United States Patent 9,283,287 (MODIFIED POLYNUCLEOTIDES FOR THE PRODUCTION OF NUCLEAR PROTEINS) - sequence listing, part 9

SEQ ID NO: 14861 - DNA, 1404 bp, Artificial Sequence
  Description of Artificial Sequence: Synthetic coding sequence
atgcgaacctatgtctgtcacatttgtagcatagcctttacatcccttgatatgtttcggtctcacatgcagggcagtgaacaccaaattaaggagtctattgtaatcaacctggtcaaaaacagccgcaagacgcaggattcgtatcagaacgagtgcgctgactatattaacgttcagaaagcacgcggactggaggccaaaacatgtttccgtaagatggaggagtcatccttggagacaaggaggtatagagaagtggttgactcccggccgagacaccggatgtttgaacagcgattgcctttcgaaaccttccgcacctacgccgccccctataatatttcacaagcaatggagaagcagttgccacactccaagaagacttacgacagcttccaagacgaactcgaggattacattaaagttcagaaggctcgtggtcttgacccaaagacttgcttccgcaaaatgagagagaactccgtcgatacacatggctaccgagagatggtggacagcggcccaagaagccggatgtgcgaacagcggtttagccacgaggcaagtcaaacctatcagagaccttaccatatttcccccgtggagtctcagcttccacaatggttgcccacacactctaagcgtacatacgactcattccaggacgagctagaagactacattaaggtgcagaaggctagagggcttgaacctaagacctgcttccgcaaaatcggcgactcaagtgtggagacacatagaaatagggaaatggtggacgttagacctcgccatcgaatgctggagcagaagttaccatgcgaaaccttccagacctatagcggcccctactctatctcacaggtggtggagaaccagctgccccactgcttacccgcccatgattcgaagcagcgactggatagtatttcctactgtcagctgacccgcgactgctttcctgaaaaacctgttcctttaagccttaatcagcaagagaacaactccggatcttatagtgttgagtccgaggtttataagcacctctctagtgagaacaatacagcagatcatcaggccggtcacaaacaaaaacaccagaagagaaaaaggcatttggaagagggcaaagaacgacctgagaaagaacaaagtaaacataagaggaagaaaagctatgaagataccgatttagataaggataagtctatcagacagcgtaagagagaagaggatagagtgaaagtatcttccggcaagttgaaacaccgaaaaaaaaaaaagagtcacgatgttccatccgaaaaagaagagagaaaacacaggaaggaaaagaaaaagtcggtggaagagcgtactgaggaggagatgctctgggatgaaagcatcttgggtttctag

SEQ ID NO: 14862 - DNA, 1917 bp, Artificial Sequence
  Description of Artificial Sequence: Synthetic coding sequence
atggagagctgctccgttacaagactggagtgcagtggggccatatctgctcattgctcactccacctgcccggtagctcagacagtcccgcatccgcttcccagatcgccgggaccactgacgctatatggaatgaacaggaaaaggcagagctttttaccgacaaattttgtcaggtctgcggcgtgatgctgcaatttgagtctcagaggattagccactatgaaggcgagaaacacgcgcagaacgtgagcttctacttccagatgcacggcgaacagaatgaggtacctggaaaaaaaatgaaaatgcatgtggagaacttccaggtgcataggtatgagggggtggacaagaataagttttgtgatctctgtaatatgatgttctcttcacctctgattgcacaatcacactacgtgggaaaggtgcatgctaagaagctgaaacagctgatggaggagcacgaccaggcgagccctagtggcttccagccagaaatggcttttagtatgagaacttatgtctgccacatttgcagtattgctttcacatctttggacatgtttcgctcccacatgcaagggagcgaacaccaaattaaagagagcattgtgattaatctagttaaaaactctcgtaaaacacaagattcataccaaaacgagtgtgctgactacatcaacgtacagaaggctagagggttggaagctaagacatgtttccggaagatggaggagtcctcgctggagacccgccgatatcgcgaggtggtggattcccggccaaggcatcgaatgttcgagcagagattgcccttcgagactttcaggacttacgccgcgccttacaatattagccaggcaatggaaaagcagctgcctcacagcaaaaagacatacgattccttccaggacgagcttgaagattacatcaaagtgcaaaaagctcgcgggctggatccaaagacctgctttcggaagatgcgtgaaaatagtgttgatacacatggatatagagaaatggtggatagtggacctcggagcaggatgtgcgaacagcggttttcccacgaggcctctcagacttaccagcggccctaccatatcagcccagtggagtcacagttaccccagtggcttccgacccacagtaaacgcacctatgactcattccaagacgagttggaagattacataaaagtgcagaaggctcggggtctcgaaccgaaaacctgctttcggaaaatcggagatagtagcgtggaaacgcataggaacagggaaatggtcgacgtcagaccacgtcaccgcatgcttgagcaaaaacttccttgtgagacctttcagacctactccggaccttactcgatttcccaggtggtggagaaccagctgccacattgcctcccagcacatgatagtaagcagaggctcgacagcatttcttactgccaactgacacgagactgttttcccgaaaaaccggttccactgtcattaaaccagcaagagaacaacagtggttcctattctgtggaaagcgaggtgtacaagcatctatcgagcgaaaacaatactgccgaccatcaggccggacacaagcaaaaacatcagaagcggaaacgtcacctagaagaggggaaggagagacccgaaaaggaacaatcaaagcacaaacggaagaagagctacgaggacacggacctcgataaggacaagagcatcagacagaggaaacgggaggaggacagggtgaaggtttcctccggcaaactgaagcatcggaagaagaaaaagagtcatgacgtgccgtccgagaaggaagagagaaagcatcgaaaagagaagaaaaaatctgttgaagagcggaccgaagaggagatgctgtgggacgagtctatcttgggcttctag

SEQ ID NO: 14863 - DNA, 600 bp, Artificial Sequence
  Description of Artificial Sequence: Synthetic coding sequence
atggccagcggttcgggtacaaagaacttagacttccgcaggaagtgggacaaggacgagtatgaaaaactcgccgaaaagcgtcttactgaggagcgcgagaagaaggatggaaaacccgtccaaccggtgaagcgagagttactgcggcatcgcgactacaaggttgaccttgagtccaagctggggaagactatagttattacaaagactactccacagagtgagatggggggctactactgcaatgtgtgtgattgcgtggtgaaagacagcatcaatttcctggaccacatcaacggaaaaaaacaccagaggaatttagggatgtctatgcgcgtggagcgcagcaccctggaccaggtgaaaaaacggtttgaagtcaataagaagaaaatggaggagaagcagaaggattatgattttgaagagcgaatgaaggagttgagggaggaggaggaaaaagctaaggcttacaaaaaagaaaagcagaaggagaagaaaagaagagccgaagaagacctgactttcgaggaagacgacgaaatggctgcagtgatgggattctccggcttcggttcaacaaagaagtcctactag

SEQ ID NO: 14864 - DNA, 870 bp, Artificial Sequence
  Description of Artificial Sequence: Synthetic coding sequence
atgatcctgcttcaacacgcagtgctcccaccaccaaaacagccatcccccagcccgcccatgtcagttgccacccgttccactggaacactccaactaccacctcagaaaccctttggacaggaggccagccttcctcttgcaggtgaagaggagctttccaaagggggagaacaagattgcgccttagaagagctctgcaaaccactctactgcaaactgtgcaacgtgacactaaactctgctcaacaggcacaggcgcactatcagggcaagaaccatgggaagaagctaagaaattattatgcagccaacagttgtccgccccccgcccgcatgtccaatgttgtggagcccgcggcgacaccagtagtgcctgtacctccacagatgggctctttcaagccgggaggacgagttatcctggctactgagaatgattactgtaagctttgtgacgcatccttcagcagccccgccgtggctcaggctcattatcaggggaaaaatcacgcgaaaaggttgcgtttggccgaagcacagtcaaactcattcagcgagtcgtctgaactgggacagcgccgtgcccgcaaagaggggaatgaatttaagatgatgccaaatcgtaggaacatgtacaccgtccagaacaatagcgcgggaccttattttaacccccgcagccgacagaggattccccgggaccttgccatgtgcgtgactcctagcggccaattctattgttccatgtgtaacgtgggggctggcgaggaaatggaatttcgccagcacctggagagtaagcagcacaagtccaaggtgtcagaacagaggtacaggaatgaaatggaaaacctcggttatgtttag

SEQ ID NO: 14865 - DNA, 447 bp, Artificial Sequence
  Description of Artificial Sequence: Synthetic coding sequence
atgattctcctacagcatgcagtgctcccaccgcccaaacagccaagtccaagcccccccatgtcagtggccactcgctcgactggcaccctgcagttacccccccagaaaccgttcggacaagaggcaagtctccctcttgctggtgaggaggaattgtctaagggaggggagcaggactgtgcactggaggagctctgcaagcctctatactgcaaactttgtaatgtgaccctgaattccgcccagcaggcccaagcccactaccaggggaaaaatcatgggaagaagcttagaaactactatgctgcgaatagttgccctccacccgctcgtatgtccaacgtggtggagcctgcggccaccccggtggttccagtgccacctcaaatgggctccttcaagccaggcgggagggtgatcttggccaccgaaaatgactactag

SEQ ID NO: 14866 - DNA, 867 bp, Artificial Sequence
  Description of Artificial Sequence: Synthetic coding sequence
atgatactcctgcagcatgcagttctccctccaccgaaacagcctagcccgtcaccacctatgtctgtagctacccgcagcactggtaccctgcagctgcccccgcagaaacctttcggtcaagaagcctcactgcctctggccggcgaggaggaattatcaaaaggaggcgagcaggattgcgcccttgaggagctctgcaaacccctctattgcaagctgtgcaatgttaccctgaactcagctcagcaggcacaggcgcactaccagggcaagaaccatggcaaaaaattgaggaattattacgcagccaacagctgtcctcctcctgcaaggatgtccaacgtggtggaaccagctgccaccccagtggtacctgtaccaccacaaatgggaagtttcaagcccggcggacgtgtgattctcgccaccgagaatgattactgtaaattgtgtgacgcttccttctcttcccctgccgtagcacaggcccactaccaaggaaagaaccacgccaaacggctgcgattggctgaagctcagagtaattctttttcagagagttccgagctgggtcagcggcgggcaagaaaggagggaaacgagtttaagatgatgccaaataggcggaatatgtatactgtacagaacaactctgggccttatttcaatccaaggtccagacagagaatcccacgagacctggccatgtgcgtaacccccagtggtcagttttattgtagcatgtgcaacgtcggagccggggaggagatggagttccggcagcacctggaaagcaagcagcacaaatctaaagtaagtgagcagagataccgaaacgaaatggaaaacctggggtacgtgtag

SEQ ID NO: 14867 - DNA, 690 bp, Artificial Sequence
  Description of Artificial Sequence: Synthetic coding sequence
atgaagagcagcgatatcgaccaggacctatttacagatagctactgcaaagtgtgcagtgctcagttgattagtgagtcacagcgagttgcccattatgaatctcggaagcacgcctcgaaggtgcgactgtactacatgctgcatccacgcgatggaggctgtccagcgaagagactgcgatctgaaaacggatccgacgcagatatggtggacaaaaataagtgctgtaccttgtgtaacatgtcttttacatctgctgtagtggctgacagtcattaccagggtaagatccacgccaagcgcctgaaactacttttgggggagaagacaccgttgaagactaccgccacaccactgagccctttgaaacctcctcgcatggatactgccccagttgtcgcatccccataccagaggagggatagtgacaggtactgtggactgtgcgccgcctggtttaataaccccttgatggcccagcagcattacgatggaaagaaacataaaaagaatgctgcacgcgtcgcactcctggaacagctgggcaccacgttggacatgggcgaactcaggggcctacgaagaaattaccgctgcactatttgctccgtttccctcaatagcatcgagcagtaccacgcgcacttgaaaggaagcaagcaccagaccaacctgaaaaataaatag

SEQ ID NO: 14868 - DNA, 462 bp, Artificial Sequence
  Description of Artificial Sequence: Synthetic coding sequence
atgaagtcttctgacattgaccaggacttgttcaccgacagttattgcaaagtctgctcagctcagctgatatccgagagtcaaagggtggcccattacgagtcaaggaaacacgctagcaaggtccgactgtactacatgctgcacccacgcgacgggggatgcccggcaaagcgactgcggagtgaaaatggctcggacgccgatatggtggacaaaaacaagtgctgcacactgtgcaatatgagctttacctccgccgttgtggctgattctcactaccaaggcaaaatccacgcaaagaggctcaagcttctgcttggtgaaaaaacccccctcaagacaaccggcctgcgtcgcaattaccgatgcaccatctgctctgtttctctcaattcaattgagcaatatcacgcccatttaaaggggtctaagcatcagaccaatttaaaaaataagtag

SEQ ID NO: 14869 - DNA, 636 bp, Artificial Sequence
  Description of Artificial Sequence: Synthetic coding sequence
atgaagtcctctgacatcgaccaggatttattcaccgattcttattgcaaagtctgttctgctcaactgatcagtgagtcccagcgtgttgcccactatgaatctcgcaaacatgctagcaaggttcgactgtattacatgctgcaccccagggatggagggtgtcccgccaagcggcttcggagcgaaaatggcagcgacgctgatatggtggataaaaataagtgttgcactctctgcaatatgtccttcacctctgctgtcgtcgctgattctcactatcaggggaaaatccacgcaaagagacttaaattattactgggggagaagacgccccttaagactacagccacaccacttagccctctcaagcccccccggatggataccgccccggtagtcgcatcaccctaccagagaagagacagcgataggtattgcggcctctgtgcagcctggtttaacaaccctcttatggcccaacaacattacgatggaaagaagcacaagaaaaacgccgcacgagtggccctgctggagcagcttgggacaacccttgatatgggagagctgcgaggcctccgaagaaactatcggtgcactatctgcagcgtgtccctgaactcgatcgagtag

SEQ ID NO: 14870 - DNA, 2685 bp, Artificial Sequence
  Description of Artificial Sequence: Synthetic coding sequence
atgaacagcatgaatccaatgaagcctgccctcccaccagcaccccatggtgatggctcatttgcatatgaatcagtgccatggcaacagtcagctacccagccggctggctcactatccgtcgtgaccaccgtgtggggcgtgggcaacgcaacccaatcacaggtgctggggaatcccatgggcccagcaggttccccttctggttcttccatgatgccgggtgttgccgggggaagttcagccctcacctccccccaatgcctcgggcaacaagctttcgcggagggaggggctaacaagggctatgttcagcagggagtttattctcgtggcggttatcccggagcaccaggattcaccacaggctatgccgggggcccaggaggtctcggtctgccctctcacgccgctaggccctctactgacttcactcaagccgctgccgctgccgccgtggccgccgccgccgccaccgccacggcaaccgcaactgccaccgtggctgccctacaggaaaagcagtcccaggaactatctcagtacggagcaatgggggcaggacaatcctttaacagtcagttcctccagcatggaggaccaagagggccatctgtgccggccggaatgaatcccacgggtattggcggagtcatgggtccaagcgggctatctcccctggcaatgaatccaactcgagccgccggaatgacccctctttatgctgggcagcggcttccccagcacgggtaccccggacccccgcaagcgcagcccttgccacggcagggggtgaagcgtacttacagcgaagtgtaccccgggcagcagtacctgcagggggggcagtacgcaccgagtactgcccagtttgccccctctccagggcaacctcctgcccctagtcctagctatccgggacataggttgcctctccagcaagggatgacacaatcactgagcgtgcctggaccaacaggacttcactacaagccaaccaggtctatccccggatacccatctagtccattgcctggcaaccctacccctccaatgaccccgagcagtagcgtgccttacatgtctcccaaccaggaagttaagtcaccgttcttaccagacctcaaacccaacctgaatagcctccactctagcccttcagggagtggcccctgcgacgagctccgcctcacctttccagtccgggatggcgtcgtccttgaaccattcagactgcagcacaacctagctgtgtccaaccacgtgttccagttaagagacagcgtgtacaagacactgattatgcggcccgacctggagttgcagttcaagtgctatcaccacgaggaccgccagatgaacacaaattggccagcttctgtccaggtgtcagtcaacgctacacccctcactattgagaggggagacaacaagacgagccacaagcccctataccttaaacatgtgtgtcaacctggaagaaacaccatccaaatcacagttacggcttgctgttgtagccacctgtttgtactgcagctcgtgcaccggccctccgtacggtcagtcctccagggcttgttaaagaaacggctgctccccgcggaacattgtattacgaaaattaagcgcaacttttcttcaggaaccatcccaggtacccctggcccaaatggggaagatggtgtcgagcagaccgcaattaaggtgtcgctgaaatgtcccattacattccgtagaattcagttgcctgctcgcggccacgattgccggcacattcagtgcttcgatctggagtcatatctgcagcttaattgtgaacggggaacatggcgctgtcctgtttgtaacaagacagcacttcttgagggactggaagtggaccaatacatgctaggtattttgatatacatccagaacagcgattatgaggaaatcactatagatcctacatgttcttggaaacctgtgccagtgaagcctgatatgcacatcaaggaggagccggacggaccagccctgaagagatgtcgcacagttagccctgcacatgttctcatgccaagcgtaatggagatgattgctgccctcgggcccggcgccgccccttttgctccgcttcagccccctagcgtccctgctccttcagactacccgggccagggatcctccttcctgggtccaggaacctttcctgagtcctttccacccactacaccaagtacccccacattggccgagtttactccggggcccccccctatctcctatcagtcggacatccccagcagtctcctcacatcagaaaagtcaacggcgtgcttgccctcacagatggctccagctgggcatctagatcccacacataaccctggcactccggggctgcacacttccaatttaggcgcccctccaggcccacagttacaccactctaacccccctcctgccagcaggcagtccctagggcaggcaagcctgggtcctacaggtgagctcgcgtttagcccggccactggggtcatggggccaccgagcatgtccggagctggcgaggctccggaaccagctctggacctccttcctgaattgactaatcccgacgaacttctatcttatttggggccacctgacctgcccacaaacaacaacgatgacttgctgagtctgtttgaaaacaactag

SEQ ID NO: 14871 - DNA, 2763 bp, Artificial Sequence
  Description of Artificial Sequence: Synthetic coding sequence
atgaatagtatgaacccaatgaagcctgcgcttccacccgcaccacatggggatggaagcttcgcctacgaaagcgttccatggcaacagtcggccacgcagcctgctggcagtttgagtgtcgtgaccacagtgtggggagtggggaatgctacccaaagtcaggtcttaggcaatcctatgggcccagccggcagcccatccgggtcttctatgatgcctggtgtggccggtggcagttctgcattgaccagcccccaatgtctcggacagcaagctttcgctgaaggaggagccaataaaggttatgtgcagcagggggtgtactcacgagggggctacccaggtgctcctggcttcaccacgggttatgccgggggccctgggggtctggggctccccagccatgccgccaggccgtctacggactttacccaggccgctgcagcagccgcggtggccgcagccgccgcgaccgctacggcaaccgccaccgctacggtcgcagccctgcaggagaaacagagtcaagagctatctcagtacggcgcaatgggcgctggccagagcttcaactcacaatttttgcaacatggcggtccacggggcccctcggtccccgctggaatgaacccgaccggcattggcggggtgatgggtccctcaggcctgtctccgctcgcaatgaatcctactcgagcagccgggatgaccccgctctacgccggtcaaaggttgccacaacacggctaccccgggcccccacaagcccagcccttgccccgtcagggtgtgaaaagaacatattccgaagtgtatcctggccagcagtaccttcagggcggccagtatgcccctagcacagcacagttcgcacccagcccggggcaacccccagccccctcccccagctaccctggccacaggttacccctgcagcagggcatgactcaaagcttgtccgtgccagggcccaccgggctccattataaacctactgaacagtttaacggtcagggagccagctttaacggcggcagcgttagttactcacagcctgggcttagcggtcccacaaggagcattcccggatacccttcatccccactgccaggtaaccctaccccacccatgactccctctagctccgtgccctatatgtcgccaaaccaagaggttaagtccccctttctgcccgatctgaaacccaacctgaactctcttcactcttctccatctggtagcggtccatgtgacgagctgcgcctgaccttcccggttcgggacggagtggtcttagaaccgtttcgactgcaacacaatctcgccgtatccaatcatgttttccagctgcgcgactctgtgtataagacattgattatgaggccagacctagagttacagttcaagtgctatcatcacgaggatcggcagatgaataccaactggcccgctagcgtgcaggtaagtgtgaatgctaccccactaaccatagagcgcggggacaacaagacctcacataagccattgtacctgaagcacgtctgccagccaggccgcaatacgattcaaattactgtgacagcctgttgttgctcacatctcttcgtcctccagttagtacaccgaccgtcggtgcggtctgtactccagggcttgctgaagaagcgtcttttgccggccgagcactgcatcactaaaattaaaaggaatttctcatccgggactatcccggggacaccaggtccgaatggcgaggatggagtggaacaaacagcaataaaagtttctttgaagtgcccaattacctttcggcggatccaactcccggcgagaggacatgattgtaggcacatccagtgtttcgacctggaaagttacctgcagctgaattgcgagaggggcacctggagatgtcctgtctgcaacaaaacagcactactggagggcctggaggtcgaccagtatatgctgggcattttgatttacatccagaacagtgactacgaagagattactatcgatcctacatgtagctggaaaccagtaccagttaagcctgatatgcacattaaggaggaacctgatggccctgcgctcaagcggtgtcgaacagtttcccccgctcacgtgctgatgccttccgttatggagatgattgcagcacttggtccgggggcagcccctttcgcccccctgcagccacctagcgtccccgccccttccgattaccctggtcagggctcctcctttctgggccccggcacttttccagagtcatttccacctaccacacctagtacacctaccctcgctgaattcacgcccggtcctccccccataagctatcaaagcgacattccaagcagcctgcttacttccgagaagtccacggcttgcctgccctcacagatggcgcctgctggccaccttgatcctacccataatcccgggacacccggcctacacactagcaacctcggtgctccccctgggccgcagcttcaccactcaaacccccctccagcatccaggcagtcccttggccaggctagcctggggcccacgggggagctcgccttttccccagcaacaggggttatgggtcccccgtctatgagtggagccggggaagctcccgagcccgctctcgatcttctacctgagctgaccaatccagatgaattattgtcttatcttggaccacctgacctccctaccaataacaacgacgacctgctgtctctatttgagaataactag

SEQ ID NO: 14872 - DNA, 2772 bp, Artificial Sequence
  Description of Artificial Sequence: Synthetic coding sequence
atgaacagcatgaaccccatgaagccagctctcccccccgcaccgcatggggatgggagtttcgcttatgagtccgtaccctggcagcagtccgcgacccagcccgccggttctctgtcagtggtcacaacagtctggggagtaggaaacgctacacagtcccaggtactcggcaaccctatgggtcctgccggtagccctagcggatcttctatgatgcccggagttgctggcggctcatcagcactcacctcaccccagtgtctggggcagcaagccttcgccgaaggcggggccaataaagggtacgtgcagcaaggagtgtacagccgcggagggtaccctggggcccctggctttaccactggatacgccggcggaccaggtggcttaggtctgcccagtcatgccgctcgcccttcgaccgattttactcaggccgcagcggccgccgccgtggctgcggctgccgctacagccacagctaccgccacggcaactgtggcggcgctgcaggaaaaacagagccaggagctgagtcagtacggcgccatgggagctggtcagtcctttaacagccaattcctgcagcacggcggacctcgcgggccaagcgtgccagccggcatgaaccctacaggcattgggggcgttatgggacctagtgggctctcgcccctagccatgaatcctaccagggctgcgggtatgactcccctgtatgctggccagaggctgccacagcatggctaccctgggccgccccaggcccagcccctcccgaggcagggcgtgaagagaacatacagtgaagtttaccctggacaacaatacctgcagggcgggcagtacgcccccagtactgcccagtttgcaccatctcctggacagccccccgctccttcgccctcataccctggccatcgattgcctctgcagcagggcatgacacagtctctctctgttcccgggccaaccggattgcactacaaacccactgaacaattcaacggccagggcgcctccttcaatgggggttcagtttcttatagccagccaggcctctccggacctacaagatccattcctgggtacccatccagccctctgcctggcaaccccaccccacctatgacaccttcgagtagtgtcccatacatgtcccccaaccaggaagtgaagagcccgtttctgcctgatctcaaacccaacctcaacagtctgcacagctcgcccagtgggtctggcccctgtgatgagctgcggctcacttttccagtccgggacggtgtcgtgttagagccttttcgactgcagcataacctcgcagtgagcaatcatgtatttcaactgcgggactccgtttacaaaacccttatcatgagacccgaccttgagttgcagtttaagtgctatcatcacgaggaccgccagatgaatacaaactggcctgcttccgtgcaagtcagcgtaaatgcgactcccctgaccattgaaaggggggataataaaacctcccacaaaccgctgtatcttaagcatgtgtgtgccagacctcagcaccatccttcgccctctccacccgcagcggcctgtgtgtcctgctcgcatctgttcgttcttcaattggtacatcgcccctcggttagatcggtacttcaaggcctcctgaagaagagattgttaccagcagagcactgtataaccaaaattaagcgcaatttttctagcgggacgattccgggcaccccaggtccgaacggggaggatggggtagaacagaccgctatcaaagtaagcttgaaatgtccaattacttttcggaggattcagttacctgcgcgaggccacgattgccggcatatccaatgcttcgacctcgagagttacctgcagttgaattgtgagcgcgggacctggagatgccctgtatgtaacaagacggctctactcgagggattggaggtggaccaatacatgctgggaatcctcatttacattcagaactcagactatgaggagattacaatcgatccaacatgtagctggaagcctgtaccagttaaaccggacatgcatattaaagaggaaccggacggcccagccctgaagagatgccgtactgtgagccccgcccatgtgctgatgccctctgtcatggaaatgatcgcggcactgggcccaggagccgcccctttcgcgccgctccagcccccctccgtccctgcaccttcagactaccccggtcaggggagttcatttttaggcccagggacattccccgaaagctttccacccactacaccttccactcccactcttgccgaattcacacccggcccccctccaatcagctatcagtccgacattccgagctcattattaacatcagaaaagagcactgcatgccttcctagccagatggctcccgctgggcacctcgaccccacccataacccggggacgcctggactgcacacaagcaacctgggggcccccccgggaccccagctccatcatagcaacccaccccccgcaagtcgccagtcacttgggcaggctagcctggggccaactggcgagcttgcctttagccccgctacaggtgtcatgggtcctccatccatgagcggggcgggggaggcaccggagcccgcccttgatcttcttcctgagctgacaaaccctgacgagcttctatcctacttgggacctccggacctgcccactaacaataatgacgatctgctgagcctctttgagaataactag

SEQ ID NO: 14873 - DNA, 2763 bp, Artificial Sequence
  Description of Artificial Sequence: Synthetic coding sequence
atgaactccatgaatcctatgaaacccgcccttcctcccgccccacatggagacgggtcttttgcttatgagtccgttccctggcagcagtctgcgacacagccggctggctcccttagtgtggtcactaccgtgtggggagtcggtaacgctacacagagccaagtgctcggaaaccccatggggcccgcgggctccccatccggctcctcgatgatgccaggagtcgccggaggttcatccgcattgacatcgcctcagtgcttgggccagcaggcattcgcagaagggggagcaaacaagggctacgtgcagcagggggtctattctagaggtgggtaccctggggcgcctggatttacaactggatatgccggcggtcctggaggcttgggcttgcccagccatgccgctaggccctctacagactttacccaagccgccgctgcggccgcagttgccgccgccgccgccaccgcaaccgcgacagccaccgccacagtagccgctcttcaggaaaaacagtcccaggaactgtctcagtacggcgcgatgggcgcaggtcagagcttcaactcacagttcctccagcatggagggcctcgtggccccagcgttcccgctggaatgaacccaactggaattggaggtgtcatgggcccctctggcctgtcgcccctggccatgaatccgacgcgcgccgcagggatgacaccactatatgccggccagagactccctcagcacgggtatcccggtcccccacaggctcagccgttacctcgacaaggggtcaagcgaacctacagtgaggtttacccagggcaacagtacttgcagggcggacagtatgcgccctcaaccgctcaattcgccccttcacccgggcagccaccggcaccgtccccctcctaccctgggcaccgcttgccacttcaacaagggatgactcaaagtctcagcgtgcctggtccaactggcctgcattacaaacctacagaacagttcaacggccaaggggccagcttcaacggcggatccgtgtcttattcccagcccggcctctcaggccctaccaggtcaattccgggatatccttcatctccattgcccggaaatcccacgcctcctatgacaccaagctcctccgtgccatacatgtctcctaaccaggaagtgaagtcccctttcctgcctgatctgaagccaaacctcaattccctccattcttctcccagcggaagcgggccatgtgatgagttaaggctgacttttcctgttcgtgacggcgtcgttcttgagcccttcagactgcagcacaaccttgctgtttcaaatcatgtgtttcagctgcgggacagcgtttataagaccctgattatgagaccagatctcgagctgcagttcaaatgttaccatcacgaggatagacagatgaacacgaattggccagctagcgtgcaagtgtccgttaacgctacaccactgaccatcgagcgtggcgacaataagacaagtcacaagccactctatctcaaacacgtgtgtcagccaggcaggaacaccattcagatcacagtcactgcatgctgctgtagccacctctttgtgctgcagctcgtgcaccggccgagcgtgcgaagtgtactgcagggcctgctgaaaaagcggttgctgcccgctgaacactgcattactaagatcaaaagaaacttttccagcggaaccattccaggaactccggggcctaatggagaggacggtgtcgagcagaccgcaattaaagtaagcctgaagtgcccgattactttcaggcgaatacagctccccgctcgggggcatgattgcagacatattcaatgttttgacttggaaagttacctgcagctgaactgcgaacggggtacttggcgctgtcccgtttgcaacaagactgcactcctggaaggccttgaagtggaccagtacatgctgggtatcctgatttatatccaaaacagcgactatgaagagattacgatcgatcctacgtgcagttggaagccggtgcctgtaaagcccgatatgcatatcaaggaagaacccgatggtccagctctgaagagatgcagaacagtaagcccggctcacgttttgatgcctagcgtcatggaaatgatcgccgccctgggccccggggctgcacccttcgctcctctccagccaccatcagtgccagctccttccgattaccctggacagggctcttcattcctcggccccggaacattccctgaatctttcccccctacaacaccatccacacctactctcgctgagttcaccccaggaccaccgcccatctcttaccagtcggatataccaagctcactgctgacctctgagaagagtacagcatgtcttcccagccaaatggcgcccgccggtcatcttgatccaactcacaaccccggcacccctgggctccatacctccaaccttggcgcccctcccgggcctcagttacaccattccaatcctccaccggccagtaggcagtctcttgggcaagcctcattagggcccacaggggagctcgctttttcccctgctaccggggtcatgggtccaccctccatgtccggcgctggggaggcaccagagcctgctctcgatctgctgcctgagctcaccaacccagacgagttgctcagctaccttggaccccccgatttgcctacaaataacaacgatgacctgttgagtctattcgagaataactag

SEQ ID NO: 14874 - DNA, 273 bp, Artificial Sequence
  Description of Artificial Sequence: Synthetic coding sequence
atgaactccatgaatccaatgaagcctgcacttcctcctgccccccacggcgacggctcattcgcctacgagtctgtgccctggcagcagtctgcaacccagccggcgggaagcctttcagtggtgactactgtgtggggcgtgggtaacgcaacccagagtcaggttctcggcaatcccatgggccccgcaggcagtccttctgggtcctcaatgatgcccggcgtggccggaggatccagcgcgctgaccagcccacagtgcctggggtag

SEQ ID NO: 14875 - DNA, 3429 bp, Artificial Sequence
  Description of Artificial Sequence: Synthetic coding sequence
atgaaagaacctctcctgggaggagagtgtgacaaagcagtggcgtcccagctgggactcctagacgaaatcaaaaccgagccagataatgcccaggagtactgccacagacagcaatcaagaacgcaagaaaatgagcttaagatcaatgcagtgttttcggagtcagctagccaattaactgcaggcattcagctctctctggccagctcgggcgtcaacaaaatgcttccctcggtgtcaaccaccgcaattcaagtctcctgcgcaggctgcaagaagatcctgcaaaaagggcagactgcttatcagcgaaagggttccgctcagttgttttgttctattccctgtatcacagagtacatctcctcggcatccagccctgtgccatcgaaacgaacatgctccaactgctctaaagatatcttaaaccccaaggatgtcatttccgtgcagctagaggatactactagctgcaagacattctgctccctctcttgcctcagctcttatgaagagaagaggaaaccttttgttactatttgcactaactccattttgaccaagtgctctatgtgccagaaaaccgcaataattcagtacgaggtgaaataccaaaatgttaagcacaatttatgtagtaatgcatgcttgtccaagttccacagcgctaataatttcatcatgaactgctgtgagaactgcggaacttactgttataccagttcctccctaagtcatatactgcagatggagggtcagagtcattattttaactcgagcaagagtataaccgcatataagcaaaagcctgcaaaacccctaatctctgtcccctgcaagcccctgaaacccagcgacgaaatgatcgagacaactagcgacctgggcaagaccgaactgttctgttctattaattgcttttccgcttactccaaggccaaaatggagtcatcctccgtcagtgtggtgtccgtggtgcacgacacctccacagagctcctctcccccaaaaaagacaccactccagtcataagcaacatcgtgtcactggccgacactgacgtggccctgcctatcatgaataccgacgtcttgcaggatacagtgtccagtgtgacagcgaccgctgacgttatcgtggacttgtctaagtcctctccctcagagccctcaaacgccgttgcttcttcgagcacagagcagccttccgtgagcccatcgtcttcagtcttttctcagcatgcaattggatccagtacagaagtgcagaaggataatatgaaatcaatgaaaataagcgatgagctgtgtcatcccaaatgcacatcgaaggttcaaaaagtgaagggtaagtcgcgctctatcaagaaatcatgttgcgcagatttcgaatgtctggagaacagtaagaaagacgtggctttttgttacagctgtcagttgttctgccaaaaatatttttcctgcggcagagagagtttcgcaacgcacggaacctcaaattggaaaaaaactctggaaaaattccggaaacacgaaaaatcagagatgcatttaaaatccctcgaattctggcgagagtaccagttttgcgatggtgcggtgtccgacgatttatccatccattccaagcagatcgagggtaacaaaaagtatctgaagctgatcatcgagaacatccttttcctgggcaagcaatgcctgcccctaagaggcaacgaccagtctgtgtcatcagtcaataagggtaatttcctggagttattggagatgcgtgcaaaggacaaaggcgaagagactttcagactcatgaattctcaggtggacttctacaactccacacagatccagagcgacattatcgagataatcaaaacggaaatgttacaggacatagttaacgaaattaatgacagttctgcgttctctattatctgtgatgaaacaattaacagcgcaatgaaggagcagctgtcgatttgcgtgcgctatccacagaagtcctcaaaagccattctcatcaaggagagattcctcgggttcgtggatactgaagagatgacggggacacacttacatcgcaccatcaagacatacctccaacaaataggggtagacatggacaagatacacggccaggcatatgattcaactaccaatctcaagattaagttcaataagatcgctgcagaatttaagaaagaggagccacgcgcactgtatattcactgttacgcccatttcctggatctgagcatcatccggttctgcaaggaggtgaaggagctaaggtctgccctgaaaaccttgtcctctcttttcaataccatttgtatgagcggggaaatgctggctaacttcagaaatatctacaggctcagtcagaacaagacttgtaagaagcatatctcgcagtcatgctggacagtccacgaccgcactcttcttagtgtcatcgactctctgcccgagatcatcgagactctggaagtgatcgctagccacagctccaacacttcatttgcagacgagctttcccacctactgactctcgtgtctaagtttgagttcgtcttttgcctgaaattcctctacagagtcctcagcgttacaggcatcctgtccaaagaactgcagaacaagacaattgacatattttccctcagctccaagattgaggccatacttgaatgcttgagttctgaaagaaacgatgtctattttaagacaatctgggacggtactgaggagatctgccagaaaatcacctgtaagggttttaaagtggagaagcccagtctgcagaaacggagaaaaatacagaagtctgtggatcttggaaactcagataatatgtttttccccacttcgaccgaagagcaatacaagatcaatatttattaccaggggctggatacgatcctacaaaacctgaagctgtgcttcagtgaattcgattattgcaaaattaaacagattagcgaactcctgtttaaatggaacgaacccctcaacgaaacaaccgcaaagcatgttcaggagttttataagctggacgaagatatcatccccgagttgagattttacaggcactatgctaaactgaatttcgttattgacgactcctgcattaatttcgtgagcttaggctgcctcttcattcaacacggactgcactccaatattccatgcctgagtaaattgctctatattgcgctgtcatggccaattacttcagcctcaacagaaaattcattttcaacgctgcccaggctaaagacatatctgtgcaatacaatggggcaggagaaactcacgggccctgctctcatggcggtggagcaagaattggttaataagctgatggagcctgagcgcctgaatgagattgtggagaagtttattagtcaaatgaaggaaatctag

SEQ ID NO: 14876 - DNA, 3204 bp, Artificial Sequence
  Description of Artificial Sequence: Synthetic coding sequence
atgctgccctcagtgtccacaaccgctatccaggtgagctgtgcaggatgcaagaagattctgcagaagggacagacagcctatcagagaaaagggagtgcccagttgttttgttccattccctgtatcacggagtacattagcagcgccagcagtcccgtccctagtaagaggacttgttccaattgctctaaggatatactaaatccaaaagatgtgatcagcgtccagctggaagatacaacctcatgtaaaacattctgttcactttcctgtctgagcagctacgaggagaaaaggaagccctttgtaactatttgcactaactctatattaaccaaatgctccatgtgtcagaaaacggctataattcagtatgaggtaaagtatcaaaacgtgaaacataacttgtgttccaacgcttgcctatcgaagttccactctgcgaacaactttataatgaactgttgtgagaactgcgggacctactgctacacctccagctccttatctcacatcttacagatggaggggcagagccattactttaattcgtccaagagtattactgcctacaagcagaaaccagcaaaacccctcatcagcgtcccttgtaaacccttaaaacccagtgacgaaatgattgagaccacctcagatctcggcaagaccgagctcttctgcagcatcaattgtttttccgcctattctaaggctaagatggaaagtagttctgtctcagtggtctcagttgtgcacgacacatccactgagctcttatccccgaagaaagatacaaccccagtaattagcaatattgtgtcccttgccgatacggacgtggccctcccaataatgaacaccgacgtgctgcaagacacagtctcttccgtgactgccactgctgacgttatagtggacctatccaagtcgtcccctagcgagccaagtaacgccgtggcctcctcctcaaccgagcagccttctgtgtccccttcatcttccgtatttagccagcatgccataggcagcagcactgaggttcagaaagacaacatgaaatcgatgaagatctcggatgagctgtgtcatcctaagtgcacaagcaaggttcagaaggtgaagggaaagagtagatctatcaagaagtcttgttgtgctgattttgagtgtttggaaaatagtaagaaggacgtggcattttgctacagttgccagctattttgccagaagtacttttcatgcgggcgggagtctttcgctacccatggaacgtccaactggaagaaaaccctggagaaatttcgaaaacacgagaaaagcgaaatgcacttaaagtcattagaattctggagagagtatcagttttgcgatggggcagtgagtgacgatttgagcatccatagcaaacaaatagaaggcaacaaaaaatatctgaaacttattattgaaaacattctgtttcttggcaagcagtgtttgccccttcgcgggaatgatcaatccgtctccagcgtgaacaaggggaattttctggaactactggagatgagagctaaggacaaaggggaggagacatttaggttaatgaatagtcaggtggacttttataattctacacagatacagtccgacatcattgagatcataaagaccgaaatgcttcaggacatcgtgaatgagatcaacgatagttctgctttttccatcatctgcgacgaaacaataaacagtgcaatgaaggagcagttgagcatctgcgtgagatacccccagaagtctagtaaagcaatcctcatcaaggaacggtttctaggctttgttgataccgaggaaatgactggtacacaccttcaccgcaccattaaaacatacttgcaacagattggcgtggatatggataagatacacggtcaggcctacgacagtaccacgaacctgaagattaagtttaataaaatcgctgcagagttcaaaaaggaggagcctagggccctttacatacactgttacgctcactttctggatctgtccataattaggttctgcaaagaagttaaggaactcagaagcgccctaaagacgctgagctcactttttaacactatctgtatgagcggcgaaatgctggctaacttcaggaacatttaccgactcagtcaaaataaaacctgcaaaaaacacatctcacagtcctgttggactgtgcatgatcgcaccctcctcagtgtaatcgactcattaccggaaatcatcgagactttagaagttatcgcatcccactcctctaatacctcattcgcggacgaactgagtcacttgctcaccctcgtttcaaaatttgagtttgtattctgcctcaaattcctctacagggtgctgtcagtgacaggaatcctgtccaaagaattgcagaacaaaactattgacattttcagtctgtccagcaagattgaggccatcctggaatgtcttagcagcgagcggaacgacgtttattttaagacgatctgggacggaaccgaggagatctgccagaagattacttgcaagggattcaaagtagaaaaaccatctctgcagaagcggcgcaagattcagaagagtgtggatctcgggaactccgacaacatgttctttccaactagcacggaagaacagtacaagattaacatctattaccaaggtctggataccatcctgcagaatctgaaactctgtttttccgagtttgattactgcaagattaagcaaattagcgagctgctgtttaagtggaatgagccccttaatgagacaactgcaaaacacgttcaagagttctacaaactcgacgaggatatcatccctgagctgcggttttacaggcattacgccaagctcaattttgtgatcgatgacagctgtattaacttcgtttcccttggctgtctgttcattcaacatggtctgcactcgaatatcccctgtctttctaaactactttatatcgctctgagttggcctatcacctctgcttcaaccgagaactcgttctccacattaccacggctcaagacctacttgtgcaacaccatgggccaggagaagctcaccggtcccgcacttatggccgtggaacaggagctcgttaacaaactgatggagcccgaaaggcttaacgagatagtggaaaagttcatttctcagatgaaggagatctag

SEQ ID NO: 14877 - DNA, 3429 bp, Artificial Sequence
  Description of Artificial Sequence: Synthetic coding sequence
atgaaagaaccccttttgggcggagaatgcgacaaagctgtcgccagtcagctgggcctgttggatgagatcaaaaccgagcccgacaatgctcaggagtattgccacaggcaacagtccagaacacaagagaacgagctgaagatcaatgcagtattcagcgagtccgcatctcagctgacagctggcattcagttgtctctagcaagtagtggtgtcaacaagatgctgccatccgtttccactacagcaatccaggtgagctgtgccggttgcaagaagatactacagaagggccagaccgcataccagagaaaaggtagcgcacaattattctgtagtatcccgtgtatcactgagtatatttcatctgcttcttctcccgtcccatccaagcgcacttgctcaaattgctccaaagacattctaaatccaaaagatgttatctcagtccagctcgaagataccacatcttgtaaaaccttctgcagcttgagctgtctgtcttcctatgaagagaagcggaaaccattcgtgacaatatgcaccaattccatcctgaccaaatgtagcatgtgccagaaaacagccatcattcaatatgaggtgaaatatcaaaatgtgaaacataatctgtgttctaatgcctgcctctctaagtttcactctgccaataactttatcatgaactgttgtgagaattgtggcacatactgttatacttcctcgtctctgtcgcatatcctgcaaatggagggccagagtcactactttaatagcagcaaatctatcacagcttataagcaaaaacccgcgaagcccctcatttccgttccatgtaagccgttgaagccaagtgatgaaatgatcgaaaccacgagtgaccttggtaaaacagagttgttctgctccataaactgtttttctgcctactccaaggcaaagatggaaagttcatcggtgagtgtggtgtctgttgtgcacgatacatcgaccgaactcttaagccccaagaaggacaccactccagttatcagtaatatcgtgtcactggcagatacagatgtcgctcttcctatcatgaataccgacgtcttacaggacaccgtaagttcggtgactgccactgctgatgtcatcgtggacttatcgaagagctctccttcagagccttctaacgcagtggcatcctcttccacagagcagccaagcgtttccccgagttcttccgtcttttctcaacacgcaataggttctagcaccgaagtccagaaggataatatgaagtcaatgaagatcagcgatgaactctgccaccctaagtgtactagcaaggtccagaaggtgaagggaaagtctagatccatcaagaaatcgtgctgcgccgactttgagtgtcttgaaaactcaaaaaaggatgtcgcattttgttacagctgtcagctcttctgccagaagtattttagctgtggtcgggaatcattcgcaacccatggcacatcgaattggaagaagaccctagaaaaatttaggaaacacgaaaaatcagagatgcatctgaaaagcttagaattttggcgcgagtaccagttttgcgacggtgccgtgtctgacgatctgtcaatccattcaaaacagatcgagggtaacaaaaaataccttaagctgataatagagaatattttgtttctaggcaaacagtgcctcccgctgcgcggcaacgatcaatctgtctcatctgtgaacaaagggaatttcctggagttgctggaaatgcgtgccaaagacaagggagaggaaaccttccgcttgatgaatagtcaggtcgacttctacaattctactcaaatccaatccgacatcatagagatcattaagactgagatgttacaggatatcgtaaacgaaataaacgacagttcagcgttcagcataatctgtgatgagaccattaacagcgctatgaaagaacaactcagtatttgtgtgaggtacccccagaaatctagtaaagccatattgataaaggaacgctttctgggattcgtggacaccgaggagatgaccggaacacatttgcatcgcaccataaaaacgtatctgcaacagatcggagtggacatggacaaaatccacggacaggcctacgatagcaccacaaacttaaagattaaattcaacaaaattgcggccgagttcaagaaagaggagcctagggctctgtatatccattgctatgcccattttctcgatctgagcatcatccgcttctgcaaggaggtcaaggagctgcggagcgcgcttaagaccctcagctctctgttcaatacaatttgcatgagtggcgagatgcttgcgaatttccgaaacatttatcggctctctcagaacaagacttgcaaaaaacacatctcacaaagttgttggactgtgcacgacagaacgcttctgtctgtgatagattcactgcctgaaatcattgaaaccctcgaggttatagcatcccacagctcaaacacatcatttgccgacgagctgtcccatctgctaaccctcgtctcaaagttcgagttcgtgttttgtctcaagttcctatatcgcgtgctctctgtgacaggtatcctctcgaaggaacttcagaacaaaactatcgacattttttcgctctcatcgaagatcgaggctatattggaatgtctctcgtctgagagaaatgatgtctacttcaaaaccatctgggacggcaccgaggaaatatgccaaaagattacgtgtaaaggtttcaaagttgagaagccttcacttcagaaacgacgcaagattcaaaaaagcgtcgacctgggaaacagcgacaacatgttttttccaacgtcaactgaggagcaatacaagatcaatatctactaccagggtctggataccattctgcagaacctcaagctctgtttctcagaatttgactattgcaagattaaacagatttcagaactcctgttcaagtggaatgagcccctgaacgaaacgaccgctaagcatgtccaggagttctacaagctggatgaggacatcatccccgaactacgtttctacaggcactacgccaaattgaactttgtcatagatgacagctgcataaactttgtatcactcggctgtctcttcatccagcacggcctgcactcaaacatcccatgtctgtctaagctgctatacatagccctgtcctggcctatcacttcagctagtaccgaaaactcattctcaactttgccccgattgaaaacatacctgtgtaatacaatgggacaagagaagctcacagggccagctctgatggctgtggagcaggagttggtgaacaaactcatggaacccgagcgcctgaatgaaatagtagagaagtttatatctcaaatgaaggaaatctag

SEQ ID NO: 14878 - DNA, 1389 bp, Artificial Sequence
  Description of Artificial Sequence: Synthetic coding sequence
atgaaggaacctctgttaggaggagaatgcgataaagccgtggcctcacaattgggattgctggacgagatcaagacggaacccgataatgcccaagagtattgtcatcgacaacagtcgaggacacaggagaacgaactaaagatcaatgcggtcttctccgaatctgcatctcagctcacagccggaatccagctctcactggcctccagcggggtcaataagatgcttccgtctgtcagcacaactgccatccaggtctcttgcgcaggctgcaaaaaaattctccagaaaggccagaccgcatatcagcgcaaaggatctgcccagttgttttgcagcatcccatgcattaccgaatacattagcagcgccagttcccccgtaccctctaaaaggacctgcagtaattgctctaaggacattctgaatccaaaggatgttatcagtgtgcagctggaagatacaacctcttgcaaaacattctgttctctgtcctgcttgtcttcctacgaggagaaaaggaagccattcgtcacaatatgcacgaactcaattttgactaaatgttcaatgtgtcagaagaccgccatcatacagtatgaagtgaagtaccagaacgtgaaacataatctttgctccaacgcttgcctgagcaagttccactccgcgaacaatttcattatgaattgctgcgagaactgtggcacttattgctataccagctcctcacttagccatatcctgcaaatggaaggacagagtcattatttcaacagcagcaaatccatcaccgcatacaagcaaaaacccgcaaagcccctgatttcagtgccatgcaagcctctgaaaccaagcgacgagatgatcgaaaccacttcagatctcgggaagacagaattgttctgtagtattaattgtttctctgcatattccaaagccaagatggagagttcgagcgtgtcggtagtgagcgtcgtgcatgataccagcacagagctgctcagcccgaaaaaggacacaacgcccgtgatcagtaatatagtgtccctggcggatactgatgtggctttgcccatcatgaatacagacgtgctccaggatactgtcagttccgtcactgctacggcagatgtcatcgtggatctctctaagagctctcctagtgaacccagcaatgctgttgcgagcagctcgaccgagcagccgtctgtgagcccttccagctcagtgttctctcaacacgccatcggcagttctaccgaagttcagaaggacaacatgaagagcatgaagataagtgatgaactctgccaccctaagtgcacctcaaaggtgcagaaagtgaagggcaagagtaggagcattaagaaatcttgttgcgcatag

SEQ ID NO: 14879 - DNA, 2010 bp, Artificial Sequence
  Description of Artificial Sequence: Synthetic coding sequence
atggaaaaatgttctgtgggagggctcgaactgacagaacagacaccagccctcctgggtaacatggcaatggccacctcgctgatggatattggtgacagtttcggacatccggcctgtccccttgtgtctagatcacgcaacagccccgttgaggacgacgatgatgatgatgatgtagtattcattgagtcaatacagcccccttctatcagtgctcccgccatcgccgaccagagaaattttattttcgctagctctaaaaacgaaaaaccacagggcaactattcagtgatccctccatcttcgcgtgacctggcatcgcaaaagggcaacatttcagagacgattgtcatagacgatgaggaggatattgaaacgaatggcggcgctgagaagaagagctcctgctttattgagtggggtctgccgggcactaagaacaaaacaaatgatcttgattttagcacctcaagtctatcccggtctaagacaaagactggggtgagacctttcaatccaggcagaatgaacgtggccggggatctgtttcaaaacggcgaattcgcaacacaccattcgcctgacagctggatctcgcaatctgcctcatttccatcaaaccaaaaacagccaggagttgattccctgtctcccgtcgcccttctacgcaaacagaactttcagccaaccgcccagcaacagcttacaaagcctgcaaagattacctgcgctaattgtaagaaaccccttcagaagggccagactgcttatcagcgtaagggcagcgctcacctgttctgttccacaacctgcttatccagcttcagccataagcggacccagaatacaaggagtataatctgcaagaaagacgccagcaccaaaaaggccaatgtgattctgccggtagagagctccaaaagctttcaggagttctattccacttcatgcctgtccccctgcgagaataattggaatctcaaaaagggcgtgtttaacaagagtcgttgcacaatctgtagtaagttagctgagattcggcatgaagtctccgtaaacaatgtaacccacaaactgtgttcaaaccactgttttaacaaatatcggctcgctaacggtctgatcatgaattgttgcgaacactgcggagagtacatgccgtctaaaagtaccggcaacaacattctggtcattggtggacagcagaagaggttctgttgtcagagctgtataaacgaatacaaacaaatgatggagactaagtccaagaaactgaccgcgtcagagaatcgtaagcgaaacgcctttcgcgaggagaacgaaaagcaattatacggcagctccaacaccctcctgaaaaagatagaaggaataccagaaaagaaggaaaaaacctctcagctgcagctctctgtggaatgtggcaccgataccttattgatccaggaaaatgtgaacctcccgcccagctctacatccaccatcgccgatacattccaggagcagctggaggagaaaaatttcgaggactccatagttcccgttgtgctgagtgcagatcctggcacttggccaaggatcctaaatatcaaacaacgtgatacattagtggagaacgtcccgcctcaggtgcggaacttcaattttcccaaggacaatacggggagaaaattctcagagacttactacactagaattctccccaacggggagaagacaaccaggtcctggctcctgtattctacatctaaggattcagtcttctgtctgtactgcaagcttttcggggaaggaaagaatcagctgaaaaatgaaaatgggtgtaaggactggcagcacttaagccacatcctgtccaaacacgaggaaagtgagatgcatgtcaacaattctgtcaaatattcaaaattaaagagcgatctgaagaagaacaaggcgattgacgccgccgaacaccggctttatgagaatgaaaagaacgacggggtgttgttactgtatacctag

SEQ ID NO: 14880 - DNA, 1149 bp, Artificial Sequence
  Description of Artificial Sequence: Synthetic coding sequence
atggagaaatgcagcgtcggaggcctggaactgacagagcaaacacccgcactcttaggaaatatggccatggccactagtctaatggatattggagactcatttggtcatcccgcctgtccactggtgagtcgcagtagaaattcccccgtggaagacgacgacgacgatgacgatgtggttttcattgagtctatccaacccccatcaatctcagcccctgccatagccgaccagcgaaattttatattcgcatcctctaagaatgagaagccccaaggtaactactctgttattccgccatcttcaagagatttagcaagccagaaggggaacatttcagaaacaatcgtgattgacgatgaggaggacatcgagacaaatgggggcgccgagaaaaaatcatcctgcttcattgagtggggtctaccagggactaagaataagactaacgacctcgatttcagcacttctagtcttagtaggtctaagacaaagactggggtacgtcccttcaatcctggtcgtatgaacgtggctggagacttgtttcagaacggagagttcgcaactcaccactccccagatagctggattagccagtctgccagcttcccctctaaccagaaacaaccaggcgtcgactccctgtccccagtcgcactgttgcggaaacagaattttcagccaaccgcacagcagcaacttaccaaacccgctaagataacttgcgcaaactgcaaaaagcctctacagaaagggcagacggcctaccagagaaaaggttccgcacatctgttttgtagcactacctgtctctccagcttctctcataagaggacccagaacaccagatcgattatctgcaaaaaggacgcctcaaccaagaaggccaatgtgatcctgcctgttgagtccagcaaatcttttcaggaattctacagcacaagctgcctgagcccatgcgagaataactggaacctcaaaaagggtgtcttcaataaatccaggtgtactatttgctctaagctggccgaggtgtggatattcattccaaagctgctttttaggcttactgtcatcattctcacatttaaatgctattacgtactgttccatctccataacgcacgagtgctcgacgtgtag

SEQ ID NO: 14881 - DNA, 627 bp, Artificial Sequence
  Description of Artificial Sequence: Synthetic coding sequence
atggagaaatgcagcgttggcggtctcgagctcactgaacagactcccgcccttctgggaaacatggcaatggcaacctctctcatggacatcggcgacagctttggacaccctgcttgccccctggttagcaggtcacggaactctccagtagaggatgacgatgacgacgacgacgtcgtgttcatcgaaagcattcagccccccagcattagcgccccagctatcgccgatcagcggaatttcatctttgcaagtagcaagaatgagaaaccacagggcaactacagtgtcatcccgccctcatctcgtgacctggccagccagaagggtaacatttctgaaaccatcgtaatcgatgatgaggaagacatagagaccaatggtggcgctgaaaaaaaaagttcttgttttatagaatgggggctgcccgggacaaagaacaagaccaacgaccttgactttagcacaagttcattaagtcgctctaagactaagactggcgttaggccgttcaaccctggcaggatgaatgtggccggggacttattccaaaacggtgagtttgccactcatcattccccagagatgcacttgcaacgccggcttatgtcattcttccaatag

SEQ ID NO: 14882 - DNA, 513 bp, Artificial Sequence
  Description of Artificial Sequence: Synthetic coding sequence
atgaaggagcccctggacggggaatgcgggaaggcagtggtcccgcaacaagagctgctcgataagattaaagaagagccggataatgcccaggaatacgggtgcgtccaacagcccaagacacaggagtctaagctcaaaattggaggggtttcatctgtgaatgaaaggcctatcgcccaacagctgaaccctggttttcagctcagtttcgctagttctggacctagtgtgttacttccttctgtgcctgcagtagctatcaaggtcttttgctctggttgcaagaagatgttgtataagggacaaaccgcctaccataaaactggtagcacgcagctgttctgttccaccaggtgcattacaaggcactcatcaccagcttgtctgcctcctccccctaaaaaaacctgtacgaactgctccaaatataagattctgaatattcccttctacttcacattctttctagtctgcatacttttcagttctaacattttgctgatactttag

SEQ ID NO: 14883 - DNA, 3978 bp, Artificial Sequence
  Description of Artificial Sequence: Synthetic coding sequence
atgaaggaaccactcgatggagaatgtggaaaggccgttgttccacagcaggagctcttggataagatcaaggaagaacctgacaatgcccaagaatacgggtgtgttcagcagcctaaaacccaagaatctaaactcaagatagggggagtgtctagtgtcaacgagcgccctattgcccagcagttgaatccgggttttcagctgagctttgctagttcaggcccctcggtccttttgccaagcgtgccagctgtggccatcaaggtcttttgcagcggatgcaagaaaatgctttacaaaggccagaccgcatatcacaagacagggtccacgcaactcttttgcagcacccgctgtattacacgtcacagtagcccagcatgcctgccaccacctccaaagaagacctgcacaaactgctccaaggatatattgaaccctaaggacgtcatcaccacccgttttgaaaatagttacccaagcaaagatttttgctcacagtcctgtctaagctcttatgaacttaagaagaaaccggtggtaaccatttacacaaaatcgatcagtacaaagtgcagtatgtgccagaagaatgcagacacccgctttgaggtgaagtaccagaacgtggtgcacggactatgctccgatgcatgcttttctaagttccatagcactaacaaccttacaatgaattgctgtgaaaactgcggttcttactgctactcctcctctggcccatgtcagagccaaaaagtgttctcatcaacatccgtcaccgcctataagcagaacagcgcccagatacctccctatgcactggggaagagtttgaggccaagcgctgagatgatcgagaccactaatgattctgggaaaacagagttattttgttccattaactgtttatcagcctacagagtgaagacagtgaccagcagtggtgtgcaggtcagttgtcactcctgtaagaccagcgctatacctcagtatcacttggctatgagcaatggtactatttacagcttttgctcttcatcatgcgttgttgcctttcagaatgtcttttctaaacctaagggcaccaactcttcagccgtgcccctcagtcagggacaggtggtggtcagtcccccatccagtaggtcggcagtgtcaatcggggggggaaataccagtgccgtgagcccttcatccataagaggcagcgcagcagctagtttacagcctctcgcggaacagtcccagcaggtggctctcacccataccgtggtgaagttgaaatgccagcactgtaaccacttattcgccacaaaacctgaactgctgttttacaaagggaaaatgttcctgttttgtgggaaaaactgctcggacgagtacaagaagaaaaataaagtcgtggcaatgtgtgactactgcaagttgcagaaaattatcaaggagaccgtcaggttttcaggagtggataaacccttctgttcagaagtgtgtaaatttctaagcgcccgcgactttggggagcggtggggaaattattgtaaaatgtgttcttactgcagccagacctccccaaatttggtggagaacagactcgaaggcaaactggaagagttctgttgcgaggactgcatgtccaaattcacagtactgttctatcaaatggcaaagtgtgatggatgtaaacggcaggggaaacttagcgaatcaattaagtggcgaggcaacataaaacacttttgcaacctgttttgcgtgctggaattctgtcatcagcagataatgaatgattgcctgccccaaaacaaggtaaacatcagcaaggccaagactgccgttaccgaactcccatcagctcggactgatactacaccagtcatcaccagcgtcatgagtctcgccaagattccagcaacattatccaccggcaatacgaattccgtgctgaaaggcgcagtgacaaaagaggccgcgaagataatccaagatgaatcgacacaagaggatgccatgaagtttccctcctcccagagttcccagccctcacgactccttaaaaataagggcatttcctgtaagcctgttactcagacaaaggctacatcctgcaagccacatactcagcataaggagtgtcagacggatctgcccatgcccaacgagaagaacgatgcagagctggacagtccaccctcaaagaaaaaaaggctgggattttttcagacctacgacaccgagtatctaaaggtggggttcattatttgtcctgggtctaaggagtcctctcccagacctcaatgtgtgatatgtggcgaaatactgagctccgaaaatatgaagccagctaatcttagtcatcacctaaaaactaagcatagtgagctagagaacaagccagtcgatttcttcgagcagaagtctctcgagatggaatgccaaaactccagcctgaaaaagtgtttgctggtggagaaaagcctggtcaaagcatcttacctgatcgctttccaaacagccgctagtaaaaagcctttttcgattgccgaagaactcattaaaccatacttagtggagatgtgttcagaagtgctggggtcctcagccggcgacaagatgaaaactatccccttatccaacgtcactatccagcacagaatcgatgaactgagcgctgatattgaagatcagctgatccaaaaagttcgcgagtccaagtggttcgcgttgcagatcgatgagagttctgaaatttcaaacatcaccttactgctgtgttacatccgtttcattgactatgactgtagggatgtcaaggaggagctattgttctgcatcgagatgcccactcagatcaccgggtttgaaattttcgaactgataaataagtacattgactctaagtccctcaactggaagcactgtgtaggcctgtgtaccgatggtgctgcctcaatgaccggcagatatagcggtcttaaagccaagattcaggaggtggctatgaatacagctgcgtttacacactgttttattcaccgggagaggctcgttgcagagaaactgtccccatgtctgcacaagattctgctccagtccgcacagattctatcatttatcaagtccaacgccttgaactccaggatgttgactatactgtgcgaggagatgggatccgagcacgtcagcctcccattgcacgctgaggttcgctggataagccgcggccgtatgttgaaacgccttttcgagctgcgacacgagatcgaaatatttttgagtcaaaagcactctgatctagccaagtattttcacgacgaggagtgggtgggcaagctggcctacctgtccgacattttcagcctaataaatgagctgaatcttagcttgcagggcaccctcacaacattcttcaacctctgtaacaagatcgacgtgtttaaaagaaaactgaagatgtggttaaagcgaacacaagaaaacgattacgatatgttcccctccttcagtgagttctcgaacagcagcggcctgaatatgaccgacattaccagaattatatttgagcatctggaaggactgagtcaggtgttttctgattgcttcccacccgagcaagatctgcgctccggaaacctctggattatccatcccttcatgaatcaccagaataataatctgacagattttgaggaggagaagctgaccgagctctccagtgatttggggctacaggccctcttcaagtctgtgtccgttacccagttctggataaatgcaaaaacaagttatcccgaattgcatgagagggccatgaaatttctcctaccgttcagtactgtgtatctgtgtgacgccgcattttctgccctgaccgagagcaagcagaaaaatctccttggctccgggccagcactgaggctcgctgtcacttccttgatccctagaatagagaagttggtgaaggagaaagaatag

SEQ ID NO: 14884 - DNA, 513 bp, Artificial Sequence
  Description of Artificial Sequence: Synthetic coding sequence
atgaaggagccccttgatggagagtgtgggaaagccgttgtgcctcagcaggaacttttggacaagattaaggaggaacctgacaacgcccaagaatacggctgtgttcagcagccaaaaactcaggagagcaaactgaagattggaggagtttccagcgtcaacgagcgaccaattgcccagcagcttaaccctggcttccagttgtctttcgcatcctccggcccatcagtcctgctgccgtccgtgcccgcagtagctataaaagtgttctgctcaggttgtaagaaaatgctttataagggacagacagcctatcataaaaccggcagtacccagctgttttgttctacacgctgtatcaccagacacagttcacccgcatgtttgccgcctccaccgaagaaaacctgtacaaactgtagtaagtataagatccttaacatccctttttatttcacatttttccttgtgtgcatcttgttttccagcaacattctcctgatcctgtag

SEQ ID NO: 14885 - DNA, 2172 bp, Artificial Sequence
  Description of Artificial Sequence: Synthetic coding sequence
atgaaggagcccttggatggcgaatgcggcaaggctgtggtcccacagcaggaacttctggataagattaaggaagaacctgacaacgcccaggagtatggatgcgtacagcagccaaaaactcaggagtcaaaacttaaaatcggaggggtatcaagcgtgaacgagcggccaatagctcagcagttgaatcccgggtttcaactgagcttcgccagctcaggtccgtccgtgctcctgccctctgtgcctgctgtcgccatcaaggtgttttgttccggctgtaagaaaatgctgtataagggacagaccgcctaccataagaccgggtcgacccagctcttctgtagcacacgatgtattacccgtcactcgtctcccgcttgtctgccacctccacccaaaaagacgtgcacaaattgcagtaaagacatcctgaacccaaaagatgtgattactacacggtttgagaattcatacccctctaaggatttttgctcccagagttgcctcagtagttacgagttgaagaagaaaccagttgtgacaatctacaccaaatctatttctaccaagtgctctatgtgccagaagaacgccgacactagattcgaagtgaaataccagaacgtggtgcacggcctgtgttccgacgcttgctttagcaaatttcacagcacaaataatcttacaatgaactgctgcgaaaattgcggctcatactgctactctagttccggtccctgtcagagccagaaagttttttcctctactagcgtgaccgcctacaagcagaactcagctcagatccccccttatgccttggggaagtctcttaggccatcagccgagatgattgagaccaccaacgattctggaaaaaccgagctattttgttctatcaattgtctgagcgcgtacagagtcaaaacagtgaccagctctggcgttcaggtatcctgtcatagctgcaaaactagtgccatcccccagtatcatctcgcaatgtctaacggtaccatctacagcttttgttcaagcagctgtgtggtcgcatttcagaacgtgttcagcaagccaaaaggtaccaattcttcagctgtccccctgagccagggccaagtggttgtctctccaccaagctccagatcggccgtatctattggtggaggcaacacatcggctgtatctcctagctccatacgaggaagcgcagctgcttcactgcagccgctggccgagcaatcgcaacaggtggctctgacccacaccgtcgttaagctcaagtgccagcattgcaaccatttgttcgctactaaacccgagcttttgttctataagggcaaaatgtttctgttttgtggcaaaaactgctcagacgagtacaaaaagaaaaacaaggtggtggccatgtgcgattactgtaaactgcagaaaattatcaaagagaccgtgaggttttctggggttgacaaacctttttgcagtgaggtgtgcaaattcctatctgctagggattttggagagcgttggggcaactactgtaaaatgtgtagctactgctcacagacctctccaaatctggtggagaaccggcttgaggggaagttggaggaattttgctgtgaagactgcatgagcaaattcaccgtgctcttttaccaaatggcaaagtgcgatggatgtaaacgtcaaggaaaactgtcggagtctataaaatggagagggaatatcaagcatttctgtaatcttttctgcgtgctcgagttctgccatcagcagattatgaacgattgcttgccacagaacaaagtgaatatttccaaagcgaaaaccgccgtgaccgagctcccaagtgctcgaactgataccacccctgttataacatcggttatgtccctggccaagatacctgctactctgagtactggtaatacaaacagtgtccttaaaggagccgtaactaaggaagcggctaaaatcattcaggacgaaagcactcaagaggacgctatgaaattcccttcaagccaaagctcccagcccagtcgcttgcttaagaacaaaggaatctcatgtaaaccggtaacccagacaaaagctacgagttgtaaaccgcacacccagcacaaggaatgtcagaccgaatgccccgttcgggccgtgtgctag

SEQ ID NO: 14886 - DNA, 627 bp, Artificial Sequence
  Description of Artificial Sequence: Synthetic coding sequence
atgaaggaaccactggatggggagtgtgggaaagcagtagtccctcagcaagagctgctggacaagatcaaagaggagcccgataatgctcaggaatacggctgcgttcagcagcctaagactcaggaatccaaactgaagattgggggcgttagttccgttaacgagagacccattgcccaacaactcaatcctggcttccagttatccttcgcctcatccggaccctccgtcttgctgccgtccgtgcccgccgttgccataaaagtgttctgcagtggctgtaaaaagatgctgtacaaaggtcaaaccgcttatcataagactggctctactcagctgttctgttcaactcgatgcataaccaggcacagttctcccgcctgcctgccacctcctccaaaaaagacttgcacaaactgctcaaaggatattctgaacccaaaagacgtgattacaaccagatttgaaaactcgtacccgagcaaggacttttgctcccagtcgtgcttgtccagttacgagttgaagaagaaacccgtggtcactatctacacaaaaagcatcagtactaagtgttctatgtgccagaagaatgccgacacaaggttcgaggtgaaatactag

SEQ ID NO: 14887 - DNA, 1689 bp, Artificial Sequence
  Description of Artificial Sequence: Synthetic coding sequence
atgagtcgggtccacggcatgcatccaaaagaaacaacccggcagctgagcctcgccgtgaaggatggacttattgtggaaacgttgacagttgggtgtaagggcagcaaagctggaatcgaacaggaaggctattggttgccaggcgatgaaattgactgggagacagagaaccatgactggtattgctttgaatgtcatttgccaggagaggtcctgatctgtgatctgtgctttagggtgtaccacagtaagtgtttgtcggatgaattcaggctccgtgactcatcaagcccctggcagtgtccagtgtgtaggagcatcaagaaaaaaaacaccaacaaacaggagatgggcacctacttaagattcattgtgagccgtatgaaggagagggcaatcgatctgaataaaaagggcaaagacaataagcatccaatgtaccggagactcgtccactccgccgttgacgttcctaccattcaggagaaagtaaatgaaggcaagtaccgcagctatgaagaattcaaagctgacgcgcaactgctgctccataacaccgtgatcttctatggggccgacagcgagcaagctgacatcgccagaatgctgtacaaggatacgtgccacgaactcgatgagctacaattatgcaaaaactgtttctatttgtctaatgctcggcctgataactggttctgttacccatgcataccaaaccacgagctcgtgtgggccaaaatgaagggcttcgggttctggcctgccaaagtgatgcagaaggaggacaatcaagtggacgtccgattcttcgggcatcatcaccagagggcttggatcccctctgagaacatccaggacatcaccgtgaatatccatcgactgcacgtcaagcggagtatgggctggaagaaggcttgcgacgaactggagctccaccagcgcttcctgcgcgaggggagattttggaaatcaaagaatgaggatcgcggcgaagaagaggcggaaagctccatctcttcaacctccaatgagcagctgaaggttacccaggaaccacgggcaaaaaagggcaggagaaaccagtcagtcgagcctaagaaggaggagccggagccagagacagaagctgtgagctcctcccaagagattcccacaatgccacaaccaattgaaaaggtgagcgtatccacccaaactaaaaagctgtctgcctccagtcctcggatgcttcatcgatcaactcagactaccaacgatggtgtctgtcagtccatgtgccacgataagtacaccaaaatctttaacgacttcaaggaccgcatgaagagcgatcataaaagggagacagagagagttgtgcgtgaggccctcgagaagctacggtctgagatggaggaggagaagcgacaggccgtcaacaaagccgtggctaatatgcagggagagatggatcgtaaatgtaaacaggtgaaagagaaatgcaaggaggaatttgtggaagagattaagaaattagcgacccaacacaagcagctcataagtcagaccaaaaagaaacagtggtgctacaattgcgaggaggaggccatgtaccattgttgctggaatacttcctattgttcgatcaaatgccagcaggagcactggcacgcagaacacaaacggacttgcagacgcaagaggtag

SEQ ID NO: 14888 - DNA, 1758 bp, Artificial Sequence
  Description of Artificial Sequence: Synthetic coding sequence
atggttatattcaccagcctgcaccgctacgtgattttcatctcgtgcatcatagtgatcaattggtatatgagtagagtacatggaatgcatcccaaagagacaacaagacaactcagcctcgctgtgaaggacgggcttattgtcgaaaccctcacagtcggctgcaagggctcaaaggccgggatcgagcaagaaggctactggttacctggcgatgagatcgactgggaaacagaaaatcacgattggtactgtttcgaatgtcatcttcccggagaggtgctcatttgcgacctgtgctttagagtttatcattcgaaatgtctgtcagatgagttcagactgcgggattcctcttcgccgtggcagtgcccagtttgccggtcaatcaagaagaaaaataccaataagcaggagatgggtacatatcttcgtttcatcgtcagccggatgaaggaacgagcaattgatttgaataagaaaggtaaggacaataagcatcctatgtacagaaggctggtccattctgcagtcgacgtgccaaccattcaagagaaggtgaatgaaggcaagtaccggagttatgaggaattcaaagctgatgcccagctgctcctacacaatacagtaattttttacggtgcggacagcgaacaggctgatattgcacgtatgctgtataaggatacatgtcacgagctcgacgaactgcagctttgtaagaactgcttttacctatccaatgcacgacctgacaactggttctgctacccgtgcatcccgaaccacgaattggtgtgggcaaagatgaagggattcggcttctggcccgctaaagttatgcagaaagaggataatcaggttgatgtaagattcttcggccaccaccaccagcgggcgtggatcccttctgagaatatccaggatattacagttaatatccacaggttgcacgtgaaaaggagtatgggctggaagaaggcctgcgacgagcttgaactgcaccaacgctttctgagagaaggaaggttttggaaaagtaagaatgaagaccgtggcgaggaagaagcagaatcttcgattagctcaaccagtaatgagcaactgaaggtgacccaggagccccgagccaagaagggcagacgcaaccaatctgtggagcctaagaaagaagaacccgagcccgaaacggaggccgtaagttcttctcaggagatccccaccatgccccagccaatcgagaaggtgtccgtgtctacccagacaaagaaactgagcgccagtagcccacggatgttacacagatcgacgcagacaacaaatgacggcgtatgccaatctatgtgtcacgataaatatacaaaaatcttcaatgatttcaaggaccgcatgaagtccgatcataaaagggaaaccgaaagggtcgtccgcgaagcattggagaagctccggagcgaaatggaggaagagaagcggcaggccgtaaacaaggccgttgcgaatatgcagggagagatggatcgcaagtgcaagcaagtcaaagagaagtgtaaggaggagtttgtggaggagattaagaagctcgccacacaacacaaacagctcatttctcagacaaaaaaaaaacagtggtgttacaattgtgaggaggaagctatgtatcattgctgttggaacacttcatactgcagcataaaatgtcaacaagagcactggcatgcggagcacaagcgcacgtgccgaaggaagaggtag

SEQ ID NO: 14889 - DNA, 1809 bp, Artificial Sequence
  Description of Artificial Sequence: Synthetic coding sequence
atggcccgcctaacaaaacgccgccaagccgacaccaaggcaatacagcatctgtgggccgccatcgaaataattagaaaccagaaacagatagcaaacatcgacaggattaccaagtacatgtctagagtacacgggatgcatccgaaggagactacgcggcaattgagcctcgccgtgaaagacgggctaatcgtggaaaccttgactgtcgggtgcaagggaagcaaggctggcattgaacaggagggatattggctcccgggcgatgaaatcgattgggaaacagagaaccacgattggtattgttttgagtgtcatctaccaggagaggtccttatatgtgacctgtgctttcgagtgtatcattccaagtgtctgtcggatgagttccgcctaagggactcctcctctccttggcagtgtccagtatgtagatctatcaaaaagaaaaatacaaataaacaggagatgggcacctacctccgattcatcgtctcccggatgaaggagcgtgctattgatctaaacaaaaaagggaaggataacaagcatcctatgtatcgacgcctggtgcactccgctgttgatgtgccaaccattcaagaaaaagtcaatgaaggcaaataccggtcgtatgaagagttcaaggctgacgcccagcttctgttgcacaataccgtgatcttctatggcgctgacagcgaacaagcagacattgcccggatgttgtataaggacacctgtcacgaactggacgaactgcagctgtgtaaaaactgcttctacttaagtaatgcgcgtcccgacaattggttttgctatccttgcatcccgaaccatgagctggtttgggccaagatgaagggattcggcttttggcccgcgaaggttatgcaaaaggaagataaccaagtcgacgtgaggtttttcggccaccaccaccagcgggcatggatcccgtcagagaatatccaggatattactgtgaatatacatagactccacgtgaagcgtagcatgggctggaaaaaagcctgcgatgaacttgagcttcatcaaaggtttctgcgcgaaggcagattttggaagtccaaaaacgaggatcgtggagaggaagaagccgagagcagcatctcctctactagtaacgaacagttaaaagtgactcaggagccgcgggcaaagaagggcagacgtaatcagagtgtcgagcctaagaaggaggagcccgaaccggaaacagaggcggtcagcagctcccaggagattcctactatgccccaacccattgagaaagtgagcgtcagcactcagaccaagaaattgagcgcatcaagtccaagaatgcttcatagaagcacgcagaccactaatgatggagtatgccaaagcatgtgtcacgataaatatacaaagatctttaatgattttaaggataggatgaagagcgaccataaacgcgagaccgagcgtgttgtacgcgaagctctcgaaaagctccgtagcgagatggaggaagaaaagcggcaagctgtgaacaaggccgtggctaatatgcagggcgagatggaccgtaagtgtaagcaagtgaaagaaaagtgcaaggaggaattcgtggaggaaataaaaaagctggccacgcagcataagcagctcatttcacaaaccaaaaaaaagcagtggtgctacaactgcgaggaggaggccatgtaccattgctgctggaacacctcttactgttctatcaagtgtcagcaggagcactggcacgccgagcacaagagaacctgtaggcgcaagcggtag

SEQ ID NO: 14890 - DNA, 1587 bp, Artificial Sequence
  Description of Artificial Sequence: Synthetic coding sequence
atgagtagggtgcatggcatgcatcccaaagagacaactcggcagctgtcactggcggtaaaagatggactcatcgttgaaacgctcaccgtgggatgtaagggcagcaaggctggcatcgagcaggagggttactggttgcctggtgacgaaattgactgggagaccgagaaccacgactggtactgcttcgagtgtcacctgcctggagaagtgctaatctgcgacctatgttttcgcgtgtaccacagcaagtgcctgagcgacgagttcagactgcgagactcgagttctccctggcagtgtccagtgtgccgaagcataaagaaaaagaataccaataaacaggagatggggacttacctacgattcatagtaagtagaatgaaggaacgtgctatcgaccttaataagaaggggaaggataataaacaccccatgtacagaagactggtgcattctgccgtggacgtgcccacaatccaagagaaggtcaacgagggcaaatataggagctatgaagagtttaaagcagatgcgcagctgttgcttcacaacacggtcatcttctacggtgccgattcagagcaggccgacatagcgagaatgttgtacaaggatacatgccacgaattggacgagctgcagctgtgcaagaactgcttttatctgagcaacgccaggcccgataactggttctgttatccttgcattcccaaccacgagcttgtctgggccaagatgaaggggtttggtttctggcccgcgaaagtgatgcagaaagaggataaccaggtggatgtccgattctttgggcaccaccaccaacgggcctggattccatccgaaaacatccaagacattacagtcaacatccataggttacacgttaaaagatcaatgggctggaagaaggcctgcgacgaactcgagttacatcagcgcttcttaagagagggaagattctggaaatccaaaaatgaggatcggggggaagaggaagccgaatcttcaattagtagcacatccaatgagcaactgaaagtgacgcaagagcctcgtgccaaaaagggacgccggaatcagtcagtggagcctaagaaagaggagccagagcctgagacggaggctgtttcctcctctcaggaaattccaactatgccgcagccgatcgagaaggtgtctgtgtcaacccagaccaagaagctgtcagccagttccccccggatgttacataggtcgacccagaccacaaatgacggggtatgccaatcaatgtgtcatgacaaatacaccaagatttttaacgactttaaggacagaatgaaatcggatcataagagggaaacggagcgagtggtgagagaagctctcgagaagctgcgctccgagatggaggaggagaaacgccaagccgtgaataaagcagttgctaatatgcagggcgaaatggaccggaagtgcaaacaagtgaaggaaaagtgtaaggaggagtttgtggaagagattaaaaagttggctacccagcacaagcagctgatatctcaaactaaaaaaaaacaatgggtgaacacatccctgttttag

SEQ ID NO: 14891 - DNA, 1689 bp, Artificial Sequence
  Description of Artificial Sequence: Synthetic coding sequence
atgtctcgagtgcatggtatgcaccccaaagagacaactaggcagctgtccctggcggtgaaagatggtctcatcgtggagactctgacagtgggttgcaagggcagcaaggcaggtattgagcaggagggctattggttgccaggagacgaaattgactgggagacagaaaatcatgactggtactgcttcgagtgccatctgcccggcgaagtgctaatctgtgacctctgtttccgggtgtaccatagcaaatgcctgagcgatgaatttcgcctacgggattcctcctctccatggcagtgtccagtctgtcgctcaatcaagaaaaaaaataccaacaagcaagaaatgggcacctacttgcgcttcatcgtctcacgaatgaaagagagagctatcgatctaaataagaaggggaaagacaacaaacatcctatgtaccggcgcctggttcatagtgccgtcgatgtgccgaccatccaggagaaggtaaacgagggcaagtatcgcagctatgaagagtttaaggctgacgcgcagctgcttctgcacaatactgtcattttttacggggccgatagtgagcaggccgacatcgcccggatgctttataaagacacctgccatgagctggatgagctccagttgtgtaagaattgtttttacctttccaacgccaggcctgacaattggttctgctacccctgcatccctaatcacgaactggtctgggctaaaatgaagggtttcggcttttggccagccaaggttatgcaaaaagaggataatcaagtggatgtgcgtttcttcggccaccaccaccaaagggcctggatccccagtgagaacattcaagacattacagtgaatatccaccggctacacgtcaaacgttctatgggttggaagaaggcttgtgacgaactcgagctgcatcagaggttcctgagagaaggccgcttctggaaatcaaagaatgaagatcggggcgaagaggaagccgaaagctctattagctctacctctaatgagcaactgaaggtgacacaggaaccaagagctaagaagggccgtcgaaaccaaagcgtggaacccaaaaaagaagaacccgagccagaaaccgaggccgtttcaagctcccaggagatccctactatgccccagcctattgagaaggtctccgtgagtacccagacaaaaaagctctccgctagctccccgcgcatgctgcacaggtctacccagacgactaacgacggagtgtgccagtcgatgtgtcatgataaatataccaaaatctttaacgattttaaggatcggatgaagtccgaccataagcgggagacagagcgggttgtgcgcgaggcactcgagaagctcagatctgaaatggaagaagagaagcgacaggctgttaacaaagctgtggctaacatgcagggtgagatggaccgcaagtgcaaacaggttaaggagaaatgtaaagaggagttcgtggaggagattaaaaaactcgccactcaacataaacagctgatttcgcagacaaagaagaagcagtggtgttacaactgtgaagaagaagccatgtatcattgctgctggaatacaagctactgcagcatcaaatgccagcaagagcactggcacgcagagcataaaaggacctgtagacggaaaaggtag

SEQ ID NO: 14892 - DNA, 1527 bp, Artificial Sequence
  Description of Artificial Sequence: Synthetic coding sequence
atgagtagggtgcacgggatgcaccccaaggaaaccacccgtcagctgtccctggccgtcaaggacggactgattgtagaaacactgacagttggatgcaaggggtccaaggccgggattgaacaggagggatactggttacctggcgacgaaatttccatcaaaaaaaagaataccaataagcaggagatgggcacgtacttgcgcttcatcgtgtcccgaatgaaagagagagcaatagaccttaataaaaagggtaaagacaacaaacacccaatgtacagaaggctcgtacattccgcggtcgatgttcctactatacaagaaaaggtcaatgaaggcaaatacagaagctatgaggaattcaaggcagacgctcagctcctgctgcataacactgtgattttctatggcgcagactctgagcaagcggacattgcccggatgctttataaggacacatgccacgagctcgatgaactgcagctctgtaaaaactgcttttatctctctaacgctagacccgacaactggttttgttacccctgtataccgaatcacgaacttgtttgggccaagatgaagggatttggcttctggcccgcaaaggtgatgcagaaggaagataaccaggtggatgtgcggttcttcggacaccaccaccagagagcgtggatcccctctgaaaatatccaggatattactgtgaacatccaccgactccatgtgaagaggtccatgggctggaaaaaagcttgtgatgagttagagttgcaccagcggttcctgcgggaggggcgcttctggaagagtaaaaatgaagatcgcggcgaggaagaggccgagtcgtcgattagctcaacctccaacgaacagttgaaagttacacaggagccccgcgcgaagaaaggccggcgaaatcagtcggtggaacccaagaaagaagagccagaacctgagactgaggctgtgagcagctcccaagaaataccgactatgccgcagcctatcgagaaagtgtctgtatctactcagacaaagaagctgagcgcttcgtccccacgtatgctgcaccgcagtacccagactacgaatgacggagtctgtcaaagcatgtgccatgacaaatataccaaaatttttaatgacttcaaggatcggatgaagagcgatcataagagggagactgaacgagtggtgagagaggccctcgagaagttacgctcagagatggaggaagagaaacggcaggccgtaaataaagccgtagcaaacatgcagggtgagatggaccgcaaatgtaaacaggtcaaggagaaatgtaaagaggaattcgtggaggagataaagaaattggccacgcagcacaaacagctcatttctcagactaaaaagaaacaatggtgttacaattgcgaagaggaggccatgtaccattgctgttggaatacttcttactgctctatcaaatgtcagcaggaacactggcatgcagagcacaaaaggacctgcaggagaaaacgctag

SEQ ID NO: 14893 - DNA, 1554 bp, Artificial Sequence
  Description of Artificial Sequence: Synthetic coding sequence
atggcccgcctgaccaaacggagacaggcagacactaaggccatacagcatctgtgggcagccattgagatcatacgaaatcagaaacagattgcgaacattgatagaatcacaaaatatatgagcagggttcacggaatgcaccctaaagaaaccactagacaactgtccctggctgtgaaagatgggctgatcgtggaaacactgactgtgggctgcaaaggaagtaaggccggcatagagcaggaagggtactggctgccaggtgacgagatttcgataaaaaaaaagaacactaataaacaagagatgggaacatacctgcgcttcatcgtaagtagaatgaaagagcggaaagtcaacgagggaaaatatcggtcttatgaagaattcaaggctgatgcgcaattgctgctacacaacaccgtgattttctatggcgccgattccgagcaggctgacatcgctcgtatgctgtacaaggacacatgtcacgaactggatgagctgcagctatgtaagaactgcttttatctgtctaatgcccggcctgataactggttctgctacccctgtattccgaaccacgagctggtctgggccaaaatgaagggcttcggtttctggcccgccaaagtaatgcagaaggaggacaatcaggttgacgtgagattcttcggacatcatcaccaacgggcctggattccaagcgagaatatccaggacatcacagttaacattcatcgattacacgtaaaaaggtctatgggatggaaaaaggcctgtgacgagctggaattacaccaacgtttcttgagagagggacggttttggaaatccaaaaatgaggacaggggcgaagaagaggcggagtccagtatctcaagcacttcaaacgagcagctcaaagtaactcaggagccaagagctaaaaaggggcgtagaaaccagtcagttgagccaaaaaaggaagaacccgaacccgaaaccgaagcggtttcgtcctcacaagaaattcctaccatgccacagcccatcgagaaggtgagcgtgagcacccaaacaaagaaactaagcgccagcagcccgcggatgctccataggtccacacagaccaccaacgatggggtttgccaatccatgtgccacgacaagtacaccaaaattttcaacgactttaaggaccgcatgaaatctgatcacaaacgggagaccgagcgcgtagtgcgggaggccctggaaaagttgagatccgagatggaagaggaaaagaggcaggcagtcaataaggccgtggccaatatgcagggcgagatggaccgaaagtgtaagcaggttaaagagaagtgtaaggaagagttcgtggaggaaattaagaaactggccacccaacataagcagctcatttcccaaactaagaagaaacagtggtgctataactgtgaggaggaggccatgtatcattgttgctggaataccagttactgttccatcaaatgtcagcaggaacactggcatgccgaacacaaaagaacttgcagacgaaaaaggtag

SEQ ID NO: 14894 - DNA, 1809 bp, Artificial Sequence
  Description of Artificial Sequence: Synthetic coding sequence
atggccaggttgacaaagcgccggcaggctgacacgaaagcaatccagcatttatgggccgctattgagatcatccgcaaccagaagcaaatcgcgaatatcgaccgaataacgaaatacatgtctcgagtccacgggatgcatcccaaggagactacaagacagctgtctctggccgtgaaggacggactgatcgtcgagacattgaccgtcggatgtaaagggagcaaggccggaatcgagcaggagggttactggctacctggggatgaaatcgactgggagaccgagaaccacgactggtattgtttcgagtgccacttaccgggcgaagtgcttatttgcgatctgtgcttccgcgtgtaccatagtaagtgcctttccgatgagtttaggctgcgagactcttcttctccatggcagtgtccagtatgcagatccatcaagaagaagaatacgaacaagcaagagatgggcacctacttgagatttattgtttcccggatgaaggaacgtgcaatcgacctgaacaaaaagggcaaagataacaaacaccccatgtatcggaggctagtgcattcagcagtggatgttcctacgatccaagagaaagtgaacgagggcaaatatagatcatatgaagagttcaaagcggatgctcagcttctgctgcacaacactgttattttttacggtgcagactcagagcaggctgacatcgcccggatgctatacaaagacacatgccacgagcttgacgaactccagttgtgcaagaactgcttctatctatctaacgcacggccagacaactggttctgttatccttgtattcctaatcacgaactcgtgtgggcaaaaatgaaaggtttcggcttttggccagcaaaagtcatgcagaaggaggacaaccaggtagacgtgcgcttctttggtcatcatcaccagcgcgcttggattccaagcgagaatatccaggacatcactgtcaacatccatcggcttcacgtgaaaaggagtatgggctggaaaaaggcctgtgatgagctggagcttcaccagcgcttcctcagggagggacgattttggaagtccaagaacgaggaccgcggcgaagaggaggcggagagcagcattagttcaacttcaaacgagcagctgaaagtgacccaagagcctagagcaaaaaagggaaggcggaatcagtctgtggagcccaagaaagaggagcccgagcccgagacagaagcagtctcttcttcccaagaaattcccactatgccccaacccattgagaaggttagcgtgtccacccagaccaagaaacttagtgcttctagcccccggatgttgcacaggagcactcagaccacaaacgatggtgtgtgccagtccatgtgtcacgataagtatacgaagatttttaacgactttaaggaccgaatgaaaagcgaccacaagcgggagacagaacgggttgtacgggaggccctcgaaaaactccgtagtgaaatggaagaggagaagcggcaagctgtgaataaggctgtcgcaaatatgcagggagagatggaccgcaagtgcaagcaggtgaaagaaaagtgcaaagaggagttcgtcgaggaaataaagaaactggcgacccagcacaaacagctgatcagtcagacaaagaaaaagcagtggtgctataattgcgaggaggaggcgatgtatcattgttgctggaatacatcctattgttccatcaaatgtcaacaggaacactggcacgcagagcacaagcggacctgccggcggaaacggtag

SEQ ID NO: 14895 - DNA, 1569 bp, Artificial Sequence
  Description of Artificial Sequence: Synthetic coding sequence
atggcccggcttacaaaacgccggcaagcagataccaaagccattcaacatctgtgggcagcaatcgagattatcagaaatcaaaagcagatcgccaatatcgatcgcatcacaaaatacatgtcaagagtgcatggaatgcatcctaaagaaaccacccgacaactgagtcttgccgtgaaagatggcctcattgtcgaaactttgactgttggctgcaagggtagcaaagccggaatcgagcaggaggggtattggctcccaggagatgaaatctctatcaagaaaaagaataccaataaacaggagatgggcacatatctccgctttatagtctcgaggatgaaggaacgggcgatcgacttgaataagaaagggaaggacaataagcaccccatgtatcgccggctggtccactccgccgttgatgtccctacaattcaggagaaggtgaatgaaggtaagtacaggtcctatgaagaatttaaagcagatgcccagctgctgctccacaacacagtgattttttatggcgctgacagcgagcaggcggatattgcccgcatgctgtataaagacacctgtcacgagattcctaaccatgagctggtgtgggctaaaatgaagggttttggtttctggcccgccaaagtcatgcaaaaagaggacaaccaggtcgacgtgcgcttctttggccatcatcaccagcgcgcatggattccttccgaaaacattcaagacattacggttaatattcatcgcctccacgtcaaacgatcgatgggctggaaaaaggcttgcgacgaactggaactccaccagagatttcttagggagggacgtttctggaaatctaaaaacgaagatcgaggagaggaagaggctgaatcctcgatttccagcaccagcaatgaacaactgaaggtcactcaggaacccagggctaaaaaaggtcggcggaatcagagcgttgagcctaagaaggaggagcccgaacccgaaactgaggcagtatcaagctcccaggaaatccctacgatgccccaacccatagagaaggtttcagtgagcacccaaacaaaaaagctctctgcctctagtcccagaatgctgcacagatctacacagacaaccaatgatggggtgtgccagtccatgtgtcacgataagtacacaaagatctttaacgattttaaggaccgcatgaagtccgaccacaaaagggaaaccgaacgagtggtccgagaggcccttgaaaagctgcgcagcgagatggaagaggagaaacgacaggccgtaaataaagctgtggcaaatatgcaaggcgagatggatagaaagtgcaagcaggtgaaagaaaagtgcaaggaggagttcgtcgaggagatcaaaaaattagcgactcagcacaagcagttgatctctcagacaaaaaagaaacaatggtgctataattgtgaagaagaagcaatgtatcactgttgctggaacacgtcatactgcagtatcaagtgccagcaggaacactggcacgcagaacacaagcgaacttgtagacggaagcgatag

SEQ ID NO: 14896 - DNA, 1704 bp, Artificial Sequence
  Description of Artificial Sequence: Synthetic coding sequence
atggcccggttaactaagcggcggcaggccgatacgaaagcaattcagcacctttgggcagcaattgaaattattcgcaatcagaagcaaatcgcaaatatagatcggattaccaagtatatgtccagggtgcacggcatgcatccaaaagagacaacgaggcagctctccctcgctgtgaaggacggcctgatcgtcgaaactttaaccgtgggctgtaaggggagcaaggcaggaatcgagcaggagggatattggctgccgggagacgaaatcgactgggaaactgagaaccatgattggtattgttttgagtgccacctgccaggggaagtgttaatctgcgatttatgcttccgtgtttatcacagcaagtgcctaagcgacgagtttaggcttcgagacagttcaagtccctggcagtgtccagtctgtagaagcatcaagaagaaaaatacaaataagcaggagatgggcacctatctgcggttcatcgtttctaggatgaaagagcgtgctatcgacctgaacaagaaaggaaaagataacaaacaccctatgtacaggcgattggtccattctgcggtggacgtgccaaccatccaggaaaaagtgaatgagggcaagtaccgatcctatgaggaatttaaggccgatgctcaacttctattacataatacggttattttctatggtgatagtgagcaggcagatatcgcgaggatgctttacaaggacacatgccacgagcttgatgaacttcagctctgcaagaactgcttctacctatccaatgcacgtcccgacaattggttttgctatccttgtatccctaatcatgagctggtctgggcaaagatgaaaggatttggcttctggcccgccaaggtgatgcaaaaggaggacaaccaggtggatgtgagattcttcgggcaccatcaccagagggcatggattccaagtgagaacattcaagacattacagtcaatattcatcgcttgcacgtcaagcgatccatgggttggaagaaagcctgtgatgagctagaactgcaccagagattcctgagagaggggaggttctggaagagtaaaaatgaagatcgaggggaagaagaagccgaatcaagtattagctctactagcaacgagcagttaaaggtgactcaggagccccgcgctaaaaagggaagacggaaccagagcgttgaacctaaaaaagaggagccagagccagagactgaagcagtgtccagtagccaggagatccctaccatgccccagcctattgaaaaggtttcagtgtccacccaaaccaaaaagctaagtgccagttcaccccggatgctccataggtccacgcaaactactaatgacggagtttgccagagcatgtgccacgataaatataccaaaatttttaacgactttaaggaccggatgaaaagtgatcacaaaagggagacagaaagagtcgttcgcgaagctctcgaaaagttgagaagtgaaatggaagaggagaaaaggcaggccgtcaacaaggctgtggctaatatgcagggcgaaatggataggaaatgtaagcaagtgaaggagaaatgtaaagaagaattcgttgaggagatcaaaaagttagccactcagcataaacagctgatctcacagaccaagaagaagcaatgggtgaacacgtcacttttttag

SEQ ID NO: 14897 - DNA, 1194 bp, Artificial Sequence
  Description of Artificial Sequence: Synthetic coding sequence
atggggacttacttgaggttcattgtctctagaatgaaagaaagagctatcgacctgaataagaaagggaaagataataagcaccctatgtaccggcggctggtgcactcagctgtggacgtgcctacaattcaggaactggatgagcttcagctctgcaagaactgcttctatttatccaacgctcggcccgacaattggttctgctatccttgcattcctaaccatgagctcgtctgggccaagatgaagggattcggattttggcctgctaaagtcatgcagaaagaggacaaccaggttgatgtcaggttctttggacaccatcaccagagagcctggataccttccgaaaacatccaggatataaccgtgaacatccaccgcctgcatgtcaaaagatcaatgggttggaagaaagcatgtgacgaattggagctccaccagagatttttacgcgagggcaggttctggaaatcgaagaacgaggatagaggcgaggaggaggccgaatctagcatttcatcgacgtccaatgaacagctgaaggtgacccaggagccacgcgccaagaagggaaggcgcaatcagtctgtggaacctaagaaagaggaacccgagccagaaaccgaggccgtgtcatcaagtcaagagatcccaacgatgccacagcctattgagaaagtcagcgtgtctacccagactaagaaactgagcgcttcttctccacggatgctgcatcgctcgactcagacaaccaatgatggagtttgccagtcaatgtgccatgacaaatatactaaaatctttaatgatttcaaggaccggatgaagtccgaccataaaagagaaacggagcgagttgtgcgcgaggcactcgagaagctcaggagtgaaatggaggaagaaaaaagacaggcagttaataaagccgttgccaatatgcaaggcgaaatggatagaaaatgtaagcaggtgaaagaaaaatgcaaagaagaatttgtcgaagagataaaaaaactcgccacccaacacaagcagctcatctcccagaccaaaaagaaacagtggtgctataactgtgaagaggaggcaatgtatcattgctgctggaacacttcgtattgtagcatcaagtgccaacaggaacattggcacgcggagcataagcggacttgcagacgaaagagatag

SEQ ID NO: 14898 - DNA, 1449 bp, Artificial Sequence
  Description of Artificial Sequence: Synthetic coding sequence
atgtcgcgagttcacgggatgcatcccaaagaaactactcgtcaattatctctggcggttaaagatggacttatcgtggagaccttaacagtcgggtgtaagggcagcaaggcagggattgagcaggaagggtactggttgccaggtgacgagatcagcattaaaaagaagaacaccaataagcaggaaatgggcacttatctcagattcattgtttcccgcatgaaggagcgcgccattgatctcaataagaagggcaaggataataaacacccaatgtatcgacgcctagtgcactcagcagttgacgttcccacaatccaggaaaaggtgaatgaaggtaaatatcgctcctacgaggagtttaaggctgacgcccaactgctcctccataacactgttattttttatggagccgactccgaacaggccgacatcgcaaggatgttatacaaagatacttgccatgagatcccaaaccatgaactggtctgggccaagatgaaggggttcggcttctggcctgccaaggttatgcagaaagaagataatcaggtggatgtccgattttttggccaccatcaccagcgggcttggattccttctgaaaacattcaggatatcaccgtgaacattcatcgactccatgtgaaacgaagcatgggctggaagaaggcgtgcgacgaattagaattgcaccagaggttcttgagagagggcaggttctggaagagtaaaaatgaggatcgtggcgaagaggaggcggagtcctcaatttcatctacctccaatgagcagttgaaagtcacacaggagcctcgcgcgaagaagggacgaagaaaccagtcagtcgagcctaaaaaagaagagcctgaaccagagacagaggccgttagcagcagccaagagatccccaccatgccacaacccatcgagaaggtctctgtgtccactcaaacaaagaagctctccgcgagctcacctaggatgctgcatcgaagtacccagaccaccaacgacggtgtctgccagtccatgtgccatgataagtacacgaaaatttttaatgattttaaagacaggatgaagtcagaccataaacgggaaacggagagggtagtgagggaggctctggaaaagttaagatccgaaatggaggaggagaagaggcaggccgtgaataaagctgttgccaatatgcagggagaaatggatcggaagtgtaaacaggttaaagagaaatgcaaagaagaatttgttgaggaaatcaagaagctcgctacacagcacaagcagctgattagccagaccaaaaagaaacaatggtgctataactgtgaagaggaggcaatgtaccactgttgctggaatacatcctactgtagtatcaagtgccagcaagagcattggcatgccgaacacaagcgcacatgtcgccgcaagaggtag

SEQ ID NO: 14899 - DNA, 3510 bp, Artificial Sequence
  Description of Artificial Sequence: Synthetic coding sequence
atggacatttcgaccagaagtaaagacccgggcagtgccgagcgcaccgcccagaaacgcaagttcccatccccacctcacagctctaatggacactcgccacaggacacaagcacgagcccaataaaaaaaaagaaaaaaccaggcctgcttaattcgaacaataaggaacagtcggagttgaggcatggcccattctactacatgaagcagccactcacaaccgacccggttgacgtggtgccccaagacgggagaaatgacttttactgctgggtatgtcacagggagggccaggtactctgctgcgaactctgtcctcgcgtctatcacgccaagtgcctgcgcttgacttcagagcctgaaggtgattggttctgtccggagtgcgagaaaattaccgtcgcagaatgtatcgaaactcaatccaaagctatgacaatgctcaccatagaacagctgtcatatctgctgaaattcgcaatccagaaaatgaaacagcccggaaccgacgccttccagaagcctgtgcctctggaacaacacccggactatgctgagtacatatttcaccccatggacctttgtacacttgaaaaaaatgcgaagaagaagatgtacggctgcacggaggcttttctggccgacgcaaaatggatcctccacaattgtatcatatacaatggcggcaaccacaaattgacacagattgctaaagtggtcattaagatctgcgagcacgaaatgaatgaaatagaagtctgccctgagtgctaccttgcggcctgtcagaaaagggataactggttttgcgagccctgtagtaatccccatccattggtatgggcaaaactcaagggctttccattttggcctgctaaggcattgagggacaaggatggtcaggttgatgcccgttttttcggacaacatgaccgggcatgggtgccgattaataattgctatctcatgagcaaagagatcccattttcagtcaaaaagaccaaaagcatctttaatagcgctatgcaggagatggaggtatacgtggaaaatatcagacggaaatttggtgtttttaactacagccctttccgcaccccctatacccccaactctcagtaccagatgctgctggatccaacaaacccctcagctggaaccgcaaagatcgataagcaggagaaggtaaagctgaatttcgacatgacagcttccccaaaaattcttatgagtaaaccagtgctgagtggcggaactgggagacgaatcagcctgtctgatatgcccaggagccccatgtccacaaatagtagcgtgcacacaggttccgacgtggaacaggacgctgagaaaaaggccacgtcaagccacttcagtgcctctgaagagagcatggacttcctggacaagtcaaccgccagcccggcatccaccaaaactggtcaggcggggagcctcagcgggtcacccaaacccttttccccccagcttagcgcacccataactactaagaccgacaaaacaagcaccacaggctccattctgaacctgaaccttggccatcggtccaaagccgaaatggacctaaaagagttatctgagagcgttcagcagcagagtacccccgtgcctttgatcagccctaagcgccagattcgatctcgcttccagctaaacctggacaagactattgagtcctgcaaggcacagctgggcattaacgaaatctcagaggatgtctataccgcagtggaacattcagacagtgaagacagcgagaagtccgattccagtgattccgaatacatctccgatgacgaacagaaatccaaaaatgaaccagaggacactgaggacaaagaaggctgtcaaatggataaggagcctagcgctgtcaagaagaagccaaaacctactaaccctgtagaaattaaagaagagctgaagtctacctctcctgcaagtgaaaaagccgatcccggagcggtgaaggacaaagcctccccggaacctgagaaagatttttctgagaaggcaaaaccttccccccatcccataaaagataagttgaagggcaaagacgagaccgactcacccacagtccacctgggcctggattcagatagcgagtctgagttagtgatcgatctcggtgaggatcactcaggcagggaaggacgaaaaaataaaaaggaacctaaggaacccagccccaaacaggatgtcgtgggcaaaaccccacctagcactacagtgggaagccacagtcccccagaaacccccgtgcttacgagaagcagtgcacagactagcgccgccggcgccacggcaactacgagcacatcatccaccgttaccgtaactgcacctgcccccgccgcaacaggatcccctgtcaaaaagcagcgacccctcctccctaaggagactgcgccagccgtgcagcgagttgtctggaattcatcaaccgtgcagcagaaggaaatcacgcagtccccgtccacatcaacaatcaccttagtgacaagcacccagtcttctcccttagtcacctcctctggaagcatgtctacactggtgtcctcagttaatgctgacctgccaattgcgaccgccagcgccgatgtcgctgccgatatcgcaaaatatacatcaaaaatgatggacgccattaaaggtaccatgacagaaatttacaacgatctgagtaagaatacaaccggtagcacaatagccgaaattcgaaggctgcggattgaaattgaaaagcttcagtggctgcaccagcaagaactgtccgaaatgaagcataatctggagttaaccatggcagagatgcgccagtctttagaacaggaaagagaccggctcattgccgaggtaaagaagcagctggaacttgaaaagcagcaggccgtagatgagacaaagaagaaacagtggtgtgcgaactgcaaaaaggaggctatattctattgttgttggaacacctcttattgtgattatccatgccagcaggcacactggcctgaacacatgaagtcctgcactcaatctgcaaccgcccctcagcaggaggctgatgctgaagtgaatactgaaacattaaataagagttcccagggatcctcctcatcaacacagtccgcaccctcagagaccgcctcggcctccaaggagaaggagaccagcgccgagaaatcaaaggaatcaggctcgacactggatttatccggcagtcgggaaaccccatcttctattttactaggcagcaatcaggggtccgtcagtaagcggtgtgacaaacagccggcttatgccccaaccacaaccgatcaccagcctcaccccaattatcccgcacagaagtatcactcgcggagcaataagtcttcctggagctcttcagatgagaagcgtggttctactaggtcagatcacaacacatcaacttcaaccaagtccctcctccccaaggagtctcgcctcgacacattttgggattag

SEQ ID NO: 14900 - DNA, 3561 bp, Artificial Sequence
  Description of Artificial Sequence: Synthetic coding sequence
atggacatttcgacaagaagtaaggacccaggaagcgcagagcggactgcccagaaacggaagttcccctccccaccccattccagtaatggccacagcccacaggacactagcaccagtcccattaaaaagaagaagaaaccaggactgcttaattcaaataataaagagcagtccgaattaagacacggtccattttattatatgaagcaacccctgaccaccgatccggtggacgtggttccccaggatggccggaatgacttctattgttgggtatgccaccgggaaggacaagtcctgtgctgtgaattatgccctagggtatatcatgccaaatgtttgagactgacttcagagccagagggcgactggttttgccccgagtgcgagaaaattactgtggcagagtgtatagagacccagtctaaagccatgacgatgctgactatcgagcaactttcatacttgctcaagtttgcgatccagaaaatgaaacagccaggcaccgacgcctttcaaaagccagtgcccctcgaacagcaccctgactacgccgaatacatttttcaccccatggatctctgcacactggaaaagaacgcaaagaagaagatgtacggatgtacagaggcgtttttggccgatgctaagtggatcctgcacaattgcatcatctataacggaggtaaccacaaactgactcagattgccaaggttgtcatcaagatatgtgagcacgaaatgaacgaaattgaggtctgccctgagtgttacctagccgcatgtcagaagagagataactggttttgtgagccatgttccaatcctcatcctttagtatgggcaaaactcaagggctttccattctggcccgccaaggcactccgggacaaggacggccaggtcgatgcaagattctttgggcagcacgacagagcatgggtgcctataaacaattgctacttgatgtctaaggagatcccattcagtgttaagaaaactaagagcatcttcaacagcgcaatgcaggagatggaggtatacgtcgagaacatacggcggaagttcggggttttcaactacagccctttcaggactccctacactccgaactcacaataccagatgctgcttgatcctacaaacccctccgcaggcacggccaaaatcgacaaacaggagaaggtgaagttgaacttcgatatgaccgctagtccaaaaattcttatgagtaaaccggtgctgtccggagggaccggcagacggataagtctgtccgatatgccgcggtccccaatgagtaccaattcttctgtccatactggatctgacgtggaacaggacgccgagaagaaagccacctctagtcacttctccgcctcagaggagtctatggactttctcgataaaagcactgcttcccccgcctccaccaagacaggtcaagccggatccttgtcagggtcccccaagcctttctctccccagctgtccgccccaattacgaccaagacagacaagacctctacaaccggaagcattctgaacctcaatctcgacaggtcaaaggcagaaatggatttaaaagaactcagcgaatccgtccaacaacaaagcacccccgttccacttatatcgcccaagagacagattaggtcaagatttcaactgaacttggataaaaccattgaaagctgtaaggcgcagcttgggatcaatgagattagtgaggacgtgtatactgccgtggaacactcagactctgaggacagcgagaagagcgattctagtgattcggagtacatcagcgacgacgaacagaagtctaaaaatgaacccgaggacactgaggataaggagggatgccagatggataaagagccaagtgccgttaaaaaaaagcccaaaccgacaaacccagtggagataaaagaggagcttaagtcgacaagtcccgccagtgagaaagcagacccgggcgctgttaaagataaggcctctcccgagcccgagaaggatttcagcgagaaagccaagccttctccacatccaatcaaggacaaacttaaaggtaaggacgagaccgattcacctaccgtccacctgggtctggattccgactctgaaagcgagctggtgatcgacctgggagaggatcactcaggtcgtgaggggagaaaaaacaagaaggagccaaaggagccttcccctaaacaggacgttgtaggcaaaacgcctccgagcaccactgtgggaagccactcaccgcctgagacccctgtgctcacacggtccagcgcccagacaagcgccgctggggcaacagccaccacaagcacatcgagcacagttactgtgacagcaccagcccctgctgccaccggaagcccagtgaaaaagcagcggccattactcccaaaggagacagccccagccgtgcagagagtggtctggaactcgagctccaaattccagacctcctcacagaagtggcatatgcagaagatgcaaagacagcaacagcagcagcagcagcaaaaccagcagcagcagccacaaagctcacagggcacgaggtaccaaactcggcaggcagtcaaggccgtgcaacagaaagaaatcacgcaaagcccaagtacctccacgataacccttgtgacttcaactcagtcctctcctcttgtcacttccagtggatccatgagcactctcgtaagcagcgtgaatgccgacctcccaattgccactgcgtcggctgacgtagcagctgacatcgccaaatacaccagcaagatgatggacgcgatcaaaggtactatgacagaaatctataacgaccttagcaagaataccactggaagcacaatagccgagatacggcgtttgaggatagagattgaaaaactacagtggctacaccaacaggaactcagcgaaatgaaacacaacttggagttgacaatggctgagatgcggcaatctctggaacaggaaagagaccggttgatagccgaggtgaaaaagcaattggaactcgaaaaacaacaggccgtagatgaaaccaagaagaaacagtggtgcgcgaattgcaagaaagaagccatcttttactgttgctggaacacttcttactgtgactatccctgtcagcaggcacattggcctgagcacatgaagagttgtactcagtcggctactgccccccagcaagaggcagatgccgaggttaatacagaaactctcaataagagttcacagggcagctccagctctacccagagcgctccttcagaaacagcatccgcttccaaagagaaggaaacgagcgctgaaaaaagcaaagagagcgggagtacactggacctgtctggctcgagggagaccccgagcagtattctcctaggcagcaatcaggggtccgatcatagccgcagtaacaagtcatcatggagcagctccgacgaaaaacgcggatctaccagaagcgaccataacacctctacatccaccaagagcttgctcccaaaagaatctcgcctggatacattctgggactag

SEQ ID NO: 14901 - DNA, 3483 bp, Artificial Sequence
  Description of Artificial Sequence: Synthetic coding sequence
atgcatccacaaagtttagcagaggaagaaatcaagacggagcaggaagtggtggagggcatggacatcagtacccggtcaaaagatccaggcagcgctgagcggacagcacaaaagaggaagttccccagtcccccgcactcctcgaatggccatagccctcaggatacaagcactagcccgattaagaagaaaaagaaaccgggccttctaaactctaataacaaagagcagtctgagctgcgccatggacctttttactatatgaaacaacccctcactacagatccagtagacgtggtccctcaggatggtaggaacgatttttattgctgggtgtgtcaccgagaggggcaagttctctgttgcgaactgtgccctagggtctaccatgccaaatgtctccggctgaccagtgagcccgagggcgactggttttgcccagagtgcgagaagataaccgtggctgagtgtatcgaaacgcagagcaaggcgatgacgatgctgactatcgagcaactcagttatttgctaaaatttgccattcaaaaaatgaaacagcctgggactgacgcctttcagaagcccgtacccctggagcagcaccccgactacgcggagtatatctttcaccctatggacctctgtactttggagaagaacgccaagaagaagatgtacggctgcaccgaggcttttctggccgatgcaaagtggatcctgcataattgcataatctacaacggcggtaatcacaaactgacccagatcgctaaggtggtgataaagatctgtgaacacgaaatgaacgagatcgaggtctgtccagagtgctacctggcagcatgccaaaaacgggacaattggttttgtgaaccctgcagtaatcctcatcccctggtttgggcgaaactcaagggtttccctttttggcccgccaaagcgctcagagataaagatggccaggtcgacgcccgcttttttggccagcacgaccgcgcctgggtcccaataaacaattgctacctcatgtccaaagagataccattctctgtcaagaaaacaaagagcatcttcaactcagcaatgcaggagatggaggtatacgtcgaaaatattcggcgaaaatttggggtctttaactacagcccattccggactccctacactcccaacagtcagtaccaaatgctactcgatccaaccaaccctagtgccggcaccgcaaagatagataaacaagaaaaggtgaaattgaacttcgacatgacggctagtcccaagatcctgatgtcaaaacccgtcctgtccggagggactggtagaagaatttctctgagcgacatgcctaggtctccaatgagtacaaactcttctgtgcatacaggatctgatgtcgagcaagatgcggaaaaaaaagccacaagttcacatttcagtgcctcagaggagtcaatggattttctggacaaaagcacagcgtccccggcatcaaccaagacaggacaggccggctctctgtcagggtcacctaagcccttctcacctcagttgagcgcccccatcaccaccaaaaccgacaagactagcaccactgggagcatattaaacctcaaccttgatcggagcaaagccgagatggacttgaaggaacttagtgagtcagtgcagcagcagtctaccccagtgcctctcattagccccaaacggcagatcagaagccgtttccagctgaacttggataagaccattgagagttgtaaagcccaactgggtatcaacgagatcagcgaggatgtgtacactgccgtcgagcactctgatagcgaggactctgaaaagagcgactcctctgattccgagtacataagtgacgacgagcaaaagagcaaaaatgagccggaggacactgaagacaaggaaggttgtcagatggataaggagccaagcgccgtaaaaaaaaagccaaaaccaacaaaccctgtggaaatcaaggaggagctgaagagcacttctcccgcttcagagaaagccgacccgggagcagtgaaagacaaagcttctccggaaccagagaaagatttttccgagaaggcaaaaccaagccctcaccctatcaaggacaagctgaagggtaaagatgagaccgattcacccaccgtgcacctgggcttagacagcgattccgagagtgaacttgtgatagatctaggcgaggatcacagcggccgagaggggaggaaaaacaagaaggagcccaaggagccttccccaaagcaggacgtggtaggaaagacacctccgtccacgactgtgggttctcattctcctccagaaaccccggtcttgactcggtccagcgctcaaacgtctgccgctggtgccactgccacaacctctacctccagcaccgtcaccgttacagccccagctccagccgcaacaggcagtcccgtgaaaaagcagcgtcctctgctgcccaaggagacggctcccgccgtccagagagttgtgtggaactcatcaactgttcaacaaaaagagatcactcagtcaccgtcaacatccacaattaccctggtgacgagtacccagagttccccactggtcacaagtagcggaagcatgtctacattagtatccagtgtaaacgccgacctccccatcgcgaccgccagcgcagacgtagccgccgatatcgccaaatacacatcaaagatgatggacgcaataaagggaacgatgacagaaatttacaatgatctatccaaaaacaccacgggctccacgatcgctgaaatacgccggctacggatcgagattgagaagctgcagtggctgcaccaacaggagctgtccgagatgaaacacaatctcgagctgactatggctgaaatgcgccaatctttggagcaagaacgcgacaggctgattgctgaggttaagaaacagttggagctggagaaacagcaggccgtcgacgaaactaaaaaaaagcagtggtgcgcgaactgcaagaaggaggccatcttctactgctgctggaatacatcctactgtgactatccctgtcagcaagctcactggccagagcacatgaaatcgtgcacacagtctgctactgccccgcagcaggaagctgatgccgaagtgaatactgagacccttaacaagagcagccaaggtagctcgtcatcaacccaaagcgccccaagtgagaccgcgtcagcatcaaaggaaaaggagacatcagctgaaaaaagcaaggaatccgggtcgacactggatctgtcgggctctcgggaaaccccctcgagtatcctgctgggaagcaaccagggcagcgatcattctcgctcaaacaagagctcatggtcttccagtgatgagaaaagggggtccactcgcagtgaccacaatacaagcacatccaccaagtccctgctccctaaagaaagtcgcttggatactttctgggactag

SEQ ID NO: 14902 - DNA, 3645 bp, Artificial Sequence
  Description of Artificial Sequence: Synthetic coding sequence
atggatatctccactaggagtaaggatcccggaagcgcagaacggacagctcagaagcggaagttcccttcccctccccacagcagcaatggacacagtccacaagatacctcaaccagccctatcaagaaaaaaaagaagcctggtctactgaacagcaacaacaaagagcagtctgaattgaggcacgggccattctactacatgaagcagccattaaccacggacccggtggatgtagtcccacaggatggcaggaacgatttttactgttgggtctgtcatcgagaaggccaggtgctttgttgcgagctatgccccagagtctaccacgctaaatgcttgcggctgacaagcgagcctgaaggagattggttctgccccgaatgcgagaagattaccgtggccgagtgcatcgagacacagtccaaagccatgactatgctaaccattgagcaactgagttatttactcaagttcgcaatacagaaaatgaaacagcccggaactgacgccttccagaaacccgtccctctggaacaacatcccgactacgcagagtatatttttcatccaatggacttatgcaccctggaaaagaacgcaaagaaaaaaatgtacgggtgcaccgaagccttcctcgccgacgccaagtggattctgcataactgcattatatataacgggggcaatcataaactgacacagatcgcaaaagttgtgattaaaatatgcgagcacgagatgaatgaaatcgaggtttgtcccgagtgctatcttgccgcttgccagaaaagagacaattggttctgcgaaccttgctccaatcctcacccgctcgtgtgggcgaagttgaaggggttccccttttggcccgccaaagccctgcgggacaaggacggtcaggtggatgcccggtttttcggccagcatgacagagcttgggtccctattaataattgttacctcatgtccaaggagattcccttcagtgtgaaaaaaaccaagtcaattttcaattccgccatgcaagaaatggaagtgtacgtagaaaatataagacgcaagttcggggtcttcaactactcacccttcagaaccccttacacaccaaactcgcagtatcagatgctacttgacccaaccaaccccagcgccggaactgccaagatcgacaaacaggagaaagtcaagctgaacttcgacatgaccgcatcaccaaagattctcatgtctaaaccagtgctgtccggagggaccggaaggcgaataagcctctctgatatgcctagatctccaatgagtactaatagttcagtacatactgggagtgacgtcgagcaggatgcagagaagaaggctacttcttcccacttctctgcttcggaagagtctatggatttcctggataagagcactgcatcccctgctagcactaaaactggtcaggccggatcactgtctggcagtccgaaaccattttctccccagctcagcgctcccattacaacaaaaacagataagaccagcaccacaggttccattcttaatttgaatttagacagaagtaaggccgaaatggacctgaaggaactgagcgaatccgtccagcagcagtccactcccgtgccactgatcagtcccaaacggcagatacgtagcaggttccagctgaacttggacaaaactattgagtcgtgtaaagctcagttgggaattaatgagatatctgaagatgtgtacactgccgttgagcactctgatagtgaagattccgaaaagtctgattcatcggattctgagtatatctcggacgacgagcagaagagcaaaaacgaaccagaagacacagaggataaagaaggttgccagatggacaaagagccaagcgcagtcaagaagaagcccaagcccaccaaccctgtggagatcaaggaggagctcaagtctacttcccctgctagcgagaaggccgatccaggtgccgtgaaggacaaagcttcaccggagccagaaaaggattttagcgagaaggccaagccctccccacaccccatcaaagataagctgaaaggaaaagacgagacagacagcccaaccgtgcatctggggttagattctgactctgagagcgaactggtgatcgacttgggagaagaccacagcggccgagagggccgtaaaaataaaaaagagcccaaagagcctagtcccaaacaggacgtggttggaaaaactccaccctccaccactgttgggagtcactctccgccagagacaccagtgttgacaaggtcctccgcccagacatcagcagctggcgcgaccgcaacaacttccactagtagtactgttacagtgacagcaccagccccagcggccactgggagtcctgttaagaagcagcgccctctgctcccaaaggaaacagcgccggctgttcaacgggtcgtgtggaatagttcgagtaagtttcagacatcctcgcaaaaatggcatatgcaaaaaatgcaaagacagcagcaacagcagcagcagcaaaaccagcagcagcagccccagagtagccagggcactcggtaccaaaccaggcaggccgtcaaggccgttcagcaaaaggaaattacccagtccccatcaacctcgacgatcaccctggtgaccagtacacaatcatctcctctggtcacctcttctggatcaatgagtaccctggtgtcatcggtgaacgcggatctgcctatcgccactgcaagcgctgatgtagcggccgacattgcaaaatatacttcgaagatgatggatgctatcaagggtaccatgacagagatctataacgacttaagcaaaaacaccaccggtagcactatcgccgaaatcaggaggctacggatcgaaatcgaaaagttacaatggctgcatcaacaggaattaagtgagatgaagcacaacctggagctgaccatggccgagatgcggcaatccctcgaacaggaaagggaccgcctcatcgcagaggtaaaaaagcaattagagttagaaaagcagcaagctgtggacgaaacaaaaaaaaaacaatggtgtgcgaactgcaagaaggaagccatcttctattgctgctggaatacctcctattgtgactacccttgccagcaggctcactggcctgagcacatgaagtcctgcacccagtctgcaaccgcacctcagcaggaggctgacgctgaggtgaacacagaaaccttgaacaaatcgtctcagggcagctctagttccacccaatccgcccccagtgagacggcaagtgcctccaaagaaaaggagacaagcgctgaaaagagcaaagagtccggatccaccctagatctgtccggctcccgagagacgccatcctctatccttttggggagtaatcagggtagcgtgagcaaaagatgtgacaaacaaccagcatacgcgccgaccaccacagaccatcagccccacccaaattatccagcccaaaaatatcattcacggagcaataagtcctcttggtcatccagcgatgagaaacgtggcagtacacggagcgatcacaacacaagcaccagcaccaaaagtctactacccaaagaatcacggttagacacgttctgggactag

SEQ ID NO: 14903 - DNA, 3408 bp, Artificial Sequence
  Description of Artificial Sequence: Synthetic coding sequence
atgcatccccagtcattggctgaggaggagataaagaccgagcaggaagtggttgagggtatggatatatccactagaagcaaagatccaggatccgccgagaggactgctcagaagagaaagtttccatcaccaccacatagcagtaacggacactctccacaggacaccagtacttctcccatcaagaaaaaaaagaagccaggactactgaatagtaacaacaaggagcaagatgggagaaatgacttctactgctgggtgtgccatagagaaggacaggtgctgtgttgtgaattgtgtcccagggtttatcacgccaaatgcctgaggctgacctcggaaccagaaggggactggttctgccccgagtgcgagaagataaccgtcgctgaatgcatagaaacacaatcaaaggctatgactatgctcacgatagaacagctgtcatacctgctcaaatttgcaattcagaaaatgaagcaacccggaactgatgcttttcagaagcccgtgcctttggagcagcacccagactacgccgaatatatctttcaccctatggacttatgcactctggaaaaaaatgctaagaagaaaatgtatggttgtaccgaagcatttcttgctgacgctaagtggatcttgcacaactgtatcatctacaatggaggcaaccataagctcacacagatcgctaaggtggtgatcaaaatatgtgaacacgagatgaatgaaatcgaagtctgccccgaatgctatcttgcggcctgtcagaaacgggataactggttctgcgaaccatgcagtaaccctcatcctctcgtttgggctaaactaaaagggttcccattttggcctgctaaagcactacgggacaaggatggccaggtggacgcccgattcttcggccagcacgatcgggcctgggtcccgatcaataattgttacctgatgagcaaagaaatcccattcagcgtcaagaagacgaagagcatcttcaactccgcaatgcaagaaatggaggtctacgtggagaatatacgacgcaaatttggggtctttaactactcccccttccgcactccttatacccccaacagtcagtaccagatgcttctggacccgactaaccctagcgcgggaacagcaaagatcgataagcaggaaaaggtcaagctgaatttcgatatgaccgccagccccaagattctcatgtcaaaacccgtgctgtctggcggcacaggacgaagaatctctctaagtgatatgccccggtccccaatgtctacaaattctagcgtacataccggctctgatgtggaacaagacgctgagaagaaagccacgagttctcacttctcggcatccgaggagtctatggattttctggataagtcaacagcgtcccccgcatcaaccaaaaccggtcaggcgggatcactaagcggaagtcctaaaccttttagtccacagttgagcgcccctattacgacaaagacagataagacgagtacaactggatctatcttaaatctgaatctggacagatccaaagcagaaatggatttaaaggagctttccgaaagcgtgcaacagcagtccacccctgtcccgttgatttctcctaagaggcaaatccggtcccggtttcaattaaacctggataagactattgaatcatgtaaagcacagttgggaattaatgagatttccgaggacgtgtacacggcggtggagcactccgatagcgaggacagcgagaagagcgatagttccgacagcgaatatatttccgatgatgaacagaagtctaagaacgaacccgaggacaccgaagacaaggaggggtgccagatggacaaagaaccctcagccgtgaagaagaaacccaaacccaccaatccggtggagattaaggaagagttaaaatccacatccccagcaagcgaaaaggccgatcctggggctgtcaaagacaaagcttcacctgaacccgaaaaagactttagcgagaaggcaaaaccttccccccatcctatcaaagacaagttaaaggggaaggatgagaccgactcaccaaccgtacacctggggctcgattctgactccgaaagcgagttggtgatcgatctaggcgaggatcactcaggccgagaggggagaaagaataaaaaggagcctaaggaaccaagccccaaacaggatgttgtcggcaagaccccccctagtactaccgttgggagtcattcacccccagaaaccccagtgcttacacggtcttctgcccaaacctctgcagccggcgccaccgctaccacgtccacctccagtactgttaccgtcactgctcctgctcccgcggctactggcagccctgttaagaaacagcgacctctactgcccaaagagaccgcacctgcggttcaaagggtcgtctggaactccagcacagtacaacagaaggagattacccagagtccctccaccagcaccataacgctggttacctcgacgcagagttcaccgttggtaacctccagtggatcaatgtcaacgcttgtgtccagcgtaaatgcagacctgcctattgccacagcaagtgctgatgtagctgctgatatagcgaagtacacttcaaagatgatggacgccattaagggaactatgactgagatttacaacgacctgagcaagaacacaactggaagcaccattgcggagatacggagactgcggattgaaatcgagaaattgcagtggctgcaccaacaggagcttagtgaaatgaaacataatctggaactgactatggccgaaatgcggcagtccttggagcaggagcgcgacaggctgatcgccgaagtcaagaaacagctggagcttgaaaaacaacaggctgttgatgagaccaagaagaaacagtggtgcgccaattgtaagaaggaggcaatcttctattgttgctggaacacttcatactgcgactacccctgccaacaggcgcactggccggaacacatgaaaagctgtacacaatctgctactgcaccacagcaggaggcggacgctgaggtgaatacagagaccctgaacaagtctagtcagggttcctcgagttccactcagtccgcaccttctgagactgccagcgcgtcaaaagagaaagagactagcgcagaaaagagcaaggagagcggcagtaccttggacctgtcagggagccgagaaactccttccagcattctcttgggctctaatcaaggcagtgatcacagccggtccaacaaaagcagctggtcaagtagcgatgaaaagagaggttctacaagaagcgatcataacacatccacttcaaccaagagcttactcccgaaggagtcccgattggatacgttctgggactag

SEQ ID NO: 14904 - DNA, 3411 bp, Artificial Sequence
  Description of Artificial Sequence: Synthetic coding sequence
atgcaccctcagagtctcgccgaggaagagattaaaacagaacaggaggtggtggaaggcatggatatctccactcggtctaaggacccaggctcagcagaaagaactgctcagaagcgaaagtttccctctccacctcacagcagtaatggtcactcaccccaggacacctctactagcccaattaagaagaaaaaaaaaccaggtttgttaaactccaacaacaaggaacaggacggccgcaacgatttttattgctgggtctgccacagagaaggacaggtgctgtgctgcgagttgtgcccacgcgtctatcacgccaaatgcttgagactcacttccgagcccgaaggagattggttctgtcccgagtgcgagaagattactgtcgccgagtgcattgagacacagagcaaggcaatgacaatgttgacaatagagcagctgtcctatctcctgaaatttgcaatccagaagatgaagcagccgggcacagacgcttttcaaaagcctgtcccactggagcagcaccccgactacgccgaatacatcttccatcccatggacctttgcacgctcgagaagaacgcaaagaagaagatgtacgggtgtacagaggcctttcttgccgatgccaaatggatacttcacaattgcatcatctacaatggggggaatcacaagcttactcagatcgccaaggtagtgatcaagatttgcgaacacgagatgaacgagatagaggtttgtcctgaatgctatctggctgcgtgccagaaacgtgataactggttctgtgagccatgttcgaatccgcacccattggtgtgggccaagctgaaaggcttcccgttctggcccgcgaaagctctgcgagacaaggacgggcaagtcgatgcccgattttttgggcagcacgatcgggcatgggtgcccattaacaactgctacctcatgtctaaagaaattcccttcagcgttaaaaagaccaaaagcatatttaactcagctatgcaggaaatggaggtctacgtcgagaatatcaggagaaagttcggcgtgttcaattatagccctttcaggaccccatatacgccaaattcccagtaccagatgctgctcgaccctactaaccccagcgcgggaactgccaagatcgataagcaggagaaagtgaagttgaatttcgacatgacagcctctcccaagatcctgatgtcgaagcccgttctctctggtgggacagggagaaggatcagtttgagtgacatgccccgctcacccatgtctactaacagctcagttcacaccggatccgatgtagaacaggacgccgagaagaaagccacaagctcacacttctccgcctcagaggaatcaatggactttcttgataagagtacagccagccctgcctctacgaagacaggacaggccggcagcctctcgggctcacctaagcccttctccccacagctctctgccccgatcaccacaaagaccgacaagacatctacaaccgggagcatcttgaatcttaatctggaccgcagtaaagccgagatggacctaaaggaactctctgaaagcgtgcagcagcaaagcacaccggtgccacttataagcccaaaacgtcagattcgttctcgctttcagctgaatttagataaaaccattgagtcatgcaaagcccagctgggaatcaatgaaatttctgaagatgtctatacagcagtcgaacacagcgactctgaagactccgaaaagtctgacagttccgattcagaatacatctcagatgacgagcagaagagtaagaatgagcctgaagacaccgaggacaaggaagggtgccagatggacaaagaaccctccgctgtaaaaaagaaacctaagcccactaatcccgtggaaatcaaggaagagttgaagtccacttcccctgcttcagaaaaggcagatcccggcgctgttaaggataaggcatctccggaacctgagaaagacttcagtgaaaaggcgaaaccctcgccgcatcctattaaggataaacttaaaggaaaggatgaaactgactcacccaccgtgcacctgggcctcgatagcgatagtgaatctgagctggtgattgatctaggagaggaccactctggccgcgagggccgcaagaacaagaaggagcctaaggaaccttcccccaaacaggacgtggtgggaaaaacaccaccgtccaccactgtgggttcccatagcccaccagaaactccagttctcacaagatcttcggctcagacaagcgccgccggtgccaccgcaacaacatcaacgagttccacggtaacggtgactgcacctgcccccgcagctacaggctcccctgtcaagaagcagcgacccctgctcccaaaggaaacagctcccgcagtccagagggtagtgtggaattcatctacggtgcagcagaaggaaataacgcaaagtccatccactagtacgatcactttggtcaccagcacccagagctcccctctagtgacaagctcagggtcaatgtccaccttagtgtcaagcgttaatgctgacctccccatcgccacagcctctgccgacgttgctgcagacattgcaaaatacacatccaagattcggcggctgagaattgaaattgagaagctccagtggttacatcagcaggaactcagcgaaatgaagcacaacctggaattaactatggccgaaatgagacaaagcctggagcaggagcgtgatcgcctcatagctgaggtaaagaagcagctcgagctggagaagcagcaggccgtggacgaaactaaaaaaaaacagtggtgcgcaaactgtaagaaagaagcgatcttctactgttgttggaatacgtcttactgtgattacccctgtcagcaggctcattggccagagcatatgaaaagttgtacccagagtgctacggcaccacagcaggaagccgacgctgaggttaacacagagactttgaacaaatcatcacagggctcctcttccagtacgcagtcagcgccatctgagactgcctctgctagcaaagagaaggagacaagcgctgagaagtccaaagaatcggggagcactctggatttatcaggcagcagagagacaccaagctctattctgttggggtcaaatcaggggtcagtgagtaaacgctgcgacaagcagcctgcctacgctcctaccacaaccgatcaccagccacaccctaactaccccgcacaaaagtatcatagcagatccaataagtcaagttggtctagttctgacgaaaagcgcgggtcaaccagatccgaccacaatacctccacaagtactaaatcgctgctgcctaaagagtctaggctggataccttttgggattag

SEQ ID NO: 14905 - DNA, 3561 bp, Artificial Sequence
  Description of Artificial Sequence: Synthetic coding sequence
atgttttcctctctccagaagtcatttaatctggccgaagaggaaattaagactgaacaagaagttgtggaaggcatggacattagcacccggtctaaggacccaggcagcgccgaaagaacggcacagaagcgcaagttcccatcccccccccactcgagcaacggccactcaccacaggacaccagcacttcacccataaaaaagaaaaaaaagcctggcctgctgaattctaataacaaggagcaggatggaagaaacgatttttactgttgggtgtgtcatcgagagggtcaggttctctgttgcgagctttgccccagggtgtatcacgctaaatgtctccggctgacgtcagaacccgagggggattggttttgtcccgaatgcgagaagatcaccgttgcagagtgtatcgaaacccaatctaaggccatgaccatgttaaccatcgagcagctctcttacttgcttaaatttgccatccagaaaatgaagcagccaggtactgatgctttccaaaagccagtcccgctggaacaacaccctgattatgcagaatatatattccaccctatggacttgtgcacactcgagaaaaatgcgaagaaaaaaatgtacgggtgtacagaagcctttctggcagatgcaaaatggatcctgcacaactgtatcatctataacggaggaaatcataagctcacacaaattgccaaagtggtcattaagatctgcgagcatgaaatgaacgaaatcgaggtgtgcccagaatgttatctcgctgcttgccagaaacgcgataattggttttgcgagccttgctctaatccgcatccccttgtgtgggcgaagctgaaaggtttcccattttggcctgctaaggctcttcgggataaggatgggcaggtcgacgcgcgcttctttggccagcatgaccgagcctgggtgcctataaacaactgctacctgatgtcaaaagaaatccccttctcggtgaagaaaacaaagtccattttcaatagtgccatgcaggaaatggaggtgtatgtggaaaacatcaggaggaaatttggcgtgtttaattatagcccctttcggaccccttatacaccgaattctcagtaccagatgctcctggatcccactaacccgtctgccggcaccgctaagatagacaaacaggagaaagtaaagcttaacttcgatatgaccgcaagccccaagatactcatgtctaagcctgtgttgtctggcggaaccgggaggcggatcagcctgtccgacatgcctaggtctccaatgagcactaatagtagcgtccatacgggatcagacgtggaacaggatgcagagaaaaaggccacctccagccacttttcagctagtgaagagagcatggattttcttgataagagcacagctagccccgcaagtaccaaaaccggacaagctggctcactatctggatcccccaagccctttagtcctcaactaagcgctcccattaccactaaaactgacaagacatctacaacgggaagtatcctcaatctaaatctagaccgtagcaaggccgagatggatttgaaagagctgtcagagagcgtccagcagcagagtactccagtccctctcatctcaccaaagcgccagataaggtctcgattccaactcaacttagacaagacaatcgagagctgcaaggcacaacttggaattaacgagatttctgaagatgtttacactgccgtcgagcactccgattctgaggacagtgagaagtccgatagtagcgatagcgagtacatttcagacgatgagcagaagagcaagaacgagccagaagacactgaggacaaggagggttgccagatggacaaagagccaagcgcagtcaagaagaagccaaaacctactaatcctgtggagatcaaagaagaactaaaatccacatcacctgcttccgaaaaagcggatcctggcgctgtgaaggataaggcttccccagaacccgagaaggatttcagtgagaaggccaagccgagccctcatcctataaaagataagttgaaaggcaaggacgaaacagattcgccaactgttcatttgggactggattccgactccgaatcagaattagtgatagatctcggggaagaccattcgggccgggaaggacgcaaaaataagaaagagccaaaggaaccgtccccaaagcaggacgtcgtgggcaaaactccgccttccaccactgtggggtcacatagccccccagagacacccgtcctgacacgatcttccgcccagacctccgccgctggggccactgcaaccacgagcacaagcagtacggtgacagtgaccgcaccagcgcccgccgccaccggatcaccagtgaagaagcagcggccgctgctcccaaaagagacagcccctgccgtacagcgggttgtgtggaattcttccagtaagtttcagaccagcagccagaagtggcacatgcagaagatgcaacgccagcaacagcagcaacagcaacagaatcagcagcagcagccccagagctcccaggggactcggtaccagacccggcaggccgtgaaagcagtccagcagaaagaaatcacacagagcccttctacgagcacaatcacattggtgacctctacccagagtagtcccttggtcacgtcttccggatctatgtcgactcttgtgtcttctgtgaacgccgacttaccaatcgcaacagcctctgccgatgtggcagccgatatcgccaagtacacctccaaaatgatggacgccatcaaaggaactatgacggaaatctataatgatttgtctaaaaatactaccgggtcaaccatcgctgagattcgaaggttacgaatagagattgaaaaattgcagtggctccaccagcaggagctgtcggaaatgaaacataatctcgagttaactatggctgagatgcgccagtccctggagcaggagcgcgacaggctcattgccgaggtgaaaaagcagctggagttggaaaaacaacaggcagtcgatgagacaaaaaaaaaacagtggtgcgccaactgcaagaaggaggcgatattctattgctgctggaacacaagctattgtgattatccctgtcagcaggcccactggcccgagcatatgaaatcttgtacacagtctgccacggctccccagcaggaggccgacgccgaggtgaatacagaaaccctcaacaagagtagccagggttcttcatccagcactcagtccgctccctcagagaccgcaagtgcttctaaggagaaggaaacctccgccgagaaaagtaaagagtccggcagcaccttggatctctctggatctcgggaaaccccttcctcaatcctgctcggctcaaatcagggcagcgaccacagcaggtccaataaatcctcctggtctagttcagatgagaagcgcggatcaactcggtcagaccataatacaagtacctctacaaagtccttgcttcccaaggagtctcggctggatactttttgggactag

SEQ ID NO: 14906 - DNA, 75 bp, Artificial Sequence
  Description of Artificial Sequence: Synthetic coding sequence
atggacatctcgacccgatccaaagatccaggttcagctgaaaggacagcccagaaacgcaagttcccatcatag

SEQ ID NO: 14907 - DNA, 129 bp, Artificial Sequence
  Description of Artificial Sequence: Synthetic coding sequence
atggacatctctacacggtctaaggatccggggtctgcagagcggactgcacaaaagcgcaagttcccttcgccaccacattctagcaacggccacagtcctcaggacaccagcacaagcccaatctag

SEQ ID NO: 14908 - DNA, 3318 bp, Artificial Sequence
  Description of Artificial Sequence: Synthetic coding sequence
atggatatatccaccagaagcaaagaccctggaagtgccgagcgcactgcacagaagcggaagttcccatcaccaccccattcatccaatggtcattccccccaggatacgagcacatctcccatcaaaaagaaaaagaaaccaggcctgttaaattccaataacaaagagcaggatgggcgcaatgatttttactgttgggtgtgccatcgggagggtcaggtgctttgctgcgagctctgtcccagagtgtatcacgcaaagtgtctcaggctcacttccgagccggagggggattggttttgcccagagtgtgagacagacgcttttcagaaacccgtacctctcgagcaacaccccgactatgctgagtacatctttcatcccatggatctttgcaccctggaaaagaacgcaaaaaagaagatgtatggctgcactgaggccttcttagccgacgctaaatggattctgcacaattgtataatttataatggtggaaaccacaagctgactcagatcgccaaagtggtgattaagatctgtgaacatgaaatgaatgaaatcgaagtgtgccctgaatgctatttggcagcctgtcagaagagggataattggttttgcgaaccatgttcgaacccccatccactcgtctgggctaagcttaaggggttccccttttggcccgctaaagcgctgcgggataaggatggacaggtggacgcacgcttcttcggccaacatgacagggcatgggtcccaatcaataactgctatcttatgagcaaagagatccccttttctgttaagaagacaaagagtatcttcaacagcgctatgcaggagatggaggtctacgtagagaacattcgcagaaaatttggagtgtttaattacagtccatttaggaccccttacacgccaaatagccagtaccagatgctcctggatccaacgaacccctccgccggaaccgcaaaaatagacaagcaggaaaaggtaaagttgaactttgacatgaccgctagcccaaagattcttatgtctaagcctgtgctgtcgggcggtaccggccgcaggatttccttgtcggacatgccgaggagtccaatgtccacaaactcctctgtgcacaccggctccgatgtagaacaggatgccgaaaagaaagcaactagctctcatttcagcgcatccgaagagagtatggactttctggacaaatccacggcaagtccagcgagtactaagactggacaggcaggttccctctctggtagccctaaacccttctctccccagctctctgcccctatcacaacaaagaccgacaagacaagcacaacagggagtatcctgaacctgaatttagatagaagtaaagcagagatggatttgaaagaacttagcgagagcgtgcagcagcagtctacccctgtgcccctgattagtcctaaaagacagataaggagtcggtttcagcttaacctcgacaaaacaattgagtcatgcaaagcccaactgggaattaatgagatctctgaagacgtatataccgctgtcgaacactccgacagtgaagactccgaaaaaagtgactcaagcgactctgaatatatttcggacgacgagcagaaaagcaagaacgaacctgaggacacagaggacaaagaaggttgccagatggacaaagaaccatccgcagtcaaaaagaagccgaaaccaacaaacccagttgaaatcaaagaggagttgaagagcacttctcctgcctccgagaaagcggacccgggcgccgtaaaggataaggcttctccagaacctgaaaaggacttttctgagaaagctaagccctcaccacatcctatcaaagataagctgaagggcaaagacgagactgactcacctaccgtccacctgggactggatagtgacagtgagtccgagttagtcattgaccttggggaggaccatagcggacgggagggccgtaagaacaaaaaggagcccaaggaaccctcacccaagcaggacgtcgtgggtaagacccctccttccacaaccgtcgggtcgcattcccccccagagacgcctgtgcttactaggtcctctgctcaaacaagcgctgccggagctaccgcgacaacctccacttcctcgacagttaccgtgaccgctccggcacccgcggcgactggcagcccagtcaaaaaacagaggcctctgctccccaaggagaccgcacccgccgtacagcgcgtcgtatggaactcaagcactgtacagcagaaggaaatcacccagtctccgagtacatccactatcacattggtaacatctactcagtcatcccccctggtcaccagttccgggtccatgtctactctggtcagctctgtcaacgcagatctcccgattgccaccgccagtgctgacgtcgctgcggacattgcgaagtacaccagtaaaatgatggatgccataaagggaaccatgacagagatctacaacgacctaagcaagaataccacgggcagcactattgccgagatccgacgccttcggatcgagattgaaaagcttcaatggctccatcagcaagaactttccgagatgaagcataacctggagttaaccatggcagagatgagacagtcattggagcaggagcgagatagattgattgccgaagtaaaaaagcaactcgagcttgaaaaacaacaggccgtagatgagaccaagaaaaaacagtggtgtgcaaactgcaagaaagaagcgatcttctactgttgctggaacacttcctattgcgattacccttgccagcaagcacactggccagaacacatgaagagctgtacacaatctgccaccgctccccagcaggaagccgacgcggaggtgaacaccgaaacactaaacaagagctcccagggctcatcctccagtacacagtcagcaccaagcgaaaccgcatccgcaagcaaggaaaaagagacatctgctgagaaaagcaaagagtccggatccaccctggacctgtccgggagccgtgaaactccaagttcaatcctattaggctccaaccagggatccgtaagcaaaaggtgtgataaacagcccgcgtatgcacccactactaccgatcaccagcctcatcccaattacccagcccagaaataccactcccgcagtaacaagagctcatggtcttcttcagatgaaaagcgcggaagcaccagaagtgaccataacacttccaccagcaccaaaagcctgcttccaaaggagagtagactcgatactttctgggactag

SEQ ID NO: 14909 - DNA, 3567 bp, Artificial Sequence
  Description of Artificial Sequence: Synthetic coding sequence
atgcacccgcaatcactggctgaagaagagattaaaaccgagcaggaagtcgtcgaaggcatggacatttcgactcgttccaaggacccaggcagcgcagagcggacggcccagaagcggaaatttcctagtcctcctcactccagtaatggacacagtccccaggacacttccacctctccaattaaaaaaaagaagaagccaggcctcctgaactccaataataaagaacagtctgagctgcgccacggacccttttactatatgaagcagcctctgacaaccgacccggtcgacgtcgtaccccaagatggaagaaatgacttttactgctgggtttgccatagggaagggcaagtcttgtgttgcgaactatgtcccagggtgtatcatgccaaatgcctgaggctgacgtcagagccggagggagattggttctgccctgaatgcgagaagataactgttgccgaatgtatcgaaacccagagtaaggccatgactatgctcacgatcgagcaactgtcctatctattgaagttcgccatacagaagatgaagcagccgggcaccgacgcgtttcaaaaaccagtgccactggagcaacatccagactacgctgaatatatctttcatccaatggatctctgtaccttggaaaaaaatgccaaaaagaaaatgtatggctgcactgaagctttcctggccgatgcaaaatggatcctgcataattgcataatttacaacggcgggaatcataaactgactcagattgcgaaggtcgtgatcaaaatctgcgaacatgagatgaatgagatcgaggtctgccccgagtgttacctcgccgcctgccagaaaagggacaactggttctgcgaaccctgtagtaacccccaccctttggtctgggccaagcttaagggcttcccattctggcctgccaaagcgttacgggataaagatggccaagtggacgctaggttttttgggcagcatgacagggcatgggttcctattaataattgttacctgatgtctaaggaaattcccttctctgtgaagaagaccaaatctatcttcaatagcgcaatgcaggagatggaggtgtacgtagagaacatcagacgaaaatttggagtgttcaattattcacctttccgaacaccatatactccgaacagtcagtaccagatgttgcttgatccaacaaatccctccgcaggcactgcaaagatcgacaagcaggaaaaagttaaactaaatttcgacatgacagccagccccaaaatcttaatgtctaaacctgtgctaagtggagggaccgggaggaggatttctctcagcgacatgccacggtctccaatgagcactaacagttctgttcatacaggatcagatgtggagcaggatgccgaaaagaaggccacatccagtcatttttctgcttctgaggaatcgatggattttctggataagtcgacagcatccccggcgagtactaaaaccggccaggcaggatcactcagtggctctccaaaaccattctccccgcagttgagcgcccctattactacaaagacggataaaacctccactactggctctatcttgaacctgaacctcgaccgcagcaaggcagagatggaccttaaggaactgagtgagagcgttcagcaacagtcaacgccggttcccctgatcagccctaaaagacagattcggtctcgcttccagctgaatcttgacaagacaatcgagagttgtaaagcccagctgggtatcaatgaaattagcgaggacgtgtacacagctgtggaacatagcgatagcgaagactcagaaaagagtgactcatcggattcagaatatatatccgacgacgaacaaaaaagtaaaaacgagccagaggacactgaggataaggagggttgtcaaatggataaagagccctccgccgtgaagaagaaaccaaaacccaccaatcctgtggagattaaggaggaactgaaaagcactagtcctgccagtgaaaaggcagaccccggcgcagtgaaagacaaagctagtccagagcccgagaaagactttagtgaaaaggctaaacccagtccccatcctataaaagataagttaaaaggaaaggacgaaaccgatagccctactgttcatctggggttagatagtgactccgaatccgaattggtcattgacttgggggaggatcactccggcagggagggccgcaaaaataaaaaagaacccaaagagccatcaccgaagcaggacgtggttgggaaaacaccgccgtccaccaccgtcgggtcccatagcccgccagaaactccagtgttaactagaagttccgctcaaactagcgcggccggcgccaccgccactaccagcacttcttctaccgttacagtcacagccccagcacccgcggcaaccggcagtccggtgaagaagcagcgacctctgctccctaaagaaactgcccccgcagtccagcgggttgtttggaattccagcaccgtccagcagaaggaaattacgcagtcgccaagcactagcaccatcacattagttactagcacacaatcaagtcccctggtgactagttcagggagcatgtcaaccctggtgagtagtgtgaatgcggacctgccaattgccactgcatcagcggacgtcgcagcagacatcgccaagtatactagcaagatgatggatgccatcaaaggaaccatgaccgaaatctataacgatctgtccaaaaacaccactggctctactatagccgagattcgcagattgaggatagaaatcgagaagttacagtggctccatcagcaggaacttagcgaaatgaagcacaacctcgagctgaccatggctgagatgagacagagtctggaacaggagcgagaccgcctaatcgcagaggtcaaaaagcaactggagttagagaagcagcaggcagtggacgagaccaagaaaaagcagtggtgtgcgaactgcaagaaagaggctatcttctattgctgctggaatacgtcttactgcgactacccatgtcaacaggcccactggccagaacatatgaagagttgtacccagagtgccactgccccccagcaggaggccgatgcagaagtgaacaccgagactcttaataaaagttcacagggcagttcatcaagtactcagagcgcccctagcgaaaccgccagtgccagtaaggaaaaagaaacgtcagctgagaaaagtaaagagtccggctctaccctggacctgtccggatctagggaaacgccgtctagcattctcctcggtagcaatcagggcagtgtctccaagcggtgcgacaaacagcctgcttatgcccctactacaaccgatcaccagcctcaccccaattacccggctcagaaatatcactcacgcagcaacaaaagcagctggtcctcctccgacgagaagcgcggcagcacccggagcgaccacaacacctctacaagtacgaaatctctgctccccaaggaaagtcgcctggacactttttgggattag

SEQ ID NO: 14910 - DNA, 3291 bp, Artificial Sequence
  Description of Artificial Sequence: Synthetic coding sequence
tgaacagatcctgtcgacgtagtgccccaagacgggcggaacgatttctactgttgggtttgccacagagaagggcaggtgctgtgttgtgagctgtgtccccgggtttatcacgctaaatgcctgcgtttgacaagcgagccagagggcgattggttctgccctgagtgtgaaaaaatcaccgtcgccgaatgtattgagacccagtcaaaggcgatgactatgcttacaatcgaacagctgtcttacctgctgaaattcgctattcagaagatgaaacaacctgggacagatgccttccaaaaacccgtaccactggagcagcatcctgactacgccgagtatatctttcatcccatggacctgtgtactttggaaaagaacgctaaaaaaaaaatgtatggctgcacggaggcgtttctggcggacgcaaaatggatcctgcataattgtatcatttacaatggaggcaaccataagcttacgcagattgcgaaggtggtgatcaaaatatgtgaacatgaaatgaatgagatagaagtgtgccctgagtgctatctggcagcttgtcagaagcgcgacaattggttttgtgaaccgtgtagcaatccacaccccctggtttgggcaaaacttaaaggatttcctttttggccagcgaaggcattgagagacaaggacggacaggtcgacgctagattctttggacaacacgatcgcgcctgggtccccatcaataactgctatttaatgtcgaaggaaatcccttttagcgtgaagaaaacaaagagcatcttcaactccgcgatgcaggaaatggaagtatatgttgagaacatcagacgtaagttcggtgtgttcaattactcccccttcagaacaccctacactcctaattcccagtaccagatgctgctggatcccacaaatccctccgctggcacagctaaaatcgataaacaggagaaggttaaattgaactttgacatgaccgcctctcctaaaattctgatgtctaagccagttttatccggaggaacaggacgccggatcagcctgagcgacatgcccagaagtccaatgtcgaccaatagtagcgtacatactggctcagacgtagaacaggacgcagagaaaaaagccacctcctcacacttttccgcgtctgaagagtccatggacttcctagacaaatcaactgccagcccggcctcaaccaagacaggccaggctgggtcgcttagtgggtcgccaaaacctttcagcccacaacttagcgcccccatcactactaaaacagataagacctctaccacaggctccattttgaatttaaatctgggtcaccgcagtaaagctgagatggacctgaaggaactctccgaatcagtgcagcagcaaagcacaccagtgccactcatctcacccaagcgacaaattcgaagcaggttccagctgaatcttgacaagactatcgaaagctgtaaagctcagcttggcattaacgaaatctccgaagacgtttataccgcggtcgaacatagtgatagtgaggatagtgagaagtcagactcctctgactccgaatacatctctgacgacgagcagaagagtaagaatgagccggaagatacagaggacaaggaggggtgtcagatggacaaagagcctagtgccgttaagaagaaacctaagcctacaaaccctgtagagatcaaagaggagctcaaaagtacctcccccgccagtgaaaaagctgatccaggagcggtgaaagacaaggctagtcccgagccggaaaaagacttctccgagaaagccaagccatcacctcatccaatcaaagataaactaaagggaaaggatgagacagactccccaaccgtccatctggggctggattctgattctgaatccgaactcgtcatcgatttgggtgaggaccattctggccgggaaggccgcaagaataaaaaagagcctaaagagccctctcccaagcaggatgtggtcggcaaaacgcctccgagcacgacagtgggtagtcactctccccccgagacaccagttttgacccggagctccgcccagacttccgctgcaggtgccacagcgacaacctcaacatcctccacggtgacagttaccgccccagccccagctgcaaccggttctccagtgaagaagcaaagacccctcttgcccaaggagaccgcacccgccgtgcagcgagtggtatggaattcttccacagtccaacagaaagagattacacagagtccttcaacttctaccatcacactcgtgaccagtacccagtcctcccctctggtaacatctagtggttcaatgtctacattggtgagtagtgtcaacgctgatctgcccatcgctaccgccagtgccgatgtagccgcagacatagctaaatacacttctaaaatgatggatgccatcaagggtacaatgacagaaatctacaatgacctgagcaaaaatactactggctccaccatcgcggagattcggcgattgagaatagagattgagaagctgcaatggctacatcaacaagagcttagtgagatgaaacacaacttagagctaacaatggcagaaatgcgtcagtcattagaacaagagagggaccggcttattgctgaagttaagaagcagctcgaattggaaaagcagcaagccgttgatgaaaccaagaagaaacagtggtgtgccaattgcaagaaggaggcaatattttactgttgctggaacaccagttattgtgattacccttgccagcaggcccactggccggaacacatgaaaagctgcactcaatctgccacagcccctcagcaagaggctgatgccgaagtcaacactgagactctgaacaaaagttctcagggcagctcctcttccacacaatcagcaccaagcgaaacagctagtgcatcgaaggagaaagagactagcgctgagaaatccaaggagtcgggcagtacccttgacctgtctggaagccgcgagaccccgagttcaatccttcttggtagtaatcagggatccgtcagtaagcgctgcgacaagcaaccagcctacgctccaacaactactgaccatcagccacatccaaattatcctgcgcagaagtatcattctcgtagcaataaaagtagctggtcaagctcggatgaaaagcgtggtagcactcgatccgatcacaacacatcaacgtcaactaagtctctgctgccaaaagagagccgcctagacacgttctgggactag

SEQ ID NO: 14911 - DNA, 3726 bp, Artificial Sequence
  Description of Artificial Sequence: Synthetic coding sequence
atggtttttctggaagagtttgaggctcgatcttgtctcgccgaggaagaaattaagaccgaacaagaggtggtagaaggcatggatatatctacaagaagtaaagacccgggcagcgccgagagaaccgctcagaaacggaagttcccttccccaccccactcctccaacggacattcacctcaggatacatcaacgtctccgatcaagaaaaagaaaaagccgggcctcctaaactccaacaacaaagagcaatcggagttaagacatggccccttttactacatgaagcagcccctgacaacggatcccgttgacgtggtgccacaggacggaagaaacgacttttattgctgggtgtgccatcgggaggggcaagtcctttgctgcgaactctgtccccgggtatatcacgctaaatgcctgagattgacatctgaaccagagggggactggttctgtccagagtgcgagaagataaccgtggcagagtgtatcgaaacacagtcaaaggccatgacgatgctgaccatcgaacagctcagctacctgttgaagttcgccatccagaagatgaagcaaccgggcactgacgcttttcaaaaacctgtcccccttgagcaacatcccgactatgcagaatatatattccatcccatggatctctgcaccttggaaaagaacgctaagaaaaaaatgtatggctgcaccgaggccttcctggccgatgccaaatggatactccacaattgtataatttataacgggggtaatcataagctaacacaaattgcaaaagtagtgattaagatttgtgaacatgagatgaatgaaattgaagtgtgtcccgagtgctacttggcggcctgtcagaagagggacaactggttttgtgagccttgcagcaaccctcacccattggtgtgggcaaagctgaaggggttccctttttggccagccaaggccctgagggataaagacgggcaggtggacgcccgcttctttggccagcacgatcgagcatgggtcccaattaacaattgttacctgatgtcgaaggaaatccccttttccgttaaaaagacaaagtcaatcttcaactctgccatgcaggagatggaagtgtacgttgaaaatataaggagaaaattcggcgtgttcaattattctcccttcaggacaccctatacccccaactcgcagtatcagatgttacttgaccctacaaatccttccgccggaactgcaaaaatcgataaacaggagaaagtgaagctgaacttcgacatgacagccagccccaagatactcatgagtaagccagtcttatccggtggaactggtagacggataagtctgagcgacatgccgagaagccccatgtctacaaactcatcagtgcacaccggcagtgatgtggaacaggacgcagaaaagaaggcaacttcgagccatttctcagcctccgaggagagtatggacttccttgataagagtacagcgagccccgcgtctacgaaaaccggccaggccggctcattgagcgggtcaccgaagcccttctctccccagctgtccgccccaattactaccaagacagacaagacctctactacgggctcgattttaaacctgaacttagaccgctcaaaggcagagatggatctcaaggagctttccgagtccgtccagcagcaatctacccccgttcccctgatctcacccaaacggcaaatccgttccaggtttcaattgaatttagataaaactatcgagagctgcaaagcccagctcggaattaatgagatcagcgaagatgtgtatactgccgtggagcacagcgactccgaagatagcgagaagagtgactcttcagatagcgagtatatttctgacgacgagcagaagtcgaaaaacgaaccagaggatacagaagataaggaaggatgtcagatggataaagaacccagcgcggtgaaaaaaaagcccaagccaacaaacccggttgaaatcaaagaggaattaaaatccaccagccccgcaagtgagaaggctgatcctggtgctgttaaggataaggcaagtcccgaaccggaaaaagactttagcgagaaagctaagccaagcccgcaccccatcaaggacaagctcaaaggtaaagacgagacggactccccaacagttcacctgggactcgatagtgactccgagagcgagctggtgatcgatttaggtgaggatcattcagggcgagaggggcgcaaaaataaaaaagagccgaaagaaccttcgcccaaacaggacgtggtcggtaagaccccgcccagcactacagtgggtagtcacagcccgcccgagactccagtcctcacacggtcttctgcccagacgtcagcggctggagccaccgcaacaacatccaccagttcaacagtgacagtcactgcccccgcccccgcagccacaggctccccggttaaaaagcagcgccccctgctccctaaagaaaccgctccagccgtgcagagggtcgtctggaactcttcttctaagttccagacatcttctcaaaaatggcatatgcagaaaatgcagaggcagcaacaacagcagcagcaacagaaccagcagcagcaacctcagtcatcccaagggactcgctatcagacaagacaggctgtgaaggccgtccagcagaaggaaatcacgcaaagcccctccactagtaccataactttggtcacgtctacacagtcgagccctctggtgacctcctcggggtcaatgtccactcttgtgtcgtcagttaatgctgatctgcctattgcaactgccagtgcggacgttgccgctgacattgctaaatacactagcaagatgatggatgcaattaagggcaccatgactgaaatttacaatgatctgtctaagaataccactggttccaccattgcagaaattcgccggctccgtattgagatagagaagctgcagtggcttcatcagcaagaattgtccgagatgaagcacaatttagagctaacgatggcagaaatgcgacaatcactcgaacaggagagggatcgactcatcgctgaagtgaaaaagcaactcgagttggagaaacagcaggcggtagacgaaaccaagaaaaaacagtggtgcgctaactgcaagaaagaggctattttttactgctgttggaacacatcatactgcgattacccttgtcagcaagctcactggccagaacatatgaaatcttgtactcagagcgcaacagcaccccaacaggaagcggatgccgaagtcaataccgagactctgaataagtcctctcaggggagcagttctagcacccaatcggcccctagtgagacagcttcagcctctaaggagaaggagacatcagctgaaaagagtaaggaatcagggagcacattagatcttagtgggagcagggaaaccccatcttcaatactgctcgggagcaaccagggcagcgtcagtaagagatgcgacaagcagccggcctacgctcccacaacaactgatcatcaacctcaccctaattaccctgctcagaagtatcatagcaggagcaacaaatcctcatggtctagttctgatgagaagcgaggctccacaagaagcgatcacaatacttcaacttccactaagtcattgctgccaaaggaaagcagactagatacattttgggattag

SEQ ID NO: 14912 - DNA, 3405 bp, Artificial Sequence
  Description of Artificial Sequence: Synthetic coding sequence
atgcatccccaaagcctggccgaggaagaaatcaaaactgagcaggaggtggtagagggaatggacatctctactcgttccaaggaccctggatccgccgaaagaaccgctcagaaacgtaagttccccagtcccccgcacagctccaacggacacagcccccaagacacatctacttctcccatcaagaaaaagaagaagcctggactgctcaatagtaacaacaaggaacaggacggccgaaatgatttttactgttgggtttgccatcgcgaaggccaggtcctctgttgcgaactatgccctcgagtctaccacgccaagtgcctacggctcaccagcgagcctgagggggattggttttgtcccgagtgtgaaaagattacggtagctgaatgcattgaaacgcagtctaaggccatgactatgctgacgatcgaacagctgagctatctcctcaagttcgccatccagaagatgaaacagcctggaaccgacgcctttcagaagcctgtgcctctagaacagcacccggattacgcagaatatatctttcacccaatggacttatgcacattagagaagaacgccaagaagaaaatgtatggttgcaccgaggcttttcttgctgatgcaaagtggatcctccacaattgcataatctataacggaggaaatcacaagcttactcagatcgccaaggtggtgattaagatctgcgaacacgagatgaacgagatcgaggtttgtcccgagtgttacctggccgcctgccagaagcgcgacaactggttttgtgagccttgtagtaatccccacccattggtctgggccaagctcaagggattccctttctggcccgctaaagcacttagagataaggatggacaggtcgacgcgcgtttttttggacagcatgatagggcctgggtgccaattaataattgttatctgatgagcaaagagatccctttcagcgttaaaaagaccaagagtatatttaactctgcaatgcaggagatggaggtgtatgtggagaacatcaggcgaaaatttggtgtttttaactactcaccattcaggacgccgtacactcccaactctcagtaccagatgttgctagatcccacaaatccctcagccggtactgccaagatcgacaagcaggagaaggtgaaactcaactttgacatgacggcttcccccaagatcttaatgtccaaaccagttctgagcggaggaacaggaaggcgaatcagcctgagcgatatgcctcgatcacccatgtcaaccaattccagtgtccataccggctctgatgtggagcaggacgctgagaagaaagccacttctagccatttcagtgcgagcgaagaaagcatggacttcctcgacaagagtacagatagatctaaggcagagatggatcttaaggaattgtcggagagtgtgcagcagcagtccaccccggttcccctgatttctccaaagcggcaaatccggagtagattccaacttaacctggataagaccatcgagagctgcaaagcacagctcggcatcaacgagatctctgaggacgtgtacacagcagtcgagcactctgactctgaggatagcgagaaatccgattcctctgatagcgaatacatctctgacgatgaacagaagtcaaagaatgaaccagaggatactgaagacaaggaagggtgtcagatggataaggagccttcagccgtcaagaagaagcctaagcccactaaccctgtggaaataaaggaggaactgaagtccacgagccccgcctcagagaaagccgacccaggcgcggtgaaggacaaggccagccctgagccagagaaggattttagcgagaaagctaagccatctccccatccaataaaggataagttgaaaggcaaagacgagactgactcccctaccgtgcatcttggcttggactccgatagcgagtccgaactggtgatcgatctgggcgaggaccatagtggaagggaaggaagaaagaataaaaaagagccgaaagaaccgagccccaagcaagacgtggttggcaagactcctccatcaaccacagtgggaagccacagcccccccgagacacctgtcttaacacgtagctctgctcaaacttccgctgctggagctaccgctacaaccagcactagcagtacggtcacagtgactgctccggctcccgctgccactggcagcccagtcaaaaagcaacgccctttgctgccaaaagaaacagctcccgctgtgcagagagtcgtgtggaacagcagtagtaaatttcaaacaagtagccaaaagtggcatatgcagaagatgcagagacagcagcaacagcagcagcagcagaaccagcaacagcagccacagtcaagccagggcacccggtaccagacccgccaggcagtgaaggcagtgcagcagaaagagatcacccagtctccctccactagtacaatcaccctcgttacttcaacccagagttccccgctagtgaccagttcagggagtatgtcaacattggtttcaagcgttaacgccgacttgcccattgctacagcctccgccgatgtggccgctgatatagccaaatacacctctaagatgatggatgctatcaagggtacaatgaccgagatctataatgatctcagcaagaacacaaccggaagcacaattgcagaaatccgccgccttcggattgagatagagaagctgcagtggctgcaccagcaagagctgagcgagatgaagcacaaccttgaactcactatggcggagatgagacagtcactggagcaggaaagagatcgcttaatcgcggaggttaagaaacagttggagctcgagaaacagcaggccgtagatgagacaaagaaaaaacaatggtgcgctaattgtaagaaggaagccattttctattgctgttggaacacttcctattgtgactatccctgtcagcaagctcattggccagagcacatgaaatcttgcacacaatctgctactgcaccacagcaagaggccgacgccgaggttaacaccgaaactttgaataagtccagtcagggctcctcatcttcaacacagagcgctccgagcgagacggcttcagcgtctaaagagaaggagactagtgccgagaaatctaaggaaagcgggtctactttagacctcagcgggtcgcgggagactccaagtagtattctgttaggctccaaccaaggaagcgatcacagccgcagcaacaagtcgagttggtcaagctctgacgagaaacgtggctcaacccggagcgaccataataccagcacttctactaagtcactgctgccaaaagaaagccggctcgacaccttctgggattag

SEQ ID NO: 14913 - DNA, 2805 bp, Artificial Sequence
  Description of Artificial Sequence: Synthetic coding sequence
atggaagagcggagaccacacctcgacgccagaccccggaacagccacacaaatcatcgaggccctgtcgacggggagctgccgccccgcgcccgcaaccaggccaataacccccccgccaacgcgttgaggggaggagcatcgcaccctggaaggcacccgagggcaaataaccatcccgccgcatattggcagagggaggagaggttccgcgcaatgggtaggaacccgcatcagggacgcaggaaccaggagggacacgcttccgacgaagctagagaccagaggcacgatcaagagaacgacacgaggtggcggaatggaaatcaggattgcagaaacaggcgcccaccttggtctaatgacaattttcagcagtggaggacaccccaccagaaacctaccgagcagcctcagcaagctaaaaaactgggttataagtttttagaatctttgcttcagaaggatcctagtgaagtcgttattaccctggctacctcgttgggcctgaaggaactgctttctcattccagcatgaagtcaaactttctggagctcatttgccaggttcttcgtaaagcgtgcagctcaaagatggacagacagagtgtgctgcacgtgctgggtatcctcaagaactcgaaattcttgaaggtgtgtctgccagcatacgttgtgggcatgataacagagccgattccagatatccggaaccaataccccgaacatatctccaatattatttctttgctccaggatctggtgagtgtgtttcccgcatcgtcagtccaggaaacatccatgcttgtcagcctcctgcccacaagtctgaatgccctgagggcttccggagtggacatcgaagaagagaccgagaaaaatctggagaaagtccaaactatcattgagcacttacaagagaaacgccgagaaggcacgctcagggtagatacctatacactcgtgcagcccgaagcggaagatcacgttgagtcatacaggactatgcctatctatcccacttacaatgaagtacacctggacgagaggccctttctgagacccaacatcatctccggcaagtatgattcgactgcgatctacctcgacacgcacttccgcctgctccgcgaggactttgtccggccgctgagggaaggtatcctcgagctcctgcagagctttgaggaccaaggcttgagaaaacgcaagtttgacgatatcaggatttactttgatacacgaatcattacccccatgtgctctagcagtggaatagtgtataaggtgcagttcgacaccaaacccctgaagttcgtcagatggcagaacagtaagaggttactctatggatcactggtgtgcatgagtaaggacaatttcgagacctttctgtttgctacagtaagcaaccgtgagcaggaagatctatgcagaggaatcgtacaactgtgctttaacgaacagtcgcagcaactgctggcagaagtccagccttccgacagtttcctgatggtggagaccactgcttactttgaggcttacaggcatgtgctggaagggttacaggaggtgcaagaggaggacgtgccgttccagcggaacattgtggaatgcaactctcacgtcaaagagcctcgatacctgctgatgggaggacggtacgatttcacgccgctgattgagaacccctctgcaaccggcgaattcctgcgaaacgtggaggggctgcggcaccctcggataaacgtgctcgatccaggacaatggccatccaaagaggcgttgaaactggacgattcccagatggaggctttgcaattcgctctcactcgggagctggccatcatacaggggccaccgggcacaggaaaaacttatgtgggcctcaagatcgtgcaggccctgctgaccaacgaatcagtgtggcagatctctcttcagaagtttcccattctagtagtgtgctacactaatcacgcacttgaccagttcctggaagggatatataactgtcagaaaacaagcatcgtgcgagttggcgggcgtagcaacagcgaaatcctgaagcagtttactctgcgagaattacgcaacaagagggaattccggcgaaatttgcctatgcatttgcggcgagcttatatgtccattatgacccaaatgaaagaaagcgagcaagagttgcacgagggcgccaagacccttgagtgcactatgagaggtgtgttgagggagcagtatctccagaagtatatctctcctcaacattgggagtccctgatgaatgggcctgtgcaggactctgaatggatatgctttcagcattggaagcacagcatgatgctggaatggctcggattgggcgtcggatctttcacacaaagtgtgtcccctgcagggcccgaaaacactgcacaagccgaaggagacgaggaggaagagggtgaggaagagtcatctcttatcgagatcgctgaagaagcggacttgattcaggccgatagggttatcgaggaagaggaagtcgtgcgtccacaacgacgcaagaaggaagagagcggcgcagaccaggagcttgcaaaaatgctgctggcgatgaggctggaccactgcggcaccgggactgctgctggacaagagcaggctacaggcgagtggcagacgcagaggaaccaaaagaagaagatgaaaaaaagagtgaaggacgagctgcgcaaattgaatactatgaccgcagcggaagccaatgaaatagaggatgtgtggcaactggacctgtcttcacgttggcagttatactag

SEQ ID NO: 14914 - DNA, 5757 bp, Artificial Sequence
  Description of Artificial Sequence: Synthetic coding sequence
atggaagaaagaagaccccatcttgatgcccggcctagaaattctcataccaatcatcgcgggccggtggacggagagctcccacctagagctcgcaaccaagctaacaacccaccagcaaatgctctgcgcgggggggctagccatccaggccggcaccccagggccaataatcatcccgccgcctactggcaaagagaagagcgctttcgggcaatgggaaggaaccctcatcaaggaagacgaaaccaggaaggacacgcatctgacgaagcccgagaccagagacacgaccaagagaacgatacgcgctggcgtaatggcaatcaggactgtcggaaccgccgccccccctggtcaaacgacaatttccagcagtggagaaccccgcaccagaaacccactgagcaaccacagcaggccaaaaaactgggatataaattcctggagtcgctcctgcagaaagacccaagtgaagttgtgataactctggccacctcactcggattgaaagaactcttgtcccacagctcaatgaagtcaaattttctggagcttatctgccaagtgctccggaaagcttgttccagtaaaatggatagacaaagcgttctacatgtgctgggcatcctgaagaattccaaattcctgaaagtgtgtctgcccgcctatgtggtcggaatgatcaccgaacccatcccagatatccggaatcagtatcccgaacacataagtaacataatttctctgctacaggacctcgtctctgtgttccccgctagctctgtccaggaaacaagcatgctcgtgtcactgctccccacgtcgctgaacgcgctcagggcttccggcgtagacatagaggaagagaccgaaaagaacctagagaaagttcagacgatcattgagcacctgcaggagaagcgccgggagggcactctccgagtggacacatacacgttggtgcagcctgaggccgaggaccacgtagaatcctaccggacaatgcctatctaccctacctataacgaagtgcatcttgatgagcgtcctttcctgcgccctaatattatcagtggcaaatatgactcaacggcgatctacctcgatacgcattttcgcctgctgcgcgaagattttgttaggccactgagagaaggcatcctcgagctcctccagtcattcgaagaccaggggttgagaaaacgcaagtttgacgacatcagaatctactttgataccaggattatcactccaatgtgttccagttcgggcatcgtctacaaggtgcagtttgatactaaacctttgaagtttgtgagatggcaaaactccaaacgactgctgtacgggtctctcgtttgcatgtcaaaagacaacttcgagacctttctcttcgcaacggtttccaacagagagcaggaggacctctgcaggggaatagtacaactgtgttttaacgaacagtcccagcagctgctcgctgaggtgcagccatccgattcctttctcatggtggaaaccacagcttacttcgaggcctaccgccacgtattggagggcctacaggaggttcaggaggaggacgtcccttttcaaagaaatatcgtagagtgtaactcccacgtgaaggagcctcgctatctgctgatgggtggtagatacgacttcacccctctcatcgaaaatccctcagcaaccggtgaatttttaagaaatgtcgagggcctgcgtcaccctcggatcaacgtgctggaccccggacagtggccctctaaagaggcgcttaaattggacgattcccaaatggaggctctccagttcgccttaacaagagaacttgccataattcaaggcccacctggcacaggtaagacatatgtcgggcttaagatagtgcaggccctgctgaccaacgaatccgtctggcaaatctccttgcagaagttcccaatcctggtggtttgctacacaaatcatgcgctggaccagtttctggaagggatctacaactgccagaagaccagcatcgttagagtgggtggccgcagcaactcggaaatcctgaagcagttcaccctccgagaactcaggaataagcgagaatttaggcggaacttaccgatgcatctccgtcgggcctatatgtccatcatgactcaaatgaaagagtccgagcaggagctacacgaaggagccaaaaccctggagtgtacaatgagaggagtactgagggagcagtatttacaaaagtacatttcaccccaacattgggagagtctgatgaacggccctgtccaagactccgaatggatttgctttcagcattggaagcattccatgatgctggaatggctgggcttgggggtgggtagcttcacacaatcagtgagccccgccggaccagagaacaccgcacaggctgagggagacgaggaagaggagggcgaggaagagtcgagcctgattgaaatcgcggaagaagccgacctgatccaggccgaccgcgtgatcgaggaagaggaggtggttcgtccacagaggcgcaaaaaggaagagagtggcgccgaccaggagcttgctaagatgctcttggcaatgcggctggaccactgcgggaccggtacagctgccggacaagagcaggctacaggagaatggcagacacaacgcaaccagaagaaaaaaatgaagaagagagttaaggatgagttacgcaagctcaataccatgaccgccgccgaggcaaatgagatcgaagacgtgtggcaacttgacctgagctcacgatggcagctctatagactgtggctacagttgtaccaggccgacactaggagaaaaatcctgtcctatgagagacaatataggacatccgccgaaaggatggcagaactccgcctccaggaagatctgcacattttgaaagacgctcaggtggtcgggatgactactacgggtgcagccaagtatagacagatcctgcagaaggtggaacctagaatcgtgattgtggaggaagctgctgaggtgttagaggcgcatactattgccaccctgagtaaagcctgccagcacctgatccttatcggcgaccaccaacagctgcgcccctctgcaaacgtgtatgatctggccaaaaacttcaaccttgaagtgtctttgtttgagcgcctggttaaggtgaacattccatttgtgcgcctgaattaccaacaccggatgtgtcctgagatagccaggctgctcactcctcacatctatcaagatctggaaaatcacccctcagtgctgaaatacgaaaagattaagggagtgtcctctaacttgtttttcgtcgaacacaatttccctgagcaggaaatccaggaagggaaatcacatcagaaccagcacgaggcgcactttgtggtcgaactttgcaaatacttcttgtgccaggagtacctcccaagtcagattacaatcctgaccacctataccggacagctcttttgtctccgtaaactgatgccagctaagacgtttgcaggagtcagagttcacgtcgtggataagtaccagggagaagagaatgatatcatcctgttaagcctcgtacggagcaaccaggaagggaaagtggggtttctgcagatatccaaccgcatttgtgtggcactgtcccgagccaagaaagggatgtactgcatagggaatatgcagatgcttgccaaggtgcctctgtggtcaaagatcatccacaccctccgagagaataaccagataggtccaatgctccgactttgctgccagaaccaccctgaaacccacactctagtctcaaaggcctccgacttccagaaggttcctgagggcggatgctctctcccctgcgagttccgtctggggtgcggccacgtctgcacacgggcatgccatccgtacgatagctcgcataaagagttccagtgtatgaagccatgtcagaaagttatctgtcaggagggtcatcgttgccccctggtttgcttccaggaatgtcagccttgtcaggtgaaggtgcctaaaactataccacgctgtgggcacgaacagatggtgccctgctccgtgccagaaagcgatttttgttgccaggaaccatgctcaaaatcactgcggtgtggccaccggtgtagccacccttgtggggaagactgcgtacagctatgttcggagatggtgacaattaaactgaaatgcggccacagtcagcccgttaagtgcggccacgtagaaggtttactgtacggcggactccttgttaagtgtacaaccaagtgcgggactatcttggactgcggccatccatgtcccggtagctgccacagttgcttcgaagggagatttcacgagcggtgccagcaaccatgcaaacgactgttgatctgtagccacaagtgccaggaaccttgcatcggggagtgcccaccttgccagcgcacgtgccagaataggtgcgttcactctcaatgtaaaaagaagtgcggagagctctgctccccttgtgtggagccctgtgtctggcggtgccagcactatcagtgcactaagctatgctcagaaccctgcaaccgacctccatgctacgtgccatgtaccaaactgctcgtgtgtggtcacccctgcataggcctgtgtggcgagccttgccccaaaaagtgccggatttgtcacatggatgaagtgacccagattttttttggcttcgaggacgaaccagacgccagattcgttcaactggaagactgcagccacatctttgaggtgcaggcccttgatcgctacatgaacgagcagaaagacgatgaagtcgccatccggcttaaagtctgccccatttgccaagtgccgatcagaaaaaatctgcgttacggtacaagcattaagcagaggctcgaggaaatagaaataattaaagagaagatccaaggctctgccggggagatagccacttcccaagaacggcttaaggctctgctagaacggaagagcctccttcaccaactgcttcccgaagatttccttatgctcaaggaaaagctggcacagaagaacctgagcgtgaaggatctcggcctcgtggagaactatataagcttctacgaccacctcgcctctctgtgggattcactgaagaagatgcacgtgctggaggagaaaagggtgaggacccggctggaacaggtgcacgagtggcttgccaagaagagactcagtttcaccagccaggagttgtcagatcttagaagcgaaatccaacgattaacatatcttgtgaatctactgaccagatacaagatcgcggagaaaaaagtcaaagactctatcgctgtggaggtctactccgttcagaatatcctcgagaaaacctgcaagtttactcaagaggatgaacaacttgtccaggagaaaatggaagccctcaaggcgacacttccttgttccggtctggggatttctgaagaagagagggttcagatcgtatctgcgattggatatccccgggggcattggtttaagtgccggaatgggcatatctatgtaatcggggattgtggaggagcaatggagagggggacctgccccgattgcaaagaggtgattggtggcacaaaccacacgctggagcgaagcaatcagctggcttccgaaatggacggtgcacagcacgccgcctggtctgacacagccaataacctgatgaacttcgaagaaatccagggcatgatgtag

SEQ ID NO: 14915 - DNA, 3813 bp, Artificial Sequence
  Description of Artificial Sequence: Synthetic coding sequence
atggaggaaagacggccccatctggatgcacgacctcgcaactcacacactaatcataggggccccgtggatggggagctgccaccccgtgcccgtaatcaggccaataatccccccgccaatgcactacgtggcggcgcttcacacccagggcggcaccctagggccaacaatcaccctgcagcgtactggcagagagaggagagattccgggccatgggcagaaacccgcaccaggggcgtagaaaccaggagggccatgcctctgatgaagcacgggaccagcgacatgatcaagaaaacgacactcggtggagaaacgggaaccaagactgccgtaacaggcggccaccatggtccaacgacaacttccagcaatggcgcacccctcaccagaaacccactgagcagccccagcaagcaaaaaaactgggttacaaattcttagaaagtttactgcaaaaagatccaagtgaagtagtgatcacccttgcaacgtcactgggtttgaaagaactactatcacattctagcatgaaatccaatttcttggaattgatctgccaggtccttcggaaagcttgctcatccaaaatggaccgccagtctgtcttacacgtgttgggtattcttaagaatagtaaatttctgaaagtttgtcttccagcgtatgtcgtgggaatgatcacagaaccaatccctgatattaggaaccagtaccctgagcacatttcaaacatcataagcctgctacaggatctggtgtctgtctttcctgcatcctctgtgcaggagacctccatgctcgtttccttgctaccaacttcgctaaacgcgctgcgcgccagcggggttgatatcgaggaggaaaccgaaaaaaacctggaaaaggtgcagaccataatagagcacttgcaggaaaaacgtagagaggggactttacgagtggatacttacacgttggttcagccagaggcagaggaccacgtggagagttatcgcactatgccaatctacccaacatataacgaggttcacctcgacgaaagacccttcctcagaccgaatattatctctggaaagtatgattccactgctatttatcttgatactcatttcagactcctccgagaagacttcgtgcgacccttgagagaggggattttggaactgttacagagctttgaggaccaaggcttaagaaagcgtaagttcgacgatattaggatctacttcgatacccgaattattacgcccatgtgtagttcgagcggcatcgtgtacaaggtccagtttgatactaagcctctcaaatttgtgcggtggcagaacagcaagcgcttactatacggcagcctcgtttgtatgtctaaggacaacttcgagactttcctcttcgcgacggttagtaatcgggagcaggaggatctgtgtagaggtatagtacagctttgcttcaatgaacagtctcagcagctccttgctgaggtccagcccagcgactcattcctcatggttgagaccaccgcgtacttcgaggcttataggcatgtcttggagggtcttcaagaggtccaggaagaggacgtacccttccagcgtaatatcgtagaatgtaacagccacgttaaggaaccaagatacttgctaatgggcggcaggtacgatttcaccccactgatcgagaatcctagcgccaccggcgagtttttgagaaacgttgaggggttgcgccatccgcgaattaatgtcttggatccaggtcagtggcccagcaaagaggcacttaagctggatgattctcagatggaggccctccagttcgccctaacccgggaacttgccataattcagggacctcccggcactgggaaaacgtacgttggactgaaaatcgtgcaggccttgcttaccaatgagagcgtgtggcaaatttcccttcaaaaattcccaatcctggtagtgtgctacactaatcacgctctggaccagtttctcgagggaatatacaattgtcagaagacgtcaatcgtcagagtggggggacgaagcaattccgagattctgaagcagtttactcttcgggagttgagaaacaagagagagttcagacggaacctgcccatgcatcttcgccgtgcctatatgtctattatgacccaaatgaaagaatctgagcaggagctgcatgagggggcaaagacactcgaatgtaccatgaggggcgtcctccgcgaacagtacctccagaagtacataagcccacaacactgggagagtctcatgaacggacccgtccaggatagcgagtggatttgtttccagcattggaagcatagcatgatgctggaatggctaggattaggcgtgggctccttcacccaaagcgtaagtcccgctggtcccgagaatacagcacaggcagaaggcgacgaggaggaagagggagaggaggagtcctctcttatcgaaattgccgaagaggccgatctgattcaagctgatcgagtgatagaagaagaggaagtggtgagaccacagaggcgcaaaaaggaggagagtggtgcggaccaggagctcgcgaaaatgctccttgccatgcggctggaccactgtgggacaggcacggccgcaggccaagaacaggcaacaggcgagtggcaaacgcagcggaatcagaaaaagaaaatgaagaagcgtgtgaaggatgagttgaggaagctgaatacaatgactgccgctgaggccaacgagatcgaggacgtgtggcagctcgacttaagttcccggtggcaattgtaccggctatggctccagttataccaggctgatactagacgaaaaattctctcatatgagagacagtatagaacctcggccgagcggatggcagagctgcggctccaggaagaccttcacattctgaaggatgctcaggtagtgggcatgacaaccactggggcggccaaataccggcaaatcctgcagaaagtggagccccggatcgtgatcgtggaagaagcagctgaggtcttggaagcacacactatagccacactcagtaaagcatgccagcatttaatcctaatcggcgaccatcagcaactacgtccaagtgccaatgtgtatgatctagccaagaattttaatctcgaggtttccctttttgagaggctagtgaaagtcaacatcccctttgttagacttaactatcagcacaggatgtgtccagaaatcgcccgcctactcaccccacatatctatcaggacctggaaaatcatccgagtgttcttaagtacgaaaaaattaaggccaagtcaaactcatgtagagcgctggccaccgggatgcggcgaaaacacaagatctcagggatgattttaagcttcttcaaactcacgattaggagtgcccggtttcagctgctactgtccggtagctggaccacggccagcttcccttttagccgctcacgcttcgcggttctcatttgccgtgacaacaagcggatgcccgccgtgaaacccgtttccacaaacactggctcgcacggcctgcagatgcccggggccctcatgggggaaacattccagaaggggagcacttctcgggatgccgcggcttgtcttctgagttctctggtgaacaaaattcccccaagatccttaacttgggcttcagattgctgcatttcctttagcagtgcttcctcatgtcggacggcatacacttcattttccatcttttcgatcctgtcgagaaacctgcggatgacttcacagtgggaaaaaattaagcgcatttacaaatag

SEQ ID NO: 14916 - DNA, 5757 bp, Artificial Sequence
  Description of Artificial Sequence: Synthetic coding sequence
atggaggagcgcagacctcacctggatgcgaggccaagaaacagccatacaaaccacaggggccctgtcgatggtgaactgcccccccgggctaggaatcaggcaaacaacccacccgctaacgctctacggggaggcgcctcccatccgggacgacaccctcgcgccaacaaccatcccgctgcatactggcagagggaagaacggttccgagccatgggtagaaatccccatcagggacgacgtaatcaagaaggccacgcctcagatgaagctcgggatcagagacatgaccaggaaaatgatactcgctggaggaatgggaaccaggactgccgtaaccgacggcccccatggtctaacgataactttcagcagtggcggacaccacatcagaaacctaccgagcagccacagcaagctaagaagctggggtataagttccttgagtccttactccagaaggacccaagcgaggtcgttataacgctcgccacgagtctcggtctgaaggagctcctctctcactcctcgatgaaatctaatttccttgaactgatttgccaggtccttcgtaaggcatgcagttctaaaatggaccgtcaatcagtgttgcacgtgctcggcattttaaaaaattccaagttcctaaaggtatgtctccctgcctatgttgttgggatgattacagaacctattccagacattcgcaatcagtatcctgaacatatttccaacattattagtctcctgcaggaccttgtgagtgtgtttccagcctcttccgtccaggaaacatctatgttggtaagcttgcttcccacttccctgaatgcccttcgcgcgtcaggcgtggacatcgaggaggagactgagaagaatctcgagaaggtgcaaaccataattgagcacctgcaagaaaaacggagagaggggaccctgcgcgtggatacctacacactcgtgcaaccggaagctgaggatcacgtggagtcctatcggactatgcctatctacccaacctacaacgaagtgcatctggacgagaggccatttctgcggcccaatatcatttcaggcaagtacgattctacagctatataccttgatactcatttcagactgctgcgcgaggatttcgttaggcctctgcgtgaaggaatcttggaactcctacagagcttcgaggatcagggactacgcaagagaaagtttgatgacattagaatatattttgacacccggatcatcacgcctatgtgttcctctagcggtatcgtgtacaaggtgcagtttgacacaaaacctctgaaattcgtgagatggcaaaattctaaaaggttgctttacggtagcttggtgtgtatgagtaaagataacttcgaaacattcctgtttgccacagtgtcaaatagggaacaggaggacttatgtcgcgggattgtacagttgtgtttcaacgagcagagtcaacagttattggccgaagtacaaccctccgactcctttcttatggtcgagacaactgcctactttgaggcttaccgccacgtgctggaaggcctccaggaggtccaagaagaggacgtgcccttccaacgtaatatagtggaatgtaatagtcacgtgaaggaacccaggtacttgctgatgggaggtaggtatgactttacgcctctgattgagaatccaagcgccacaggagagttcctgcgcaatgtagaaggccttcggcatccccggataaatgtgctggatccagggcagtggcctagcaaagaggcccttaaactcgatgattctcagatggaggcccttcagtttgctcttactagggaactcgccattattcaggggccacctgggacaggtaagacctacgtaggcctgaaaatagttcaggccctgctgaccaacgagtccgtatggcaaatcagtctccagaagttcccaattcttgtggtctgctataccaatcatgctctcgaccagttcctggagggaatttacaattgtcaaaaaacctcgattgtgagggtcggcggtagatccaactccgaaatactcaaacagtttacgttgcgcgagttgaggaacaagcgcgagttcagaaggaatctgcctatgcacctgcgaagagcatacatgagcattatgacccagatgaaagagagtgaacaggaacttcacgagggagccaaaactttggagtgcacaatgaggggagtgctgagggagcagtatttgcaaaaatacatatcacctcaacactgggaatccttaatgaacgggcccgtgcaagactctgagtggatttgttttcagcattggaagcactctatgatgctggagtggctcggccttggagtcggttccttcacacaaagtgtgtcacctgccggtccagagaacaccgcacaagcagagggagatgaggaggaagagggagaggaagagagctccttgatagaaatcgctgaagaggctgacttgatacaagccgatagagtgattgaagaagaggaggtcgtcagaccacagcggcggaagaaagaggagtcaggcgccgatcaagagctggcaaagatgttactcgccatgagactggaccactgcggtaccggcacggccgcagggcaggaacaagccacgggcgagtggcaaacacagcgtaatcagaagaagaagatgaagaaacgcgtaaaggacgaactgagaaagctgaacacaatgaccgccgccgaggctaacgaaatcgaggacgtttggcagctggatttgagcagccggtggcagctgtaccggctgtggctccaactgtaccaagctgataccaggcggaaaattttgagttacgagagacaataccggacgtctgccgaacgcatggccgaactccgcctgcaggaagacctgcacatcctcaaagacgctcaggtggtgggtatgacaaccacgggcgctgccaaataccgtcagattctccaaaaagtcgagccgcggatcgtgattgtagaggaagctgcagaagtgctcgaagcccataccattgctacattgtccaaggcctgccaacacctgatccttataggggatcaccaacagctgagaccatcagccaatgtgtacgacttggctaagaactttaacctggaggtgtcgctgtttgagagactggtgaaggtgaatatcccctttgtccggttaaattaccagcaccggatgtgccccgaaattgcccggcttttgactcctcatatctatcaagacctcgagaaccatccgtccgtcttgaaatacgagaagattaagggcgtctcgtctaacttgttttttgttgagcataactttccggagcaggaaatccaagagggtaaaagccaccagaatcagcatgaagcacacttcgtcgtcgagttgtgtaagtattttctttgtcaggagtacctccctagccagatcacaatcttgaccacatacactggacaattgttttgtctgagaaagctcatgcctgcgaagacttttgccggcgtccgcgttcatgtggtggataaataccagggagaggagaacgacatcatcctcctgtccttggtaaggtctaaccaggaggggaaagtcgggtttctgcagattagcaacaggatttgtgtggctcttagtcgagctaaaaaaggtatgtattgcattggaaacatgcaaatgttagctaaggtcccactgtggtccaagatcatccacaccctaagggaaaacaaccagatcggaccaatgctgagactctgctgccaaaaccatccagagacccatactctagtttctaaagcgagtgactttcagaaggtccctgagggaggatgctctctcccttgcgaatttcgcctaggctgcgggcatgtgtgtaccagggcttgtcacccctacgactctagccacaaggaatttcaatgtatgaaaccatgtcagaaggttatttgtcaagagggccaccggtgcccactggtttgttttcaggaatgtcaaccctgtcaggtgaaggttccgaaaaccatccctcgatgcgggcatgagcagatggtgccctgctctgtgcccgagtccgacttttgctgccaggaaccttgtagcaaatctctgagatgtgggcatcgatgctcccacccttgtggagaggattgtgtgcagctgtgttccgagatggtcaccataaagctgaagtgcggacatagtcagcccgtgaaatgtggccacgtggagggactcttatacggcggcctgctggtgaaatgcaccactaagtgcggcactattctggattgtggacatccatgtccggggtcatgtcactcttgctttgaaggccgttttcacgaacggtgccagcagccttgtaaaaggctgctcatttgctcccataaatgtcaggagccatgtatcggggagtgcccgccatgtcagagaacgtgccagaaccgatgtgtgcactcgcagtgcaagaagaagtgcggagagctgtgttcaccatgcgttgagccttgcgtatggaggtgccaacattatcaatgcacgaagttatgctcagaaccatgcaatagaccaccctgctatgtgccatgcaccaagttgctcgtgtgcgggcacccttgcatcggtctttgcggggagccttgccctaaaaagtgcaggatttgccatatggacgaagttactcagatcttcttcggctttgaggatgaacccgacgcacgctttgtgcagctggaagattgcagtcatatctttgaagtgcaggccctggataggtacatgaatgaacaaaaggacgacgaagtggcaataagactcaaggtgtgccctatctgtcaagttcccatcagaaaaaatttgcggtacgggacctccattaaacagaggctggaagagattgagatcatcaaggagaagatccaagggtctgccggcgagatcgccaccagccaggaaagacttaaggccctgctagagaggaaaagtttgctacaccagttgctcccggaggactttctaatgctgaaggagaagctcgcacaaaagaacctgtctgtgaaggaccttggactagtggagaattacatctccttttatgatcacctggctagcctttgggacagcctgaagaaaatgcacgtccttgaagaaaaacgagtgcgaacgaggctcgaacaggttcacgagtggttagccaaaaaacggctctctttcacctcccaggagctctccgacctcagaagcgagatccagcgcctcacatatcttgtcaacctgttaacccgctacaaaatcgccgagaaaaaagtcaaagattccatagccgtggaagtctatagcgtccagaacatcctagaaaaaacttgcaagtttacccaggaagacgaacagcttgttcaggaaaaaatggaggctttgaaagcgaccctgccctgcagtggcctgggcattagtgaagaagagagggtgcagatcgtgtcggcaatcggttatccacggggccattggttcaagtgtaggaatggacatatctacgtcatcggggattgtggtggcgccatggagagaggcacttgcccagattgtaaagaggtgattggtggaacgaaccacacactagagcgcagtaaccaattggcatcagagatggatggcgcccagcatgctgcatggtccgatactgctaacaatcttatgaatttcgaggagattcagggaatgatgtag

SEQ ID NO: 14917 - DNA, 2748 bp, Artificial Sequence
  Description of Artificial Sequence: Synthetic coding sequence
atggaagaacgccgtccccacctcgatgcccggccacggaattctcacactaaccaccgtgggcctgtggacggcgagctgcctccacgcgcaaggaatcaagctaacaaccctcctgccaatgccctgcgaggaggcgcctcccaccctggaaggcatcctagagctaataatcatcccgccgcctactggcaacgggaggagcggttcagagcaatgggacgcaacccccatcagggtaggcgcaaccaggaaggacatgcctctgatgaagctagagaccagcgacacgatcaagagaatgatacacgctggcgcaacgggaaccaagattgtaggaaccgacggcccccatggagtaatgacaacttccagcagtggaggaccccacaccagaaacctactgagcagccgcaacaagccaagaaacttggatacaagttcctggagtcccttttgcagaaggaccctagcgaagtggtgataactctggctacgagccttggtctcaaggaactcctgtcccacagtagcatgaaaagtaactttctggagctgatatgtcaagtccttcgcaaagcctgcagctctaaaatggataggcagtctgtgctacacgttcttggaatcctgaagaactctaagtttcttaaagtgtgcctgcccgcatacgttgttggaatgataacagaaccaattcctgatatccgcaaccaatacccagagcacatttccaacatcatttctctcctgcaggacctggtcagtgtgtttcccgcttctagcgtacaggaaacctcgatgctggtctccctcttacctacctcccttaatgctctacgcgccagtggggtcgacatcgaagaggagactgagaaaaacctggagaaagtccagaccatcatagaacatttacaggagaagcgacgcgagggaacgctgagagtagacacatacacactcgtccagcccgaggcagaagaccacgtggagtcctatcgcactatgcctatttacccaacctataacgaggtacacctggacgaaaggccgtttttgcgcccgaatatcatcagtggcaagtatgactccaccgcgatctatttagatacgcatttccggctgttgcgcgaggatttcgttcgcccccttcgcgaaggaattctcgagctgctgcagagcttcgaggaccaaggattgcggaaacggaaatttgacgacatcagaatctacttcgacacccgcataatcacgcctatgtgtagctcaagtggcatcgtttacaaagtgcagtttgatactaagcctctgaaatttgtacgctggcagaattcaaagcgtctcctctacggaagcttggtttgcatgagcaaagacaattttgagaccttcctcttcgccacagtaagtaatagggagcaggaagacttgtgcaggggaatcgtccagttgtgctttaacgagcagtcccagcagctgcttgcagaggttcagcccagtgatagctttttgatggtggagacaactgcctattttgaagcatatcgtcatgtccttgaaggattgcaggaagtccaggaagaggacgtccccttccagcgtaacattgtcgagtgtaactcacacgttaaagagccaaggtacctactcatgggtggcagatatgacttcactccgcttatcgagaacccatccgccacaggcgagttcctgcgcaatgtcgaaggtttgcgtcatccccgaatcaacgtactcgacccagggcaatggcctagcaaggaagctctgaagcttgatgactcccaaatggaggctctgcaattcgcattgactcgggaactcgccattattcagggcccccccggtacagggaagacatacgtcggactcaaaattgtccaggctctgctcactaatgagtctgtttggcagatctcccttcaaaaatttcccattctggtggtttgctacaccaaccacgccctggatcaatttctcgaaggaatctacaattgtcagaaaactagtatagtgcgagtcggtggaaggtccaatagtgagatcctgaagcaatttaccctgagggaactcaggaacaagcgagaattcagaagaaatctgcccatgcacctgcggagggcatacatgtccattatgacacagatgaaggaatccgagcaggaactgcatgagggcgccaagactttggaatgtaccatgaggggcgtgctgagggagcaatacttgcagaagtacataagcccccagcattgggagagcttgatgaatgggcctgtacaggacagcgaatggatctgctttcaacactggaagcactctatgatgttggagtggttaggactcggcgtgggctccttcacgcagagcgtctctccggccggccctgagaacacagctcaagccgagggggacgaggaagaggagggggaggaggagagctcattaatcgaaatcgcagaggaggctgatctaattcaagctgatcgggtgattgaagaggaggaagtggtgaggcctcagagacggaaaaaagaagagagcggagccgaccaggagttagcaaagatgctcttagctatgcgcctcgatcactgcggtactggaaccgctgcgggtcaggagcaggctaccggggagtggcagacacagcgaaaccagaaaaaaaaaatgaagaaaagagagaaagaggaaaaaaaagagcgagaaaagagacgcaagaaaaaatag

SEQ ID NO: 14918 - DNA, 2124 bp, Artificial Sequence
  Description of Artificial Sequence: Synthetic coding sequence
tccaagatggacagacagtctgtgttgcacgtactcggaatcctcaagaactcgaagttcctgaaagtgtgcctccctgcctacgtggtgggaatgatcaccgaacctatccctgatatcagaaaccagtacccagagcacatctcaaatatcatatccctcctgcaggatctggtttcagtttttcccgccagctctgtgcaggaaactagcatgctggtgtctctgttgcccacctcattgaacgcattgagggcttccggtgtagacatcgaggaagagacagagaagaacctcgaaaaggtgcagaccattattgagcatcttcaggagaaaagaagagaaggcacactccgagtggacacttataccctggtgcagccagaggccgaggaccatgttgagtcctataggaccatgccgatatatccaacatacaacgaggtgcacctcgatgaaaggccattcctccgccctaatattatcagcgggaaatacgactccaccgctatttacctggatactcacttccgtcttctgagagaagacttcgtgcgtccactgagagagggtatccttgagttgttgcaatcctttgaggatcagggcttgcgcaaacggaagttcgacgacatcaggatatacttcgacactaggataatcactccaatgtgcagttcgagcggcattgtatacaaagttcagttcgataccaagcctcttaagttcgtgcgctggcagaacagcaagcgtctcctctacggctccctagtgtgcatgagcaaggataattttgaaacctttctctttgctaccgtgagcaaccgggagcaggaggatttgtgccgcggtatcgttcaactctgtttcaatgaacagagccagcagctgctggccgaagttcagccatcagactccttccttatggtggagaccacagcatatttcgaggcctaccgccacgttcttgagggattacaggaagtgcaggaggaggacgtgccattccagaggaacattgtggaatgtaattctcacgtgaaagaacccagatacctgctgatggggggccggtacgacttcacaccactaatagaaaacccaagcgcaaccggcgaattccttaggaatgtggaaggtctgcgtcatcctagaataaacgtgctggaccccggccaatggcccagcaaggaggctctgaaactggacgattctcaaatggaggctctgcagttcgcgctgaccagagaattagctattatccaggggccccccgggacaggcaagacatacgtgggccttaagattgtgcaggccctcttaactaacgagagtgtgtggcaaatcagcctccagaagttccctatcttagttgtctgctatacaaatcatgcccttgatcagttcctggaggggatctacaactgccagaagaccagtatcgtgagggtgggaggaagatcaaactccgagattcttaaacagttcacattgcgagagttgaggaataaacgagagttccgccgcaacctgcctatgcatcttcggagggcgtacatgtctatcatgacgcagatgaaggagtctgaacaggagcttcacgagggcgctaaaactttggagtgtacaatgaggggagtgctgagagaacaatacctgcagaaatacatctccccacaacactgggagtcgttaatgaacggccctgtacaagatagcgagtggatctgctttcaacattggaagcactcaatgatgctggagtggcttggtctaggggttggctccttcacacagtctgtatccccagctggccctgagaatacagctcaggcagaaggcgacgaggaggaagaaggggaagaagagagctctctgattgaaattgctgaggaggcggatttaattcaggccgaccgggtaatagaggaggaagaggtagtcagaccccaacgacgcaagaaggaggagagtggggctgatcaagagcttgctaagatgttgttggctatgcggcttgaccactgtggcactgggacggctgctggacaggaacaggctaccggcgaatggcagacggttccttgtctcgtgcttatgagcgctgatcccgcccagccctag

SEQ ID NO: 14919 - DNA, 186 bp, Artificial Sequence
  Description of Artificial Sequence: Synthetic coding sequence
atggaggagaggcgaccacacctggacgcaagaccccggaatagccacaccaaccaccggggcccagttgatggtgagctgcctccaagagcagaaatcatgcctctgcattcaagtctgggtgaccgttctaaaaccctatcacaaaagaagaaatcgttttttcttgtgttagctccgacatag

SEQ ID NO: 14920 - DNA, 963 bp, Artificial Sequence
  Description of Artificial Sequence: Synthetic coding sequence
atgtctactaagaattttcgggtttccgatggtgattggatctgccctgacaagaaatgtggaaacgtaaattttgctcgcaggacgtcatgtaaccgctgcggcagggaaaagacgaccgaggctaagatgatgaaggccggcggtacggagattggaaaaacactcgccgagaagtcccggggtttgttcagtgcaaatgactggcagtgcaagacatgttctaacgtcaactgggccaggcggtccgaatgtaatatgtgcaatacccccaagtatgctaaactcgaagagagaacagggtatggaggcggtttcaacgaaagggagaacgtggagtatatcgaacgagaagaatctgacggagaatacgacgagtttgggcggaagaaaaaaaaatatagaggcaaagcagtgggtcccgcctcaatcttaaaagaggtcgaggacaaagagtcggagggtgaagaagaggacgaagacgaagacttgtccaagtataaactggacgaagatgaggatgaggatgatgcggacctgtcgaagtataacctagatgctagtgaggaggaggactccaacaagaagaaatctaaccggcgctcacgttctaagtctcggtcaagccactctcgctcttcctctagatcatctagtccgtcaagctcccggagtaggagcagaagtaggtctcgctcgtcctcctccagccaaagccggagccgcagctcttcaagagagcgcagccgtagtagagggtcgaaaagccgaagctcaagccgaagccacagaggcagttcatctccccgcaagcgctcttattctagttctagtagcagcccagagaggaacaggaagcgcagtcggagtcgctcgtcatccagtggggatagaaaaaaacggcgtactcggagcaggtcgccagagtcacaggtgatcggagaaaatacgaagcagccgtag

SEQ ID NO: 14921 - DNA, 993 bp, Artificial Sequence
  Description of Artificial Sequence: Synthetic coding sequence
atgagcacaaagaatttcagggtgtccgacggagattggatctgtcccgacaaaaaatgcggtaacgtcaatttcgctagaaggacatcttgcaatagatgcggacgagagaaaacaactgaggctaagatgatgaaagccggcggaaccgaaatcggcaagactcttgccgaaaagtcacgaggactcttctcagccaatgattggcagtgtaagacttgttccaacgtgaattgggccaggcgcagcgaatgtaatatgtgtaacactcctaagtacgcaaaactggaggagagaacgggttatggcggagggtttaacgagagagaaaatgtagaatacatcgaaagagaagagtccgacggcgagtacgacgagtttggtcggaaaaagaaaaaataccgaggtaaggccgtcggccccgcatccattcttaaggaggtggaggacaaagaatccgaaggggaagaggaggacgaagacgaagacctctccaaatataaactcgatgaggatgaagacgaggacgatgccgacctttcaaagtacaatctggacgccagcgaggaagaggactcaaataagaaaaagtccaatcggcggagccgaagcaagtcgaggtcttctcattcgaggtcaagtagtagatctagctcaccctccagctctcggagtaggtcccggtcccggagcagatccagtagctctagtcagagtcggtctcgatcttcatcaagggagcgaagccgtagcagagggtctaagtcccgaagttcgagtcggagtcacagaggctcttccagtccgagaaaacgatcatatagtagttcgagcagctcacctgaacgcaacagaaagcggtcaagatccaggtccagttccagcggggaccgcaagaaacggagaacgaggtccagatctccagaacggaggcataggtcgagctccgggagttcgcactcagggtcccgtagttcctccaagaagaaatag

SEQ ID NO: 14922 - DNA, 1458 bp, Artificial Sequence
  Description of Artificial Sequence: Synthetic coding sequence
atgttggagagactcaaggccccttggagcgccgcactgcagcgaaaatacttcgatctggggatctggactgccccgatctcacctatggccctaacaatgcttaacgggcttcttattaaggactcctccccgcctatgctcctgcatcaggttaacaagacagcccagctcgacacctttaattaccagagttgttttatgcagagcgtgtttgatcattttccggaaattctgtttatccatcggacctataatccaagagggaaggtgctgtataccttcctggttgatggcccacgcgtgcagctagaaggacatctcgctagggccgtgtatttcgccatccccgccaaagaagacaccgaaggactggctcaaatgtttcaggtattcaaaaagttcaaccccgcatgggaaagagtgtgcacgattctggtggatccccacttcctcccgctgcctatcctggccatggaatttcccacagcggaggttctgctgtccgcattccacatctgcaaattcttacaggccaaattttaccagctgtctttggaaagaccagttgaaagactgcttctgacttctctgcaaagtacaatgtgttctgccactgccggcaacctgcgaaaactgtacaccttactttcaaattgcattcctcctgctaagctacccgaattacactcccactggctgctgaacgatcgaatctggctggcccataggtggcgatcacgagccgaatcgtcgcattacttccaatctcttgaggtcactacacatatcctaagccagtttttcggcacaactccatctgagaagcagggcatggctagcctgtttagatacatgcagcagaacagcgccgataaggcaaacttcaatcagggcctgtgcgctcagaataatcatgcacccagcgacacgattcccgaatctcctaaactggagcagttggtagagagccatattcagcatagcctcaatgctatttgcacaggacccgcagcgcaactctgtctgggcgaactagcggtggtgcagaaatcaacccacctgattggaagtggctcagagaagatgaatatccaaatcctggaagacacccacaaggtgcagccacagccaccggctagttgctcttgctactttaatcaggcctttcatctgccgtgtagacacatcttggcgatgttgtccgccaggcgacaggtccttcagccagacatgctacctgcacagtggaccgcaggatgtgcaacatccctggactcaatcctggggagcaaatggtccgaaaccctggataagcatcttgcagtcacccatcttaccgaggaggtcgggcagttgttgcaacactgcactaaagaagagttcgagcgaagatatagcaccctccgggagttagcggacagttggatcggaccatacgaacaagtgcagctgtag

SEQ ID NO: 14923 - DNA, 1458 bp, Artificial Sequence
  Description of Artificial Sequence: Synthetic coding sequence
atgctggagagactcaaggccccctggagcgcagccttacaacgtaagtactttgaccttggaatctggacagcacccattagccccatggcccttaccatgctgaacggattgctgataaaagactcctcccctccgatgctgctacaccaggttaataagacagctcagttagatacctttaactaccagagctgttttatgcagtcggtttttgaccacttcccagagattttgttcattcaccgcacctacaatcctcggggaaaggttctatacaccttcctggtggatggacccagagttcagctggagggacatctcgccagggctgtgtactttgcaatcccagccaaggaagatacggagggactggctcaaatgtttcaagtgtttaagaagttcaaccccgcgtgggaaagagtgtgcacgattttagtcgacccccactttctccctctccccatcttagccatggaatttcccaccgcagaggtcctgctgtctgcatttcacatttgcaagttcttgcaggctaagttttatcaactgagcctggagcggccagttgagagactgctcctgacttcattgcaatccaccatgtgctccgccacagccggaaacctaagaaaactctataccttacttagtaattgtatcccccctgccaagctaccagagctccactcacattggctcctcaacgaccgaatctggcttgcccacaggtggaggagtagggcagagtcttcacattacttccaatcattagaagtgacaactcacattttatcacagttttttgggacaactccctccgagaagcagggcatggcttctctcttcagatacatgcagcagaattcagcggataaagccaatttcaaccaggggttatgcgcccagaacaatcacgcaccgagcgacacaataccagagtccccaaagttagaacagctagtggagagccacattcaacactccctgaatgccatttgtaccggtcctgccgcccaactttgcctaggtgagctggccgtggtgcaaaagagtactcatctgattgggtccggttcagagaagatgaacatccagattctcgaggatacccacaaggtccaaccacaaccgcctgccagctgcagctgctatttcaatcaggcattccacctgccgtgccgccatattttggccatgcttagtgctcggcgacaagtccttcagccagacatgttgcctgcacagtggacagcaggctgtgcaactagtctggatagcatcttgggatcaaaatggtctgaaaccctcgacaagcacctggccgtcactcaccttacagaagaggtggggcaactcttgcagcattgtacaaaggaggagttcgaacgaagatacagcaccctgcgcgagctcgccgattcttggatcggaccctatgaacaagttcaactgtag

SEQ ID NO: 14924 - DNA, 423 bp, Artificial Sequence
  Description of Artificial Sequence: Synthetic coding sequence
atggctgttgtgttaccggctgtggtcgaggagcttctttcagagatggctgccgctgttcaggagtccgcccgtatccccgacgaatacttattatccttaaagtttttatttggttcttcggccacacaagcgctggatctagtagacaggcagtccatcacattaatatcatccccctctgggcggcgggtgtaccaggtcttaggaagcagtagcaaaacttatacttgccttgcctcctgccattactgctcctgtcccgcatttgccttctcagtcctaagaaaaagtgactcaattctgtgtaagcaccttctagcagtctacctgagccaggtgatgcggacctgccagcaactgtccgtgagtgacaagcaactcaccgacatacttcttatggagaagaaacaagaggcttag

SEQ ID NO: 14925 - DNA, 423 bp, Artificial Sequence
  Description of Artificial Sequence: Synthetic coding sequence
atggccgttgtactcccggctgttgtggaggagctgctctccgaaatggccgccgccgtgcaagagagtgccagaatccctgacgagtatctgttatccctgaaatttctttttggttcttcagccacacaggccctcgacctggtggatcgtcagtctataacactgatctcctcaccgtctggtcgacgggtctatcaggtgctcgggagctccagtaagacctatacctgcttggcgtcctgtcactactgctcctgtcctgccttcgccttcagcgtgctcagaaagtccgattctattctgtgtaaacatctgcttgctgtttatctctctcaagtgatgaggacttgccagcagctttctgtgtccgataagcagctcaccgatattttgctgatggagaaaaagcaggaggcctag

SEQ ID NO: 14926 - DNA, 1230 bp, Artificial Sequence
  Description of Artificial Sequence: Synthetic coding sequence
atgattgatctatggctatactcttaccagcggcttctccaaacaatcgcggtcttggaggcacaacgatcacaagccgtacaggatctggaatccctgggtaggcatcaaagagaggcacttaaaaaccccataggatttgtggaaaagttgcagaagaaggccgatatcggcttaccgtatcctcagagagtggtccagctcccggagatcgtgtgggatcagtatactcacagtctggggaactttgagcgcgagttcaagaaccggaaacgtcatactcgtcgagtaaagctagtcttcgataaggtcggtctacctgctagacctaagtctccccttgacccaaagaaggatggcgaatctctcagctactccatgctgccactgtccgacggaccggaagggtcttcttccagacctcaaatgatccgggggcgcctgtgtgacgacacgaagccagagacttttaatcaactctggacagttgaagagcagaaaaagctagagcagctcctcattaaataccctcccgaggaagtggagagccggcgttggcagaagatcgcagacgaactgggaaaccgcaccgcaaaacaggtggctagtcgtgttcagaaatattttatcaagcttactaaagccgggattcctgtcccgggacggacccccaatctgtatatttactctaagaaatcctcaacgtcacgtagacagcatcctctaaacaagcatctatttaaacctagtacttttatgacctctcacgagccaccagtgtacatggacgaagatgacgacaggtcatgctttcactcccacatgaacaccgcagtggaggatgctagcgacgatgaatccattcccattatgtaccgcaaccttcccgaatataaggagttgctgcagtttaagaaacttaaaaaacaaaagctgcaacaaatgcaagccgagtccggtttcgtacagcacgtcggttttaagtgcgacaactgcgggatcgagcccatacagggcgtgcgctggcactgccaagactgccctcctgagatgtcactggacttttgtgactcatgttccgactgcctgcacgagaccgacattcacaaggaagaccatcagctggaacccatttacaggagcgaaacttttctggatcgcgattactgcgttagtcaaggcacgtcatacaactatctggaccccaactactttcccgctaaccgctag

SEQ ID NO: 14927 - DNA, 2712 bp, Artificial Sequence
  Description of Artificial Sequence: Synthetic coding sequence
atggccgcttcccgctcaactcgggtgactcggagcaccgtcgggttgaatgggctggatgagtctttttgcggcaggactctgcggaacaggtcaatcgcacatcctgaagaaatcagttcgaattcccaggtgagatcccggtcacctaaaaaacggccagagcctgtacccatacagaagggtaataacaacggaagaacaacggatctaaaacaacagtccactagggagtcctgggtgtcaccccgtaagcgcggcctcagtagcagtgaaaaggacaacattgaacgtcaagccattgaaaactgcgagcgcaggcagacagagccagtatccccagtgttaaagaggatcaagagatgcctcagatctgaggctcctaactcttcagaggaggacagcccaatcaaaagcgataaggaaagcgtcgagcaacgaagcacagtggttgacaatgacgcagatttccaagggaccaagagggcatgtagatgcctgatcctggatgattgcgagaaaagggagatcaagaaggttaacgtcagcgaggaagggcctttaaacagcgccgtggttgaagaaatcaccggctatctcgcggtgaacggggtcgacgatagtgactctgcagtgattaactgcgacgactgtcagcccgatggaaacactaagcagaattctataggaagttacgtgctgcaggaaaaaagcgtggcagagaatggcgacacagatacgcagacctctatgttcctggactcgagaaaggaggatagttatattgatcacaaagtaccctgtacagattcacaggttcaagtgaagctggaggaccataagatcgtgacagcctgcctccccgtagagcatgttaatcagttaactaccgaaccagcgaccggaccattcagcgagactcagtcaagtctgcgggattccgaagaggaagttgacgtcgtcggggattccagcgcttccaaggagcaatgcaaagaaaacaccaacaatgagctggatacatcccttgagtccatgccggcgagcggcgagcccgagccttcacccgtcctggactgcgtttcggctcaaatgatgtccctttctgagccgcaggaacaccggtacacactgcgtactagtccaagacgggccgcccctacgcgcggctcgcccactaaaaattcttctccctatcgggagaacgggcagtttgaggaaaataatctgtctcctaacgaaactaatgccaccgtcagcgataatgtctcccaaagtcccaccaaccccggcgaaatcagccagaacgaaaagggcatttgctgtgattctcaaaacaatgggtctgaaggggtaagcaaacctccatcagaagctcggctgaatataggccatcttccatctgcaaaggaaagcgcctcccagcacatcacggaagaggaggatgatgaccctgacgtctactatttcgagagcgaccacgtggccctgaagcacaataaggactatcagcgcctgttgcagactatagcagtgctggaagcgcagcgttcacaagcagttcaggatctggagagtctcggaagacatcaacgggaggcacttaaaaatcctatcggctttgtggaaaaactccagaaaaaggcagatatcggcctgccttaccctcagcgagtggtgcagctcccagagatagtttgggatcagtatacccacagcctaggtaatttcgaacgtgagtttaagaatcgcaagagacatacccgtagggttaagctggtatttgataaggtgggactcccagcccgacctaagtcaccgttagatcctaaaaaagatggtgagagcctcagctactctatgcttcccttaagtgatggccctgagggatcctcttccaggccccagatgatccggggcaggctgtgcgatgacacgaagccggagacattcaaccaactgtggacagttgaagagcaaaagaaactggagcagctcctcatcaaatatcctccagaagaagtggaatcacgccgctggcaaaaaattgctgatgagctggggaatagaaccgccaagcaggtggcctcccgggtacagaagtattttatcaaattgaccaaagctggcatacctgtacccgggcgtacaccaaatctctatatctacagcaaaaaaagcagtacatcaaggaggcagcatccactcaataagcatttatttaagccgtccacttttatgacatcacatgagcctccagtgtatatggacgaggatgatgatagaagttgcttccacagccacatgaatacagcggtcgaggatgcatctgacgacgagagcatccctatcatgtaccggaacctgcccgagtacaaagagctgcttcagttcaagaaacttaaaaagcaaaagctgcaacagatgcaggctgagtccggctttgtccaacatgtcggatttaaatgcgataattgcggaattgagccaattcagggcgtgcgatggcactgccaggactgcccgcccgagatgtcgctggacttttgtgactcatgctcagactgcctccacgaaacagatatccataaggaggaccaccagctcgagcccatctacagatcagaaacctttctcgaccgagactactgcgtgtcgcagggcactagctataattatctggatccaaactactttcccgctaataggtag

SEQ ID NO: 14928 - DNA, 111 bp, Artificial Sequence
  Description of Artificial Sequence: Synthetic coding sequence
atggcagccagcaggtctacccgggtgacccggagcaccgttggcctgaacggcctggacgaatccttttgcgggcggacgcttcggaaccgcagcatcgcccacccttag

SEQ ID NO: 14929 - DNA, 177 bp, Artificial Sequence
  Description of Artificial Sequence: Synthetic coding sequence
atggcagccagtagatctactcgagtcacgcggtctactgtgggactgaatggcctggacgaatctttttgcggtaggacccttcggaacaggtctatcgcccacccagaggaaatttcgtctaattcacaggtccgatcaagatctcctaagaaacggcccgaaccggtgccttag

SEQ ID NO: 14930 - DNA, 381 bp, Artificial Sequence
  Description of Artificial Sequence: Synthetic coding sequence
atgtcggtgatggatctcgcaaatacttgttcttcttttcaaagtgatttggacttttgctccgattgcggtagtgtgctgcctttgccaggagcgcaggatactgttacatgcatcaggtgtggctttaacataaatgttcgcgatttcgaaggaaaggtcgtcaaaactagcgtcgtcttccatcagctgggaaccgcgatgcctatgtctgttgaggaaggccctgaatgccagggtccagttgtagatcgtcgttgcccacggtgcggccacgaagggatggcatatcacactagacagatgcgaagtgccgatgaaggtcaaactgtgttttatacctgtacaaactgtaagttccaggagaaggaagacagctag

SEQ ID NO: 14931 - DNA, 381 bp, Artificial Sequence
  Description of Artificial Sequence: Synthetic coding sequence
atgtctgtgatggaccttgcgaacacttgctcaagcttccaatctgatctggacttttgttcggactgtggaagcgttcttcccctgcccggtgcccaagacacagtcacttgtatccggtgcggtttcaacattaacgtcagggatttcgaggggaaggtagtgaagacatcagtggtgtttcaccaactggggacggccatgccaatgagcgtggaagaaggacccgagtgccagggccctgtggtggaccgtcgctgcccccgatgcggacatgaaggaatggcgtaccacacacggcaaatgcgcagcgccgatgaggggcagaccgtcttttatacctgtactaactgtaaatttcaggaaaaagaagactcttag

SEQ ID NO: 14932 - DNA, 381 bp, Artificial Sequence
  Description of Artificial Sequence: Synthetic coding sequence
atgtcggtaatggacttggccaatacatgctccagttttcagagtgacctcgacttctgttccgattgtggatcagtgctgcctctgccaggcgcccaagacactgtaacatgtattcgatgcggcttcaatatcaatgtgagagattttgagggcaaggtggtaaaaacgtcagtggtcttccatcagttaggcactgccatgcctatgtctgtagaggagggacccgagtgtcaaggcccagttgttgatcggcgttgtcctagatgtggtcatgagggaatggcgtaccacacaagacaaatgcgcagtgccgacgaagggcaaactgtgttctatacctgcacaaattgcaagttccaggagaaagaagactcttag

SEQ ID NO: 14933 - DNA, 381 bp, Artificial Sequence
  Description of Artificial Sequence: Synthetic coding sequence
atgtcagtcatggacctggctaatacatgttcttctttccagagtgatctagatttctgttccgactgcgggtctgtgctgccactgcctggggcacaggacacagtgacttgtattaggtgcggtttcaatattaatgtgagggacttcgagggaaaggtggtgaaaacttctgtagtcttccatcagctaggaaccgctatgccaatgagcgtggaggaaggccccgaatgtcaaggccccgtggtggaccgacgatgccctaggtgcgggcacgaagggatggcgtatcacactaggcaaatgagatccgccgacgagggacagactgtcttttatacttgcacaaattgcaagtttcaggagaaggaagattcctag

SEQ ID NO: 14934 - DNA, 381 bp, Artificial Sequence
  Description of Artificial Sequence: Synthetic coding sequence
atgagcgtgatggatctggccaacacttgtagctccttccagtcagatctagatttctgtagcgactgtggcagtgtcctccctttgccgggagcccaggatactgtaacctgtatccggtgtggcttcaacatcaacgtcagagactttgaggggaaggtggtcaagaccagtgtggtgttccaccagctcggcaccgcaatgccaatgagcgttgaggagggcccagagtgccagggccccgtagtcgacagaagatgccctaggtgcggacatgagggcatggcctaccacacaagacagatgagaagcgccgacgaagggcagactgtgttttacacctgtactaactgcaagtttcaggagaaagaggacagctag

SEQ ID NO: 14935 - DNA, 381 bp, Artificial Sequence
  Description of Artificial Sequence: Synthetic coding sequence
atgagcgtcatggacctcgcaaacacatgttcaagctttcagtctgatttggacttctgtagtgactgcgggagcgtcttacccctgcccggggcgcaagatacagttacatgcattagatgcggattcaacattaatgtgcgagacttcgaaggcaaggtcgttaagacctcagtcgtgttccatcagctcggcactgctatgcctatgtccgtcgaagagggacctgagtgccagggaccagttgtcgatcggaggtgtcctcgctgcggccacgaaggtatggcttatcataccagacagatgaggtctgccgatgaagggcagactgtgttttacacatgtacgaattgcaaattccaagagaaagaagacagttag

SEQ ID NO: 14936 - DNA, 381 bp, Artificial Sequence
  Description of Artificial Sequence: Synthetic coding sequence
atgagcgtcatggatcttgccaacacctgctcctcatttcagtcagacctggatttttgtagtgattgtggcagcgttcttcccctgcctggtgcccaggacactgtgacttgtatcaggtgcggcttcaacatcaatgtcagggatttcgagggaaaggtcgtgaaaacgtccgtcgtgtttcaccagctgggaacagctatgccaatgtctgtcgaggagggccccgagtgccaggggcctgtcgtggacagacggtgcccacggtgtggccacgagggcatggcataccacacccgccaaatgcggagcgccgacgaaggccagaccgtgttttatacttgcaccaattgtaaattccaggaaaaagaggattcttag

SEQ ID NO: 14937 - DNA, 381 bp, Artificial Sequence
  Description of Artificial Sequence: Synthetic coding sequence
atgagtgttatggatctggcaaacacgtgttccagctttcagtctgatttggatttctgtagcgactgtggtagcgtcctgcccctgccaggggctcaagacaccgttacctgcattcggtgtgggtttaacattaacgtacgagatttcgagggcaaggttgtgaaaacctccgtggtgttccaccagctaggaactgccatgcccatgtctgtcgaggaagggccagagtgccaaggtcctgtcgtggaccgaaggtgtcccagatgcggacacgagggtatggcatatcacacgcggcagatgcgcagtgcagacgaggggcaaacggtgttctacacatgtaccaattgtaaattccaggagaaagaggacagctag

SEQ ID NO: 14938 - DNA, 381 bp, Artificial Sequence
  Description of Artificial Sequence: Synthetic coding sequence
atgagcgtcatggatctggccaatacatgttcatccttccagtctgatttggacttctgctccgactgtggatctgtgttaccgctcccaggagcccaggacaccgtgacctgtatacgatgcggttttaatatcaatgttcgggattttgagggtaaagtcgtgaagacctccgtcgtctttcatcaactagggacggcaatgccaatgtcagtggaagagggcccggagtgtcagggaccagtggtcgataggagatgccctcgatgcgggcacgagggcatggcataccatacacggcaaatgcgatcagcagatgagggtcagacagtgttttacacatgtacaaattgtaagtttcaggagaaggaagatagctag

SEQ ID NO: 14939 - DNA, 381 bp, Artificial Sequence
  Description of Artificial Sequence: Synthetic coding sequence
atgtcagtgatggatttggcaaatacttgctcttcctttcaatcggatctggatttttgtagcgattgcggttcggtactccccttgccaggcgcccaagacacagtgacttgcatacggtgcggatttaacatcaatgtacgcgacttcgagggcaaagtagtcaaaaccagcgtggtgtttcaccagttgggcactgcgatgcctatgtccgtggaagaaggccccgaatgccagggacctgtggtagaccgcaggtgccctcgatgtggccatgaagggatggcttaccatacaaggcagatgcgtagcgccgatgaggggcaaaccgtgttttatacctgcaccaactgcaagtttcaagagaaggaggatagctag

SEQ ID NO: 14940 - DNA, 381 bp, Artificial Sequence
  Description of Artificial Sequence: Synthetic coding sequence
atgtccgttatggatctggcgaatacctgctcttctttccaaagcgacctagatttctgcagcgattgcggcagcgtcttgcccctgcctggggcacaagacaccgtgacctgcattagatgtggattcaacattaacgtcagagacttcgaagggaaagtcgtaaaaactagcgtcgtgtttcatcagctggggactgccatgcccatgtctgttgaggaggggcctgaatgccagggtccagtggtcgacagacgttgtccccgatgtggacatgaggggatggcatatcacacccggcagatgcgatcagctgacgaaggacaaactgtcttttatacctgcacgaattgtaagttccaagagaaagaggacagctag

SEQ ID NO: 14941 - DNA, 381 bp, Artificial Sequence
  Description of Artificial Sequence: Synthetic coding sequence
atgagcgtgatggatctggctaatacctgttccagctttcagagcgatctggatttctgttcagattgcggcagtgtgctgcctcttccaggggcccaggacaccgtaacatgcattcgatgtggcttcaacattaatgttcgcgacttcgaagggaaggtagtgaaaacaagtgtagtttttcaccaactgggaaccgccatgccgatgagtgttgaggagggcccagaatgtcaggggccggtcgttgacagaaggtgtcccaggtgtggccacgaaggtatggcttatcacacccgccagatgcggagtgctgatgaagggcagaccgtgttctacacgtgcactaattgcaagtttcaggagaaggaggactcatag

SEQ ID NO: 14942 - DNA, 381 bp, Artificial Sequence
  Description of Artificial Sequence: Synthetic coding sequence
atgagcgttatggatctggccaatacgtgctcatcattccagtctgacctggacttttgctccgattgcggatctgtcctcccattgccaggcgcccaggacactgtcacatgtattaggtgcggttttaacatcaatgtgagggattttgaaggtaaggtggtcaagaccagcgtggtattccatcagctcggcacagccatgcctatgtccgtcgaggaagggcctgaatgtcagggtcccgtcgtggaccggcgctgtccccgatgtgggcacgaggggatggcttaccatacacgacagatgcgttctgcagatgagggacagacagtgttttacacctgcacaaactgtaagttccaggagaaggaggactcctag

SEQ ID NO: 14943 - DNA, 381 bp, Artificial Sequence
  Description of Artificial Sequence: Synthetic coding sequence
atgagcgtcatggacctagcgaatacatgcagtagctttcagtccgacctcgatttttgcagcgattgcggctcagtgcttcctctaccaggagctcaagataccgttacatgcattagatgcggttttaatattaacgtcagggatttcgagggcaaggtcgtgaagacgtctgtggtgtttcaccagttgggaactgctatgccgatgtcggtggaggaaggcccagagtgccaggggccagtggtcgatcgcagatgccccaggtgcggccatgaggggatggcctatcacaccaggcagatgcggagcgctgacgagggtcagaccgtcttctatacctgtacaaattgcaaatttcaggagaaggaggattcttag

SEQ ID NO: 14944 - DNA, 381 bp, Artificial Sequence
  Description of Artificial Sequence: Synthetic coding sequence
atgagtgtcatggatctcgcaaatacctgttctagttttcagagcgacctcgacttctgtagtgactgtggctccgtgcttccccttccgggggcccaagacactgtgacctgtatccgctgcggtttcaacattaatgtgcgagactttgagggtaaggtggttaagacctctgtggttttccatcagctcggcactgccatgccgatgagcgtggaagaaggacccgagtgtcaggggccagttgtagatcgtcgttgtcctaggtgtggccacgagggcatggcctaccacaccaggcagatgagatctgctgacgaaggtcagactgtattctatacctgtaccaattgcaaatttcaggagaaggaagattcatag

SEQ ID NO: 14945 - DNA, 381 bp, Artificial Sequence
  Description of Artificial Sequence: Synthetic coding sequence
atgagtgtaatggacctagctaatacttgcagtagttttcaaagtgacctggatttctgtagtgactgtggctcagttttgccgctccctggagcccaggacactgtaacatgtatcagatgcgggtttaatatcaatgtgagggatttcgagggaaaagtggtgaagaccagcgtcgtgttccaccagctgggcacagccatgcccatgtccgtggaagagggccccgagtgccaggggccagtggttgaccgaagatgtccgagatgcggccacgaggggatggcataccacactagacagatgcggagcgctgatgaggggcagacggttttttacacctgcaccaattgcaagtttcaggagaaagaggactcttag

SEQ ID NO: 14946 - DNA, 381 bp, Artificial Sequence
  Description of Artificial Sequence: Synthetic coding sequence
atgagcgtgatggatctcgccaacacctgttccagcttccagtccgatctcgatttctgctctgattgtgggtcggtgctgcccctgcccggcgcccaagatactgtgacctgcatacgctgtgggtttaacatcaatgtgcgagattttgagggtaaggtagttaagacatctgtggtatttcatcagctggggacagctatgccgatgtccgtcgaagaaggacccgaatgccagggtccagtcgtcgaccgtagatgccctcgctgtgggcatgaaggcatggcctaccacacaagacagatgcgaagtgccgatgaagggcagactgtgttttacacctgtacaaattgtaagttccaggagaaagaagactcctag

SEQ ID NO: 14947 - DNA, 381 bp, Artificial Sequence
  Description of Artificial Sequence: Synthetic coding sequence
atgagtgtcatggatttggcaaatacctgtagcagctttcagtcggaccttgatttttgcagcgattgtggcagcgtgctgcctctgccaggcgctcaggacacagtgacctgtatcagatgcggctttaatatcaacgtgagggattttgaaggaaaagtcgtcaaaacatccgtggtgttccaccagctgggtacagcaatgccaatgtcagttgaggaagggcctgagtgccagggccctgtggtcgaccgccggtgcccaaggtgcgggcacgaaggaatggcttatcacacgaggcagatgagaagcgccgatgaaggccagacagtcttctacacatgcacaaactgcaagtttcaggaaaaggaggactcctag

SEQ ID NO: 14948 - DNA, 381 bp, Artificial Sequence
  Description of Artificial Sequence: Synthetic coding sequence
atgagtgtgatggacctagcaaacacatgcagctcgttccagagcgacctggatttttgttctgattgcggtagtgtgctcccattacccggagctcaggatacggtgacatgcattagatgtggatttaacataaacgtacgggactttgaggggaaagttgtgaagacctccgtggtcttccaccagctagggaccgctatgccaatgtcggtagaagagggacccgagtgccagggacctgtggtagatcggaggtgtccaaggtgcggacacgagggcatggcgtaccacacaagacagatgaggtctgccgacgaggggcagacagtgttttacacctgtactaactgcaagttccaggagaaagaggactcctag

SEQ ID NO: 14949 - DNA, 381 bp, Artificial Sequence
  Description of Artificial Sequence: Synthetic coding sequence
atgtctgtgatggacctcgcaaacacttgttctagcttccagtcggatctagacttttgttccgattgtggttctgtactgccgctaccaggtgcgcaggataccgtaacatgtatccggtgcgggtttaatattaacgttcgggatttcgaggggaaggtggtcaagacctccgttgtatttcaccagctgggaaccgccatgcctatgagtgtcgaagagggccccgagtgtcagggccctgtcgtcgaccgtcgctgtcctagatgcggtcacgaagggatggcatatcatacgagacagatgcggtctgctgacgaaggacagactgttttctacacttgcactaattgcaaatttcaggaaaaagaggacagttag

SEQ ID NO: 14950 - DNA, 381 bp, Artificial Sequence
  Description of Artificial Sequence: Synthetic coding sequence
atgtccgttatggatctggccaatacttgtagttcattccagagcgacctcgatttctgctcagattgcgggagtgtgctgcctttaccgggtgcccaggacacagttacatgtatccggtgcgggttcaacatcaacgtgcgggactttgagggcaaagtggtgaagacttctgtcgtatttcaccagctgggcactgccatgcccatgtcagttgaagaagggccagaatgtcagggccctgtggttgacaggcggtgcccaaggtgcggtcatgagggtatggcctaccacactcgtcagatgaggagcgctgacgagggacagaccgtgttctatacgtgcaccaattgcaagttccaagagaaggaggattcatag

SEQ ID NO: 14951 - DNA, 381 bp, Artificial Sequence
  Description of Artificial Sequence: Synthetic coding sequence
atgtcagttatggatctagccaatacttgtagttcttttcaatctgatctcgacttctgtagtgattgtgggtccgtactgcccctcccaggggcgcaggatactgtgacttgcatcaggtgtggtttcaatattaatgttagggacttcgaggggaaagtggtgaaaacttctgtggtcttccatcagctcgggacagcgatgcccatgagcgtggaagaaggccctgaatgccaaggccccgttgttgatcgccgctgcccaaggtgcggacatgaaggaatggcctaccatacaaggcaaatgcggtccgctgatgagggtcaaaccgtgttctacacttgcaccaactgcaaattccaggagaaggaagactcctag

SEQ ID NO: 14952 - DNA, 381 bp, Artificial Sequence
  Description of Artificial Sequence: Synthetic coding sequence
atgtccgtgatggacctcgctaacacatgctcttcttttcaatccgacttggatttctgcagcgactgcggttcggtgttaccattgcccggagctcaggacaccgtgacatgtatacggtgcgggttcaacatcaacgtgcgggacttcgagggcaaagtggtgaagacgtccgtcgtatttcaccaacttggcacagctatgcctatgtcggtcgaagagggtcctgaatgccaaggcccggttgtggacagacggtgtccaaggtgcggccacgagggaatggcttaccacaccaggcagatgcggagcgcagacgagggacagactgtgttttacacctgcacaaactgcaagttccaagagaaggaagacagctag

SEQ ID NO: 14953 - DNA, 381 bp, Artificial Sequence
  Description of Artificial Sequence: Synthetic coding sequence
atgtccgttatggacctggctaacacttgctcttcattccaatctgaccttgacttctgctctgactgcggcagcgtccttccgctgccgggcgcccaggacacagtgacatgcatcaggtgcgggttcaacataaacgtgcgtgactttgaaggcaaggtagttaagacgtccgtcgtgtttcatcagctgggtacagccatgccaatgtcagtggaagaaggaccagagtgccagggacctgtagtggaccgaagatgccctagatgtgggcacgaagggatggcttaccacactcgccagatgcgcagcgccgacgagggtcaaactgtcttctatacatgcactaattgtaagttccaggagaaagaggacagctag

SEQ ID NO: 14954 - DNA, 381 bp, Artificial Sequence
  Description of Artificial Sequence: Synthetic coding sequence
atgtccgtaatggatctagccaatacgtgctcatcatttcaatccgacttagacttttgctctgactgtggcagcgtgctccctttgcccggggcccaggataccgtgacctgcatacgctgcggcttcaacatcaacgtgcgtgacttcgaaggaaaagtggttaagacctctgtagtatttcatcagctgggcacagccatgcccatgagcgtcgaggagggcccggagtgccagggccccgtcgtagataggaggtgtccccgatgcgggcacgagggcatggcttaccataccaggcagatgagatcagcggacgagggacagacagtgttctatacgtgtaccaattgcaagtttcaggaaaaggaggattcttag

SEQ ID NO: 14955 - DNA, 381 bp, Artificial Sequence
  Description of Artificial Sequence: Synthetic coding sequence
atgagtgtgatggatctcgccaatacttgtagctcattccagagcgatcttgacttttgcagcgactgcgggtcggtgttaccactgccgggggcccaggataccgtcacttgcatccgctgcggcttcaatattaatgtgcgcgatttcgagggtaaagttgtgaagacctcagtagtgttccaccagctgggaaccgccatgcctatgagcgtggaagaaggcccagaatgtcagggcccagtggtagaccgtagatgtcctaggtgtggccatgagggaatggcttaccacacgagacagatgaggagcgcggacgaggggcaaaccgtcttctacacatgcacaaattgcaaattccaggaaaaggaggactcctag

SEQ ID NO: 14956 - DNA, 381 bp, Artificial Sequence
  Description of Artificial Sequence: Synthetic coding sequence
atgtcagtgatggaccttgcaaacacatgctcttcatttcagtcagatctggacttctgtagcgattgcggaagcgtgctccccctgcctggggcccaggacactgtcacatgtatacggtgcggatttaacatcaatgtgcgggacttcgagggcaaggtggtgaagacgtctgtcgtatttcatcagcttgggacagctatgcctatgtctgtggaagaaggacccgagtgtcaaggccccgtagtcgaccgacgctgccctcggtgtggacacgagggcatggcgtatcacacgcggcagatgcggtccgcagatgaaggtcaaacagtgttttatacgtgcaccaactgcaagtttcaggagaaggaagactcatag

SEQ ID NO: 14957 - DNA, 381 bp, Artificial Sequence
  Description of Artificial Sequence: Synthetic coding sequence
atgagtgttatggatctggccaacacttgcagcagctttcaaagcgaccttgatttctgctctgactgtgggtctgttctgcctcttcccggtgcccaggacaccgtaacatgcatccgctgtgggtttaatattaatgtgagagactttgagggcaaggtggtaaagacctctgttgtgttccatcagctgggtacggccatgcccatgagtgtcgaagaaggcccagagtgtcagggacctgtcgtcgacaggcggtgcccacgttgtggacacgaaggaatggcatatcacacgcgccagatgagatccgcagatgaaggccagaccgttttctacacctgtacaaactgtaagtttcaagagaaagaggatagctag

SEQ ID NO: 14958 - DNA, 381 bp, Artificial Sequence
  Description of Artificial Sequence: Synthetic coding sequence
atgtctgtcatggatctcgccaatacatgtagctcctttcagagtgacctagatttctgcagtgattgcgggagcgtgctgcctctgcccggcgctcaggacacagtgacatgtatccgttgtggcttcaatatcaacgtcagggacttcgaagggaaagtcgttaagacctccgtggtgttccaccagctgggtactgccatgcctatgtccgtggaggagggacccgaatgccagggtccagtggtggatcgtcgatgtccccgctgtggccatgaaggcatggcctaccatactagacaaatgagatctgccgatgagggtcagacagtcttttacacctgtacaaactgtaaatttcaagagaaggaggattcttag

SEQ ID NO: 14959 - DNA, 381 bp, Artificial Sequence
  Description of Artificial Sequence: Synthetic coding sequence
atgtcagtgatggacttagcaaatacatgttcttctttccaatctgacctggacttttgctccgactgcggtagcgtcctgccactgccgggcgctcaggacacagtcacctgtatccgttgtggtttcaatataaacgtccgggattttgaggggaaagtggtgaagacatctgtggtctttcatcagttggggaccgctatgccaatgagcgtggaagaggggcctgagtgtcaggggccagtcgtcgataggagatgccctagatgcggtcatgaaggaatggcttaccacactaggcagatgcggtctgccgatgagggacagactgtattttacacctgcacaaattgtaagttccaggagaaggaggattcctag

SEQ ID NO: 14960 - DNA, 381 bp, Artificial Sequence
  Description of Artificial Sequence: Synthetic coding sequence
atgtctgtgatggatctcgccaacacatgctcttcatttcagagcgatcttgacttctgttctgactgtggttctgtgctgccactccctggggctcaggacaccgtcacctgcattcggtgtggatttaatattaacgtccgagattttgagggaaaagtggtcaaaacttcggtggtattccaccagctcgggacagctatgccaatgtctgttgaagaaggaccagagtgtcaaggtcccgtcgtggaccgcagatgtcctcgctgtgggcacgaaggtatggcttatcatacgcggcaaatgagatccgctgatgaggggcaaaccgttttctatacatgcaccaactgcaagttccaagagaaggaggatagttag

SEQ ID NO: 14961 - DNA, 381 bp, Artificial Sequence
  Description of Artificial Sequence: Synthetic coding sequence
atgtccgtcatggacttagccaatacttgcagctcgttccagtctgatctggacttttgcagcgattgcgggagcgtgttaccactgcccggtgcccaagatacagtcacttgcattcggtgcggcttcaacatcaacgtaagggatttcgagggtaaggtggtcaagacaagcgtagtgttccatcagctaggtactgccatgccgatgagcgttgaggaaggacccgagtgtcaaggtcccgtggtagaccggagatgcccgaggtgcggacacgaaggcatggcgtatcatacacgccagatgaggtctgcggacgagggtcagactgtcttctatacttgtactaattgcaaatttcaggagaaggaggactcatag

SEQ ID NO: 14962 - DNA, 2133 bp, Artificial Sequence
  Description of Artificial Sequence: Synthetic coding sequence
atggatctcccagccttactgccagcaccgaccgcccgtggcggccaacacggtgggggacctgggccactgagaagggcgcctgccccattgggcgccagccctgcacgccggcgcttacttctggtccggggccccgaggatgggggccccggagccaggccaggcgaggctagcggtccatcgcctccaccggctgaggatgacagcgatggcgactcctttttggtgctgctggaggttccacacggaggcgccgccgcggaggcggcagggagccaggaagccgaaccggggtcaagggtgaatctggcaagcagacccgagcagggaccaagcggtccagccgctcccccggggccaggggtagctcccgctggggcagtgacaatttcgagtcaggaccttctggtgcgcttggatagaggtgtgcttgctttgagtgccccacctgggccagccactgcgggggcagctgctccccgcagggcgccccaggcaagtggaccctctactccagggtaccgttgtcctgagccccagtgtgcgttggcgttcgcaaagaaacatcagctgaaggtgcacctgctcactcatgggggcgggcagggtagacggccatttaagtgccctttagaagggtgtggctgggccttcaccacatcctacaaacttaagcgccatctgcagtcccatgataagctgcgcccatttggatgccctgtgggcggctgtggcaagaagttcaccaccgtctataatctgaaggcccacatgaagggtcatgaacaggagagcctgttcaaatgcgaagtgtgcgcagagcgcttccctacacacgccaagctgtctagccaccagcgctcccactttgagcctgagcggccctacaagtgtgacttccccgggtgcgaaaaaacctttatcaccgtgagcgcccttttctcacataatagagcgcacttccgagaacaggaactcttcagctgtagcttccctgggtgctccaagcagtacgacaaggcctgtagactcaagatacacctaagatcccacacaggtgagcgaccattcatctgcgattccgatagctgcgggtggaccttcacaagtatgtccaaattattaagacatcgaagaaagcacgacgacgatcggagattcacctgccccgtcgagggctgcggtaaatcgtttactcgtgccgagcacctgaaagggcattcaattacccatctcgggacgaaaccgtttgagtgtccggttgaggggtgctgtgcacgtttctcagctcggtcttctctctatattcatagtaagaaacacgtccaggacgtgggggcacccaagtctcggtgtcccgtgtccacgtgcaaccgcctctttacgtcaaaacactcaatgaaagcacatatggtcaggcaacactctaggcggcaggatcttcttccccagctcgaggctccctctagcctaactccgtctagcgaattgtccagcccggggcaatccgaactgacaaatatggacctcgctgcattattcagcgacacaccagccaacgcatctgggtcagctggagggtctgacgaagctctaaactcaggcatactgacgatcgatgtgaccagtgtctcctcatcattgggaggaaacctccctgcgaataattcatctctgggcccaatggaaccgctggttttggtcgcgcactccgatataccaccatcactcgacagtccccttgtgttggggacggccgcgacggtgctccagcagggaagcttttccgtggacgatgtgcagacagtatctgccggcgcgctgggctgtctcgtagctctgccgatgaagaacctgagcgatgacccattagcactgacgtctaactcaaacctggctgcccacattaccacgcctacttccagtagcacacctagggaaaacgcttcggtacccgagctgttggcacctatcaaggtcgagcctgactcgccaagtagaccaggggccgtcggccagcaggagggatctcacgggcttcctcagagcaccttacccagcccagcagagcaacacggagcacaggacacagaactgtccgccgggaccggaaatttctacctggtgtag

SEQ ID NO: 14963 - DNA, 2577 bp, Artificial Sequence
  Description of Artificial Sequence: Synthetic coding sequence
atggatcttcccgctctgcttcccgcacctaccgcccgtggaggtcagcatggggggggaccgggccccttacgtagggcccccgccccactgggagcatcgcccgccagaagacgactgctcctggtccgaggcccagaggacgggggacccggtgctagaccaggtgaagcctcgggccccagccccccgcccgctgaggacgactcagacggcgacagttttctggtcctgctggaggtgccacacgggggggcagcggccgaagccgcaggctcacaagaagcagaaccgggaagcagggtgaacctggcatcccgcccagagcagggcccgagcgggcccgccgccccaccgggacctggtgtagcaccagcaggggccgtcacgatctctagccaggacctgctggtccgcttggatcggggtgtgttggctctttccgcccctcctggacccgctaccgccggcgctgcggcacctagacgagctccccaagcgtccgggccatctacccccggatatcggtgcccagagccccagtgcgccttggccttcgcaaaaaagcaccagctcaaggtccacttgctgacccacggtgggggacagggaaggcggccattcaagtgccccctcgagggatgtggctgggcattcacgacgtcctacaagttgaaacgacacctgcagtcacatgataaactcagaccattcggatgcccggtgggcggttgcgggaaaaaattcaccacggtctataatctgaaagctcacatgaagggacacgaacaggaatcactgttcaaatgcgaggtgtgtgcggagcggttccctactcacgccaagttatcctcccaccaaagatcacacttcgaacctgagcgcccgtataagtgtgacttcccaggatgtgagaagacattcatcacagtctcggcattatttagccataacagagcccatttccgggagcaggagctgtttagctgctcctttcctgggtgctcaaaacagtatgataaagcttgcagattgaagattcacctgaggagccatactggtgaaaggccatttatttgcgatagcgatagttgcggatggacctttacatcgatgtccaagttgttgagacaccggaggaagcatgatgatgataggaggttcacttgtccagtggaagggtgcggcaagtcgtttactcgggccgaacatctgaaagggcactccatcactcatttgggcacaaagccattcgaatgtccagttgagggttgttgcgcccggttctcagcacggtctagcctgtacatacatagcaagaagcacgtgcaggacgtgggggctcccaaaagtagatgcccggtttccacctgtaacagacttttcaccagcaagcattccatgaaggcgcatatggttcggcagcactctcgcaggcaggacctcctgcctcaactggaggcccctagtagcttgaccccaagttccgaactgtcatctcccggtcagagcgaactaacaaatatggacttggccgcactgttcagtgacactcccgccaatgccagcgggagtgccgggggttctgacgaggcgcttaatagcggtatcctaacaatagacgtgaccagtgtttcgtcgagcctcgggggcaacctcccagctaacaatagcagtcttggccctatggagcccctcgttctggtggcacacagtgatattcctcctagtctggacagcccactagtactaggcaccgccgcaaccgtcctgcagcaagggtcattctccgtcgacgatgtgcagacagtgtcagcgggagcactggggtgccttgttgccttgccaatgaaaaatttgtccgatgaccccctggctctgacttccaacagcaatctagctgcccacatcaccacgcccacatcatcgtctactccacgggaaaacgcgtctgttcctgagctgctggctccaattaaggtcgaacccgacagccccagccggccaggagccgtcgggcaacaggagggtagtcatgggctgcctcagtccaccttaccgtcacctgctgagcaacatggagctcaggataccgaactcagcgcaggcactggcaatttttacctggagtctggcggtagtgcaaggaccgattaccgggccattcagttggcgaaggaaaagaagcaacgaggcgccggctccaatgctggagcctcccaatctactcagaggaagatcaaagagggcaagatgtcacccccccattttcatgcaagccaaaactcctggctgtgcggctcacttgtggttccgagtggcggtcggcccggaccagctccagccgcaggcgtgcagtgtggggctcagggggttcaagtccagctagtgcaggatgacccctcaggcgaaggggtgctacccagtgcccggggtccggcaacttttcttccttttctcacagtggatctgccggtgtacgttttgcaggaagtgcttccatcatccgggggccccgcgggaccagaggcaactcagttcccgggaagcaccattaatttgcaggacctgcagtag

SEQ ID NO: 14964 - DNA, 546 bp, Artificial Sequence
  Description of Artificial Sequence: Synthetic coding sequence
atgatggacaacagaggcaacagcagcctgcctgacaagctgcccatcttcccagacagcgcccggctgcccctgaccaggagcttctacctggagcccatggtgaccttccacgtgcaccctgaggcccctgtgagcagcccctacagcgaggagctgccccggctgcccttccccagcgacagcctcatcctgggcaactacagcgagccctgccccttctccttccccatgccctaccccaactaccggggctgtgagtacagctatggccctgccttcaccaggaagagaaatgaaagagagcggcagagggtgaagtgtgtgaatgaaggctacgcccagctgcggcaccacctgcctgaggagtacctggagaagaggctgagcaaggtggagaccctgcgggccgccatcaagtacatcaactacctgcagagcctgctgtacccagacaaggccgagaccaagaacaaccctgggaaggtgtcctccatgattgccaccaccagccaccacgccgaccccatgttccgcatcgtgtag

SEQ ID NO: 14965 - DNA, 546 bp, Artificial Sequence; identical to SEQ ID NO: 14964
  Description of Artificial Sequence: Synthetic coding sequence

SEQ ID NO: 14966 - DNA, 522 bp, Artificial Sequence
  Description of Artificial Sequence: Synthetic coding sequence
atgatggagaccaggaagccagctgagcggctggccctgccctacagcctgaggacagcccccctgggcgtgcccggcaccctgcccggcctgccccggcgggaccccctgcgggtggccctgcggctggatgctgcctgctgggagtgggcccggagcggctgtgcccggggctggcagtacctgcctgtgcccctggacagcgcctttgagcccgccttcctgaggaagagaaatgaaagagagcggcagagggtgcgctgtgtgaatgaaggctacgcccggctgcgggaccacctgccccgggagctggccgacaagaggctgagcaaggtggagaccctgcgggccgccatcgactacatcaagcacctgcaggagctgctggagcggcaggcctggggcctggagggcgccgccggggctgtgccccagaggagagctgagtgcaacagtgatggagagagcaaggccagcagcgcccccagccccagcagcgagcctgaggagggcggcagctag

SEQ ID NO: 14967 - DNA, 819 bp, Artificial Sequence
  Description of Artificial Sequence: Synthetic coding sequence
atggaggccgaggagagcgagaaggccgccacagagcaggagcccctggagggcacagagcagaccctggatgctgaggaggagcaggaggagagcgaggaggccgcctgtggcagcaagaagagggtggtgcccggcatcgtgtacctgggccacatccccccacgcttccggcccctgcacgtgaggaacctgctgagcgcctatggagaggtgggccgggtcttcttccaggccgaggacagatttgtgcggaggaagaagaaggctgctgctgctgctgggggcaagaagaggagctacaccaaggactacacagagggctgggtggagttccgggacaagagaattgccaagagggtggccgccagcctgcacaacacccccatgggcgcccggcggcgcagccccttccgctatgacctgtggaacctgaagtacctgcaccgcttcacctggagccacctgtctgagcacctggcctttgagcggcaggtgcggcggcagaggctgcgggcagaggtggcccaggccaagcgggagacagacttctacctgcagagcgtggagcggggccagcgcttcctggccgcagatggagaccctgcccggccagatggctcctggacctttgcccagaggcccacagagcaggagctgcgggccaggaaggccgcccggcctgggggccgggagcgggcccggctggccacagcccaggacaaggcccggagcaacaagggcctgctggcccgcatctttggagcccccccacccagcgagagcatggagggccccagcctggtgcgggacagctag

SEQ ID NO: 14968 - DNA, 3396 bp, Artificial Sequence
  Description of Artificial Sequence: Synthetic coding sequence
atgttccagatccctgtggagaacctggacaacatcaggaaggtgaggaagaaggtgaagggcatcctggtggacatcggcctggacagctgcaaggagctgctgaaggacctgaagggctttgatcctggagagaagtacttccacaacacctcctggggagatgtgtccctgtgggagcccagcggcaagaaggtgcgctaccgcaccaagccctactgctgcggcctgtgcaagtacagcaccaaggtgctgaccagcttcaagaaccacctgcaccgctaccatgaagatgaaattgaccaggagctggtgatcccctgccccaactgtgtgtttgccagccagcccaaggtggtgggccgccacttcaggatgttccacgcccctgtgaggaaggtgcagaactacacagtgaacatcctgggggagaccaagagcagcagaagtgatgtgatctccttcacctgcctgaagtgcaacttcagcaacaccctgtactacagcatgaagaagcacgtgctggtggcccacttccactacctgatcaacagctacttcggcctgaggacagaggagatgggagagcagcccaagaccaatgacacagtgtccattgagaagatccccccaccagacaagtactactgcaagaagtgcaatgccaatgccagcagccaggatgccctgatgtaccacatcctgaccagtgacatccaccgggacctggagaacaagctgcggagcgtcatcagcgagcacatcaagaggacaggcctgctgaagcagacccacatcgcccccaagccagctgcccacctggccgccccagccaatggaagtgcccccagcgccccagcccagcccccctgcttccacctggccctgccccagaacagccccagccctgctgctggccagcctgtgacagtggcccagggcgcccctggcagcctgacccacagccccccagctgctggccagagccacatgaccctggtgagcagccccctgcctgtgggccagaacagcctgaccctgcagcccccagccccccagcccgtcttcctgagccatggagtgcccctgcaccagagcgtgaacccccctgtgctgcccctgagccagcctgtgggccctgtgaacaagtctgtgggcacctctgtgctgcccatcaaccagacagtgcggcctggggtgctgcccctgacccagcctgtgggccccatcaacagacctgtgggccctggggtgctgcctgtgagccccagcgtgaccccaggagtgctgcaggccgtgtccccaggagtgctgtctgtgtccagagctgtgcccagcggcgtgctgcctgctggccagatgaccccagctggccagatgaccccagctggggtcatccctggccagacagccaccagcggcgtgctgcccaccggccagatggtgcagagcggcgtgctgcctgtgggccagacagcccccagccgggtgctgcccccaggccagacagcccccctgcgggtcatctctgctggccaggtggtgcccagcggcctgctgagccccaaccagacagtgagcagcagcgctgtggtgcctgtgaaccagggcgtgaacagcggcgtgctgcagctgagccagcctgtggtgtctggagtgctgcctgtgggccagcctgtgcggcctggggtgctgcagctgaaccagacagtgggcaccaacatcctgcctgtgaaccagcctgtgcggcctggggccagccagaacaccaccttcctgaccagcggcagcatcctgcggcagctgatccccaccgggaagcaggtgaatggcatccccacctacaccctggcccctgtgtctgtgaccctgcctgtgcccccaggcggcctggccaccgtggccccaccccagatgcccatccagctgctgcccagcggggctgctgcccccatggccggctccatgcctggcatgcccagcccccctgtgctggtgaatgctgcccagagcgtgtttgtgcaggccagcagcagcgctgctgacaccaaccaggtgctgaagcaggccaagcagtggaagacctgccctgtgtgcaatgagctgttccccagcaatgtgtaccaggtgcacatggaggtggcccacaagcacagcgagagcaagtctggagagaagctggagcctgagaagctggccgcctgtgcccccttcctgaagtggatgagggagaagacagtgcgctgcctgagctgcaagtgcctggtgtctgaggaggagctgatccaccacctgctgatgcacggcctgggctgcctcttctgcccctgcaccttccatgacatcaagggcctgtctgagcacagcaggaacagacacctgggcaagaagaagctgcccatggactacagcaacagaggcttccagctggatgtggatgccaatggaaacctgctcttcccccacctggacttcatcaccatcctgcccaaggagaagctgggggagcgggaggtgtacctggccatcctggccggcatccacagcaagagcctggtgcctgtgtatgtgaaggtgcggccccaggccgagggcaccccaggcagcacaggcaagagggtgtccacctgccccttctgcttcggcccctttgtgaccacagaggcctatgagctgcacctgaaggagcggcaccacatcatgcccaccgtgcacacagtgctgaagagccctgccttcaagtgcatccactgctgcggcgtgtacacaggcaacatgaccctggccgccatcgctgtgcacctggtgcgctgccgcagcgcccccaaggacagcagcagtgacctgcaggcccagcccggcttcatccacaacagcgagctgctgctggtgtctggagaggtgatgcatgacagcagcttctctgtgaagaggaagctgcctgatggccacctgggcgctgaggaccagagacatggagaggagcagccccccatcctgaatgctgatgctgcccctggccctgagaaggtgacctctgtggtgcccttcaagaggcagagaaatgaaagcaggacagagggccccatcgtgaaggatgaggccctgcagatcctggccctggaccccaagaagtatgagggccgctcctatgaggagaagaagcagttcctgaaggactacttccacaagaagccctaccccagcaagaaggagattgagctgctgagcagcctcttctgggtgtggaagattgatgtggccagcttcttcggcaagaggcgctacatctgcatgaaggccatcaagaaccacaagcccagcgtgctgctgggctttgacatgtctgagctgaagaatgtgaagcaccggctgaactttgaatatgagccctag

SEQ ID NO: 14969 - DNA, 516 bp, Artificial Sequence
  Description of Artificial Sequence: Synthetic coding sequence
atgttccagatccctgtggagaacctggacaacatcaggaaggtgaggaagaaggtgaagggcatcctggtggacatcggcctggacagctgcaaggagctgctgaaggacctgaagggctttgatcctggagagaagtacttccacaacacctcctggggagatgtgtccctgtgggagcccagcggcaagaaggtgcgctaccgcaccaagccctactgctgcggcctgtgcaagtacagcaccaaggtgctgaccagcttcaagaaccacctgcaccgctaccatgaagatgaaattgaccaggagctggtgatcccctgccccaactgtgtgtttgccagccagcccaaggtggtgggccgccacttcaggatgttccacgcccctgtgaggaaggtgcagaactacacagtgaacatcctgggggagaccaagagcagcagaagtgatgtgatctccttcacctgcctgaagtgcaacttcagcaacaccctgtactacagcatgaagtag

SEQ ID NO: 14970 - DNA, 1512 bp, Artificial Sequence
  Description of Artificial Sequence: Synthetic coding sequence
atggctgctgccatcacagacatggctgacctggaggagctgagccggctgagccccctgcccccaggcagccctggcagcgctgcccggggccgggcagagcccccagaggaggaggaggaggaggaggaggaggaggaggaggccgaggccgaggccgtggccgccctgctgctgaatggaggcagcggcggcggcggcggcggcggcggcggcggcgtgggcggcggggaggccgagaccatgtctgagcccagccctgagagcgccagccaggccggagaagatgaagatgaggaggaggatgatgaggaggaggaggatgagagcagcagcagcggcggcggggaggaggagagcagcgctgagagcctggtgggcagcagcggcggcagcagcagtgatgagaccaggagcctgagccctggggccgccagcagcagcagtggagatggagatggcaaggagggcctggaggagcccaagggcccccggggcagccagggcggcggcggcggcggcagcagcagcagctctgtggtgtcctctggaggagatgagggctatggaactggaggcggcggcagcagcgccaccagcggcggcagaagaggcagcctggagatgagcagtgatggagagcccctgagcaggatggattctgaggacagcatcagcagcaccatcatggatgtggacagcaccatcagcagcggccgcagcaccccagccatgatgaatggccagggcagcaccaccagcagcagcaagaacatcgcctacaactgctgctgggaccagtgccaggcctgcttcaacagcagcccagacctggccgaccacatccgcagcatccacgtggatggccagagaggaggagtgtttgtgtgcctgtggaagggctgcaaggtgtacaacacccccagcaccagccagagctggctgcagaggcacatgctgacccacagcggggacaagcccttcaagtgtgtggtgggcggctgcaatgccagctttgccagccagggcggcctggcccggcacgtgcccacccacttcagccagcagaacagcagcaaggtgagcagccagcccaaggccaaggaggagagccccagcaaggccggcatgaacaagaggaggaagctgaagaacaagagaagaagaagcctgccccggccccatgacttctttgatgcccagaccctggatgccatccgccaccgggccatctgcttcaacctgagcgcccacatcgagagcctgggcaagggccacagcgtggtgttccacagcacagtgattgccaagaggaaggaggacagcggcaagatcaagctgctgctgcactggatgcctgaggacatcctgcctgatgtgtgggtgaatgaaagtgagcggcaccagctgaagaccaaggtggtgcacctgagcaagctgcccaaggacacagccctgctgctggaccccaacatctaccgcaccatgccccagaagaggctgaagaggtag

SEQ ID NO: 14971 - DNA, 906 bp, Artificial Sequence
  Description of Artificial Sequence: Synthetic coding sequence
atgtacacccggcgctacagcagcatcagcagcaccatcatggatgtggacagcaccatcagcagcggccgcagcaccccagccatgatgaatggccagggcagcaccaccagcagcagcaagaacatcgcctacaactgctgctgggaccagtgccaggcctgcttcaacagcagcccagacctggccgaccacatccgcagcatccacgtggatggccagagaggaggagtgtttgtgtgcctgtggaagggctgcaaggtgtacaacacccccagcaccagccagagctggctgcagaggcacatgctgacccacagcggggacaagcccttcaagtgtgtggtgggcggctgcaatgccagctttgccagccagggcggcctggcccggcacgtgcccacccacttcagccagcagaacagcagcaaggtgagcagccagcccaaggccaaggaggagagccccagcaaggccggcatgaacaagaggaggaagctgaagaacaagagaagaagaagcctgccccggccccatgacttctttgatgcccagaccctggatgccatccgccaccgggccatctgcttcaacctgagcgcccacatcgagagcctgggcaagggccacagcgtggtgttccacagcacagtgattgccaagaggaaggaggacagcggcaagatcaagctgctgctgcactggatgcctgaggacatcctgcctgatgtgtgggtgaatgaaagtgagcggcaccagctgaagaccaaggtggtgcacctgagcaagctgcccaaggacacagccctgctgctggaccccaacatctaccgcaccatgccccagaagaggctgaagaggaccctcatcaggaaggtgttcaacctgtacctgagcaagcagtag

SEQ ID NO: 14972 - DNA, 1554 bp, Artificial Sequence
  Description of Artificial Sequence: Synthetic coding sequence
atggctgctgccatcacagacatggctgacctggaggagctgagccggctgagccccctgcccccaggcagccctggcagcgctgcccggggccgggcagagcccccagaggaggaggaggaggaggaggaggaggaggaggaggccgaggccgaggccgtggccgccctgctgctgaatggaggcagcggcggcggcggcggcggcggcggcggcggcgtgggcggcggggaggccgagaccatgtctgagcccagccctgagagcgccagccaggccggagaagatgaagatgaggaggaggatgatgaggaggaggaggatgagagcagcagcagcggcggcggggaggaggagagcagcgctgagagcctggtgggcagcagcggcggcagcagcagtgatgagaccaggagcctgagccctggggccgccagcagcagcagtggagatggagatggcaaggagggcctggaggagcccaagggcccccggggcagccagggcggcggcggcggcggcagcagcagcagctctgtggtgtcctctggaggagatgagggctatggaactggaggcggcggcagcagcgccaccagcggcggcagaagaggcagcctggagatgagcagtgatggagagcccctgagcaggatggattctgaggacagcatcagcagcaccatcatggatgtggacagcaccatcagcagcggccgcagcaccccagccatgatgaatggccagggcagcaccaccagcagcagcaagaacatcgcctacaactgctgctgggaccagtgccaggcctgcttcaacagcagcccagacctggccgaccacatccgcagcatccacgtggatggccagagaggaggagtgtttgtgtgcctgtggaagggctgcaaggtgtacaacacccccagcaccagccagagctggctgcagaggcacatgctgacccacagcggggacaagcccttcaagtgtgtggtgggcggctgcaatgccagctttgccagccagggcggcctggcccggcacgtgcccacccacttcagccagcagaacagcagcaaggtgagcagccagcccaaggccaaggaggagagccccagcaaggccggcatgaacaagaggaggaagctgaagaacaagagaagaagaagcctgccccggccccatgacttctttgatgcccagaccctggatgccatccgccaccgggccatctgcttcaacctgagcgcccacatcgagagcctgggcaagggccacagcgtggtgttccacagcacagtgattgccaagaggaaggaggacagcggcaagatcaagctgctgctgcactggatgcctgaggacatcctgcctgatgtgtgggtgaatgaaagtgagcggcaccagctgaagaccaaggtggtgcacctgagcaagctgcccaaggacacagccctgctgctggaccccaacatctaccgcaccatgccccagaagaggctgaagaggaccctcatcaggaaggtgttcaacctgtacctgagcaagcagtag

SEQ ID NO: 14973 - DNA, 1314 bp, Artificial Sequence
  Description of Artificial Sequence: Synthetic coding sequence
atggctgctgccatcacagacatggctgacctggaggagctgagccggctgagccccctgcccccaggcagccctggcagcgctgcccggggccgggcagagcccccagaggaggaggaggaggatgagagcagcagcagcggcggcggggaggaggagagcagcgctgagagcctggtgggcagcagcggcggcagcagcagtgatgagaccaggagcctgagccctggggccgccagcagcagcagtggagatggagatggcaaggagggcctggaggagcccaagggcccccggggcagccagggcggcggcggcggcggcagcagcagcagctctgtggtgtcctctggaggagatgagggctatggaactggaggcggcggcagcagcgccaccagcggcggcagaagaggcagcctggagatgagcagtgatggagagcccctgagcaggatggattctgaggacagcatcagcagcaccatcatggatgtggacagcaccatcagcagcggccgcagcaccccagccatgatgaatggccagggcagcaccaccagcagcagcaagaacatcgcctacaactgctgctgggaccagtgccaggcctgcttcaacagcagcccagacctggccgaccacatccgcagcatccacgtggatggccagagaggaggagtgtttgtgtgcctgtggaagggctgcaaggtgtacaacacccccagcaccagccagagctggctgcagaggcacatgctgacccacagcggggacaagcccttcaagtgtgtggtgggcggctgcaatgccagctttgccagccagggcggcctggcccggcacgtgcccacccacttcagccagcagaacagcagcaaggtgagcagccagcccaaggccaaggaggagagccccagcaaggccggcatgaacaagaggaggaagctgaagaacaagagaagaagaagcctgccccggccccatgacttctttgatgcccagaccctggatgccatccgccaccgggccatctgcttcaacctgagcgcccacatcgagagcctgggcaagggccacagcgtggtgttccacagcacagtgattgccaagaggaaggaggacagcggcaagatcaagctgctgctgcactggatgcctgaggacatcctgcctgatgtgtgggtgaatgaaagtgagcggcaccagctgaagaccaaggtggtgcacctgagcaagctgcccaaggacacagccctgctgctggaccccaacatctaccgcaccatgccccagaagaggctgaagaggtag

SEQ ID NO: 14974 - DNA, 3681 bp, Artificial Sequence
  Description of Artificial Sequence: Synthetic coding sequence
atggacagctttgacctggccctgctgcaggagtgggacctggagagcctgtgtgtgtatgagccagacagaaatgccctgcggaggaaggagcgggagaggaggaaccaggagacccagcaggatgatggcaccttcaacagcagctacagcctcttcagcgagccctacaagaccaacaagggagatgagctgagcaaccgcatccagaacaccctgggcaactatgatgagatgaaggacttcctgacagacaggagcaaccagagccacctggtgggcgtgcccaagccaggagtgccccagacccctgtgaacaagattgatgagcactttgtggccgacagccgggcccagaaccagcccagcagcatctgcagcaccaccaccagcaccccagctgctgtgcctgtgcagcagagcaagaggggcaccatgggctggcagaaggccggccaccccccatctgatggccagcagagggccacccagcagggcagcctgcggaccctgctgggagatggagtgggccggcagcagccccgggccaagcaggtgtgcaatgtggaggtgggcctgcagacccaggagcggcccccagccatggccgccaagcacagcagcagcggccactgtgtgcagaacttcccccccagcctggccagcaagcccagcctggtgcagcagaagcccacagcctacgtgcggcccatggatggccaggaccaggccccagatgagagccccaagctgaagagcagcagcgagacctctgtgcactgcaccagctaccggggcgtgcctgccagcaagccagagcccgcccgggccaaggccaagctgagcaagttcagcatccccaagcagggcgaggagagccgctctggagagaccaacagctgtgtggaggagatcatccgggagatgacctggctgccccccctgagcgccatccaggcccctgggaaggtggagcccaccaagttccccttccccaacaaggacagccagctggtgagcagcggccacaacaaccccaagaagggagatgctgagcctgagagcccagacagcggcaccagcaacacctccatgctggaggatgacctgaagctgagcagtgatgaggaggagaatgagcagcaggccgcccagaggacagccctgcgggccctgagtgacagcgctgtggtgcagcagcccaactgcaggacctctgtgcccagcagcaagggcagcagcagcagcagcagcagcggcagcagcagcagcagcagtgacagcgagagcagcagcggcagtgacagcgagacagagagcagcagcagcgagagcgagggcagcaagccaccccacttcagcagccctgaggccgagcccgccagcagcaacaagtggcagctggacaagtggctgaacaaggtgaacccccacaagccacccatcctgatccagaatgaaagccacggcagcgagagcaaccagtactacaaccctgtgaaggaggatgtgcaggactgtgggaaggtgcctgatgtgtgccagcccagcctgcgggagaaggagatcaagagcacctgcaaggaggagcagaggcccaggacagccaacaaggcccctggcagcaaaggagtgaagcagaagagccccccagctgctgtggccgtggccgtgtctgctgctgcccctcctcctgctgtgccctgtgccccagcagaaaatgccccagccccagcccggcgctctgctgggaagaagcccaccaggagaacagagaggaccagcgctggagatggagccaactgccacaggcctgaggagcctgctgctgctgatgccctgggcacctctgtggtggtgcccccagagcccaccaagacccggccctgtggcaacaacagagccagccacaggaaggagctgcggagctctgtgacctgtgagaagaggaggacccggggcctgagccgcatcgtgcccaagagcaaggagttcatcgagacagagagcagcagcagcagcagcagcagtgacagcgacctggagagcgagcaggaggagtaccccctgagcaaggcccagacagtggccgccagcgccagcagtggaaatgaccagaggctgaaggaggccgccgccaacggcggcagcggcccccgggcccctgtgggcagcatcaatgcccggaccaccagtgacatcgccaaggagctggaggagcagttctacaccctggtgcccttcggcagaaatgagctgctgagccccctgaaggacagtgatgagatccgcagcctgtgggtgaagattgacctgaccctgctgagccgcatccctgagcacctgccccaggagcccggggtgctgagcgccccagccaccaaggacagcgagagcgccccacccagccacaccagtgacaccccagctgagaaggccctgcccaagagcaagaggaagaggaaatgtgacaatgaagatgactaccgggagatcaagaagagccagggcgagaaggacagcagcagccggctggccaccagcaccagcaacaccctgagcgccaaccactgcaacatgaacatcaacagcgtggccatccccatcaacaagaatgagaagatgctgcggagccccatcagccccctgagtgatgccagcaagcacaagtacaccagcgaggacctgaccagcagcagccggcccaatggaaacagcctcttcaccagcgccagcagcagcaagaagcccaaggctgacagccagctgcagccccacggcggggacctgaccaaggccgcccacaacaacagcgagaacatccccctgcacaagagccggccccagaccaagccctggagccctggcagcaatggccaccgggactgcaagaggcagaagctggtgtttgatgacatgcccaggtctgctgactacttcatgcaggaggccaagaggatgaagcacaaggcagatgccatggtggagaagtttgggaaggccctgaactatgcagaggccgccctgtccttcattgaatgtggaaatgccatggagcagggccccatggagagcaagagcccctacaccatgtacagcgagaccgtggagctgatccgctatgccatgaggctgaagacccacagcggccccaatgccaccccagaggacaagcagctggccgccctgtgctaccgctgcctggccctgctgtactggaggatgttccggctgaagagggaccatgctgtgaagtacagcaaggccctgattgactacttcaagaacagcagcaaggccgcccaggcccccagcccctggggcgccagcggcaagagcacaggcacccccagccccatgagccccaaccccagccctgccagctctgtgggcagccagggcagcctgagcaatgccagcgccctgagccccagcaccatcgtgtccatcccccagaggatccaccagatggccgccaaccacgtgtccatcaccaacagcatcctgcacagctatgactactgggagatggctgacaacctggccaaggagaaccgggagttcttcaatgacctggacctgctgatgggccctgtgaccctgcacagctccatggagcacctggtgcagtacagccagcagggcctgcactggctgaggaacagcgcccacctgtcctag

SEQ ID NO: 14975 - DNA, 3756 bp, Artificial Sequence
  Description of Artificial Sequence: Synthetic coding sequence
atggacagctttgacctggccctgctgcaggagtgggacctggagagcctgtggggcgaggacatcctgaaccagagaaatgacagcctggtggtggagttccagagcagcgccagccgctgccgctctgtgtatgagccagacagaaatgccctgcggaggaaggagcgggagaggaggaaccaggagacccagcaggatgatggcaccttcaacagcagctacagcctcttcagcgagccctacaagaccaacaagggagatgagctgagcaaccgcatccagaacaccctgggcaactatgatgagatgaaggacttcctgacagacaggagcaaccagagccacctggtgggcgtgcccaagccaggagtgccccagacccctgtgaacaagattgatgagcactttgtggccgacagccgggcccagaaccagcccagcagcatctgcagcaccaccaccagcaccccagctgctgtgcctgtgcagcagagcaagaggggcaccatgggctggcagaaggccggccaccccccatctgatggccagcagagggccacccagcagggcagcctgcggaccctgctgggagatggagtgggccggcagcagccccgggccaagcaggtgtgcaatgtggaggtgggcctgcagacccaggagcggcccccagccatggccgccaagcacagcagcagcggccactgtgtgcagaacttcccccccagcctggccagcaagcccagcctggtgcagcagaagcccacagcctacgtgcggcccatggatggccaggaccaggccccagatgagagccccaagctgaagagcagcagcgagacctctgtgcactgcaccagctacagaggagtgcctgccagcaagccagagcccgcccgggccaaggccaagctgagcaagttcagcatccccaagcagggcgaggagagccgcagcggggagaccaacagctgtgtggaggagatcatccgggagatgacctggctgccccccctgagcgccatccaggcccctgggaaggtggagcccaccaagttccccttccccaacaaggacagccagctggtgagcagcggccacaacaaccccaagaagggagatgctgagcctgagagcccagattctggcaccagcaacacctccatgctggaggatgacctgaagctgagcagtgatgaggaggagaatgagcagcaggccgcccagaggacagccctgcgggccctgagtgacagcgctgtggtgcagcagcccaactgcaggacctctgtgcccagcagcaagggcagcagcagcagcagcagcagcggcagcagcagcagcagcagtgacagcgagagcagcagcggcagtgacagcgagacagagagcagcagcagcgagagcgagggcagcaagccaccccacttcagcagccctgaggccgagcccgccagcagcaacaagtggcagctggacaagtggctgaacaaggtgaacccccacaagccacccatcctgatccagaatgaaagccacggcagcgagagcaaccagtactacaaccctgtgaaggaggatgtgcaggactgtgggaaggtgcctgatgtgtgccagcccagcctgcgggagaaggagatcaagagcacctgcaaggaggagcagaggcccaggacagccaacaaggcccctggcagcaagggcgtgaagcagaagagccccccagctgctgtggccgtggccgtgtctgctgctgcccctcctcctgctgtgccctgtgccccagcagaaaatgccccagccccagccaggagatctgctgggaagaagcccaccaggagaacagagaggaccagcgctggagatggagccaactgccacaggcctgaggagcctgctgctgctgatgccctgggcacctctgtggtggtgcccccagagcccaccaagacccggccctgtggcaacaacagagccagccacaggaaggagctgcggagctctgtgacctgtgagaagaggaggacccggggcctgagcagaattgtgcccaagagcaaggagttcattgaaacagagagcagcagcagcagcagcagcagtgacagcgacctggagagcgagcaggaggagtaccccctgagcaaggcccagacagtggccgccagcgccagcagtggaaatgaccagaggctgaaggaggccgccgccaatggaggcagcggcccccgggcccctgtgggcagcatcaatgcccggaccaccagtgacatcgccaaggagctggaggagcagttctacaccctggtgccctttggaagaaatgagctgctgagccccctgaaggacagtgatgagatccgcagcctgtgggtgaagattgacctgaccctgctgagccgcatccctgagcacctgccccaggagcccggggtgctgagcgccccagccaccaaggacagcgagagcgccccacccagccacaccagtgacaccccagctgagaaggccctgcccaagagcaagaggaagaggaaatgtgacaatgaagatgactaccgggagatcaagaagagccagggcgagaaggacagcagcagccggctggccaccagcaccagcaacaccctgagcgccaaccactgcaacatgaacatcaacagcgtggccatccccatcaacaagaatgagaagatgctgcggagccccatcagccccctgagtgatgccagcaagcacaagtacaccagcgaggacctgaccagcagcagccggcccaacggcaacagcctcttcaccagcgccagcagcagcaagaagcccaaggctgacagccagctgcagccccatggaggagacctgaccaaggccgcccacaacaacagcgagaacatccccctgcacaagagccggccccagaccaagccctggagccctggcagcaatggccaccgggactgcaagaggcagaagctggtgtttgatgacatgcccaggtctgctgactacttcatgcaggaggccaagaggatgaagcacaaggcagatgccatggtggagaagtttgggaaggccctgaactatgcagaggccgccctgtccttcattgaatgtggaaatgccatggagcagggccccatggagagcaagagcccctacaccatgtacagcgagaccgtggagctgatccgctatgccatgaggctgaagacccacagcggccccaatgccaccccagaggacaagcagctggccgccctgtgctaccgctgcctggccctgctgtactggaggatgttccggctgaagagggaccatgctgtgaagtacagcaaggccctgattgactacttcaagaacagcagcaaggccgcccaggcccccagcccctggggcgccagcggcaagagcacaggcacccccagccccatgagccccaaccccagccctgccagctctgtgggcagccagggcagcctgagcaatgccagcgccctgagccccagcaccatcgtgtccatcccccagaggatccaccagatggccgccaaccacgtgtccatcaccaacagcatcctgcacagctatgactactgggagatggctgacaacctggccaaggaaaatcgggagttcttcaatgacctggacctgctgatgggccctgtgaccctgcacagctccatggagcacctggtgcagtacagccagcagggcctgcactggctgagaaattctgcccacctgtcctag

SEQ ID NO: 14976 - DNA, 3681 bp, Artificial Sequence; identical to SEQ ID NO: 14974
  Description of Artificial Sequence: Synthetic coding sequence

SEQ ID NO: 14977 - DNA, 300 bp, Artificial Sequence
  Description of Artificial Sequence: Synthetic coding sequence
atggacagctttgacctggccctgctgcaggagtgggacctggagagcctgtgtgtgtatgagccagacagaaatgccctgcggaggaaggagcgggagaggaggaaccaggagacccagcaggatgatggcaccttcaacagcagctacagcctcttcagcgagccctacaagaccaacaagggagatgagctgagcaaccgcatccagaacaccctgggcaactatgatgagatgaaggacttcctgacagacaggagcaaccagagccacctggtgggcgtgcccaagccaggatag

SEQ ID NO: 14978 - DNA, 468 bp, Artificial Sequence
  Description of Artificial Sequence: Synthetic coding sequence
atggacagctttgacctggccctgctgcaggagtgggacctggagagcctgtgtgtgtatgagccagacagaaatgccctgcggaggaaggagcgggagaggaggaaccaggagacccagcaggatgatggcaccttcaacagcagctacagcctcttcagcgagccctacaagaccaacaagggagatgagctgagcaaccgcatccagaacaccctgggcaactatgatgagatgaaggacttcctgacagacaggagcaaccagagccacctggtgggcgtgcccaagccaggagtgccccagacccctgtgaacaagattgatgagcactttgtggccgacagccgggcccagaaccagcccagcagcatctgcagcaccaccaccagcaccccagctgctgtgcctgtgcagcagagcaagaggggcaccatgggctggcagaaggccggccaccccccatag

SEQ ID NO: 14979 - DNA, 345 bp, Artificial Sequence
  Description of Artificial Sequence: Synthetic coding sequence
atggacagctttgacctggccctgctgcaggagtgggacctggagagcctgtgtgtgtatgagccagacagaaatgccctgcggaggaaggagcgggagaggaggaaccaggagacccagcaggatgatggcaccttcaacagcagctacagcctcttcagcgagccctacaagaccaacaagggagatgagctgagcaaccgcatccagaacaccctgggcaactatgatgagatgaaggacttcctgacagacaggagcaaccagagccacctggtgggcgtgcccaagccaggagtgccccagacccctgtgaacaagattgatgagcactttgtggcctag

SEQ ID NO: 14980 - DNA, 54 bp, Artificial Sequence
  Description of Artificial Sequence: Synthetic coding sequence
atggacagctttgacctggccctgctgcaggagtgggacctggagagcctgtag

SEQ ID NO: 14981 - DNA, 486 bp, Artificial Sequence
  Description of Artificial Sequence: Synthetic coding sequence
atggacagctttgacctggccctgctgcaggagtgggacctggagagcctgtgtgtgtatgagccagacagaaatgccctgcggaggaaggagcgggagaggaggaaccaggagacccagcaggatgatggcaccttcaacagcagctacagcctcttcagcgagccctacaagaccaacaagggagatgagctgagcaaccgcatccagaacaccctgggcaactatgatgagatgaaggacttcctgacagacaggagcaaccagagccacctggtgggcgtgcccaagccaggagtgccccagacccctgtgaacaagattgatgagcactttgtggccgacagccgggcccagaaccagcccagcagcatctgcagcaccaccaccagcaccccagctgctgtgcctgtgcagcagagcaagaggggcaccatgggctggcagaaggccggccaccccccatctgatggccagcagaggtag

SEQ ID NO: 14982 - DNA, 2346 bp, Artificial Sequence
  Description of Artificial Sequence: Synthetic coding sequence
atggacagctttgacctggccctgctgcaggagtgggacctggagagcctgtggggcgaggacatcctgaaccagagaaatgacagcctggtggtggagttccagagcagcgccagccgctgccgctctgtgtatgagccagacagaaatgccctgcggaggaaggagcgggagaggaggaaccaggagacccagcaggatgatggcaccttcaacagcagctacagcctcttcagcgagccctacaagaccaacaagggagatgagctgagcaaccgcatccagaacaccctgggcaactatgatgagatgaaggacttcctgacagacaggagcaaccagagccacctggtgggcgtgcccaagccaggagtgccccagacccctgtgaacaagattgatgagcactttgtggccgacagccgggcccagaaccagcccagcagcatctgcagcaccaccaccagcaccccagctgctgtgcctgtgcagcagagcaagaggggcaccatgggctggcagaaggccggccaccccccatctgatggccagcagagggccacccagcagggcagcctgcggaccctgctgggagatggagtgggccggcagcagccccgggccaagcaggtgtgcaatgtggaggtgggcctgcagacccaggagcggcccccagccatggccgccaagcacagcagcagcggccactgtgtgcagaacttcccccccagcctggccagcaagcccagcctggtgcagcagaagcccacagcctacgtgcggcccatggatggccaggaccaggccccagatgagagccccaagctgaagagcagcagcgagacctctgtgcactgcaccagctacagaggagtgcctgccagcaagccagagcccgcccgggccaaggccaagctgagcaagttcagcatccccaagcagggcgaggagagccgcagcggggagaccaacagctgtgtggaggagatcatccgggagatgacctggctgccccccctgagcgccatccaggcccctgggaaggtggagcccaccaagttccccttccccaacaaggacagccagctggtgagcagcggccacaacaaccccaagaagggagatgctgagcctgagagcccagattctggcaccagcaacacctccatgctggaggatgacctgaagctgagcagtgatgaggaggagaatgagcagcaggccgcccagaggacagccctgcgggccctgagtgacagcgctgtggtgcagcagcccaactgcaggacctctgtgcccagcagcaagggcagcagcagcagcagcagcagcggcagcagcagcagcagcagtgacagcgagagcagcagcggcagtgacagcgagacagagagcagcagcagcgagagcgagggcagcaagccaccccacttcagcagccctgaggccgagcccgccagcagcaacaagtggcagctggacaagtggctgaacaaggtgaacccccacaagccacccatcctgatccagaatgaaagccacggcagcgagagcaaccagtactacaaccctgtgaaggaggatgtgcaggactgtgggaaggtgcctgatgtgtgccagcccagcctgcgggagaaggagatcaagagcacctgcaaggaggagcagaggcccaggacagccaacaaggcccctggcagcaagggcgtgaagcagaagagccccccagctgctgtggccgtggccgtgtctgctgctgcccctcctcctgctgtgccctgtgccccagcagaaaatgccccagccccagccaggagatctgctgggaagaagcccaccaggagaacagagaggaccagcgctggagatggagccaactgccacaggcctgaggagcctgctgctgctgatgccctgggcacctctgtggtggtgcccccagagcccaccaagacccggccctgtggcaacaacagagccagccacaggaaggagctgcggagctctgtgacctgtgagaagaggaggacccggggcctgagcagaattgtgcccaagagcaaggagttcattgaaacagagagcagcagcagcagcagcagcagtgacagcgacctggagagcgagcaggaggagtaccccctgagcaaggcccagacagtggccgccagcgccagcagtggaaatgaccagaggctgaaggaggccgccgccaatggaggcagcggcccccgggcccctgtgggcagcatcaatgcccggaccaccagtgacatcgccaaggagctggaggagcagttctacaccctggtgcccctggccggcaccaacttcagccccctgtag

SEQ ID NO: 14983 - DNA, 2610 bp, Artificial Sequence
  Description of Artificial Sequence: Synthetic coding sequence
atggacagctttgacctggccctgctgcaggagtgggacctggagagcctgtgtgtgtatgagccagacagaaatgccctgcggaggaaggagcgggagaggaggaaccaggagacccagcaggatgatggcaccttcaacagcagctacagcctcttcagcgagccctacaagaccaacaagggagatgagctgagcaaccgcatccagaacaccctgggcaactatgatgagatgaaggacttcctgacagacaggagcaaccagagccacctggtgggcgtgcccaagccaggagtgccccagacccctgtgaacaagattgatgagcactttgtggccgacagccgggcccagaaccagcccagcagcatctgcagcaccaccaccagcaccccagctgctgtgcctgtgcagcagagcaagaggggcaccatgggctggcagaaggccggccaccccccatctgatggccagcagagggccacccagcagggcagcctgcggaccctgctgggagatggagtgggccggcagcagccccgggccaagcaggtgtgcaatgtggaggtgggcctgcagacccaggagcggcccccagccatggccgccaagcacagcagcagcggccactgtgtgcagaacttcccccccagcctggccagcaagcccagcctggtgcagcagaagcccacagcctacgtgcggcccatggatggccaggaccaggccccagatgagagccccaagctgaagagcagcagcgagacctctgtgcactgcaccagctaccggggcgtgcctgccagcaagccagagcccgcccgggccaaggccaagctgagcaagttcagcatccccaagcagggcgaggagagccgctctggagagaccaacagctgtgtggaggagatcatccgggagatgacctggctgccccccctgagcgccatccaggcccctgggaaggtggagcccaccaagttccccttccccaacaaggacagccagctggtgagcagcggccacaacaaccccaagaagggagatgctgagcctgagagcccagacagcggcaccagcaacacctccatgctggaggatgacctgaagctgagcagtgatgaggaggagaatgagcagcaggccgcccagaggacagccctgcgggccctgagtgacagcgctgtggtgcagcagcccaactgcaggacctctgtgcccagcagcaagggcagcagcagcagcagcagcagcggcagcagcagcagcagcagtgacagcgagagcagcagcggcagtgacagcgagacagagagcagcagcagcgagagcgagggcagcaagccaccccacttcagcagccctgaggccgagcccgccagcagcaacaagtggcagctggacaagtggctgaacaaggtgaacccccacaagccacccatcctgatccagaatgaaagccacggcagcgagagcaaccagtactacaaccctgtgaaggaggatgtgcaggactgtgggaaggtgcctgatgtgtgccagcccagcctgcgggagaaggagatcaagagcacctgcaaggaggagcagaggcccaggacagccaacaaggcccctggcagcaaaggagtgaagcagaagagccccccagctgctgtggccgtggccgtgtctgctgctgcccctcctcctgctgtgccctgtgccccagcagaaaatgccccagccccagcccggcgctctgctgggaagaagcccaccaggagaacagagaggaccagcgctggagatggagccaactgccacaggcctgaggagcctgctgctgctgatgccctgggcacctctgtggtggtgcccccagagcccaccaagacccggccctgtggcaacaacagagccagccacaggaaggagctgcggagctctgtgacctgtgagaagaggaggacccggggcctgagccgcatcgtgcccaagagcaaggagttcatcgagacagagagcagcagcagcagcagcagcagtgacagcgacctggagagcgagcaggaggagtaccccctgagcaaggcccagacagtggccgccagcgccagcagtggaaatgaccagaggctgaaggaggccgccgccaacggcggcagcggcccccgggcccctgtgggcagcatcaatgcccggaccaccagtgacatcgccaaggagctggaggagcagttctacaccctggtgcccttcggcagaaatgagctgctgagccccctgaaggacagtgatgagatccgcagcctgtgggtgaagattgacctgaccctgctgagccgcatccctgagcacctgccccaggagcccggggtgctgagcgccccagccaccaaggacagcgagagcgccccacccagccacaccagtgacaccccagctgagaaggccctgcccaagagcaagaggaagaggaaatgtgacaatgaagatgactaccgggagatcaagaagagccagggcgagaaggacagcagcagccggctggccaccagcaccagcaacaccctgagcgccaaccactgcaacatgaacatcaacagcatgcagctgcccatctag

SEQ ID NO: 14984 - DNA, 390 bp, Artificial Sequence
  Description of Artificial Sequence: Synthetic coding sequence
atggacagctttgacctggccctgctgcaggagtgggacctggagagcctgtgtgtgtatgagccagacagaaatgccctgcggaggaaggagcgggagaggaggaaccaggagacccagcaggatgatggcaccttcaacagcagctacagcctcttcagcgagccctacaagaccaacaagggagatgagctgagcaaccgcatccagaacaccctgggcaactatgatgagatgaaggacttcctgacagacaggagcaaccagagccacctggtgggcgtgcccaagccaggagtgccccagacccctgtgaacaagattgatgagcactttgtggccgacagccgggcccagaaccagcccagcagcatctgcagcaccacctag

SEQ ID NO: 14985 - DNA, 3066 bp, Artificial Sequence
  Description of Artificial Sequence: Synthetic coding sequence
atgaccctgcggctggatgctgggggcatccccagcctggccccccgggtgtacatcagcggcagccccagccagcgcttcctgcccaggaagaggaacaagggggagagcgctggccgggacagcctgctggccggcagcgcccgcttcggcagcagaggagaggcccagctgcagggcagcgagctgctgagcaggaacagcggggagagcctggtgcgcatccgcagctgtggccaggagctgatcacctgcctgagcaggcctgagactggaggcaagtttgaggtggacacccagaggcctgtgtgcccccccagccgggcccgggccgcccgggccagcgctgctgctgtggccgccgccgccaccctgaccccacccaccatggacagctttgacctggccctgctgcaggagtgggacctggagagcctgtggggcgaggacatcctgaaccagagaaatgacagcctggtggtggagttccagagcagcgccagccgctgccgctctgtgtatgagccagacagaaatgccctgcggaggaaggagcgggagaggaggaaccaggagacccagcaggatgatggcaccttcaacagcagctacagcctcttcagcgagccctacaagaccaacaagggagatgagctgagcaaccgcatccagaacaccctgggcaactatgatgagatgaaggacttcctgacagacaggagcaaccagagccacctggtgggcgtgcccaagccaggagtgccccagacccctgtgaacaagattgatgagcactttgtggccgacagccgggcccagaaccagcccagcagcatctgcagcaccaccaccagcaccccagctgctgtgcctgtgcagcagagcaagaggggcaccatgggctggcagaaggccggccaccccccatctgatggccagcagagggccacccagcagggcagcctgcggaccctgctgggagatggagtgggccggcagcagccccgggccaagcaggtgtgcaatgtggaggtgggcctgcagacccaggagcggcccccagccatggccgccaagcacagcagcagcggccactgtgtgcagaacttcccccccagcctggccagcaagcccagcctggtgcagcagaagcccacagcctacgtgcggcccatggatggccaggaccaggccccagatgagagccccaagctgaagagcagcagcgagacctctgtgcactgcaccagctaccggggcgtgcctgccagcaagccagagcccgcccgggccaaggccaagctgagcaagttcagcatccccaagcagggcgaggagagccgctctggagagaccaacagctgtgtggaggagatcatccgggagatgacctggctgccccccctgagcgccatccaggcccctgggaaggtggagcccaccaagttccccttccccaacaaggacagccagctggtgagcagcggccacaacaaccccaagaagggagatgctgagcctgagagcccagacagcggcaccagcaacacctccatgctggaggatgacctgaagctgagcagtgatgaggaggagaatgagcaggccgcccagaggacagccctgcgggccctgagtgacagcgctgtggtgcagcagcccaactgcaggacctctgtgcccagcagcaagggcagcagcagcagcagcagcagcggcagcagcagcagcagcagtgacagcgagagcagcagcggcagtgacagcgagacagagagcagcagcagcgagagcgagggcagcaagccaccccacttcagcagccctgaggccgagcccgccagcagcaacaagtggcagctggacaagtggctgaacaaggtgaacccccacaagccacccatcctgatccagaatgaaagccacggcagcgagagcaaccagtactacaaccctgtgaaggaggatgtgcaggactgtgggaaggtgcctgatgtgtgccagcccagcctgcgggagaaggagatcaagagcacctgcaaggaggagcagaggcccaggacagccaacaaggcccctggcagcaagggcgtgaagcagaagagccccccagctgctgtggccgtggccgtgtctgctgctgcccctcctcctgctgtgccctgtgccccagcagaaaatgccccagccccagccaggagatctgctgggaagaagcccaccaggagaacagagaggaccagcgctggagatggagccaactgccacaggcctgaggagcctgctgctgctgatgccctgggcacctctgtggtggtgcccccagagcccaccaagacccggccctgtggcaacaacagagccagccacaggaaggagctgcggagctctgtgacctgtgagaagaggaggacccggggcctgagcagaattgtgcccaagagcaaggagttcattgaaacagagagcagcagcagcagcagcagcagtgacagcgacctggagagcgagcaggaggagtaccccctgagcaaggcccagacagtggccgccagcgccagcagtggaaatgaccagaggctgaaggaggccgccgccaatggaggcagcggcccccgggcccctgtgggcagcatcaatgcccggaccaccagtgacatcgccaaggagctggaggagcagttctacaccctggtgccctttggaagaaatgagctgctgagccccctgaaggacagtgatgagatccgcagcctgtgggtgaagattgacctgaccctgctgagccgcatccctgagcacctgccccaggagcccggggtgctgagcgccccagccaccaaggacagcgagagcgccccacccagccacaccagtgacaccccagctgagaaggccctgcccaagagcaagaggaagaggaaatgtgacaatgaagatgactaccgggagatcaagaagagccagggcgagaaggacagcagcagccggctggccaccagcaccagcaacaccctgagcgccaaccactgcaacatgaacatcaacagcctgagcctgccctag

SEQ ID NO: 14986 - DNA, 17388 bp, Artificial Sequence
  Description of Artificial Sequence: Synthetic coding sequence
atgtgtgactgcttccacatggtgctgcccacctggccaggcaccccaggctctgtgtctggccggcagctgcagcccggggagcctggagctgagacagaagatgaccacagcgtgacagagggccctgcagatgagggcatccggccccggccccagggcagcagccctgtgtatgagtacaccacagaagctgctgactttggcctgcaggaggatgcccctggccggcagggcagcgctggaagaagaagatcctggtggaagagggacagcggggacagcaggaccttcttcaggatgagcaggcctgaggccgtgcaggaggccacagaggtgaccctgaagacagaggtggaggccggggccagcggctacagcgtgactggaggaggagaccagggcatctttgtgaagcaggtgctgaaggacagcagcgctgccaagctgttcaacctgcgggagggggaccagctgctgagcaccaccgtcttctttgagaacatcaagtatgaagatgccctgaagatcctgcagtacagcgagccctacaaggtgcagttcaagatccggcggcagctgcctgccccccaggatgaggagtgggccagcagtgatgcccagcacggcccccagggcaaggagaaggaggacacagatgtggctgatggctgccgggagacccccaccaagaccctggagggagatggagaccaggagcggctcatcagcaagccccgggtgggccggggccggcagagccagcgggagcggctgtcctggcccaagttccagagcatcaagagcaagaggggccctggcccccagaggagccacagcagcagcgaggcctatgagcccagagatgcccatgatgtgagccccaccagcacagacacagaggcccagctgactgtggagcggcaggagcagaaggccggccctggcagccagaggaggaggaagttcctgaacctgcgcttcagaacaggcagcggccagggccccagcagcacaggccagcccggccggggcttccagagcggcgtgggccgggccggcgtgctggaggagctgggcccctggggagacagcctggaggagactggagctgccaccggcagccggcgggaggagagagctgagcaggaccgggaggtgatgcctgcccagagcatgcccctgcccacagagctgggggacccccggctgtgtgagggcaccccccaggagggcggcctgcgggccgcccggctgcacggcaagaccctggagggccaggcccaggagacagctgtggcccagaggaagccccgggcccagcccaccccaggcatgagccgggagggggagggggagggcctgcagagcctggagatcggcatcgcccggctgagcctgcgggacaccacagaaggaggcacccagatcggccccccagagatccgggtgcgggtgcatgacctgaagacccccaagtttgccttcagcacagagaaggagcctgagcgggagcggcggctgagcaccccccagaggggcaagaggcaggatgccagcagcaaggccggcaccggcctgaagggggaggaggtggagggcgccggctggatgcctggccgggagcccaccacccatgctgaggcccagggagatgaaggagatggagaggagggcctgcagaggacccgcatcacagaggagcaggacaagggccgggaggacacagagggccagatccgcatgcccaagttcaagatccccagcctgggctggagccccagcaagcacaccaagacaggccgggagaaggccacagaggacacagagcagggccgggagggggaggccacagccacagctgacagaagagagcagaggagaacagaggagggcctgaaggacaaggaggacagcgacagcatgaccaacaccaccaagatccagctgattcatgatgagaagaggctgaagaaggagcagatcctgacagagaaggaggtggccaccaaggacagcaagttcaagatgcccaagttcaagatgcccctgtttggagccagcgcccctgggaagtccatggaggcctctgtggatgtgtctgcccccaaggtggaggctgatgtgtccctgctgtccatgcagggcgacctgaagaccacagacctgtctgtgcagaccccatctgctgacctggaggtgcaggacggccaggtggatgtgaagctgcctgagggccccctgcctgagggcgccagcctgaagggccacctgcccaaggtgcagaggcccagcctgaagatgcccaaggtggacctgaagggccccaagctggacctgaagggccccaaggccgaggtgacagccccagatgtgaagatgagcctgagctccatggaggtggatgtgcaggccccccgggccaagctggatggagcccggctggagggggacctgagcctggccgacaaggaggtgacagccaaggacagcaagttcaagatgcccaagttcaagatgcccagctttggagtgtctgcccctgggaagtccatggaggacagcgtggatgtgtctgcccccaaggtggaggctgatgtgtccctgagctccatgcagggcgacctgaaggccacagacctgagcatccagcccccatctgctgacctggaggtgcaggccggccaggtggatgtgaagctgcctgagggccctgtgcctgagggcgccggccccaaggtgcacctgcccaaggtggagatgcccagcttcaagatgcccaaggtggacctgaagggcccccagattgatgtgaagggccccaagctggacctgaagggccccaaggccgaggtgacagccccagatggagaggtgtccctgcccagcatggaggtggatgtgcaggcccagaaggccaagctggatggagcctggctggagggggacctgagcctggccgacaaggatgtgacagccaaggacagcaagttcaagatgcccaagttcaagatgcccagctttggagtgtctgcccctgggaagagcatcaaggccctggtggatgtgtctgcccccaaggtggaggccgacctgagcctgcccagcatgcagggcgacctgaagaccacagacctgagcatccagcctgccagcacagacctgaaggtgcaggccgaccaggtggatgtgaagctgcctgagggccacctgcctgagggcgccggcctgaagggccacctgcccaaggtggagatgcccagcttcaagatgcccaaggtggccctgaagggcccccaggtggatgtgaagggccccaagctggacctgaagagccccaaggccgaggtgacagccccagatgtggaggtgtccctgcccagcgtggaggtggatgtggaggcccctggggccaagctggacagcgcccggctggagggggagctgagcctggccgacaaggatgtgacagccaaggacagccgcttcaagatgcccaagttcaagatgcccagctttggagccagcgcccctgggaagagcattgaggcctctgtggatgtgtctgcccccaaggtggaggctgatgtgtccctgcccagcatgcagggcgacctgaagaccacagacctgagcatccagcccccatctgctgacctggaggtgcacgccggccaggtggatgtgaagctgctggagggccacgtgcctgagggcgccggcttcaagggccacctgcccaaggtgcagatgcccagcctgaagatgcccaaggtggacctgaagggcccccaggtggaggtgcggggccccaagctggacctgaagggccacaaggccgaggtgacagcccacgaggtggccgtgtccctgcccagcgtggaggtggacatgcaggcccctggggccaagctggatggagcccagctggatggagacctgagcctggccgacaaggatgtgacagccaaggacagcaagttcaagatgcccaagttcaagatgcccagctttggagtgtctgcccctgggaagagcattgaggcctctgtggacctgagcgcccccaaggtggaggccgacatgagcctgcccagcatgcagggcgacctgaagaccacagacctgagcatccagccccccagcacagacctggagctgcaggccggccagctggatgtgaagctgcctgagggccctgtgcctgagggcgccggcctgaagggccacctgcccaagctgcagatgcccagcttcaaggtgcccaaggtggacctgaagggccctgagattgacatcaagggccccaagctggacctgaaggaccccaaggtggaggtgacagccccagatgtggaggtgtccctgcccagcgtggaggtggatgtggaggcccctggggccaagctggatggcggccgcctggaggaggacatgagcctggccgacaaggacctgaccaccaaggacagcaagttcaagatgcccaagttcaagatgcccagctttggagtgtctgcccctgggaagagcattgaggcctctgtggatgtgtctgcccccaaggtggaggctgatgtgtccctgcccagcatgcagggcgacctgaaggccacagacctgagcatccagcccccatctgctgacctggaggtgcaggccggccaggtggatgtgaagctgcctgagggccctgtgtctgagggcgccggcctgaagggccacctgcccaaggtgcagatgcccagcttcaagatgcccaaggtggacctgaagggcccccagattgatgtgaagggccccaagctggacctgaagggccccaaggtggaggtgacagccccagatgtgaagatgagcctgagctccatggaggtggatgtgcaggccccccgggccaagctggatggagcccagctggagggggacctgagcctggccgacaaggctgtgacagccaaggacagcaagttcaagatgcccaagttcaagatgcccagctttggagtgtctgcccctgggaagagcattgaggcctctgtggatgtgtctgagcccaaggtggaggctgatgtgtccctgcccagcatgcagggcgacctgaagaccacagacctgagcatccagagccccagcgctgacctggaggtgcaggccggccaggtgaatgtgaagctgcctgagggccccctgcctgagggcgccggcttcaagggccacctgcccaaggtgcagatgcccagcctgaagatgcccaaggtggccctgaagggcccccagatggatgtgaagggccccaagctggacctgaagggccccaaggccgaggtgatggccccagatgtggaggtgtccctgcccagcgtggaggtggatgtggaggcccctggggccaagctggacagcgtgcggctggagggggacctgagcctggccgacaaggatgtgacagccaaggacagcaagttcaagatgcccaagttcaagatgcccagctttggagtgtctgcccctgggaagagcattgaggcctctgtggatgtgtctgcccccaaggtggaggccgaggtgtccctgcccagcatgcagggcgacctgaagaccacagacctgtgcatccccctgcccagcgctgacctggtggtgcaggccggccaggtggacatgaagctgcctgagggccaggtgcctgagggcgccggcctgaagggccacctgcccaaggtggacatgcccagcttcaagatgcccaaggtggacctgaagggcccccagacagatgtgaagggggccaagctggacctgaagggccccaaggccgaggtgacagccccagatgtggaggtgtccctgcccagcatggaggtggatgtgcaggcccagaaggccaagctggatggagcccggctggagggggacctgagcctggccgacaaggacatgacagccaaggacagcaagttcaagatgcccaagttcaagatgcccagctttggagtgtctgcccctggccgcagcattgaggcctctgtggatgtgcctgcccccaaggtggaggctgatgtgtccctgcccagcatgcagggcgacctgaagaccacagacctgagcatccagccccccagcgctgacctgaaggtgcagacaggccaggtggatgtgaagctgcctgagggccacgtgcctgagggcgccggcctgaagggccacctgcccaaggtggagatgcccagcctgaagatgcccaaggtggacctgaagggcccccaggtggacatcaagggccccaagctggacctgaaggaccccaaggtggagatgagggtgcctgatgtggaggtgtccctgcccagcatggaggtggatgtgcaggccccccgggccaagctggacagcgcccacctgcagggcgacctgaccctggccaacaaggacctgaccaccaaggacagcaagttcaagatgcccaagttcaagatgcccagctttggagtgtctgcccctgggaagagcattgaggcctctgtggatgtgagcccccccaaggtggaggccgacatgagcctgcccagcatgcagggcgacctgaagaccacagacctgagcatccagcccctgtctgcagatgtgaaggtgcaggccggccaggtggatgtgaagctgctggagggccctgtgcctgaggaggtgggcctgaagggccacctgcccaagctgcagatgcccagcttcaaggtgcccaaggtggacctgaagggccctgagattgacatcaagggccccaagctggacctgaaggaccccaaggtggaggtgacagccccagatgtggaggtgtccctgcccagcgtggaggtggatgtgaaggcccctggggccaagctggatggagcccggctggagggggacatgagcctggccgacaaggatgtgacagccaaggacagcaagttcaagatgcccaagttcaagatgctgagctttggagtgtctgccctgggcaagagcattgaggccagcgcagatgtgtctgccctgaaggtggaggctgatgtgtccctgcccagcatgcagggcgacctgaagaccacagacctgtctgtgcagccccccagcgctgacctggaggtgcaggccggccaggtggatgtgaagctgcctgagggccctgtgcctgagggcgccggcctgaagggccacctgcccaagctgcagatgcccagcttcaagatgcccaaggtggacctgaagggcccccagattgatgtgaagggccccaagctggacctgaagggccccaagacagatgtgatggccccagatgtggaggtgtcccagcccagcgtggaggtggatgtggaggcccctggggccaagctggatggagcctggctggagggggacctgtctgtggccgacaaggatgtgaccaccaaggacagccgcttcaagatccccaagttcaagatgcccagctttggagtgtctgcccctgggaagagcattgaggcctctgtggatgtgtctgcccccaaggtggaggctgatggcagcctgagctccatgcagggcgacctgaaggccacagacctgagcatccagcccccatctgctgacctggaggtgcaggccggccaggtggatgtgaagctgcctgagggccctgtgcctgagggcgccggcctgaagggccacctgcccaaggtgcagatgcccagcttcaagatgcctgagatggacctgaagggcccccagctggatgtgaagggccccaagctggacctgaagggccccaaggccgaggtgacagccccagatgtggagatgagcctgagctccatggaggtggatgtgcaggccccccgggccaagctggatggagcccggctggagggggacctgagcctggccgacaagggcgtgacagccaaggacagcaagttcaagatgcccaagttcaagatgcccagcttccgggtgtctgcccctggagagagcattgaggccctggtggatgtgtctgagctgaaggtggaggccgacatgagcctgcccagcatgcagggcgacctgaagaccacagacatcagcatccagccccccagcgcccagctggaggtgcaggccggccaggtggatgtgaagctgcctgagggccacgtgcctgagggcgccggcctgaagggccacctgcccaagctgcagatgcccagcttcaagatgcctgaggtggacctgaagggcccccagattgatgtgaagggccccaacgtggacctgaagggccccaaggccgaggtgacagccccagatgtgaagatgagcctgagctccatggaggtggatgtgcaggccccccgggccaagctggatggagcccggctggagggggacctgagcctggccgacaagggcatgacagccaaggacagcaagttcaagatgcccaagttcaagatgcccagctttggagtgtctgcccctgggaagagcattgaggcctctgtggatgtgtctgagctgaaggtggaggctgatggcagcttccccagcatgcagggcgacctgaagaccacagacatccgcatccagcccccatctgcccagctggaggtgcaggccggccaggtggatgtgaagctgcctgagggccacgtgcctgagggcgccggcctgaagggccacctgcccaaggtgcagatgcccagcttcaagatgcccaaggtggacctgaagggcccccagattgatgtgaagggccccaagctggacctgaagggccccaaggccgaggtgacagccccagatgtggaggtgtccctgcccagcgtggaggtggatgtggaggccccccgggccaagctggatggagcccggctggagggggacctgagcctggccgacaaggatgtgacagccaaggacagcaagttcaagatgcccaagttcaagatgcccagctttggagtgtctgcccctgggaagagcattgaggtgtctgtggatgtgtctgcccccaaggtggaggccgaggtgtccctgcccagcatgcagggcgacctgaagaccacagacatcagcattgagccccccagcgcccagctggaggtgcaggccggccaggtggacctgaagctgcctgagggccacgtgcctgagggcgccggcctgaagggccacctgcccaagctgcagatgcccagcttcaagatgcccaaggtggacaggaagggcccccagattgatgtgaagggccccaagctggacctgaagggccccaagacagatgtgacagccccagatgtggaggtgtcccagcccggcatggaggtggatgtggaggcccctggggccaagctggatggagcccggctggagggggacctgagcctggccgacaaggatgtgacagccaaggacagcaagttcaagatgcccaagttcaagatgcccagctttggagtgtctgcccctgggaagagcattgaggtgctggtggatgtgtctgcccccaaggtggaggccgacctgagcctgcccagcatgcagggcgacctgaagaacacagacatcagcattgagcccccatctgcccagctggaggtgcaggccggccaggtggatgtgaagctgcctgagggccacgtgctggagggcgccggcctgaagggccacctgcccaagctgcagatgcccagcttcaagatgcccaaggtggacaggaagggcccccagattgacatcaagggccccaagctggacctgaagggccccaagatggatgtgacagccccagatgtggaggtgtcccagcccagcatggaggtggatgtggaggcccctggggccaagctggatggagcccggctggagggggacctgagcctggccgacaaggatgtgacagccaaggacagcaagttcaagatgcccaagttcaagatgcccagctaccgggccagcgcccctgggaagagcatccaggcctctgtggatgtgtctgcccccaaggccgaggctgatgtgtccctgcccagcatgcagggcgacctgaagaccacagacctgagcatccagctgcccagcgtggacctggaggtgcaggccggccaggtggatgtgaagctgcctgagggccacgtgcctgagggcgccggcctgaagggccacctgcccaaggtggagatgcccagcttcaagatgcccaaggtggacctgaagagcccccaggtggacatcaagggccccaagctggacctgaaggtgcccaaggccgaggtgacagtgcctgatgtggaggtgtccctgcccagcgtggaggtggatgtgcaggccccccgggccaagctggatggagcccggctggagggggacctgagcctggccgagaaggatgtgacagccaaggacagcaagttcaagatgcccaagttcaagatgcccagctttggagtgtctgcccctggccgcagcattgaggccagcctggatgtgtctgcccccaaggtggaggctgatgtgtccctgagctccatgcagggcgacctgaaggccacagacctgagcatccagcccccatctgctgacctggaggtgcaggccgtgcaggtggatgtggagctgctggagggccctgtgcctgagggcgccggcctgaagggccacctgcccaaggtggagatgcccagcctgaagacccccaaggtggacctgaagggcccccagattgatgtgaagggccccaagctggacctgaagggccccaaggccgaggtgcgggtgcctgatgtggaggtgtccctgcccagcgtggaggtggatgtgcaggcccccaaggccaagctggatgctggccgcctggagggggacctgagcctggccgacaaggatgtgacagccaaggacagcaagttcaagatgcccaagttcaagatgcccagcttccgggtgtctgcccctgggaagtccatggaggcctctgtggatgtgtctgcccccaaggtggaggctgatgtgtccctgcccagcatgcagggcgacctgaagaccacagacctgagcatccagccccccagcgctgacctgaaggtgcaggccggccagatggatgtgaagctgcctgagggccaggtgcctgagggcgccggcctgaaggagcacctgcccaaggtggagatgcccagcctgaagatgcccaaggtggacctgaagggcccccaggtggacatcaagggccccaagctggacctgaaggtgtccaaggccgaggtgacagccccagatgtggaggtgtccctgcccagcgtggaggtggatgtgcaggccccccgggccaagctggacagcgcccagctggagggggacctgagcctggccgacaaggatgtgacagccaaggacagcaagttcaagatgcccaagttcaagatgcccagctttggagtgtctgcccctgggaagagcattgaggcctctgtgcacgtgtctgcccccaaggtggaggctgatgtgtccctgcccagcatgcagggcgacctgaagaccacagacctgagcatccagccccacagcgctgacctgactgtgcaggcccggcaggtggacatgaagctgctggagggccacgtgcctgaggaggccggcctgaagggccacctgcccaaggtgcagatgcccagcttcaagatgcccaaggtggacctgaagggccctgagattgacatcaagggccccaagctggacctgaaggaccccaaggtggaggtgacagccccagatgtggaggtgtccctgcccagcgtggaggtggatgtggaggcccctggggccaagctggatggagcccggctggagggggacctgagcctggccgacaaggacatgacagccaaggacagcaagttcaagatgcccaagttcaagatgcccagctttggagtgtctgcccctgggaagtccatggaggcctctgtggatgtgacagcccccaaggtggaggctgatgtgtccctgcccagcatgcagggcgacctgaaggccacagacctgtctgtgcagccccccagcgctgacctggaggtgcaggccggccaggtggatgtgaagctgcctgagggccctgtgcctgagggcgccagcctgaagggccacctgcccaaggtgcagatgcccagcttcaagatgcccaaggtggacctgaagggcccccagattgatgtgaagggccccaagctggacctgaagggccccaaggccgaggtgacagccccagatgtgaagatgagcctgagctccatggaggtggatgtgcaggccccccgggccaagctggatggagtgcagctggagggggacctgagcctggccgacaaggatgtgacagccaaggacagcaagttcaagatgcccaagttcaagatgcccagctttggagtgtctgcccctgggaagtccatggaggcctctgtggatgtgtctgagctgaaggccaaggcagatgtgtccctgcccagcatgcagggcgacctgaagaccacagacctgagcatccagagccccagcgctgacctggaggtgcaggccggccaggtggatgtgaagctgcctgagggccccctgcccaagggggccggcctgaagggccacctgcccaaggtgcagatgccctgcctgaagatgcccaaggtggccctgaagggcccccaggtggatgtgaagggccccaagctggacctgaagggccccaaggcagatgtgatgacccctgtggtggaggtgtccctgcccagcatggaggtggatgtggaggcccctggggccaagctggacagcgtgcggctggagggggacctgagcctggccgacaaggacatgacagccaaggacagcaagttcaagatgcccaagttcaagatgcccagctttggagtgtctgcccctgggaagagcattgaggccagcctggatgtgtctgccctgaaggtggaggctgatgtgtccctgcccagcatgcagggcgacctgaagaccacccacctgagcatccagccccccagcgctgacctggaggtgcaggccggccaggaggatgtgaagctgcctgagggccctgtgcatgagggcgccggcctgaagggccacctgcccaagctgcagatgcccagcttcaaggtgcccaaggtggacctgaagggcccccagattgatgtgaatgtgcccaagctggacctgaagggccccaaggtggaggtgaccagccccaacctggatgtgtccctgcccagcatggaggtggacatccaggcccctggggccaagctggacagcacccggctggagggggacctgagcctggccgacaaggatgtgacagccaaggacagcaagttcaagatgcccaagttcaagatgcccagctttggcatgctgagccctgggaagagcattgaggtgtctgtggatgtgtctgcccccaagatggaggccgacatgagcatccccagcatgcagggcgacctgaagaccacagacctgcgcatccaggcccccagcgctgacctggaggtgcaggccggccaggtggacctgaagctgcctgagggccacatgcctgaggtggccggcctgaagggccacctgcccaaggtggagatgcccagcttcaagatgcccaaggtggacctgaagggcccccaggtggatgtgaagggccccaagctggacctgaagggccccaaggccgaggtgatggccccagatgtggaggtgtccctgcccagcgtggagacagatgtgcaggcccctggctccatgctggatggagcccggctggagggggacctgagcctggcccatgaagatgtggccggcaaggacagcaagttccagggccccaagctgagcaccagcggctttgagtggagcagcaagaaggtgtccatgagcagcagcgagattgagggcaatgtgaccttccacgagaagaccagcaccttccccatcgtggagagcgtggtgcatgaaggagacctgcatgaccccagcagagatggcaacctgggcctggccgtgggggaggtgggcatggacagcaagttcaagaagctgcacttcaaggtgcccaaggtgtccttcagcagcaccaagacccccaaggacagcctggtgcctggggccaagagcagcatcggcctgagcaccatccccctgagcagcagcgagtgcagcagctttgagctgcagcaggtgtctgcctgcagcgagcccagcatgcagatgcccaaggtgggctttgctggcttccccagcagccggctggacctgaccggcccccactttgagagcagcatcctgagcccctgtgaagatgtgaccctgaccaagtaccaggtgacagtgccccgggccgccctggcccctgagctggccctggagatccccagcggcagccaggccgacatccccctgcccaagacagagtgcagcacagacctgcagcccccagagggcgtgcccaccagccaggccgagagccacagcggccccctgaacagcatgatccctgtgtccctgggccaggtgtccttccccaagttctacaagcccaagtttgtgttttctgtgccccagatggctgtgcctgagggggacctgcacgccgctgtgggcgcccctgtgatgagccccctgagccctggagagcgggtgcagtgccccctgcccagcacccagctgcccagccctggcacctgtgtgtcccagggccctgaggagctggtggccagcctgcagacctctgtggtggcccctggagaggcccccagtgaagatgctgaccacgagggcaagggcagccccctgaagatgcccaagatcaagctgcccagcttccgctggagccccaagaaggagaccggccccaaggtggaccctgagtgcagcgtggaggacagcaagctgagcctggtgctggacaaggatgaggtggccccccagagcgccatccacatggacctgcccccagagagagatggagagaagggccgcagcaccaagccaggctttgccatgcccaagctggccctgcccaagatgaaggccagcaagagcggcgtgtccctgccccagagagatgtggaccccagcctgagcagcgccacagctgggggcagcttccaggacacagagaaggccagcagtgatggcggccggggcggcctgggcgccacagccagcgccaccggcagcgagggcgtgaacctgcaccggccccaggtgcacatccccagcctgggctttgccaagccagacctgcggagcagcaaggccaaggtggaggtgtcccagcctgaggccgacctgcccctgcccaagcatgacctgagcacagaaggagacagccggggctgcggcctgggagatgtgcctgtgtcccagccctgtggggagggcatcgcccccaccccagaggaccccctgcagcccagctgcaggaagccagatgctgaggtgctgactgtggagagccctgaggaggaggccatgaccaagtacagccaggagagctggttcaagatgcccaagttcaggatgcccagcctgcggcgctccttccgggaccggggcggggccggcaagctggaggtggcccagacccaggccccagctgccaccggcggggaggccgccgccaaggtgaaggagttcctggtgtctggcagcaatgtggaggccgccatgagcctgcagctgcctgaggctgatgctgaggtgacagccagcgagagcaagagcagcacagacatcctgcgctgtgacctggacagcacaggcctgaagctgcacctgagcacagctggcatgactggagatgagctgagcaccagcgaggtgcgcatccaccccagcaagggccccctgcccttccagatgcctggcatgaggctgcctgagacccaggtgctgcccggggagattgatgagacccccctgagcaagccaggccatgacctggcctccatggaggacaagacagagaagtggagcagccagcctgagggccccctgaagctgaaggccagcagcacagacatgcccagccagatctctgtggtgaatgtggaccagctgtgggaggacagcgtgctgactgtgaagttccccaagctgatggtgccccgcttctccttccctgcccccagcagtgaagatgatgtgttcatccccaccgtgcgggaggtgcagtgcccagaggccaacatcgacacagccctgtgcaaggagagccctggcctgtggggcgccagcatcctgaaggccggggccggcgtgcctggagagcagcctgtggacctgaacctgcccctggaggccccacccatcagcaaggtgcgggtgcacatccagggcgcccaggtggagagccaggaggtgaccatccacagcatcgtgaccccagagtttgtggacctgtctgtgcccaggaccttcagcacccagatcgtgcgggagagcgagatccccaccagcgagatccagacccccagctatggcttcagcctgctgaaggtgaagatccctgagccccacacccaggcccgggtgtacaccaccatgacccagcacagcaggacccaggagggcacagaggaggcccccatccaggccaccccaggagtggacagcatcagcggggacctgcagcctgacaccggggagccctttgagatgatcagcagctctgtgaatgtgctgggccagcagaccctgacctttgaggtgcccagcggccaccagctggccgacagctgcagtgatgaggagcctgctgagatcctggagttccccccagatgacagccaggaggccaccacccccctggctgatgagggccgggcccccaaggacaagccagagagcaagaagagcggcctgctgtggttctggctgcccaacatcggcttcagcagctctgtggatgaaacaggagtggacagcaagaatgatgtgcagaggtctgcccccatccagacccagcctgaggcccggcctgaggccgagctgcccaagaagcaggagaaggccggctggttccgcttccccaagctgggcttcagcagcagccccaccaagaagagcaagagcacagaagatggagctgagctggaggagcagaagctgcaggaggagaccatcaccttctttgatgcccgggagagcttcagccctgaggagaaggaggagggggagctgattggccctgtgggcaccggcctggacagccgggtgatggtgaccagcgctgccaggacagagctgatcctgcctgagcaggacaggaaggcagatgatgagagcaagggcagcggcctgggccccaatgaaggatag

SEQ ID NO: 14987 - DNA, 237 bp, Artificial Sequence
  Description of Artificial Sequence: Synthetic coding sequence
atgggccagggccagcaggccatgtgccacgaggccctgagccacatctgggtgccctttgacctgaagcgctggctgctgtacaccttctgcaactggtttgatgtgaccttccagctgcagctgtgcatcctgcggaccctgaagcgcttctgccgcagcatcctgtacaacctgaaggacaggaagaccttctggctgccccaggcctacctgtccttcctgctgatccagtag

SEQ ID NO: 14988 - DNA, 579 bp, Artificial Sequence
  Description of Artificial Sequence: Synthetic coding sequence
atggcctgtggggccaccctgaagaggcccatggagtttgaagctgccctgctgagccctggcagccccaagagaagaagatgtgcccccctgcccggccccaccccaggcctgcggcccccagatgctgagcccccaccacccttccagacccagaccccaccccagagcctgcagcagcctgcccctcctggcagcgagcggcggctgcccaccccagagcagatcttccagaacatcaagcaggagtacagccgctaccagcgctggaggcacctggaggtggtgctgaaccagagcgaggcctgtgccagcgagagccagccccacagcagcgccctgacagcccccagcagccctggcagctcctggatgaagaaggaccagcccaccttcaccctgcggcaggtgggcatcatctgtgagcggctgctgaaggactatgaggacaagatccgggaggagtatgagcagatcctgaacaccaagctggccgagcagtatgagagctttgtgaagttcacccatgaccagatcatgagaagatatggcacccggcccaccagctatgtgtcctag

SEQ ID NO: 14989 - DNA, 444 bp, Artificial Sequence
  Description of Artificial Sequence: Synthetic coding sequence
atggcctgtggggccaccctgaagaggcccatggagtttgaagctgccctgctgagccctggcagccccaagagaagaagatgtgcccccctgcccggccccaccccaggcctgcggcccccagatgctgagcccccaccacccttccagacccagaccccaccccagagcctgcagcagcctgcccctcctggcagcgagcggcggctgcccaccccagagcagatcttccagaacatcaagcaggagtacagccgctaccagcgctggaggcacctggaggtggtgctgaaccagagcgaggcctgtgccagcgagagccagccccacagcagcgccctgacagcccccagcagccctgagcagtatgagagctttgtgaagttcacccatgaccagatcatgagaagatatggcacccggcccaccagctatgtgtcctag

SEQ ID NO: 14990 - DNA, 612 bp, Artificial Sequence
  Description of Artificial Sequence: Synthetic coding sequence
atggcctgtggggccaccctgaagaggaccctggactttgaccccctgctgagccctgccagccccaagagaagaagatgtgcccccctgagcgcccccaccagcgctgctgccagccccctgtctgctgctgctgccacagctgccagcttctctgctgctgctgccagcccccagaagtacctgaggatggagcccagcccctttggagatgtgagcagccggctgaccacagagcagatcctgtacaacatcaagcaggagtacaagaggatgcagaagagaagacacctggagaccagcttccagcagacagacccctgctgcaccagtgatgcccagccccacgccttcctgctgagcggccctgccagccctggcaccagcagcgctgccagcagccccctgaagaaggagcagcccctcttcaccctgcggcaggtgggcatgatctgtgagcggctgctgaaggagcgggaggagaaggtgcgggaggagtatgaggagatcctgaacaccaagctggccgagcagtatgatgcctttgtgaagttcacccatgaccagatcatgaggcgctacggggagcagcctgccagctatgtgtcctag

SEQ ID NO: 14991 - DNA, 5724 bp, Artificial Sequence
  Description of Artificial Sequence: Synthetic coding sequence
atggaggtggcctggctggtgtatgtgctgggccagcagcccctggcccggcagggcgagggccagagccggctggtgcccggccggggcctggtgctgtggctgcccggcctgcccaggagcagccccagctggccagctgtggacctggcccccctggccccagcccggccccggggccccctcatctgccacacaggccacgagcaggccggccgggagcccggccctggcagcagcaccaagggccctgtgctgcatgaccaggacacccgctgtgccttcctgcccaggcctcctggccccctgcagacccggcgctactgccgccaccagggccggcagggcagcggcctgggcgccggccctggagctggcacctgggccccagcccctcctggggtgtccaagccccgctgccccggccgggcccggcctggagagggccagcagcaggtgaccacagcccggcccccagccatcaacagaggagcccggcagccccgggccggggctgctgctgctggccggggccctggagctggggcctggaggactggagaggccgccgccagcgctggccctgctgtgggggagggcggggccatgggcagccggcgggcccccagccggggctggggcgccggcggccgctctggagctggaggagatggagaagatgatggccctgtgtggatccccagccctgccagccgcagctacctgctgtctgtgcggcctgagaccagcctgagcagcaaccggctgagccaccccagcagcggccgcagcaccttctgcagcatcatcgcccagctgacagaggagacccagcccctgtttgagaccaccctgaagagccgctctgtgtctgaggacagtgatgtgcgcttcacctgcatcgtgacaggctacccagagcctgaggtgacctggtacaaggatgacacagagctggaccgctactgcggcctgcccaagtatgagatcacccaccagggcaacagacacaccctgcagctgtaccgctgccgggaggaggatgctgccatctaccaggccagcgcccagaacagcaagggcatcgtgtcctgcagcggcgtgctggaggtgggcaccatgacagagtacaagatccaccagcgctggtttgccaagctgaagaggaaggccgccgccaagctgcgggagattgagcagagctggaagcatgagaaggctgtgcctggagaggtggacaccctgaggaagctgagcccagaccgcttccagaggaagaggcggctgagcggggcccaggcccctggccccagcgtgcccacccgggagcctgagggcggcaccctggccgcctggcaggagggggagacagaaacagcccagcacagcggcctgggcctcatcaacagctttgccagcggggaggtgaccaccaatggagaggccgccccagaaaatggagaagatggagagcacggcctgctgacctacatctgtgatgccatggagctgggcccccagagggccctgaaggaggagagcggggccaagaagaagaagaaggatgaggagagcaagcagggcctgaggaagccagagctggagaaggccgcccagagcagaagaagcagcgagaactgcatccccagcagtgatgagccagacagctgtggcacccagggccctgtgggcgtggagcaggtgcagacccagccccggggccgggccgcccggggccctggcagcagcggcacagacagcaccaggaagccagccagcgctgtgggcaccccagacaaggcccagaaggcccctggccctggccctggccaggaggtgtacttcagcctgaaggacatgtacctggagaacacccaggccgtgcggcccctgggggaggagggcccccagaccctgtctgtgcgggcccctggagagagccccaagggcaaggcccccctgcgggcccggtctgagggcgtgcctggggcccctggccagcccacccacagcctgaccccccagcccacccggcccttcaacaggaagagatttgccccacccaagcccaagggggaggccaccacagacagcaagcccatcagcagcctgagccaggccccagaatgtggggcccagagcctgggcaaggccccaccccaggcctctgtgcaggtgcccaccccaccagccaggagaagacatggcacccgggacagcaccctgcagggccaggccggccacaggaccccaggagaggtgctggagtgccagaccaccacagcccccaccatgtctgccagcagcagcagtgatgtggccagcattggagtgtccaccagcggcagccagggcatcatcgagcccatggacatggagacccaggaggatggccgcaccagcgccaaccagaggacaggcagcaagaagaatgtgcaggctgatggcaagatccaggtggatggccgcaccagaggagatggcacccagacagcccagaggaccagggctgacaggaagacccaggtggatgctggcacccaggagagcaagaggccccagagcgacagaagtgcccagaagggcatgatgacccagggccgggcagagacccagctggagaccacccaggccggggagaagatccaggaggacaggaaggcccaggccgacaagggcacccaggaggacaggaggatgcagggcgagaagggcatgcagggcgagaagggcacccagagcgagggcagcgcccccacagccatggagggccagagcgagcaggaggtggccaccagcctgggcccccccagcaggacccccaagctgcccccaacagctggcccccgggcccccctgaacatcgagtgctttgtgcagaccccagagggcagctgcttccccaagaagccaggctgcctgcccaggtctgaggaggccgtggtgacagccagcaggaaccacgagcagacagtgctgggccccctgagcggcaacctgatgctgcctgcccagccccctcatgagggctctgtggagcaggtgggcggggagcgctgccggggcccccagagcagcggccctgtggaggccaagcaggaggacagccccttccagtgccccaaggaggagaggcctgggggcgtgccctgcatggaccagggcggctgccccctggccggcctgagccaggaggtgcccaccatgcccagcctgcccggcaccggcctgacagccagccccaaggccggcccctgcagcacccccaccagccagcacggcagcacagccaccttcctgcccagcgaggaccaggtgctgatgagcagcgcccccaccctgcacctgggcctgggcacccccacccagagccaccccccagagaccatggccaccagcagcgagggcgcctgtgcccaggtgcctgatgtggagggccgcaccccaggccccaggagctgtgaccccggcctgattgacagcctgaagaactacctgctgctgctgctgaagctgagcagcacagagaccagcggggccggcggggagagccaggtgggcgccgccaccggcggcctggtgcccagcgccaccctgacccccaccgtggaggtggccggcctgagccccaggaccagccgccgcatcctggagcgggtggagaacaaccacctggtgcagagcgcccagaccctgctgctgagcccctgcaccagccggcggctgaccggcctgctggaccgggaggtgcaggccggccggcaggccctggccgccgcccggggctcctggggccctggccccagcagcctgactgtgcctgccatcgtggtggatgaagaagatcctggcctggccagcgagggcgccagcgagggggagggggaggtgtccccagagggccctggcctgctgggcgccagccaggagagctccatggccggccgcctgggggaggccggcggccaggccgcccctggccagggccccagcgctgagagcatcgcccaggagcccagccaggaggagaagtttcctggagaggccctgaccggcctgcctgctgccaccccagaggagctggccctgggcgcccggaggaagcgcttcctgcccaaggtgcgggctgctggagatggagaggccaccaccccagaggagcgggagagccccaccgtgagcccccggggccccaggaagagcctggtgcccggcagccctggcaccccaggccgggagcggcgcagccccacccagggcaggaaggcctccatgctggaggtgcccagggctgaggaggagctggccgccggggacctgggccccagccccaaggccggcggcctggacacagaggtggccctggatgagggcaagcaggagaccctggccaagcccaggaaggccaaggacctgctgaaggccccccaggtgatcaggaagatccgggtggagcagttcccagatgccagcggcagcctgaagctgtggtgccagttcttcaacatcctgagtgacagcgtgctgacctgggccaaggaccagaggcctgtgggggaggtgggccgctctgctggagatgagggccctgctgccctggccatcgtgcaggccagccctgtggactgtggggtgtaccgctgcaccatccacaatgagcacggcagcgccagcacagacttctgcctgagccctgaggtgctgagcggcttcatcagccgggaggagggggaggtgggggaggagattgagatgacccccatggtgtttgccaagggcctggccgacagcggctgctggggagacaagctgtttggccgcctggtgtctgaggagctgcggggcggcggctacggctgcggcctgaggaaggccagccaggccaaggtgatctacggcctggagcccatctttgagagcggccgcacctgcatcatcaaggtgagcagcctgctggtgtttggccccagcagcgagaccagcctggtgggcagaaattatgatgtgaccatccagggctgcaagatccagaacatgagccgggagtactgcaagatctttgctgctgaggcccgggccgcccctggctttggagaggtgcctgagatcatccccctgtacctgatctacagacctgccaacaacatcccctatgccaccctggaggaggacctgggcaagcccctggagagctactgcagccgggagtggggctgtgccgaggcccccacagccagcggcagcagcgaggccatgcagaagtgccagaccttccagcactggctgtaccagtggaccaacggcagcttcctggtgacagacctggccggcgtggactggaagatgacagatgtgcagatcgccaccaagctgcggggctaccagggcctgaaggagagctgcttccctgccctgctggacagatttgccagcagccaccagtgcaatgcctactgtgagctgctgggcctgacccccctgaagggccctgaggccgcccacccccaggccaaggccaagggcagcaagagccccagcgctggcaggaagggcagccagctgagcccccagccccagaagaagggcctgcccagcccccagggcaccaggaagagcgcccccagcagcaaggccaccccccaggccagcgagcctgtgaccacccagctgctgggccagccccccacccaggaggagggcagcaaggcccagggcatgaggtag

SEQ ID NO: 14992 - DNA, 225 bp, Artificial Sequence
  Description of Artificial Sequence: Synthetic coding sequence
atggattctgaggtgcagagagatggccgcatcctggacctgattgatgatgcctggagggaggacaagctgccctatgaagatgtggccatccccctgaatgagctgcctgagcctgagcaggacaatggaggcaccacagaatctgtgaaggagcaggagatgaagtggacagacctggccctgcagtacctgcatgaaaatgtgccccccatcggcaactag

SEQ ID NO: 14993 - DNA, 225 bp, Artificial Sequence; identical to SEQ ID NO: 14992
  Description of Artificial Sequence: Synthetic coding sequence

SEQ ID NO: 14994 - DNA, 225 bp, Artificial Sequence; identical to SEQ ID NO: 14992
  Description of Artificial Sequence: Synthetic coding sequence

SEQ ID NO: 14995 - DNA, 225 bp, Artificial Sequence; identical to SEQ ID NO: 14992
  Description of Artificial Sequence: Synthetic coding sequence

SEQ ID NO: 14996 - DNA, 1848 bp, Artificial Sequence
  Description of Artificial Sequence: Synthetic coding sequence
atgtgcagcgaggcccggctggcccggcggctgagagatgccctgcgggaggaggagccctgggccgtggaggagctgctgcgctgtggggctgaccccaacctggtgctggaggatggagctgctgctgtgcacctggccgccggggcccggcacccccggggcctgcgctgcctgggcgccctgctgcggcagggcggggaccccaatgcccggtctgtggaggccctgacccccctgcacgtggccgccgcctggggctgcagaagaggcctggagctgctgctgagccagggcgctgaccctgccctgcgggaccaggacggcctgcggcccctggacctggccctgcagcagggccacctggagtgtgcccgggtgctgcaggacctggacaccaggaccaggaccaggaccagaattggagctgagacccaggagcctgagcccgcccctggcaccccaggcctgagcggccccacagatgagaccctggacagcatcgccctgcagaagcagccctgccgcggggacaacagagacatcggcctggaggccgaccccggcccccccagcctgcctgtgcccctggagaccgtggacaagcacggcagcagcgccagccccccaggccactgggactacagcagtgatgccagctttgtgacagctgtggaggtgtctggagcagaagatcctgccagtgacaccccaccctgggccggcagcctgccccccacccggcagggcctgctgcacgtggtgcacgccaaccagagggtgcccaggagccagggcacagaagctgagctgaatgcccggctgcaggccctgaccctgaccccaccaaatgctgctggcttccagagcagccccagctccatgcccctgctggacaggagccctgcccacagcccccccaggacccccacccctggggccagtgactgccactgcctgtgggagcaccagaccagcattgacagcgacatggccaccctgtggctgacagaagatgaggccagcagcactggaggccgggagcctgtgggcccctgccgccacctgcctgtgtccacagtgtctgacctggagctgctgaagggcctgcgggccctgggggagaacccccaccccatcacccccttcacccggcagctgtaccaccagcagctggaggaggcccagatcgcccctggccctgagttcagcggccacagcctggagctggccgccgccctgaggacaggctgcatcccagatgtgcaggctgatgaagatgccctggcccagcagtttgagcagcctgaccctgcccggcgctggagggagggcgtggtgaagagcagcttcacctacctgctgctggacccccgggagacccaggacctgcctgcccgggccttcagcctgaccccagctgagcggctgcagaccttcatccgggccatcttctacgtgggcaagggcacccgggcccggccctacgtgcacctgtgggaggccctgggccaccacggccgcagcaggaagcagccccaccaggcctgccccaaggtgcggcagatcctggacatctgggccagcggctgcggcgtggtgtccctgcactgcttccagcacgtggtggccgtggaggcctacacccgggaggcctgcatcgtggaggccctgggcatccagaccctgaccaaccagaagcagggccactgctacggcgtggtggccggctggcccccagccaggagaagaaggctgggcgtgcacctgctgcaccgggccctgctggtgttcctggccgagggggagcggcagctgcacccccaggacatccaggcccggggctag

SEQ ID NO: 14997 - DNA, 1320 bp, Artificial Sequence
  Description of Artificial Sequence: Synthetic coding sequence
atgtggacccctgtgagaagaggagctgcctggctgggcaccctgctgggccctggagagggccccccagagccccggggcggggccgcccacgcccacaagcccccagctggcagcaggaagagcacagaccaggccgtgcgcttcggccccagccagggcatgtgcagcgaggcccggctggcccggcggctgagagatgccctgcgggaggaggagccctgggccgtggaggagctgctgcgctgtggggctgaccccaacctggtgctggaggatggagctgctgctgtgcacctggccgccggggcccggcacccccggggcctgcgctgcctgggcgccctgctgcggcagggcggggaccccaatgcccggtctgtggaggccctgacccccctgcacgtggccgccgcctggggctgcagaagaggcctggagctgctgctgagccagggcgctgaccctgccctgcgggaccaggacggcctgcggcccctggacctggccctgcagcagggccacctggagtgtgcccgggtgctgcaggacctggacaccaggaccaggaccaggaccagaattggagctgagacccaggagcctgagcccgcccctggcaccccaggcctgagcggccccacagatgagaccctggacagcatcgccctgcagaagcagccctgccgcggggacaacagagacatcggcctggaggccgaccccggcccccccagcctgcctgtgcccctggagaccgtggacaagcacggcagcagcgccagccccccaggccactgggactacagcagtgatgccagctttgtgacagctgtggaggtgtctggagcagaagatcctgccagtgacaccccaccctgggccggcagcctgccccccacccggcagggcctgctgcacgtggtgcacgccaaccagagggtgcccaggagccagggcacagaagctgagctgaatgcccggctgcaggccctgaccctgaccccaccaaatgctgctggcttccagagcagccccagctccatgcccctgctggacaggagccctgcccacagcccccccaggacccccacccctggggccagtgactgccactgcctgtgggagcaccagaccagcattgacagcgacatggccaccctgtggctgacagaagatgaggccagcagcactggaggccgggagcctgtgggcccctgccgccacctgcctgtgtccacagtgtctgacctggagctgctgaagggcctgcgggccctgggccgcctgcggacctgccagcctgagcccagccactag

SEQ ID NO: 14998 - DNA, 1821 bp, Artificial Sequence
  Description of Artificial Sequence: Synthetic coding sequence
atgtgcagcgaggcccggctggcccggcggctgagagatgccctgcgggaggaggagccctgggccgtggaggagctgctgcgctgtggggctgaccccaacctggtgctggaggatggagctgctgctgtgcacctggccgccggggcccggcacccccggggcctgcgctgcctgggcgccctgctgcggcagggcggggaccccaatgcccggtctgtggaggccctgacccccctgcacgtggccgccgcctggggctgcagaagaggcctggagctgctgctgagccagggcgctgaccctgccctgcgggaccaggacggcctgcggcccctggacctggccctgcagcagggccacctggagtgtgcccgggtgctgcaggacctggacaccaggaccaggaccaggaccagaattggagctgagacccaggagcctgagcccgcccctggcaccccaggcctgagcggccccacagatgagaccctggacagcatcgccctgcagaagcagccctgccgcggggacaacagagacatcggcctggaggccgaccccggcccccccagcctgcctgtgcccctggagaccgtggacaagcacggcagcagcgccagccccccaggccactgggactacagcagtgatgccagctttgtgacagctgtggaggtgtctggagcagaagatcctgccagtgacaccccaccctgggccggcagcctgccccccacccggcagggcctgctgcacgtggtgcacgccaaccagagggtgcccaggagccagggcacagaagctgagctgaatgcccggctgcaggccctgaccctgaccccaccaaatgctgctggcttccagagcagccccagctccatgcccctgctggacaggagccctgcccacagcccccccaggacccccacccctggggccagtgactgccactgcctgtgggagcaccagaccagcattgacagcgacatggccaccctgtggctgacagaagatgaggccagcagcactggaggccgggagcctgtgggcccctgccgccacctgcctgtgtccacagtgtctgacctggagctgctgaagggcctgcgggccctgggccctgagttcagcggccacagcctggagctggccgccgccctgaggacaggctgcatcccagatgtgcaggctgatgaagatgccctggcccagcagtttgagcagcctgaccctgcccggcgctggagggagggcgtggtgaagagcagcttcacctacctgctgctggacccccgggagacccaggacctgcctgcccgggccttcagcctgaccccagctgagcggctgcagaccttcatccgggccatcttctacgtgggcaagggcacccgggcccggccctacgtgcacctgtgggaggccctgggccaccacggccgcagcaggaagcagggcagcagaagaagccccaccaggagcaagggcacagccatggagtggtggcaggccggccacctgctggtggccggggcctggggctgcacctgctgcaccgtgcccagcctgagctcctggctgaaggccagtgacagcttcatccccaggaccagcaggcctggagctgagtgctggggcgtgggccacccagcctggggcgagatgtttgagtgcagcagctgccccatgctgacagctgcccccatcagcggcttccggcggggcgtgtgtgtgtgtgtgtgtgtgtgtgtgtgtgtgtgtgtgtgtgtgtgtgtgtgtgtgtgccgggagcaccctggccgcagccccccaggatag

SEQ ID NO: 14999 - DNA, 1848 bp, Artificial Sequence; identical to SEQ ID NO: 14996
  Description of Artificial Sequence: Synthetic coding sequence

SEQ ID NO: 15000 - DNA, 720 bp, Artificial Sequence
  Description of Artificial Sequence: Synthetic coding sequence
atggagaaggagaagggaaatgatgatggcatcccagaccaggagaacagcctggacttcagcgagcacttcaaccagctggagctgctggagacccacggccacctgatccccaccggcacccagagcctgtgggtgggcaacagtgatgaagatgaggagcaggatgacaagaatgaggagtggtaccgcctgcaggagaagaagatggagaaggaccccagccggctgctgctgtgggccgctgagaagaaccggctgaccaccgtgcggcggctgctgtctgagaaggccacccacgtgaacaccagagatgaagatgagtacacccccctgcacagagctgcctacagcggccacctggacatcgtgcaggagctgattgcccagggcgcagatgtgcatgctgtgacagtggatggctggacccccctgcacagcgcctgcaagtggaacaacaccagggtggccagcttcctgctgcagcatgatgctgacatcaatgcccagaccaagggcctgctgacccccctgcacctggccgccggcaacagagacagcaaggacaccctggagctgctgctgatgaacagatatgtgaagccaggcctgaagaacaacctggaggagacagcctttgatattgcccggaggaccagcatctaccactacctgtttgagatcgtggagggctgcaccaacagcagcccccagagctag

SEQ ID NO: 15001 - DNA, 720 bp, Artificial Sequence; identical to SEQ ID NO: 15000
  Description of Artificial Sequence: Synthetic coding sequence

SEQ ID NO: 15002 - DNA, 4458 bp, Artificial Sequence
  Description of Artificial Sequence: Synthetic coding sequence
atggccgccccagcccagcccaagaagatcgtggcccccaccgtgtcccagatcaatgctgagtttgtgacccagctggcctgcaagtactgggccccccacatcaagaagaagagcccctttgacatcaaggtgattgaggacatctatgagaaggagatcgtgaagagcagatttgccatcaggaagatcatgctgctggagttcagccagtacctggagaactacctgtggatgaactacagccctgaggtgagcagcaaggcctacctgatgagcatctgctgcatggtgaatgagaagttccgggagaatgtgcctgcctgggagatcttcaagaagaagccagaccacttccccttcttcttcaagcacatcctgaaggccgccctggccgagacagatggagagttcagcctgcacgagcagacagtgctgctgctcttcctggaccactgcttcaacagcctggaggtggacctgatccgcagccaggtgcagcagctgatcagcctgcccatgtggatgggcctgcagctggcccggctggagctggagctgaagaagacccccaagctgaggaagttctggaacctgatcaagaagaatgatgagaagatggaccctgaggcccgggagcaggcctaccaggagcggcgcttcctgagccagctgatccagaagttcatctctgtgctgaagtctgtgcccctgtctgagcctgtgaccatggacaaggtgcactactgtgagcgcttcatcgagctgatgattgacctggaggccctgctgcccacccggcgctggttcaacaccatcctggatgacagccacctgctggtgcactgctacctgagcaacctggtgcggcgggaggaggatggccacctgttcagccagctgctggacatgctgaagttctacacaggctttgagatcaatgaccagacaggaaatgccctgacagaaaatgagatgaccaccatccactatgaccgcatcaccagcctgcagagagctgcctttgcccacttccctgagctgtatgactttgccctgagcaatgtggccgaggtggacacccgggagagcctggtgaagttcttcggccccctgagcagcaacaccctgcaccaggtggccagctacctgtgcctgctgcccaccctgcccaagaatgaagacaccacctttgacaaggagttcctgctggagctgctggtgtccagacatgaaagacgcatcagccagatccagcagctgaaccagatgcccctgtaccccacagagaagatcatctgggatgagaacatcgtgcccacagagtactacagcggggagggctgcctggccctgcccaagctgaacctgcagttcctgaccctgcatgactacctgctgaggaacttcaacctcttccggctggagagcacctatgagatccggcaggacatcgaggacagcgtgtccaggatgaagccctggcagagtgaatatggaggagtggtgtttggaggctgggccaggatggcccagcccatcgtggccttcaccgtggtggaggtggccaagcccaacattggagagaactggcccaccagggtgcgggcagatgtgaccatcaacctgaatgtgcgggaccacatcaaggatgagtgggagggcctgaggaagcatgatgtgtgcttcctgatcaccgtgcggcccaccaagccctacggcaccaagtttgacagaagaagacccttcatcgagcaggtgggcctggtgtatgtgcggggctgtgagatccagggcatgctggatgacaagggccgggtgattgaagatggccctgagccccggcccaacctgcggggggagagcaggaccttccgggtcttcctggaccccaaccagtaccagcaggacatgaccaacaccatccagaatggagcagaagatgtgtatgagaccttcaacatcatcatgaggaggaagcccaaggagaacaacttcaaggctgtgctggagaccatccggaacctgatgaacacagactgtgtggtgcctgactggctgcatgacatcatcctgggctacggggaccccagcagcgcccactacagcaagatgcccaaccagatcgccaccctggacttcaatgacaccttcctgagcattgagcacctgaaggccagcttccctggccacaacgtgaaggtgacagtggaggaccctgccctgcagatcccccccttccgcatcaccttccctgtgcgcagcggcaagggcaagaagaggaaggatgctgatgtggaggatgaggacacagaggaggccaagaccctcatcgtggagccccacgtgatccccaacagaggcccctacccctacaaccagcccaagaggaacaccatccagttcacccacacccagatcgaggccatccgggccggcatgcagcccggcctgaccatggtggtgggccccccaggcaccgggaagacagatgtggccgtgcagatcatcagcaacatctaccacaacttccctgagcagaggaccctgattgtgacccacagcaaccaggccctgaaccagctgtttgagaagatcatggccctggacattgatgagcggcacctgctgcggctgggccatggagaggaggagctggagacagagaaggacttcagccgctatggccgggtgaactacgtgctggcccggcgcatcgagctgctggaggaggtgaagaggctgcagaagagcctgggcgtgcctggagatgccagctacacctgtgaaacagctggctacttcttcctgtaccaggtgatgagccgctgggaggagtacatcagcaaggtgaagaacaagggcagcaccctgcctgatgtgacagaggtgtccaccttcttccccttccacgagtactttgccaatgccccccagcccatcttcaagggccgctcctatgaggaggacatggagattgctgagggctgcttccgccacatcaagaagatcttcacccagctggaggagttccgggccagcgagctgctgcggagcggcctggacaggagcaagtacctgctggtgaaggaggccaagatcatcgccatgacctgcacccacgccgccctgaagagacatgacctggtgaagctgggcttcaagtatgacaacatcctgatggaggaggccgcccagatcctggagattgagaccttcatccccctgctgctgcagaacccccaggacggcttcagccggctgaagcgctggatcatgattggagaccaccaccagctgccccctgtgatcaagaacatggccttccagaagtacagcaacatggagcagagcctcttcaccaggtttgtgcgggtgggcgtgcccaccgtggacctggatgcccagggccgggcccgggccagcctgtgcaacctgtacaactggagatacaagaacctgggcaacctgccccacgtgcagctgctgcctgagttcagcacagccaatgccggcctgctgtatgacttccagctgatcaacgtggaggacttccagggcgtgggggagagcgagcccaacccctacttctaccagaacctgggggaggccgagtatgtggtggccctcttcatgtacatgtgcctgctgggctacccagctgacaagatcagcatcctgaccacctacaacggccagaagcacctgatccgggacatcatcaacagaagatgtggcaacaaccccctgattggccggcccaacaaggtgaccaccgtggaccgcttccagggccagcagaatgactacatcctgctgagcctggtgaggaccagggctgtgggccacctgagagatgtgcggcggctggtggtggccatgagccgggcccggctgggcctgtacatctttgcccgggtgtccctcttccagaactgctttgagctgaccccagccttcagccagctgacagcccggcccctgcacctgcacatcatccccacagagcccttccccaccaccaggaagaatggagagcggcccagccatgaggtgcagatcatcaagaacatgccccagatggccaactttgtgtacaacatgtacatgcacctgatccagaccacccaccactaccaccagaccctgctgcagctgcccccagccatggtggaggagggggaggaggtgcagaaccaggagacagagctggagacagaggaggaggccatgacagtgcaggccgacatcatccccagccccacagacaccagctgccggcaggagaccccagccttccagacagacaccacccccagcgagaccggggccaccagcaccccagaggccatcccagccctgtctgagaccacccccaccgtggtgggcgctgtgtctgccccagctgaggccaacaccccccaggatgccaccagcgcccctgaggagaccaagtag

SEQ ID NO: 15003 - DNA, 1083 bp, Artificial Sequence
  Description of Artificial Sequence: Synthetic coding sequence
atgcagatcatccgccacagcgagcagaccctgaagacagccctgatcagcaagaaccctgtgctggtgtcccagtatgagaagctgaatgctggggagcagaggctgatgaatgaggccttccagcctgccagtgacctgtttggccccatcaccctgcacagccccagcgactggatcaccagccaccctgaggccccccaggactttgagcagttcttcagtgacccctacaggaagacccccagccccaacaagaggagcatctacatccagagcatcggcagcctgggcaacacccgcatcatcagcgaggagtacatcaagtggctgaccggctactgcaaggcctacttctacggcctgcgggtgaagctgctggagcctgtgcctgtgtctgtgacccgctgcagcttccgggtgaatgaaaacacccacaacctgcagatccacgccggggacatcctgaagttcctgaagaagaagaagccagaagatgccttctgtgtggtgggcatcaccatgattgacctgtacccccgggacagctggaactttgtgtttggccaggccagcctgacagatggagtgggcatcttctcctttgcccgctatggcagtgacttctacagcatgcactacaagggcaaggtgaagaagctgaagaagaccagcagcagtgactacagcatctttgacaactactacatccctgagatcacctctgtgctgctgctgcggagctgcaagaccctgacccatgagatcggccacatcttcggcctgcggcactgccagtggctggcctgcctgatgcagggcagcaaccacctggaggaggccgacagaagacccctgaacctgtgccccatctgcctgcacaagctgcagtgtgctgtgggcttcagcatcgtggagcgctacaaggccctggtgcgctggattgatgatgagagcagtgacacccctggggccaccccagagcacagccatgaggacaatggaaacctgcccaagcctgtggaggccttcaaggagtggaaggagtggatcatcaagtgcctggccgtgctgcagaagtag

SEQ ID NO: 15004 - DNA, 2172 bp, Artificial Sequence
  Description of Artificial Sequence: Synthetic coding sequence
atggccgagtacacccggctgcacaatgccctggccctgatccggctgagaaatcctcctgtgaatgccatcagcaccaccctgctgcgggacatcaaggagggcctgcagaaggctgtgattgaccacaccatcaaggccatcgtcatctgtggggctgagggcaagttctctgctggagctgacatccggggcttcagcgcccccaggaccttcggcctgaccctgggccacgtggtggatgagatccagagaaatgagaagcctgtggtggccgccatccagggcatggcctttggaggcggcctggagctggccctgggctgccactacagaattgcccacgccgaggcccaggtgggcctgcctgaggtgaccctgggcctgctgcccggggcccggggcacccagctgctgccccggctgactggagtgcctgctgccctggacctgatcaccagcggccgccgcatcctggctgatgaggccctgaagctgggcatcctggacaaggtggtgaacagcgaccctgtggaggaggccatccgctttgcccagagggtgtctgaccagcccctggagagccggcggctgtgcaacaagcccatccagagcctgcccaacatggacagcatcttcagcgaggccctgctgaagatgaggcggcagcaccctggctgcctggcccaggaggcctgtgtgcgggctgtgcaggccgctgtgcagtacccctatgaggtgggcatcaagaaggaggaggagctgttcctgtacctgctgcagagcggccaggcccgggccctgcagtatgccttctttgctgagaggaaggccaacaagtggagcaccccatctggggcctcctggaagacagccagcgcccggcctgtgtcctctgtgggcgtggtgggcctgggcaccatgggccggggcatcgtcatcagctttgcccgggcccgcatccctgtgattgctgtggacagcgacaagaaccagctggccacagccaacaagatgatcacctctgtgctggagaaggaggccagcaagatgcagcagagcggccacccctggagcggccccaagccccggctgaccagctctgtgaaggagctgggcggcgtggacctggtgattgaagctgtgtttgaggagatgagcctgaagaagcaggtgtttgctgagctgtctgctgtgtgcaagccagaggccttcctgtgcaccaacaccagcgccctggatgtggatgagatcgccagcagcacagaccggccccacctggtgattggcacccacttcttcagccctgcccacgtgatgaagctgctggaggtgatccccagccagtacagcagccccaccaccatcgccaccgtgatgaacctgagcaagaagatcaagaagattggagtggtggtgggcaactgctttggatttgtgggcaacaggatgctgaacccctactacaaccaggcctacttcctgctggaggagggcagcaagccagaggaggtggaccaggtgctggaggagtttggcttcaagatgggccccttccgggtgtctgacctggccggcctggatgtgggctggaagagcaggaagggccagggcctgaccggccccaccctgctgcccggcaccccagccaggaagaggggcaacagacgctactgccccatcccagatgtgctgtgtgagctgggccgcttcggccagaagacaggcaagggctggtaccagtatgacaagcccctgggccgcatccacaagccagacccctggctgagcaagttcctgagccgctacaggaagacccaccacatcgagcccaggaccatcagccaggatgagatcctggagcgctgcctgtacagcctcatcaatgaggccttccgcatcctgggggagggcattgctgccagccctgagcacattgatgtggtgtacctgcacggctacggctggcccaggcacaagggcggccccatgttctacgccagcacagtgggcctgcccaccgtgctggagaagctgcagaagtactaccggcagaacccagacatcccccagctggagcccagcgactacctgaagaagctggccagccagggcaacccccccctgaaggagtggcagagcctggccggcagccccagcagcaagctgtag

SEQ ID NO: 15005 - DNA, 1875 bp, Artificial Sequence
  Description of Artificial Sequence: Synthetic coding sequence
atgacccaggccgagaagggggacacagaaaatggcaaggagaagggcggggagaaggagaaggagcagaggggcgtgaagaggcccatcgtgcctgccctggtgcctgagagcctgcaggagcagatccagagcaacttcatcatcgtcatccaccctggcagcaccaccctgcgcatcggccgggccacagacaccctgcctgccagcatcccccacgtgattgcccggcggcacaagcagcagggccagcccctgtacaaggacagctggctgctgcgggagggcctgaacaagccagagagcaatgagcagaggcagaatggcctgaagatggtggaccaggccatctggagcaagaagatgagcaatggcacccggcgcatccctgtgtccccagagcaggcccggagctacaacaagcagatgaggcctgccatcctggaccactgcagcggcaacaagtggaccaacaccagccaccaccctgagtacctggtgggggaggaggccctgtatgtgaaccccctggactgctacaacatccactggcccatcagaagaggccagctgaacatccaccctggccctgggggcagcctgacagctgtgctggccgacatcgaggtgatctggagccacgccatccagaagtacctggagatccccctgaaggacctgaagtactaccgctgcatcctgctgatcccagacatctacaacaagcagcacgtgaaggagctggtgaacatgatcctgatgaagatgggcttctctggaattgtggtgcaccaggagagcgtgtgtgccacctacggcagcggcctgagcagcacctgcatcgtggatgtgggggaccagaagacctctgtgtgctgcgtggaggatggagtgagccacaggaacacccggctgtgcctggcctatggaggcagtgatgtgagccgctgcttctactggctgatgcagagagctggcttcccctaccgggagtgccagctgaccaacaagatggactgcctgctgctgcagcacctgaaggagaccttctgccacctggaccaggacatcagcggcctgcaggaccacgagttccagatccgccacccagacagccctgccctgctgtaccagttccggctgggagatgagaagctgcaggcccccatggccctcttctacccagccaccttcggcatcgtgggccagaagatgaccaccctgcagcacaggagccagggcgaccctgaggacccccatgatgagcactacctgctggccacccagagcaagcaggagcagagcgccaaggccacagctgacaggaagagcgccagcaagcccatcggctttgaaggagacctgcggggccagagcagtgacctgcctgagcggctgcacagccaggaggtggacctgggcagcgcccagggagatggcctgatggctggaaatgattctgaggaggccctgacagccctgatgagcaggaagacagccatcagcctgtttgagggcaaggccctgggcctggacaaggccatcctgcacagcattgactgctgcagcagtgatgacaccaagaagaagatgtacagcagcatcctggtggtgggcggcggcctgatgttccacaaggcccaggagttcctgcagcaccgcatcctgaacaagatgccacccagcttccgccgcatcattgaaaatgtggatgtgatcacccggcccaaggacatggaccccaggctcatcgcctggaagggcggcgctgtgctggcctgcctggacaccacccaggagctgtggatctaccagcgggagtggcagagatttggagtgaggatgctgcgggagcgggccgcctttgtgtggtag

SEQ ID NO: 15006 - DNA, 2364 bp, Artificial Sequence
  Description of Artificial Sequence: Synthetic coding sequence
atggccgccaccacagccaaccctgagatgaccagtgatgtgcccagcctgggccctgccatcgccagcggcaacagcggccctggcatccagggcggcggggccatcgtgcagagggccatcaagagaagacctggcctggactttgatgatgatggagagggcaacagcaagttcctgcgctgtgatgatgaccagatgagcaatgacaaggagagatttgcccggagtgatgatgagcagagcagcgctgacaaggagcggctggcccgggagaaccacagcgagattgaaagaagaagaagaaacaagatgacagcctacatcacagagctgagtgacatggtgcccacctgcagcgccctggccaggaagccagacaagctgaccatcctgaggatggctgtgagccacatgaagagcctgcggggcactggaaacaccagcacagatggcagctacaagcccagcttcctgacagaccaggagctgaagcacctgatcctggaggccgcagatggcttcctgttcatcgtgtcctgtgaaacaggccgggtggtgtatgtgtctgacagcgtgacccctgtgctgaaccagccccagagcgagtggtttggcagcaccctgtatgaccaggtgcacccagatgatgtggacaagctgcgggagcagctgagcaccagtgaaaatgccctgaccggccgcatcctggacctgaagacaggaacagtgaagaaggagggccagcagagctccatgaggatgtgcatgggcagccgccgctccttcatctgcaggatgagatgtggcagcagctctgtggaccctgtgtctgtgaaccggctgagctttgtgaggaaccgctgcagaaatggcctgggctctgtgaaggatggagagccccactttgtggtggtgcactgcaccggctacatcaaggcctggcccccagctggggtgtccctgcctgatgatgatcctgaggccggccagggcagcaagttctgcctggtggccatcggccgcctgcaggtgaccagcagccccaactgcacagacatgagcaatgtgtgccagcccacagagttcatcagccgccacaacatcgagggcatcttcacctttgtggaccaccgctgtgtggccaccgtgggctaccagccccaggagctgctgggcaagaacatcgtggagttctgccaccctgaggaccagcagctgctgcgggacagcttccagcaggtggtgaagctgaagggccaggtgctgtctgtgatgttccgcttccgcagcaagaaccaggagtggctgtggatgaggaccagcagcttcaccttccagaacccctacagtgatgaaattgagtacatcatctgcaccaacaccaacgtgaagaacagcagccaggagccccggcccaccctgagcaacaccatccagaggccccagctgggccccacagccaacctgcccctggagatgggcagcggccagctggccccccggcagcagcagcagcagacagagctggacatggtgcccggcagagatggcctggccagctacaaccacagccaggtggtgcagcctgtgaccaccaccggccctgagcacagcaagcccctggagaagagtgatggcctgtttgcccaggaccgggacccccgcttcagcgagatctaccacaacatcaatgctgaccagagcaagggcatcagcagcagcacagtgcctgccacccagcagctgttcagccagggcaacaccttcccccccacccccaggcctgctgagaacttcagcggcctggcccctcctgtgaccatcgtgcagcccagcgccagcgctggccagatgctggcccagatcagccgccacagcaaccccacccagggcgccacccccacctggacccccaccaccaggagcggcttcagcgcccagcaggtggccacccaggccacagccaagaccaggaccagccagtttggagtgggcagcttccagacccccagcagcttcagctccatgagcctgcccggggcccccacagccagccctggagctgctgcctaccccagcctgaccaacagaggcagcaactttgcccctgagaccggccagacagctggccagttccagaccaggacagctgagggcgtgggcgtgtggccccagtggcagggccagcagccccaccacaggagcagcagcagcgagcagcacgtgcagcagcccccagcccagcagcccggccagcctgaggtgttccaggagatgctgtccatgctgggggaccagagcaacagctacaacaatgaggagttcccagacctgaccatgtttcctcccttcagcgagtag

SEQ ID NO: 15007 - DNA, 2370 bp, Artificial Sequence
  Description of Artificial Sequence: Synthetic coding sequence
atggccgccaccacagccaaccctgagatgaccagtgatgtgcccagcctgggccctgccatcgccagcggcaacagcggccctggcatccagggcggcggggccatcgtgcagagggccatcaagagaagacctggcctggactttgatgatgatggagagggcaacagcaagttcctgcgctgtgatgatgaccagatgagcaatgacaaggagagatttgcccggagtgatgatgagcagagcagcgctgacaaggagcggctggcccgggagaaccacagcgagattgaaagaagaagaagaaacaagatgacagcctacatcacagagctgagtgacatggtgcccacctgcagcgccctggccaggaagccagacaagctgaccatcctgaggatggctgtgagccacatgaagagcctgcggggcactggaaacaccagcacagatggcagctacaagcccagcttcctgacagaccaggagctgaagcacctgatcctggaggccgcagatggcttcctgttcatcgtgtcctgtgaaacaggccgggtggtgtatgtgtctgacagcgtgacccctgtgctgaaccagccccagagcgagtggtttggcagcaccctgtatgaccaggtgcacccagatgatgtggacaagctgcgggagcagctgagcaccagtgaaaatgccctgaccggccgcatcctggacctgaagacaggaacagtgaagaaggagggccagcagagctccatgaggatgtgcatgggcagccgccgctccttcatctgcaggatgagatgtggcagcagctctgtggaccctgtgtctgtgaaccggctgagctttgtgaggaaccgctgcagaaatggcctgggctctgtgaaggatggagagccccactttgtggtggtgcactgcaccggctacatcaaggcctggcccccagctggggtgtccctgcctgatgatgatcctgaggccggccagggcagcaagttctgcctggtggccatcggccgcctgcaggtgaccagcagccccaactgcacagacatgagcaatgtgtgccagcccacagagttcatcagccgccacaacatcgagggcatcttcacctttgtggaccaccgctgtgtggccaccgtgggctaccagccccaggagctgctgggcaagaacatcgtggagttctgccaccctgaggaccagcagctgctgcgggacagcttccagcaggtggtgaagctgaagggccaggtgctgtctgtgatgttccgcttccgcagcaagaaccaggagtggctgtggatgaggaccagcagcttcaccttccagaacccctacagtgatgaaattgagtacatcatctgcaccaacaccaacgtgaagaacagcagccaggagccccggcccaccctgagcaacaccatccagaggccccagctgggccccacagccaacctgcccctggagatgggcagcggccagctggccccccggcagcagcagcagcagacagagctggacatggtgcccggcagagatggcctggccagctacaaccacagccaggtggtgcagcctgtgaccaccaccggccctgagcacagcaagcccctggagaagagtgatggcctgtttgcccaggaccgggacccccgcttcagcgagatctaccacaacatcaatgctgaccagagcaagggcatcagcagcagcacagtgcctgccacccagcagctgttcagccagggcaacaccttcccccccacccccaggcctgctgagaacttcagaaattctggcctggcccctcctgtgaccatcgtgcagcccagcgccagcgctggccagatgctggcccagatcagccgccacagcaaccccacccagggcgccacccccacctggacccccaccaccaggagcggcttcagcgcccagcaggtggccacccaggccacagccaagaccaggaccagccagtttggagtgggcagcttccagacccccagcagcttcagctccatgagcctgcccggggcccccacagccagccctggagctgctgcctaccccagcctgaccaacagaggcagcaactttgcccctgagaccggccagacagctggccagttccagaccaggacagctgagggcgtgggcgtgtggccccagtggcagggccagcagccccaccacaggagcagcagcagcgagcagcacgtgcagcagcccccagcccagcagcccggccagcctgaggtgttccaggagatgctgtccatgctgggggaccagagcaacagctacaacaatgaggagttcccagacctgaccatgtttcctcccttcagcgagtag

SEQ ID NO: 15008 - DNA, 1767 bp, Artificial Sequence
  Description of Artificial Sequence: Synthetic coding sequence
atggctgctgaggaggaggccgctgctgggggcaaggtgctgcgggaggagaaccagtgcatcgcccctgtggtgagcagccgggtgtccccaggcacccggcccacagccatgggcagcttcagcagccacatgacagagttccccaggaagaggaaaggaagtgacagcgaccccagccaggaggcccacagccagacagagaagagaagaagagacaagatgaacaacctgattgaggagctgagcgccatgatcccccagtgcaaccccatggccaggaagctggacaagctgactgtgctgaggatggctgtgcagcacctgcggagcctgaagggcctgaccaacagctatgtgggcagcaactaccggcccagcttcctgcaggacaatgagctgcggcacctgatcctgaagacagctgagggcttcctgtttgtggtgggctgtgagcggggcaagatcctgtttgtgtccaagtctgtgtccaagatcctgaactatgaccaggccagcctgaccggccagagcctgtttgacttcctgcaccccaaggatgtggccaaggtgaaggagcagctgagcagctttgacatcagcccccgggagaagctgattgatgccaagacaggcctgcaggtgcacagcaacctgcatgctggccgcaccagggtgtacagcggcagcagaagaagcttcttctgccgcatcaagagctgcaagatctctgtgaaggaggagcacggctgcctgcccaacagcaagaagaaggagcacaggaagttctacaccatccactgcaccggctacctgcgctcctggccacccaacatcgtgggcatggaggaggagaggaacagcaagaaggacaacagcaacttcacctgcctggtggccatcggccgcctgcagccctacatcgtgccccagaacagcggggagatcaacgtgaagcccacagagttcatcaccaggtttgctgtgaatggcaagtttgtgtatgtggaccagagggccacagccatcctgggctacctgccccaggagctgctgggcaccagctgctatgagtacttccaccaggatgaccacaacaacctgacagacaagcacaaggctgtgctgcagagcaaggagaagatcctgacagacagctacaagttccgggccaaggatggcagctttgtgaccctgaagagccagtggttctccttcaccaacccctggaccaaggagctggagtacatcgtgtctgtgaacaccctggtgctgggccacagcgagcccggggaggccagcttcctgccctgcagcagccagagcagcgaggagagcagccggcagagctgcatgtctgtgcccggcatgagcactggaacagtgctgggcgccggcagcatcggcacagacatcgccaatgagatcctggacctgcagaggctgcagagcagcagctacctggatgacagcagccccaccggcctgatgaaggacacccacacagtgaactgccgctccatgagcaacaaggagctgtttcctcccagccccagcgagatgggagagctggaggccacccggcagaaccagagcacagtggccgtgcacagccatgagcccctgctgagtgatggagcccagctggactttgatgccctgtgtgacaatgatgacacagccatggccgccttcatgaactacctggaggccgagggcggcctgggggaccccggggacttcagtgacatccagtggaccctgtag

SEQ ID NO: 15009 - DNA, 1911 bp, Artificial Sequence
  Description of Artificial Sequence: Synthetic coding sequence
atggctgctgaggaggaggccgctgctgggggcaaggtgctgcgggaggagaaccagtgcatcgcccctgtggtgagcagccgggtgtccccaggcacccggcccacagccatgggcagcttcagcagccacatgacagagttccccaggaagaggaaaggaagtgacagcgaccccagccagagcggcatcatgacagagaaggtggtggagaagctgagccagaaccccctgacctacctgctgagcacccgcatcgagatcagcgccagcagcggcagccgggtggaggatggagagcaccaggtgaagatgaaggccttccgggaggcccacagccagacagagaagagaagaagagacaagatgaacaacctgattgaggagctgagcgccatgatcccccagtgcaaccccatggccaggaagctggacaagctgactgtgctgaggatggctgtgcagcacctgcggagcctgaagggcctgaccaacagctatgtgggcagcaactaccggcccagcttcctgcaggacaatgagctgcggcacctgatcctgaagacagctgagggcttcctgtttgtggtgggctgtgagcggggcaagatcctgtttgtgtccaagtctgtgtccaagatcctgaactatgaccaggccagcctgaccggccagagcctgtttgacttcctgcaccccaaggatgtggccaaggtgaaggagcagctgagcagctttgacatcagcccccgggagaagctgattgatgccaagacaggcctgcaggtgcacagcaacctgcatgctggccgcaccagggtgtacagcggcagcagaagaagcttcttctgccgcatcaagagctgcaagatctctgtgaaggaggagcacggctgcctgcccaacagcaagaagaaggagcacaggaagttctacaccatccactgcaccggctacctgcgctcctggccacccaacatcgtgggcatggaggaggagaggaacagcaagaaggacaacagcaacttcacctgcctggtggccatcggccgcctgcagccctacatcgtgccccagaacagcggggagatcaacgtgaagcccacagagttcatcaccaggtttgctgtgaatggcaagtttgtgtatgtggaccagagggccacagccatcctgggctacctgccccaggagctgctgggcaccagctgctatgagtacttccaccaggatgaccacaacaacctgacagacaagcacaaggctgtgctgcagagcaaggagaagatcctgacagacagctacaagttccgggccaaggatggcagctttgtgaccctgaagagccagtggttctccttcaccaacccctggaccaaggagctggagtacatcgtgtctgtgaacaccctggtgctgggccacagcgagcccggggaggccagcttcctgccctgcagcagccagagcagcgaggagagcagccggcagagctgcatgtctgtgcccggcatgagcactggaacagtgctgggcgccggcagcatcggcacagacatcgccaatgagatcctggacctgcagaggctgcagagcagcagctacctggatgacagcagccccaccggcctgatgaaggacacccacacagtgaactgccgctccatgagcaacaaggagctgtttcctcccagccccagcgagatgggagagctggaggccacccggcagaaccagagcacagtggccgtgcacagccatgagcccctgctgagtgatggagcccagctggactttgatgccctgtgtgacaatgatgacacagccatggccgccttcatgaactacctggaggccgagggcggcctgggggaccccggggacttcagtgacatccagtggaccctgtag

SEQ ID NO: 15010 - DNA, 1869 bp, Artificial Sequence
  Description of Artificial Sequence: Synthetic coding sequence
atggctgctgaggaggaggccgctgctgggggcaaggtgctgcgggaggagaaccagtgcatcgcccctgtggtgagcagccgggtgtccccaggcacccggcccacagccatgggcagcttcagcagccacatgacagagttccccaggaagaggaaaggaagtgacagcgaccccagccagagcggcatcatgacagagaaggtggtggagaagctgagccagaaccccctgacctacctgctgagcacccgcatcgagatcagcgccagcagcggcagccgggaggcccacagccagacagagaagagaagaagagacaagatgaacaacctgattgaggagctgagcgccatgatcccccagtgcaaccccatggccaggaagctggacaagctgactgtgctgaggatggctgtgcagcacctgcggagcctgaagggcctgaccaacagctatgtgggcagcaactaccggcccagcttcctgcaggacaatgagctgcggcacctgatcctgaagacagctgagggcttcctgtttgtggtgggctgtgagcggggcaagatcctgtttgtgtccaagtctgtgtccaagatcctgaactatgaccaggccagcctgaccggccagagcctgtttgacttcctgcaccccaaggatgtggccaaggtgaaggagcagctgagcagctttgacatcagcccccgggagaagctgattgatgccaagacaggcctgcaggtgcacagcaacctgcatgctggccgcaccagggtgtacagcggcagcagaagaagcttcttctgccgcatcaagagctgcaagatctctgtgaaggaggagcacggctgcctgcccaacagcaagaagaaggagcacaggaagttctacaccatccactgcaccggctacctgcgctcctggccacccaacatcgtgggcatggaggaggagaggaacagcaagaaggacaacagcaacttcacctgcctggtggccatcggccgcctgcagccctacatcgtgccccagaacagcggggagatcaacgtgaagcccacagagttcatcaccaggtttgctgtgaatggcaagtttgtgtatgtggaccagagggccacagccatcctgggctacctgccccaggagctgctgggcaccagctgctatgagtacttccaccaggatgaccacaacaacctgacagacaagcacaaggctgtgctgcagagcaaggagaagatcctgacagacagctacaagttccgggccaaggatggcagctttgtgaccctgaagagccagtggttctccttcaccaacccctggaccaaggagctggagtacatcgtgtctgtgaacaccctggtgctgggccacagcgagcccggggaggccagcttcctgccctgcagcagccagagcagcgaggagagcagccggcagagctgcatgtctgtgcccggcatgagcactggaacagtgctgggcgccggcagcatcggcacagacatcgccaatgagatcctggacctgcagaggctgcagagcagcagctacctggatgacagcagccccaccggcctgatgaaggacacccacacagtgaactgccgctccatgagcaacaaggagctgtttcctcccagccccagcgagatgggagagctggaggccacccggcagaaccagagcacagtggccgtgcacagccatgagcccctgctgagtgatggagcccagctggactttgatgccctgtgtgacaatgatgacacagccatggccgccttcatgaactacctggaggccgagggcggcctgggggaccccggggacttcagtgacatccagtggaccctgtag

SEQ ID NO: 15011 - DNA, 1800 bp, Artificial Sequence
  Description of Artificial Sequence: Synthetic coding sequence
atggctgctgaggaggaggccgctgctggaggagaggtggccggcggggaggccacagcccctgggaaggtgctgcgggaggagaaccagtgcatcgcccctgtggtgagcagccgggtgtccccaggcacccggcccacagccatgggcagcttcagcagccacatgacagagttccccaggaagaggaagggcagtgacagcgaccccagccaggaggcccacagccagacagagaagagaagaagagacaagatgaacaacctgattgaggagctgagcgccatgatcccccagtgcaaccccatggccaggaagctggacaagctgactgtgctgaggatggctgtgcagcacctgcggagcctgaagggcctgaccaacagctatgtgggcagcaactaccggcccagcttcctgcaggacaatgagctgcggcacctgatcctgaagacagctgagggcttcctgtttgtggtgggctgtgagcggggcaagatcctgtttgtgtccaagtctgtgtccaagatcctgaactatgaccaggccagcctgaccggccagagcctgtttgacttcctgcaccccaaggatgtggccaaggtgaaggagcagctgagcagctttgacatcagcccccgggagaagctgattgatgccaagacaggcctgcaggtgcacagcaacctgcacgccggccgcaccagggtgtacagcggcagccgccgctccttcttctgccgcatcaagagctgcaagatctctgtgaaggaggagcacggctgcctgcccaacagcaagaagaaggagcacaggaagttctacaccatccactgcaccggctacctgcgctcctggccacccaacatcgtgggcatggaggaggagaggaacagcaagaaggacaacagcaacttcacctgcctggtggccatcggccgcctgcagccctacatcgtgccccagaacagcggggagatcaacgtgaagcccacagagttcatcaccaggtttgctgtgaatggcaagtttgtgtatgtggaccagagggccacagccatcctgggctacctgccccaggagctgctgggcaccagctgctatgagtacttccaccaggatgaccacaacaacctgacagacaagcacaaggctgtgctgcagagcaaggagaagatcctgacagacagctacaagttccgggccaaggatggcagctttgtgaccctgaagagccagtggttctccttcaccaacccctggaccaaggagctggagtacatcgtgtctgtgaacaccctggtgctgggccacagcgagcctggagaggccagcttcctgccctgcagcagccagagcagcgaggagagcagccggcagagctgcatgtctgtgcccggcatgagcacaggcaccgtgctgggcgccggcagcattggaacagacatcgccaatgagatcctggacctgcagaggctgcagagcagcagctacctggatgacagcagccccaccggcctgatgaaggacacccacacagtgaactgccgctccatgagcaacaaggagctgttcccccccagccccagcgagatgggagagctggaggccacccggcagaaccagagcacagtggccgtgcacagccatgagcccctgctgagtgatggagcccagctggactttgatgccctgtgtgacaatgatgacacagccatggccgccttcatgaactacctggaggccgagggcggcctgggggaccccggggacttcagtgacatccagtggaccctgtag

SEQ ID NO: 15012 - DNA, 1656 bp, Artificial Sequence
  Description of Artificial Sequence: Synthetic coding sequence
atgggcagcttcagcagccacatgacagagttccccaggaagaggaagggcagtgacagcgaccccagccaggaggcccacagccagacagagaagagaagaagagacaagatgaacaacctgattgaggagctgagcgccatgatcccccagtgcaaccccatggccaggaagctggacaagctgactgtgctgaggatggctgtgcagcacctgcggagcctgaagggcctgaccaacagctatgtgggcagcaactaccggcccagcttcctgcaggacaatgagctgcggcacctgatcctgaagacagctgagggcttcctgtttgtggtgggctgtgagcggggcaagatcctgtttgtgtccaagtctgtgtccaagatcctgaactatgaccaggccagcctgaccggccagagcctgtttgacttcctgcaccccaaggatgtggccaaggtgaaggagcagctgagcagctttgacatcagcccccgggagaagctgattgatgccaagacaggcctgcaggtgcacagcaacctgcacgccggccgcaccagggtgtacagcggcagccgccgctccttcttctgccgcatcaagagctgcaagatctctgtgaaggaggagcacggctgcctgcccaacagcaagaagaaggagcacaggaagttctacaccatccactgcaccggctacctgcgctcctggccacccaacatcgtgggcatggaggaggagaggaacagcaagaaggacaacagcaacttcacctgcctggtggccatcggccgcctgcagccctacatcgtgccccagaacagcggggagatcaacgtgaagcccacagagttcatcaccaggtttgctgtgaatggcaagtttgtgtatgtggaccagagggccacagccatcctgggctacctgccccaggagctgctgggcaccagctgctatgagtacttccaccaggatgaccacaacaacctgacagacaagcacaaggctgtgctgcagagcaaggagaagatcctgacagacagctacaagttccgggccaaggatggcagctttgtgaccctgaagagccagtggttctccttcaccaacccctggaccaaggagctggagtacatcgtgtctgtgaacaccctggtgctgggccacagcgagcctggagaggccagcttcctgccctgcagcagccagagcagcgaggagagcagccggcagagctgcatgtctgtgcccggcatgagcacaggcaccgtgctgggcgccggcagcattggaacagacatcgccaatgagatcctggacctgcagaggctgcagagcagcagctacctggatgacagcagccccaccggcctgatgaaggacacccacacagtgaactgccgctccatgagcaacaaggagctgttcccccccagccccagcgagatgggagagctggaggccacccggcagaaccagagcacagtggccgtgcacagccatgagcccctgctgagtgatggagcccagctggactttgatgccctgtgtgacaatgatgacacagccatggccgccttcatgaactacctggaggccgagggcggcctgggggaccccggggacttcagtgacatccagtggaccctgtag

SEQ ID NO: 15013 - DNA, 1809 bp, Artificial Sequence
  Description of Artificial Sequence: Synthetic coding sequence
atggctgctgaggaggaggccgctgctgggggcaaggtgctgcgggaggagaaccagtgcatcgcccctgtggtgagcagccgggtgtccccaggcacccggcccacagccatgggcagcttcagcagccacatgacagagttccccaggaagaggaaaggaagtgacagcgaccccagccaggtggaggatggagagcaccaggtgaagatgaaggccttccgggaggcccacagccagacagagaagagaagaagagacaagatgaacaacctgattgaggagctgagcgccatgatcccccagtgcaaccccatggccaggaagctggacaagctgactgtgctgaggatggctgtgcagcacctgcggagcctgaagggcctgaccaacagctatgtgggcagcaactaccggcccagcttcctgcaggacaatgagctgcggcacctgatcctgaagacagctgagggcttcctgtttgtggtgggctgtgagcggggcaagatcctgtttgtgtccaagtctgtgtccaagatcctgaactatgaccaggccagcctgaccggccagagcctgtttgacttcctgcaccccaaggatgtggccaaggtgaaggagcagctgagcagctttgacatcagcccccgggagaagctgattgatgccaagacaggcctgcaggtgcacagcaacctgcatgctggccgcaccagggtgtacagcggcagcagaagaagcttcttctgccgcatcaagagctgcaagatctctgtgaaggaggagcacggctgcctgcccaacagcaagaagaaggagcacaggaagttctacaccatccactgcaccggctacctgcgctcctggccacccaacatcgtgggcatggaggaggagaggaacagcaagaaggacaacagcaacttcacctgcctggtggccatcggccgcctgcagccctacatcgtgccccagaacagcggggagatcaacgtgaagcccacagagttcatcaccaggtttgctgtgaatggcaagtttgtgtatgtggaccagagggccacagccatcctgggctacctgccccaggagctgctgggcaccagctgctatgagtacttccaccaggatgaccacaacaacctgacagacaagcacaaggctgtgctgcagagcaaggagaagatcctgacagacagctacaagttccgggccaaggatggcagctttgtgaccctgaagagccagtggttctccttcaccaacccctggaccaaggagctggagtacatcgtgtctgtgaacaccctggtgctgggccacagcgagcccggggaggccagcttcctgccctgcagcagccagagcagcgaggagagcagccggcagagctgcatgtctgtgcccggcatgagcactggaacagtgctgggcgccggcagcatcggcacagacatcgccaatgagatcctggacctgcagaggctgcagagcagcagctacctggatgacagcagccccaccggcctgatgaaggacacccacacagtgaactgccgctccatgagcaacaaggagctgtttcctcccagccccagcgagatgggagagctggaggccacccggcagaaccagagcacagtggccgtgcacagccatgagcccctgctgagtgatggagcccagctggactttgatgccctgtgtgacaatgatgacacagccatggccgccttcatgaactacctggaggccgagggcggcctgggggaccccggggacttcagtgacatccagtggaccctgtag

SEQ ID NO: 15014 - DNA, 6858 bp, Artificial Sequence
  Description of Artificial Sequence: Synthetic coding sequence
atggccgcccaggtggccccagctgctgccagcagcctgggcaaccccccacctcctccacccagcgagctgaagaaggccgagcagcagcagcgggaggaggccggcggggaggccgctgctgctgctgctgctgagcggggggagatgaaggctgctgctggccaggagagcgagggccctgctgtgggccccccccagcccctgggcaaggagctgcaggatggagctgagagcaatggaggcggcggcggcggcggggccggcagcggcggcggccctggagctgagccagacctgaagaacagcaatggaaatgccggccccaggcctgccctgaacaacaacctgacagagcccccaggcggcggcggcggcggcagcagtgatggagtgggcgccccaccccacagcgctgctgctgccctgcccccaccagcctacggcttcggccagccctacggccgcagccccagcgctgtggccgctgctgctgctgctgtgttccaccagcagcacggcggccagcagagccctggcctggccgccctgcagagcggcggcggcggcggcctggagccctatgccggcccccagcagaacagccatgaccacggcttccccaaccaccagtacaacagctactaccccaacagaagtgcctacccacctccagccccagcctatgccctgagcagcccccggggcggcaccccaggcagcggggctgctgctgctgctggcagcaagcccccacccagcagcagcgccagcgccagcagcagcagcagcagctttgcccagcagagatttggagccatgggcggcggcggccccagcgctgctgggggcggcaccccccagcccacagccacccccaccctgaaccagctgctgaccagccccagcagcgcccggggctaccagggctacccaggaggagactacagcggcggcccccaggacggcggggccgggaaaggacctgctgacatggccagccagtgctggggcgctgctgctgctgctgctgctgctgctgctgccagcggcggggcccagcagaggagccaccacgcccccatgagccctggcagcagcggcggcggcggccagcccctggcccggaccccccagcccagcagccccatggaccagatgggcaagatgaggccccagccctatggaggcaccaacccctacagccagcagcagggccccccatctggcccccagcagggccacggctacccaggccagccctacggcagccagaccccccagcgctaccccatgaccatgcagggccgggcccagagcgccatgggcggcctgagctacacccagcagatccccccctacggccagcagggccccagcggctacggccagcagggccagaccccctactacaaccagcagagcccccacccccagcagcagcagcccccctacagccagcagccccccagccagacccctcatgcccagcccagctaccagcagcagccccagagccagcccccccagctgcagagcagccagcccccctacagccagcagcccagccagcccccccaccagcagagccctgccccctaccccagccagcagagcaccacccagcagcacccccagagccagcccccctacagccagccccaggcccagagcccctaccagcagcagcagccccagcagcctgcccccagcaccctgagccagcaggccgcctacccccagccccagagccagcagagccagcagacagcctacagccagcagcgcttccccccaccccaggagctgagccaggacagctttggcagccaggccagcagcgcccccagcatgaccagcagcaagggcggccaggaggacatgaacctgagcctgcagagccggcccagcagcctgcctgacctgagcggcagcattgatgacctgcccatgggcacagaaggagccctgagccctggggtgtccaccagcggcatcagcagcagccagggcgagcagagcaacccagcccagagccccttcagcccccacaccagcccccacctgcccggcatccggggccccagccccagccctgtgggcagccctgcctctgtggcccagagccgcagcggccccctgagccctgctgctgtgcccggcaaccagatgccaccccggccccccagcggccagagcgacagcatcatgcaccccagcatgaaccagagcagcatcgcccaggaccggggctacatgcagaggaacccccagatgccccagtacagcagcccccagcccggcagcgccctgagcccccggcagcccagcggcggccagatccacacaggcatgggcagctaccagcagaacagcatgggcagctatggcccccagggcggccagtatggcccccagggcggctacccccggcagcccaactacaatgccctgcccaatgccaactaccccagcgctggcatggccggcggcatcaaccccatgggcgccggcggccagatgcacggccagcccggcatccccccctacggcaccctgcccccaggccgcatgagccacgcctccatgggcaaccggccctacggccccaacatggccaacatgccaccccaggtgggcagcggcatgtgccccccacctgggggcatgaacaggaagacccaggagacagctgtggccatgcacgtggccgccaacagcatccagaaccggcccccaggctaccccaacatgaaccagggcggcatgatgggcaccggccccccctacggccagggcatcaacagcatggccggcatgatcaacccccagggccccccctacagcatgggcggcaccatggccaacaacagcgctggcatggccgccagccctgagatgatgggcctgggagatgtgaagctgaccccagccaccaagatgaacaacaaggcagatggcacccccaagacagagagcaagagcaagaagagcagcagcagcaccaccaccaatgagaagatcaccaagctgtatgagctgggcggggagcctgagaggaagatgtgggtggaccgctacctggccttcacagaggagaaggccatgggcatgaccaacctgcctgctgtgggcaggaagcccctggacctgtaccgcctgtatgtgtctgtgaaggagattggaggcctgacccaggtgaacaagaacaagaagtggagggagctggccaccaacctgaatgtgggcaccagcagcagcgctgccagcagcctgaagaagcagtacatccagtgcctgtatgcctttgagtgcaagattgaaagaggagaagatcctcctccagacatctttgctgctgctgacagcaagaagagccagcccaagatccagccccccagccctgctggcagcggctccatgcagggcccccagaccccccagagcaccagcagctccatggccgagggcggggacctgaagccacccaccccagccagcaccccccacagccagatcccccccctgcccggcatgagccgcagcaacagcgtgggcatccaggatgccttcaatgatggcagtgacagcaccttccagaagaggaacagcatgacccccaaccctggctaccagcccagcatgaacaccagtgacatgatgggccgcatgtcctatgagcccaacaaggacccctacggctccatgaggaaggcccctggcagtgaccccttcatgagcagcggccagggccccaatggaggcatgggagacccctacagcagagctgctggccctggcctgggcaatgtggccatgggcccccggcagcactacccctatggaggcccctatgacagagtgaggacagagcccggcatcggccctgagggcaacatgagcactggagccccccagcccaacctgatgcccagcaacccagacagcggcatgtacagccccagccgctacccaccccagcagcagcagcagcagcagcagagacatgacagctatggcaaccagttcagcacccagggcacccccagcggcagccccttccccagccagcagaccaccatgtaccagcagcagcagcagaactacaagaggcccatggatggcacctacggccccccagccaagagacatgaaggagagatgtacagcgtgccctacagcacaggccagggccagccccagcagcagcagctgcccccagcccagccccagcctgccagccagcagcaggccgcccagcccagcccccagcaggatgtgtacaaccagtatggaaatgcctacccagccacagccacagctgccacagaaagaagacctgctgggggcccccagaaccagttccccttccagtttggccgggacagagtgtctgcccctcctggcaccaatgcccagcagaacatgccaccccagatgatgggcggccccatccaggccagcgctgaggtggcccagcagggcaccatgtggcagggcagaaatgacatgacctacaactatgccaaccggcagagcacaggcagcgccccccagggccctgcctaccacggcgtgaacagaacagatgagatgctgcacacagaccagagggccaaccacgagggctcctggcccagccacggcacccggcagcccccctacggccccagcgcccctgtgccccccatgacccggcccccacccagcaactaccagcccccacccagcatgcagaaccacatcccccaggtgagcagccctgcccccctgccccggcccatggagaacagaaccagccccagcaagagccccttcctgcacagcggcatgaagatgcagaaggccggcccccctgtgcctgccagccacatcgccccagcccctgtgcagccccccatgatccggcgggacatcaccttccccccaggctctgtggaggccacccagcctgtgctgaagcagaggcggcggctgaccatgaaggacatcggcaccccagaggcctggagggtgatgatgagcctgaagagcggcctgctggccgagagcacctgggccctggacaccatcaacatcctgctgtatgatgacaacagcatcatgaccttcaacctgagccagctgcccggcctgctggagctgctggtggagtacttccgccgctgcctgattgagatcttcggcatcctgaaggagtatgaggtgggggaccccggccagaggaccctgctggaccccggccgcttcagcaaggtgagcagccctgcccccatggagggcggggaggaggaggaggagctgctgggccccaagctggaggaggaggaggaggaggaggtggtggagaatgatgaggagatcgccttcagcggcaaggacaagccagcctctgaaaattctgaggagaagctgatcagcaagtttgacaagctgcctgtgaagatcgtgcagaagaatgacccctttgtggtggactgcagcgacaagctgggccgggtgcaggagtttgattctggcctgctgcactggagaattggaggaggagacaccacagagcacatccagacccactttgagagcaagacagagctgctgcccagccggccccacgccccctgccccccagcccccaggaagcacgtgaccacagctgagggcaccccaggcaccacagaccaggagggccccccaccagatggccccccagagaagaggatcacagccaccatggatgacatgctgagcaccaggagcagcaccctgacagaagatggagccaagagcagcgaggccatcaaggagagcagcaagttccccttcggcatcagccctgcccagagccacaggaacatcaagatcctggaggatgagccccacagcaaggatgagacccccctgtgcaccctgctggactggcaggacagcctggccaagagatgtgtgtgtgtgagcaacaccatccgcagcctgagctttgtgcctggaaatgactttgagatgagcaagcaccctggcctgctgctgatcctgggcaagctgatcctgctgcaccacaagcaccctgagaggaagcaggcccccctgacctatgagaaggaggaggagcaggaccagggcgtgtcctgcaacaaggtggagtggtggtgggactgcctggagatgctgcgggagaacaccctggtgaccctggccaacatcagcggccagctggacctgagcccctacccagagagcatctgcctgcctgtgctggatggcctgctgcactgggccgtgtgccccagcgctgaggcccaggaccccttcagcaccctgggccccaatgctgtgctgagcccccagaggctggtgctggagaccctgagcaagctgagcatccaggacaacaacgtggacctgatcctggccaccccacccttcagccggctggagaagctgtacagcaccatggtgcgcttcctgagtgacaggaagaaccctgtgtgccgggagatggctgtggtgctgctggccaacctggcccagggcgacagcctggccgcccgggccatcgctgtgcagaagggcagcatcggcaacctgctgggcttcctggaggacagcctggccgccacccagttccagcagagccaggccagcctgctgcacatgcagaaccccccatttgagcccacctctgtggacatgatgaggcgggccgcccgggccctgctggccctggccaaggtggatgagaaccacagcgagttcaccctgtatgagagccggctgctggacatctctgtgagccccctgatgaacagcctggtgtcccaggtgatctgtgatgtgctcttcctgattggccagagctag

SEQ ID NO: 15015 - DNA, 5709 bp, Artificial Sequence
  Description of Artificial Sequence: Synthetic coding sequence
atggaccagatgggcaagatgaggccccagccctacggcggcaccaacccctacagccagcagcagggcccccccagcggcccccagcagggccacggctacccaggccagccctacggcagccagaccccccagcgctaccccatgaccatgcagggccgggcccagagcgccatgggcggcctgagctacacccagcagatccccccctacggccagcagggccccagcggctacggccagcagggccagaccccctactacaaccagcagagcccccacccccagcagcagcagcccccctacagccagcagccccccagccagaccccccacgcccagcccagctaccagcagcagccccagagccagcccccccagctgcagagcagccagcccccctacagccagcagcccagccagcccccccaccagcagagccctgccccctaccccagccagcagagcaccacccagcagcacccccagagccagcccccctacagccagccccaggcccagagcccctaccagcagcagcagccccagcagcctgcccccagcaccctgagccagcaggccgcctacccccagccccagagccagcagagccagcagacagcctacagccagcagcgcttccccccaccccaggagctgagccaggacagctttggcagccaggccagcagcgcccccagcatgaccagcagcaaaggaggccaggaggacatgaacctgagcctgcagagccggcccagcagcctgcctgacctgagcggcagcattgatgacctgcccatgggcacagagggcgccctgagccctggggtgtccaccagcggcatcagcagcagccagggcgagcagagcaacccagcccagagccccttcagcccccacaccagcccccacctgcccggcatccggggccccagccccagccctgtgggcagccctgcctctgtggcccagagccgcagcggccccctgagccctgctgctgtgcccggcaaccagatgccacccaggcctccttctggccagagcgacagcatcatgcaccccagcatgaaccagagcagcatcgcccaggaccggggctacatgcagaggaacccccagatgccccagtacagcagcccccagcccggcagcgccctgagcccccggcagcccagcggcggccagatccacacaggcatgggcagctaccagcagaacagcatgggcagctatggcccccagggcggccagtatggcccccagggcggctacccccggcagcccaactacaatgccctgcccaatgccaactaccccagcgctggcatggccggcggcatcaaccccatgggcgctgggggccagatgcacggccagcccggcatccccccctacggcaccctgcccccaggccgcatgagccacgcctccatgggcaaccggccctacggccccaacatggccaacatgccaccccaggtgggcagcggcatgtgccccccacctgggggcatgaacaggaagacccaggagacagctgtggccatgcacgtggccgccaacagcatccagaacagacctcctggctaccccaacatgaaccagggcggcatgatgggcactggaccaccctacggccagggcatcaacagcatggccggcatgatcaacccccagggccccccctacagcatgggcggcaccatggccaacaacagcgctggcatggccgccagccctgagatgatgggcctgggagatgtgaagctgaccccagccaccaagatgaacaacaaggcagatggcacccccaagacagagagcaagagcaagaagagcagcagcagcaccaccaccaatgagaagatcaccaagctgtatgagctgggcggggagcctgagaggaagatgtgggtggaccgctacctggccttcacagaggagaaggccatgggcatgaccaacctgcctgctgtgggcaggaagcccctggacctgtaccgcctgtatgtgtctgtgaaggagatcggcggcctgacccaggtgaacaagaacaagaagtggagggagctggccaccaacctgaatgtgggcaccagcagcagcgctgccagcagcctgaagaagcagtacatccagtgcctgtatgcctttgagtgcaagattgaaagaggagaggaccccccaccagacatctttgctgctgctgacagcaagaagagccagcccaagatccagccccccagccctgctggcagcggctccatgcagggcccccagaccccccagagcaccagcagctccatggccgagggcggggacctgaagccacccaccccagccagcaccccccacagccagatcccccccctgcccggcatgagccgcagcaacagcgtgggcatccaggatgccttcaatgatggcagtgacagcaccttccagaagagaaattccatgacccccaaccctggctaccagcccagcatgaacaccagtgacatgatgggccgcatgtcctatgagcccaacaaggacccctacggctccatgaggaaggcccctggcagtgaccccttcatgagcagcggccagggccccaacggcggcatgggagacccctacagcagagctgctggccctggcctgggcaatgtggccatgggcccccggcagcactacccctacggcggcccctatgacagagtgaggacagagcccggcatcggccctgagggcaacatgagcactggagccccccagcccaacctgatgcccagcaacccagattctggcatgtacagccccagccgctacccaccccagcagcagcagcagcagcagcagagacatgacagctatggcaaccagttcagcacccagggcaccccatctggcagccccttccccagccagcagaccaccatgtaccagcagcagcagcagaactacaagaggcccatggatggcacctacggccccccagccaagagacatgaaggagagatgtacagcgtgccctacagcacaggccagggccagccccagcagcagcagctgcccccagcccagccccagcctgccagccagcagcaggccgcccagcccagcccccagcaggatgtgtacaaccagtatggaaatgcctacccagccacagccacagctgccacagagcggcggcctgctgggggcccccagaaccagttccccttccagtttggccgggacagagtgtctgcccctcctggcaccaatgcccagcagaacatgccaccccagatgatgggcggccccatccaggccagcgctgaggtggcccagcagggcaccatgtggcagggcagaaatgacatgacctacaactatgccaaccggcagagcactggaagtgccccccagggccctgcctaccatggagtgaacagaacagatgagatgctgcacacagaccagagggccaaccacgagggctcctggcccagccacggcacccggcagcccccctacggccccagcgcccctgtgccccccatgacccggcccccacccagcaactaccagcccccacccagcatgcagaaccacatcccccaggtgagcagccctgcccccctgccccggcccatggagaacagaaccagccccagcaagagccccttcctgcacagcggcatgaagatgcagaaggccggcccccctgtgcctgccagccacatcgccccagcccctgtgcagccccccatgatcagaagagacatcaccttccccccaggctctgtggaggccacccagcctgtgctgaagcagaggcggcggctgaccatgaaggacatcggcaccccagaggcctggagggtgatgatgagcctgaagagcggcctgctggccgagagcacctgggccctggacaccatcaacatcctgctgtatgatgacaacagcatcatgaccttcaacctgagccagctgcccggcctgctggagctgctggtggagtacttccgccgctgcctgattgagatcttcggcatcctgaaggagtatgaggtgggggaccccggccagaggaccctgctggaccccggccgcttcagcaaggtgagcagccctgcccccatggagggcggggaggaggaggaggagctgctgggccccaagctggaggaggaggaggaggaggaggtggtggagaatgatgaggagatcgccttcagcggcaaggacaagccagccagcgagaacagcgaggagaagctgatcagcaagtttgacaagctgcctgtgaagatcgtgcagaagaatgacccctttgtggtggactgcagcgacaagctgggccgggtgcaggagtttgacagcggcctgctgcactggagaattggaggaggagacaccacagagcacatccagacccactttgagagcaagacagagctgctgcccagccggccccacgccccctgccccccagcccccaggaagcacgtgaccacagctgagggcaccccaggcaccacagaccaggagggccccccaccagatggccccccagagaagaggatcacagccaccatggatgacatgctgagcaccaggagcagcaccctgacagaagatggagccaagagcagcgaggccatcaaggagagcagcaagttccccttcggcatcagccctgcccagagccacaggaacatcaagatcctggaggatgagccccacagcaaggatgagacccccctgtgcaccctgctggactggcaggacagcctggccaagagatgtgtgtgtgtgagcaacaccatccgcagcctgagctttgtgcctggaaatgactttgagatgagcaagcaccctggcctgctgctgatcctgggcaagctgatcctgctgcaccacaagcaccctgagaggaagcaggcccccctgacctatgagaaggaggaggagcaggaccagggcgtgtcctgcaacaaggtggagtggtggtgggactgcctggagatgctgcgggagaacaccctggtgaccctggccaacatcagcggccagctggacctgagcccctacccagagagcatctgcctgcctgtgctggatggcctgctgcactgggccgtgtgccccagcgctgaggcccaggaccccttcagcaccctgggccccaatgctgtgctgagcccccagaggctggtgctggagaccctgagcaagctgagcatccaggacaacaacgtggacctgatcctggccaccccacccttcagccggctggagaagctgtacagcaccatggtgcgcttcctgagtgacaggaagaaccctgtgtgccgggagatggctgtggtgctgctggccaacctggcccagggcgacagcctggccgcccgggccatcgctgtgcagaagggcagcatcggcaacctgctgggcttcctggaggacagcctggccgccacccagttccagcagagccaggccagcctgctgcacatgcagaaccccccatttgagcccacctctgtggacatgatgagaagagctgcccgggccctgctggccctggccaaggtggatgagaaccacagcgagttcaccctgtatgagagccggctgctggacatctctgtgagccccctgatgaacagcctggtgtcccaggtgatctgtgatgtgctcttcctgattggccagagctag

SEQ ID NO: 15016 - DNA, 6207 bp, Artificial Sequence
  Description of Artificial Sequence: Synthetic coding sequence
atggccgcccaggtggccccagctgctgccagcagcctgggcaaccccccacctcctccacccagcgagctgaagaaggccgagcagcagcagcgggaggaggccggcggggaggccgctgctgctgctgctgctgagcggggggagatgaaggctgctgctggccaggagagcgagggccctgctgtgggccccccccagcccctgggcaaggagctgcaggatggagctgagagcaatggaggcggcggcggcggcggggccggcagcggcggcggccctggagctgagccagacctgaagaacagcaatggaaatgccggccccaggcctgccctgaacaacaacctgacagagcccccaggcggcggcggcggcggcagcagtgatggagtgggcgccccaccccacagcgctgctgctgccctgcccccaccagcctacggcttcggccagccctacggccgcagccccagcgctgtggccgctgctgctgctgctgtgttccaccagcagcacggcggccagcagagccctggcctggccgccctgcagagcggcggcggcggcggcctggagccctatgccggcccccagcagaacagccatgaccacggcttccccaaccaccagtacaacagctactaccccaacagaagtgcctacccacctccagccccagcctatgccctgagcagcccccggggcggcaccccaggcagcggggctgctgctgctgctggcagcaagcccccacccagcagcagcgccagcgccagcagcagcagcagcagctttgcccagcagagatttggagccatgggcggcggcggccccagcgctgctgggggcggcaccccccagcccacagccacccccaccctgaaccagctgctgaccagccccagcagcgcccggggctaccagggctacccaggaggagactacagcggcggcccccaggacggcggggccgggaaaggacctgctgacatggccagccagtgctggggcgctgctgctgctgctgctgctgctgctgctgccagcggcggggcccagcagaggagccaccacgcccccatgagccctggcagcagcggcggcggcggccagcccctggcccggaccccccagcccagcagccccatggaccagatgggcaagatgaggccccagccctatggaggcaccaacccctacagccagcagcagggccccccatctggcccccagcagggccacggctacccaggccagccctacggcagccagaccccccagcgctaccccatgaccatgcagggccgggcccagagcgccatgggcggcctgagctacacccagcagatccccccctacggccagcagggccccagcggctacggccagcagggccagaccccctactacaaccagcagagcccccacccccagcagcagcagcccccctacagccagcagccccccagccagacccctcatgcccagcccagctaccagcagcagccccagagccagcccccccagctgcagagcagccagcccccctacagccagcagcccagccagcccccccaccagcagagccctgccccctaccccagccagcagagcaccacccagcagcacccccagagccagcccccctacagccagccccaggcccagagcccctaccagcagcagcagccccagcagcctgcccccagcaccctgagccagcaggccgcctacccccagccccagagccagcagagccagcagacagcctacagccagcagcgcttccccccaccccaggagctgagccaggacagctttggcagccaggccagcagcgcccccagcatgaccagcagcaagggcggccaggaggacatgaacctgagcctgcagagccggcccagcagcctgcctgacctgagcggcagcattgatgacctgcccatgggcacagaaggagccctgagccctggggtgtccaccagcggcatcagcagcagccagggcgagcagagcaacccagcccagagccccttcagcccccacaccagcccccacctgcccggcatccggggccccagccccagccctgtgggcagccctgcctctgtggcccagagccgcagcggccccctgagccctgctgctgtgcccggcaaccagatgccaccccggccccccagcggccagagcgacagcatcatgcaccccagcatgaaccagagcagcatcgcccaggaccggggctacatgcagaggaacccccagatgccccagtacagcagcccccagcccggcagcgccctgagcccccggcagcccagcggcggccagatccacacaggcatgggcagctaccagcagaacagcatgggcagctatggcccccagggcggccagtatggcccccagggcggctacccccggcagcccaactacaatgccctgcccaatgccaactaccccagcgctggcatggccggcggcatcaaccccatgggcgccggcggccagatgcacggccagcccggcatccccccctacggcaccctgcccccaggccgcatgagccacgcctccatgggcaaccggccctacggccccaacatggccaacatgccaccccaggtgggcagcggcatgtgccccccacctgggggcatgaacaggaagacccaggagacagctgtggccatgcacgtggccgccaacagcatccagaaccggcccccaggctaccccaacatgaaccagggcggcatgatgggcaccggccccccctacggccagggcatcaacagcatggccggcatgatcaacccccagggccccccctacagcatgggcggcaccatggccaacaacagcgctggcatggccgccagccctgagatgatgggcctgggagatgtgaagctgaccccagccaccaagatgaacaacaaggcagatggcacccccaagacagagagcaagagcaagaagagcagcagcagcaccaccaccaatgagaagatcaccaagctgtatgagctgggcggggagcctgagaggaagatgtgggtggaccgctacctggccttcacagaggagaaggccatgggcatgaccaacctgcctgctgtgggcaggaagcccctggacctgtaccgcctgtatgtgtctgtgaaggagattggaggcctgacccaggtgaacaagaacaagaagtggagggagctggccaccaacctgaatgtgggcaccagcagcagcgctgccagcagcctgaagaagcagtacatccagtgcctgtatgcctttgagtgcaagattgaaagaggagaagatcctcctccagacatctttgctgctgctgacagcaagaagagccagcccaagatccagccccccagccctgctggcagcggctccatgcagggcccccagaccccccagagcaccagcagctccatggccgagggcggggacctgaagccacccaccccagccagcaccccccacagccagatcccccccctgcccggcatgagccgcagcaacagcgtgggcatccaggatgccttcaatgatggcagtgacagcaccttccagaagaggaacagcatgacccccaaccctggctaccagcccagcatgaacaccagtgacatgatgggccgcatgtcctatgagcccaacaaggacccctacggctccatgaggaaggcccctggcagtgaccccttcatgagcagcggccagggccccaatggaggcatgggagacccctacagcagagctgctggccctggcctgggcaatgtggccatgggcccccggcagcactacccctatggaggcccctatgacagagtgaggacagagcccggcatcggccctgagggcaacatgagcactggagccccccagcccaacctgatgcccagcaacccagacagcggcatgtacagccccagccgctacccaccccagcagcagcagcagcagcagcagagacatgacagctatggcaaccagttcagcacccagggcacccccagcggcagccccttccccagccagcagaccaccatgtaccagcagcagcagcaggtgagcagccctgcccccctgccccggcccatggagaacagaaccagccccagcaagagccccttcctgcacagcggcatgaagatgcagaaggccggcccccctgtgcctgccagccacatcgccccagcccctgtgcagccccccatgatcagaagagacatcaccttccccccaggctctgtggaggccacccagcctgtgctgaagcagaggcggcggctgaccatgaaggacatcggcaccccagaggcctggagggtgatgatgagcctgaagagcggcctgctggccgagagcacctgggccctggacaccatcaacatcctgctgtatgatgacaacagcatcatgaccttcaacctgagccagctgcccggcctgctggagctgctggtggagtacttccgccgctgcctgattgagatcttcggcatcctgaaggagtatgaggtgggggaccccggccagaggaccctgctggaccccggccgcttcagcaaggtgagcagccctgcccccatggagggcggggaggaggaggaggagctgctgggccccaagctggaggaggaggaggaggaggaggtggtggagaatgatgaggagatcgccttcagcggcaaggacaagccagccagcgagaacagcgaggagaagctgatcagcaagtttgacaagctgcctgtgaagatcgtgcagaagaatgacccctttgtggtggactgcagcgacaagctgggccgggtgcaggagtttgacagcggcctgctgcactggagaattggaggaggagacaccacagagcacatccagacccactttgagagcaagacagagctgctgcccagccggccccacgccccctgccccccagcccccaggaagcacgtgaccacagctgagggcaccccaggcaccacagaccaggagggccccccaccagatggccccccagagaagaggatcacagccaccatggatgacatgctgagcaccaggagcagcaccctgacagaagatggagccaagagcagcgaggccatcaaggagagcagcaagttccccttcggcatcagccctgcccagagccacaggaacatcaagatcctggaggatgagccccacagcaaggatgagacccccctgtgcaccctgctggactggcaggacagcctggccaagagatgtgtgtgtgtgagcaacaccatccgcagcctgagctttgtgcctggaaatgactttgagatgagcaagcaccctggcctgctgctgatcctgggcaagctgatcctgctgcaccacaagcaccctgagaggaagcaggcccccctgacctatgagaaggaggaggagcaggaccagggcgtgtcctgcaacaaggtggagtggtggtgggactgcctggagatgctgcgggagaacaccctggtgaccctggccaacatcagcggccagctggacctgagcccctacccagagagcatctgcctgcctgtgctggatggcctgctgcactgggccgtgtgccccagcgctgaggcccaggaccccttcagcaccctgggccccaatgctgtgctgagcccccagaggctggtgctggagaccctgagcaagctgagcatccaggacaacaacgtggacctgatcctggccaccccacccttcagccggctggagaagctgtacagcaccatggtgcgcttcctgagtgacaggaagaaccctgtgtgccgggagatggctgtggtgctgctggccaacctggcccagggcgacagcctggccgcccgggccatcgctgtgcagaagggcagcatcggcaacctgctgggcttcctggaggacagcctggccgccacccagttccagcagagccaggccagcctgctgcacatgcagaaccccccatttgagcccacctctgtggacatgatgagaagagctgcccgggccctgctggccctggccaaggtggatgagaaccacagcgagttcaccctgtatgagagccggctgctggacatctctgtgagccccctgatgaacagcctggtgtcccaggtgatctgtgatgtgctcttcctgattggccagagctag

SEQ ID NO: 15017 - DNA, 1842 bp, Artificial Sequence
  Description of Artificial Sequence: Synthetic coding sequence
atgatgagcctgaagagcggcctgctggccgagagcacctgggccctggacaccatcaacatcctgctgtatgatgacaacagcatcatgaccttcaacctgagccagctgcccggcctgctggagctgctggtggagtacttccgccgctgcctgattgagatcttcggcatcctgaaggagtatgaggtgggggaccccggccagaggaccctgctggaccccggccgcttcagcaaggtgagcagccctgcccccatggagggcggggaggaggaggaggagctgctgggccccaagctggaggaggaggaggaggaggaggtggtggagaatgatgaggagatcgccttcagcggcaaggacaagccagcctctgaaaattctgaggagaagctgatcagcaagtttgacaagctgcctgtgaagatcgtgcagaagaatgacccctttgtggtggactgcagcgacaagctgggccgggtgcaggagtttgattctggcctgctgcactggagaattggaggaggagacaccacagagcacatccagacccactttgagagcaagacagagctgctgcccagccggccccacgccccctgccccccagcccccaggaagcacgtgaccacagctgagggcaccccaggcaccacagaccaggagggccccccaccagatggccccccagagaagaggatcacagccaccatggatgacatgctgagcaccaggagcagcaccctgacagaagatggagccaagagcagcgaggccatcaaggagagcagcaagttccccttcggcatcagccctgcccagagccacaggaacatcaagatcctggaggatgagccccacagcaaggatgagacccccctgtgcaccctgctggactggcaggacagcctggccaagagatgtgtgtgtgtgagcaacaccatccgcagcctgagctttgtgcctggaaatgactttgagatgagcaagcaccctggcctgctgctgatcctgggcaagctgatcctgctgcaccacaagcaccctgagaggaagcaggcccccctgacctatgagaaggaggaggagcaggaccagggcgtgtcctgcaacaaggtggagtggtggtgggactgcctggagatgctgcgggagaacaccctggtgaccctggccaacatcagcggccagctggacctgagcccctacccagagagcatctgcctgcctgtgctggatggcctgctgcactgggccgtgtgccccagcgctgaggcccaggaccccttcagcaccctgggccccaatgctgtgctgagcccccagaggctggtgctggagaccctgagcaagctgagcatccaggacaacaacgtggacctgatcctggccaccccacccttcagccggctggagaagctgtacagcaccatggtgcgcttcctgagtgacaggaagaaccctgtgtgccgggagatggctgtggtgctgctggccaacctggcccagggcgacagcctggccgcccgggccatcgctgtgcagaagggcagcatcggcaacctgctgggcttcctggaggacagcctggccgccacccagttccagcagagccaggccagcctgctgcacatgcagaaccccccatttgagcccacctctgtggacatgatgaggcgggccgcccgggccctgctggccctggccaaggtggatgagaaccacagcgagttcaccctgtatgagagccggctgctggacatctctgtgagccccctgatgaacagcctggtgtcccaggtgatctgtgatgtgctcttcctgattggccagagctag

SEQ ID NO: 15018 - DNA, 6696 bp, Artificial Sequence
  Description of Artificial Sequence: Synthetic coding sequence
atggagaccggcctgctgcccaaccacaagctgaagacagtgggggaggccccagctgccccaccccaccagcagcaccaccaccaccaccacgcccaccaccaccaccaccacgcccaccacctgcaccaccaccacgccctgcagcagcagctgaaccagttccagcagcagcagcagcagcagcagcagcagcagcagcagcagcagcagcagcagcaccccatcagcaacaacaacagcctgggcggggccggcggcggggccccccagcccggccctgacatggagcagccccagcacggcggggccaaggacagcgctgctgggggccaggccgaccccccaggcccccccctgctgagcaagccaggagatgaagatgatgccccacccaagatgggagagcctgctgggggccgctatgagcaccctggcctgggcgccctgggcacccagcagccccctgtggccgtgcctgggggcggcggcggccctgctgctgtgcctgagttcaacaactactacggcagcgctgccccagccagcggcggccctgggggccgggccggcccctgctttgaccagcacggcggccagcagagccctggcatgggcatgatgcacagcgccagcgctgctgctgctggggcccctggctccatggaccccctgcagaacagccatgagggctaccccaacagccagtgcaaccactacccaggctacagcaggcctggggccggcggcggcggcggcggcggcggcggcggcggcggcggcagcggcggcggcggcggcggcggcggggccggggccggcggggccggggccggggctgtggccgctgctgctgctgctgctgctgctgctgctgggggcggcggcggcggcggctacggcggcagcagcgctggctatggagtgctgagcagcccccggcagcagggcggcggcatgatgatgggccctgggggcggcggggccgccagcctgagcaaggctgctgctggcagcgctgctgggggcttccagagatttgctggccagaaccagcaccccagcggggccacccccaccctgaaccagctgctgaccagccccagccccatgatgaggagctatggaggcagctacccagagtacagcagccccagcgcccctcctcctccacccagccagccccagagccaggccgctgctgctggagctgctgctgggggccagcaggccgctgctggcatgggcctgggcaaggacatgggcgcccagtatgctgctgccagccctgcctgggccgccgcccagcagaggagccacccagccatgagccctggcaccccaggccccaccatgggccgcagccagggcagccccatggaccccatggtgatgaagaggccccagctgtatggcatgggcagcaacccccacagccagccccagcagagcagcccctacccaggcggcagctatggccccccaggcccccagcgctaccccatcggcatccagggccgcacccctggggccatggccggcatgcagtacccccagcagcagatgccaccccagtatggccagcagggcgtgtctggctactgccagcagggccagcagccctactacagccagcagccccagcccccccacctgcccccccaggcccagtacctgcccagccagagccagcagcgctaccagccccagcaggacatgagccaggagggctacggcaccaggagccagccccccctggcccctgggaagcccaaccacgaggacctgaacctgatccagcaggagcggcccagcagcctgcctgacctgagcggcagcattgatgacctgcccactggaacagaggccaccctgagcagcgctgtgtctgccagcggcagcaccagcagccagggcgaccagagcaacccagcccagagccccttcagcccccacgccagcccccacctgagcagcatccctgggggccccagccccagccctgtgggcagccctgtgggcagcaaccagagccgcagcggccccatcagccctgccagcatccctggcagccagatgccaccccagcccccaggcagccagagcgagagcagcagccacccagccctgagccagagccccatgccccaggagcggggcttcatggccggcacccagaggaacccccagatggcccagtatggcccccagcagacaggccccagcatgagcccccaccccagccctgggggccagatgcatgctggcatcagcagcttccagcagagcaacagcagcggcacctacggcccccagatgagccagtatggcccccagggcaactacagccggcccccagcctacagcggcgtgcccagcgccagctacagcggccctggccctggcatgggcatcagcgccaacaaccagatgcacggccagggccccagccagccctgtggggctgtgcccctgggccgcatgcccagcgctggcatgcagaaccggcccttccctggcaacatgagctccatgacccccagcagccctggcatgagccagcagggcggccctggcatgggcccccccatgcccaccgtgaacaggaaggcccaggaggccgctgctgctgtgatgcaggccgccgccaacagcgcccagagccggcagggcagcttccctggcatgaaccagagcggcctgatggccagcagcagcccctacagccagcccatgaacaacagcagcagcctgatgaacacccaggccccaccctacagcatggccccagccatggtgaacagcagcgctgcctctgtgggcctggccgacatgatgagccctggagagagcaagctgcccctgcccctgaaggcagatggcaaggaggagggcaccccccagcctgagagcaagagcaaggacagctacagcagccagggcatcagccagccccccaccccaggcaacctgcctgtgcccagccccatgagccccagcagcgccagcatcagcagcttccatggagatgaaagtgacagcatcagcagccctggctggcccaagacccccagcagccccaagagcagcagcagcaccaccactggagagaagatcaccaaggtgtatgagctgggcaatgaacctgagaggaagctgtgggtggaccgctacctgaccttcatggaggagcggggcagccctgtgagcagcctgcctgctgtgggcaagaagcccctggacctcttccggctgtatgtgtgtgtgaaggagatcggcggcctggcccaggtgaacaagaacaagaagtggagggagctggccaccaacctgaatgtgggcaccagcagcagcgctgccagcagcctgaagaagcagtacatccagtacctgtttgcctttgagtgcaagattgaaagaggagaggagcccccacctgaggtgttcagcactggagacaccaagaagcagcccaagctgcagccccccagccctgccaacagcggcagcctgcagggcccccagaccccccagagcacaggcagcaacagcatggccgaggtgcctggggacctgaagccacccaccccagccagcaccccccacggccagatgacccccatgcagggcggccgcagcagcaccatctctgtgcatgaccccttcagtgatgtgtctgacagcagcttccccaagagaaattccatgaccccaaatgccccctaccagcagggcatgtccatgccagatgtgatgggccgcatgccctatgagcccaacaaggacccctttggaggcatgaggaaggtgcccggcagcagcgagcccttcatgacccagggccagatgcccaacagctccatgcaggacatgtacaaccagagccccagcggggccatgagcaacctgggcatgggccagaggcagcagttcccctatggagccagctatgacagaagacatgagccctacggccagcagtacccaggccagggccccccatctggccagcccccctacggcggccaccagcccggcctgtacccccagcagcccaactacaagaggcacatggatggcatgtatggccccccagccaagagacatgaaggagacatgtacaacatgcagtacagcagccagcagcaggagatgtacaaccagtatggaggcagctacagcggccctgaccggcggcccatccagggccagtacccctacccctacagccgggagaggatgcagggccctggccagatccagacccacggcatccccccccagatgatgggcggccccctgcagagcagcagcagcgagggcccccagcagaacatgtgggccgccagaaatgacatgccctacccctaccagaaccggcagggccctgggggccccacccaggccccaccctacccaggcatgaacagaacagatgacatgatggtgcctgaccagaggatcaaccacgagagccagtggcccagccacgtgtcccagaggcagccctacatgagcagcagcgcctccatgcagcccatcaccaggcctccccagcccagctaccagaccccacccagcctgcccaaccacatcagccgggcccccagccctgccagcttccagaggagcctggagaacaggatgagccccagcaagagccccttcctgcccagcatgaagatgcagaaggtgatgcccaccgtgcccaccagccaggtgactggacctccaccccagcccccacccatcagaagagagatcaccttccccccaggctctgtggaggccagccagcctgtgctgaagcagaggaggaagatcaccagcaaggacatcgtgaccccagaggcctggagggtgatgatgagcctgaagagcggcctgctggccgagagcacctgggccctggacaccatcaacatcctgctgtatgatgacagcacagtggccaccttcaacctgagccagctgagcggcttcctggagctgctggtggagtacttcaggaagtgcctgattgacatcttcggcatcctgatggagtatgaggtgggggaccccagccagaaggccctggaccacaatgctgccaggaaggatgacagccagagcctggctgatgacagcggcaaggaggaggaggatgctgagtgcattgatgatgatgaagaagatgaggaggatgaggaggaggacagcgagaagacagaaagtgatgagaagagcagcatcgccctgacagccccagatgctgctgctgaccccaaggagaagcccaagcaggccagcaagtttgacaagctgcccatcaagatcgtgaagaagaacaacctgtttgtggtggacagaagtgacaagctgggccgggtgcaggagttcaacagcggcctgctgcactggcagctgggcggcggggacaccacagagcacatccagacccactttgagagcaagatggagatccccccaagaagaagacctcctccacccctgagcagcgctggcaggaagaaggagcaggagggcaagggggacagcgaggagcagcaggagaagagcatcatcgccaccattgatgatgtgctgagcgcccggcctggggccctgcctgaagatgccaaccctggcccccagacagagagcagcaagttccccttcggcatccagcaggccaagagccacaggaacatcaagctgctggaggatgagcccaggagcagagatgagacccccctgtgcaccatcgcccactggcaggacagcctggccaagcgctgcatctgtgtgagcaacatcgtgcgcagcctgagctttgtgcctggaaatgatgctgagatgagcaagcaccctggcctggtgctgatcctgggcaagctgatcctgctgcaccacgagcaccctgagaggaagagggccccccagacctatgagaaggaggaggatgaagataaaggagtggcctgcagcaaggatgagtggtggtgggactgcctggaggtgctgcgggacaacaccctggtgaccctggccaacatcagcggccagctggacctgagcgcctacacagagagcatctgcctgcccatcctggatggcctgctgcactggatggtgtgccccagcgctgaggcccaggaccccttccccaccgtgggccccaacagcgtgctgagcccccagaggctggtgctggagaccctgtgcaagctgagcatccaggacaacaacgtggacctgatcctggccaccccacccttcagccggcaggagaagttctacgccaccctggtgcgctacgtgggggacaggaagaaccctgtgtgccgggagatgtccatggccctgctgagcaacctggcccagggagatgccctggccgcccgggccatcgctgtgcagaagggcagcatcggcaacctgatctccttcctggaggatggagtgaccatggcccagtaccagcagagccagcacaacctgatgcacatgcagcccccacccctggagcccccatctgtggacatgatgtgccgggccgccaaggccctgctggccatggcccgggtggatgagaacagaagtgagttcctgctgcacgagggccgcctgctggacatcagcatctctgctgtgctgaacagcctggtggccagcgtcatctgtgatgtgctcttccagatcggccagctgtag

SEQ ID NO: 15019 - DNA, 6750 bp, Artificial Sequence
  Description of Artificial Sequence: Synthetic coding sequence
atggcccacaatgctggagctgctgctgctgctggcacccacagcgccaagagcggcggcagcgaggccgccctgaaggagggcggcagcgctgctgccctgagcagcagcagcagcagcagcgctgctgctgctgctgccagcagcagcagcagcagcggccctggcagcgccatggagaccggcctgctgcccaaccacaagctgaagacagtgggggaggccccagctgccccaccccaccagcagcaccaccaccaccaccacgcccaccaccaccaccaccacgcccaccacctgcaccaccaccacgccctgcagcagcagctgaaccagttccagcagcagcagcagcagcagcagcagcagcagcagcagcagcagcagcagcagcaccccatcagcaacaacaacagcctgggcggggccggcggcggggccccccagcccggccctgacatggagcagccccagcacggcggggccaaggacagcgctgctgggggccaggccgaccccccaggcccccccctgctgagcaagccaggagatgaagatgatgccccacccaagatgggagagcctgctgggggccgctatgagcaccctggcctgggcgccctgggcacccagcagccccctgtggccgtgcctgggggcggcggcggccctgctgctgtgcctgagttcaacaactactacggcagcgctgccccagccagcggcggccctgggggccgggccggcccctgctttgaccagcacggcggccagcagagccctggcatgggcatgatgcacagcgccagcgctgctgctgctggggcccctggctccatggaccccctgcagaacagccatgagggctaccccaacagccagtgcaaccactacccaggctacagcaggcctggggccggcggcggcggcggcggcggcggcggcggcggcggcggcagcggcggcggcggcggcggcggcggggccggggccggcggggccggggccggggctgtggccgctgctgctgctgctgctgctgctgctgctgggggcggcggcggcggcggctacggcggcagcagcgctggctatggagtgctgagcagcccccggcagcagggcggcggcatgatgatgggccctgggggcggcggggccgccagcctgagcaaggctgctgctggcagcgctgctgggggcttccagagatttgctggccagaaccagcaccccagcggggccacccccaccctgaaccagctgctgaccagccccagccccatgatgaggagctatggaggcagctacccagagtacagcagccccagcgcccctcctcctccacccagccagccccagagccaggccgctgctgctggagctgctgctgggggccagcaggccgctgctggcatgggcctgggcaaggacatgggcgcccagtatgctgctgccagccctgcctgggccgccgcccagcagaggagccacccagccatgagccctggcaccccaggccccaccatgggccgcagccagggcagccccatggaccccatggtgatgaagaggccccagctgtatggcatgggcagcaacccccacagccagccccagcagagcagcccctacccaggcggcagctatggccccccaggcccccagcgctaccccatcggcatccagggccgcacccctggggccatggccggcatgcagtacccccagcagcaggacagcggagatgccacctggaaggagaccttctggctgatgccaccccagtatggccagcagggcgtgtctggctactgccagcagggccagcagccctactacagccagcagccccagcccccccacctgcccccccaggcccagtacctgcccagccagagccagcagcgctaccagccccagcaggacatgagccaggagggctacggcaccaggagccagccccccctggcccctgggaagcccaaccacgaggacctgaacctgatccagcaggagcggcccagcagcctgcctgacctgagcggcagcattgatgacctgcccaccggcacagaggccaccctgagcagcgctgtgtctgccagcggcagcaccagcagccagggcgaccagagcaacccagcccagagccccttcagcccccacgccagcccccacctgagcagcatccctgggggccccagccccagccctgtgggcagccctgtgggcagcaaccagagccgcagcggccccatcagccctgccagcatccctggcagccagatgccaccccagcccccaggcagccagagcgagagcagcagccacccagccctgagccagagccccatgccccaggagcggggcttcatggccggcacccagaggaacccccagatggcccagtatggcccccagcagacaggccccagcatgagcccccaccccagccctgggggccagatgcacgccggcatcagcagcttccagcagagcaacagcagcggcacctacggcccccagatgagccagtatggcccccagggcaactacagccggcccccagcctacagcggcgtgcccagcgccagctacagcggccctggccctggcatgggcatcagcgccaacaaccagatgcacggccagggccccagccagccctgtggggctgtgcccctgggccgcatgcccagcgctggcatgcagaaccggcccttccctggcaacatgagctccatgacccccagcagccctggcatgagccagcagggcggccctggcatgggcccccccatgcccaccgtgaacaggaaggcccaggaggccgctgctgctgtgatgcaggccgccgccaacagcgcccagagccggcagggcagcttccctggcatgaaccagagcggcctgatggccagcagcagcccctacagccagcccatgaacaacagcagcagcctgatgaacacccaggccccaccctacagcatggccccagccatggtgaacagcagcgctgcctctgtgggcctggccgacatgatgagccctggagagagcaagctgcccctgcccctgaaggcagatggcaaggaggagggcaccccccagcctgagagcaagagcaagaagagcagcagcagcaccaccactggagagaagatcaccaaggtgtatgagctgggcaatgaacctgagaggaagctgtgggtggaccgctacctgaccttcatggaggagcggggcagccctgtgagcagcctgcctgctgtgggcaagaagcccctggacctcttccggctgtatgtgtgtgtgaaggagatcggcggcctggcccaggtgaacaagaacaagaagtggagggagctggccaccaacctgaatgtgggcaccagcagcagcgctgccagcagcctgaagaagcagtacatccagtacctgtttgcctttgagtgcaagattgaaagaggagaggagcccccacctgaggtgttcagcactggagacaccaagaagcagcccaagctgcagccccccagccctgccaacagcggcagcctgcagggcccccagaccccccagagcacaggcagcaacagcatggccgaggtgcctggggacctgaagccacccaccccagccagcaccccccacggccagatgacccccatgcagggcggccgcagcagcaccatctctgtgcatgaccccttcagtgatgtgtctgacagcagcttccccaagagaaattccatgaccccaaatgccccctaccagcagggcatgtccatgccagatgtgatgggccgcatgccctatgagcccaacaaggacccctttggaggcatgaggaaggtgcccggcagcagcgagcccttcatgacccagggccagatgcccaacagctccatgcaggacatgtacaaccagagccccagcggggccatgagcaacctgggcatgggccagaggcagcagttcccctatggagccagctatgacagaagacatgagccctacggccagcagtacccaggccagggccccccatctggccagcccccctacggcggccaccagcccggcctgtacccccagcagcccaactacaagaggcacatggatggcatgtatggccccccagccaagagacatgaaggagacatgtacaacatgcagtacagcagccagcagcaggagatgtacaaccagtatggaggcagctacagcggccctgaccggcggcccatccagggccagtacccctacccctacagccgggagaggatgcagggccctggccagatccagacccacggcatccccccccagatgatgggcggccccctgcagagcagcagcagcgagggcccccagcagaacatgtgggccgccagaaatgacatgccctacccctaccagaaccggcagggccctgggggccccacccaggccccaccctacccaggcatgaacagaacagatgacatgatggtgcctgaccagaggatcaaccacgagagccagtggcccagccacgtgtcccagaggcagccctacatgagcagcagcgcctccatgcagcccatcaccaggcctccccagcccagctaccagaccccacccagcctgcccaaccacatcagccgggcccccagccctgccagcttccagaggagcctggagaacaggatgagccccagcaagagccccttcctgcccagcatgaagatgcagaaggtgatgcccaccgtgcccaccagccaggtgactggacctccaccccagcccccacccatcagaagagagatcaccttccccccaggctctgtggaggccagccagcctgtgctgaagcagaggaggaagatcaccagcaaggacatcgtgaccccagaggcctggagggtgatgatgagcctgaagagcggcctgctggccgagagcacctgggccctggacaccatcaacatcctgctgtatgatgacagcacagtggccaccttcaacctgagccagctgagcggcttcctggagctgctggtggagtacttcaggaagtgcctgattgacatcttcggcatcctgatggagtatgaggtgggggaccccagccagaaggccctggaccacaatgctgccaggaaggatgacagccagagcctggctgatgacagcggcaaggaggaggaggatgctgagtgcattgatgatgatgaagaagatgaggaggatgaggaggaggacagcgagaagacagaaagtgatgagaagagcagcatcgccctgacagccccagatgctgctgctgaccccaaggagaagcccaagcaggccagcaagtttgacaagctgcccatcaagatcgtgaagaagaacaacctgtttgtggtggacagaagtgacaagctgggccgggtgcaggagttcaacagcggcctgctgcactggcagctgggcggcggggacaccacagagcacatccagacccactttgagagcaagatggagatccccccaagaagaagacctcctccacccctgagcagcgctggcaggaagaaggagcaggagggcaagggggacagcgaggagcagcaggagaagagcatcatcgccaccattgatgatgtgctgagcgcccggcctggggccctgcctgaagatgccaaccctggcccccagacagagagcagcaagttccccttcggcatccagcaggccaagagccacaggaacatcaagctgctggaggatgagcccaggagcagagatgagacccccctgtgcaccatcgcccactggcaggacagcctggccaagcgctgcatctgtgtgagcaacatcgtgcgcagcctgagctttgtgcctggaaatgatgctgagatgagcaagcaccctggcctggtgctgatcctgggcaagctgatcctgctgcaccacgagcaccctgagaggaagagggccccccagacctatgagaaggaggaggatgaagataaaggagtggcctgcagcaaggatgagtggtggtgggactgcctggaggtgctgcgggacaacaccctggtgaccctggccaacatcagcggccagctggacctgagcgcctacacagagagcatctgcctgcccatcctggatggcctgctgcactggatggtgtgccccagcgctgaggcccaggaccccttccccaccgtgggccccaacagcgtgctgagcccccagaggctggtgctggagaccctgtgcaagctgagcatccaggacaacaacgtggacctgatcctggccaccccacccttcagccggcaggagaagttctacgccaccctggtgcgctacgtgggggacaggaagaaccctgtgtgccgggagatgtccatggccctgctgagcaacctggcccagggagatgccctggccgcccgggccatcgctgtgcagaagggcagcatcggcaacctgatctccttcctggaggatggagtgaccatggcccagtaccagcagagccagcacaacctgatgcacatgcagcccccacccctggagcccccatctgtggacatgatgtgccgggccgccaaggccctgctggccatggcccgggtggatgagaacagaagtgagttcctgctgcacgagggccgcctgctggacatcagcatctctgctgtgctgaacagcctggtggccagcgtcatctgtgatgtgctcttccagatcggccagctgtag

SEQ ID NO: 15020 - DNA, 6711 bp, Artificial Sequence
  Description of Artificial Sequence: Synthetic coding sequence
atggcccacaatgctggagctgctgctgctgctggcacccacagcgccaagagcggcggcagcgaggccgccctgaaggagggcggcagcgctgctgccctgagcagcagcagcagcagcagcgctgctgctgctgctgccagcagcagcagcagcagcggccctggcagcgccatggagaccggcctgctgcccaaccacaagctgaagacagtgggggaggccccagctgccccaccccaccagcagcaccaccaccaccaccacgcccaccaccaccaccaccacgcccaccacctgcaccaccaccacgccctgcagcagcagctgaaccagttccagcagcagcagcagcagcagcagcagcagcagcagcagcagcagcagcagcagcaccccatcagcaacaacaacagcctgggcggggccggcggcggggccccccagcccggccctgacatggagcagccccagcacggcggggccaaggacagcgctgctgggggccaggccgaccccccaggcccccccctgctgagcaagccaggagatgaagatgatgccccacccaagatgggagagcctgctgggggccgctatgagcaccctggcctgggcgccctgggcacccagcagccccctgtggccgtgcctgggggcggcggcggccctgctgctgtgcctgagttcaacaactactacggcagcgctgccccagccagcggcggccctgggggccgggccggcccctgctttgaccagcacggcggccagcagagccctggcatgggcatgatgcacagcgccagcgctgctgctgctggggcccctggctccatggaccccctgcagaacagccatgagggctaccccaacagccagtgcaaccactacccaggctacagcaggcctggggccggcggcggcggcggcggcggcggcggcggcggcggcggcagcggcggcggcggcggcggcggcggggccggggccggcggggccggggccggggctgtggccgctgctgctgctgctgctgctgctgctgctgggggcggcggcggcggcggctacggcggcagcagcgctggctatggagtgctgagcagcccccggcagcagggcggcggcatgatgatgggccctgggggcggcggggccgccagcctgagcaaggctgctgctggcagcgctgctgggggcttccagagatttgctggccagaaccagcaccccagcggggccacccccaccctgaaccagctgctgaccagccccagccccatgatgaggagctatggaggcagctacccagagtacagcagccccagcgcccctcctcctccacccagccagccccagagccaggccgctgctgctggagctgctgctgggggccagcaggccgctgctggcatgggcctgggcaaggacatgggcgcccagtatgctgctgccagccctgcctgggccgccgcccagcagaggagccacccagccatgagccctggcaccccaggccccaccatgggccgcagccagggcagccccatggaccccatggtgatgaagaggccccagctgtatggcatgggcagcaacccccacagccagccccagcagagcagcccctacccaggcggcagctatggccccccaggcccccagcgctaccccatcggcatccagggccgcacccctggggccatggccggcatgcagtacccccagcagcagatgccaccccagtatggccagcagggcgtgtctggctactgccagcagggccagcagccctactacagccagcagccccagcccccccacctgcccccccaggcccagtacctgcccagccagagccagcagcgctaccagccccagcaggacatgagccaggagggctacggcaccaggagccagccccccctggcccctgggaagcccaaccacgaggacctgaacctgatccagcaggagcggcccagcagcctgcctgacctgagcggcagcattgatgacctgcccactggaacagaggccaccctgagcagcgctgtgtctgccagcggcagcaccagcagccagggcgaccagagcaacccagcccagagccccttcagcccccacgccagcccccacctgagcagcatccctgggggccccagccccagccctgtgggcagccctgtgggcagcaaccagagccgcagcggccccatcagccctgccagcatccctggcagccagatgccaccccagcccccaggcagccagagcgagagcagcagccacccagccctgagccagagccccatgccccaggagcggggcttcatggccggcacccagaggaacccccagatggcccagtatggcccccagcagacaggccccagcatgagcccccaccccagccctgggggccagatgcatgctggcatcagcagcttccagcagagcaacagcagcggcacctacggcccccagatgagccagtatggcccccagggcaactacagccggcccccagcctacagcggcgtgcccagcgccagctacagcggccctggccctggcatgggcatcagcgccaacaaccagatgcacggccagggccccagccagccctgtggggctgtgcccctgggccgcatgcccagcgctggcatgcagaaccggcccttccctggcaacatgagctccatgacccccagcagccctggcatgagccagcagggcggccctggcatgggcccccccatgcccaccgtgaacaggaaggcccaggaggccgctgctgctgtgatgcaggccgccgccaacagcgcccagagccggcagggcagcttccctggcatgaaccagagcggcctgatggccagcagcagcccctacagccagcccatgaacaacagcagcagcctgatgaacacccaggccccaccctacagcatggccccagccatggtgaacagcagcgctgcctctgtgggcctggccgacatgatgagccctggagagagcaagctgcccctgcccctgaaggcagatggcaaggaggagggcaccccccagcctgagagcaagagcaagaagagcagcagcagcaccaccaccggggagaagatcaccaaggtgtatgagctgggcaatgaacctgagaggaagctgtgggtggaccgctacctgaccttcatggaggagcggggcagccctgtgagcagcctgcctgctgtgggcaagaagcccctggacctcttccggctgtatgtgtgtgtgaaggagattggaggcctggcccaggtgaacaagaacaagaagtggagggagctggccaccaacctgaatgtgggcaccagcagcagcgctgccagcagcctgaagaagcagtacatccagtacctgtttgcctttgagtgcaagattgagcggggggaggagcccccacctgaggtgttcagcactggagacaccaagaagcagcccaagctgcagccccccagccctgccaacagcggcagcctgcagggcccccagaccccccagagcacaggcagcaacagcatggccgaggtgcctggggacctgaagccacccaccccagccagcacccctcatggccagatgacccccatgcagggcggccgcagcagcaccatctctgtgcatgaccccttcagtgatgtgtctgacagcagcttccccaagaggaacagcatgaccccaaatgccccctaccagcagggcatgtccatgccagatgtgatgggccgcatgccctatgagcccaacaaggacccctttggaggcatgaggaaggtgcccggcagcagcgagcccttcatgacccagggccagatgcccaacagctccatgcaggacatgtacaaccagagccccagcggggccatgagcaacctgggcatgggccagaggcagcagttcccctacggggccagctatgacagaagacatgagccctacggccagcagtacccaggccagggcccccccagcggccagcccccctatggaggccaccagcccggcctgtacccccagcagcccaactacaagaggcacatggatggcatgtatggccccccagccaagagacatgaaggagacatgtacaacatgcagtacagcagccagcagcaggagatgtacaaccagtatggaggcagctacagcggccctgacagaagacccatccagggccagtacccctacccctacagccgggagaggatgcagggccctggccagatccagacccacggcatccccccccagatgatgggcggccccctgcagagcagcagcagcgagggcccccagcagaacatgtgggccgccagaaatgacatgccctacccctaccagaaccggcagggccctgggggccccacccaggccccaccctacccaggcatgaacagaacagatgacatgatggtgcctgaccagaggatcaaccacgagagccagtggcccagccacgtgtcccagaggcagccctacatgagcagcagcgcctccatgcagcccatcacccggcccccccagcccagctaccagaccccacccagcctgcccaaccacatcagccgggcccccagccctgccagcttccagaggagcctggagaacaggatgagccccagcaagagccccttcctgcccagcatgaagatgcagaaggtgatgcccaccgtgcccaccagccaggtgacaggccccccaccccagcccccacccatccggcgggagatcaccttccccccaggctctgtggaggccagccagcctgtgctgaagcagaggaggaagatcaccagcaaggacatcgtgaccccagaggcctggagggtgatgatgagcctgaagagcggcctgctggccgagagcacctgggccctggacaccatcaacatcctgctgtatgatgacagcacagtggccaccttcaacctgagccagctgagcggcttcctggagctgctggtggagtacttcaggaagtgcctgattgacatcttcggcatcctgatggagtatgaggtgggggaccccagccagaaggccctggaccacaatgctgccaggaaggatgacagccagagcctggctgatgattctgggaaggaggaggaggatgctgaatgtattgatgatgatgaggaggatgaagaagatgaggaggaggacagcgagaagacagaaagtgatgagaagagcagcatcgccctgacagccccagatgctgctgctgaccccaaggagaagcccaagcaggccagcaagtttgacaagctgcccatcaagatcgtgaagaagaacaacctgtttgtggtggacagaagtgacaagctgggccgggtgcaggagttcaacagcggcctgctgcactggcagctgggcggcggggacaccacagagcacatccagacccactttgagagcaagatggagatcccccccaggagaagacctcctccacccctgagcagcgctggcaggaagaaggagcaggagggcaaaggagacagcgaggagcagcaggagaagagcatcatcgccaccattgatgatgtgctgagcgcccggcctggggccctgcctgaagatgccaaccctggcccccagacagagagcagcaagttccccttcggcatccagcaggccaagagccacaggaacatcaagctgctggaggatgagcccaggagcagagatgagacccccctgtgcaccatcgcccactggcaggacagcctggccaagcgctgcatctgtgtgagcaacatcgtgcgcagcctgagctttgtgcctggaaatgatgctgagatgagcaagcaccctggcctggtgctgatcctgggcaagctgatcctgctgcaccacgagcaccctgagaggaagagggccccccagacctatgagaaggaggaggatgaggacaagggcgtggcctgcagcaaggatgagtggtggtgggactgcctggaggtgctgcgggacaacaccctggtgaccctggccaacatcagcggccagctggacctgagcgcctacacagagagcatctgcctgcccatcctggatggcctgctgcactggatggtgtgccccagcgctgaggcccaggaccccttccccaccgtgggccccaacagcgtgctgagcccccagaggctggtgctggagaccctgtgcaagctgagcatccaggacaacaacgtggacctgatcctggccaccccacccttcagccggcaggagaagttctacgccaccctggtgcgctacgtgggggacaggaagaaccctgtgtgccgggagatgtccatggccctgctgagcaacctggcccagggagatgccctggccgcccgggccatcgctgtgcagaagggcagcatcggcaacctgatctccttcctggaggatggagtgaccatggcccagtaccagcagagccagcacaacctgatgcacatgcagcccccacccctggagccccccagcgtggacatgatgtgcagagctgccaaggccctgctggccatggcccgggtggatgaaaatagaagtgagttcctgctgcacgagggccgcctgctggacatcagcatctctgctgtgctgaacagcctggtggccagcgtcatctgtgatgtgctcttccagatcggccagctgtag

SEQ ID NO: 15021 - DNA, 2172 bp, Artificial Sequence
  Description of Artificial Sequence: Synthetic coding sequence
atgccaccccagtatggccagcagggcgtgtctggctactgccagcagggccagcagccctactacagccagcagccccagcccccccacctgcccccccaggcccagtacctgcccagccagagccagcagcgctaccagccccagcaggacatgagccaggagggctacggcaccaggagccagccccccctggcccctgggaagcccaaccacgaggacctgaacctgatccagcaggagcggcccagcagcctgcctgacctgagcggcagcattgatgacctgcccaccggcacagaggccaccctgagcagcgctgtgtctgccagcggcagcaccagcagccagggcgaccagagcaacccagcccagagccccttcagcccccacgccagcccccacctgagcagcatccctgggggccccagccccagccctgtgggcagccctgtgggcagcaaccagagccgcagcggccccatcagccctgccagcatccctggcagccagatgccaccccagcccccaggcagccagagcgagagcagcagccacccagccctgagccagagccccatgccccaggagcggggcacccagaggaacccccagatggcccagtatggcccccagcagacaggccccagcatgagcccccaccccagccctgggggccagatgcacgccggcatcagcagcttccagcagagcaacagcagcggcacctacggcccccagatgagccagtatggcccccagggcaactacagccggcccccagcctacagcggcgtgcccagcgccagctacagcggccctggccctggcatgggcatcagcgccaacaaccagatgcacggccagggccccagccagccctgtggggctgtgcccctgggccgcatgcccagcgctggcatgcagaaccggcccttccctggcaacatgagctccatgacccccagcagccctggcatgagccagcagggcggccctggcatgggcccccccatgcccaccgtgaacaggaaggcccaggaggccgctgctgctgtgatgcaggccgccgccaacagcgcccagagccggcagggcagcttccctggcatgaaccagagcggcctgatggccagcagcagcccctacagccagcccatgaacaacagcagcagcctgatgaacacccaggccccaccctacagcatggccccagccatggtgaacagcagcgctgcctctgtgggcctggccgacatgatgagccctggagagagcaagctgcccctgcccctgaaggcagatggcaaggaggagggcaccccccagcctgagagcaagagcaaggacagctacagcagccagggcatcagccagccccccaccccaggcaacctgcctgtgcccagccccatgagccccagcagcgccagcatcagcagcttccatggagatgaaagtgacagcatcagcagccctggctggcccaagacccccagcagccccaagagcagcagcagcaccaccaccggggagaagatcaccaaggtgtatgagctgggcaatgaacctgagaggaagctgtgggtggaccgctacctgaccttcatggaggagcggggcagccctgtgagcagcctgcctgctgtgggcaagaagcccctggacctcttccggctgtatgtgtgtgtgaaggagattggaggcctggcccaggtgaacaagaacaagaagtggagggagctggccaccaacctgaatgtgggcaccagcagcagcgctgccagcagcctgaagaagcagtacatccagtacctgtttgcctttgagtgcaagattgagcggggggaggagcccccacctgaggtgttcagcactggagacaccaagaagcagcccaagctgcagccccccagccctgtggtgcagatggagccccgggcctgtgacacaggaggcagcggcaggaaggcctcctggagcaggcctgccccccgggcccgggccggcggcagccgccacacccaggccagcggcggccggcggcagaggcaccctggcctgcagaagcccctggacagcctgccccccacccagcaggtggccagccccatccctgtgcccagcctgggcaaggtgtctggcaacatctttgtggtgaagggcaagtag

SEQ ID NO: 15022 - DNA, 6870 bp, Artificial Sequence
  Description of Artificial Sequence: Synthetic coding sequence
atggcccacaatgctggagctgctgctgctgctggcacccacagcgccaagagcggcggcagcgaggccgccctgaaggagggcggcagcgctgctgccctgagcagcagcagcagcagcagcgctgctgctgctgctgccagcagcagcagcagcagcggccctggcagcgccatggagaccggcctgctgcccaaccacaagctgaagacagtgggggaggccccagctgccccaccccaccagcagcaccaccaccaccaccacgcccaccaccaccaccaccacgcccaccacctgcaccaccaccacgccctgcagcagcagctgaaccagttccagcagcagcagcagcagcagcagcagcagcagcagcagcagcagcagcagcagcaccccatcagcaacaacaacagcctgggcggggccggcggcggggccccccagcccggccctgacatggagcagccccagcacggcggggccaaggacagcgctgctgggggccaggccgaccccccaggcccccccctgctgagcaagccaggagatgaagatgatgccccacccaagatgggagagcctgctgggggccgctatgagcaccctggcctgggcgccctgggcacccagcagccccctgtggccgtgcctgggggcggcggcggccctgctgctgtgcctgagttcaacaactactacggcagcgctgccccagccagcggcggccctgggggccgggccggcccctgctttgaccagcacggcggccagcagagccctggcatgggcatgatgcacagcgccagcgctgctgctgctggggcccctggctccatggaccccctgcagaacagccatgagggctaccccaacagccagtgcaaccactacccaggctacagcaggcctggggccggcggcggcggcggcggcggcggcggcggcggcggcggcagcggcggcggcggcggcggcggcggggccggggccggcggggccggggccggggctgtggccgctgctgctgctgctgctgctgctgctgctgggggcggcggcggcggcggctacggcggcagcagcgctggctatggagtgctgagcagcccccggcagcagggcggcggcatgatgatgggccctgggggcggcggggccgccagcctgagcaaggctgctgctggcagcgctgctgggggcttccagagatttgctggccagaaccagcaccccagcggggccacccccaccctgaaccagctgctgaccagccccagccccatgatgaggagctatggaggcagctacccagagtacagcagccccagcgcccctcctcctccacccagccagccccagagccaggccgctgctgctggagctgctgctgggggccagcaggccgctgctggcatgggcctgggcaaggacatgggcgcccagtatgctgctgccagccctgcctgggccgccgcccagcagaggagccacccagccatgagccctggcaccccaggccccaccatgggccgcagccagggcagccccatggaccccatggtgatgaagaggccccagctgtatggcatgggcagcaacccccacagccagccccagcagagcagcccctacccaggcggcagctatggccccccaggcccccagcgctaccccatcggcatccagggccgcacccctggggccatggccggcatgcagtacccccagcagcagatgccaccccagtatggccagcagggcgtgtctggctactgccagcagggccagcagccctactacagccagcagccccagcccccccacctgcccccccaggcccagtacctgcccagccagagccagcagcgctaccagccccagcaggacatgagccaggagggctacggcaccaggagccagccccccctggcccctgggaagcccaaccacgaggacctgaacctgatccagcaggagcggcccagcagcctgcctgacctgagcggcagcattgatgacctgcccactggaacagaggccaccctgagcagcgctgtgtctgccagcggcagcaccagcagccagggcgaccagagcaacccagcccagagccccttcagcccccacgccagcccccacctgagcagcatccctgggggccccagccccagccctgtgggcagccctgtgggcagcaaccagagccgcagcggccccatcagccctgccagcatccctggcagccagatgccaccccagcccccaggcagccagagcgagagcagcagccacccagccctgagccagagccccatgccccaggagcggggcttcatggccggcacccagaggaacccccagatggcccagtatggcccccagcagacaggccccagcatgagcccccaccccagccctgggggccagatgcatgctggcatcagcagcttccagcagagcaacagcagcggcacctacggcccccagatgagccagtatggcccccagggcaactacagccggcccccagcctacagcggcgtgcccagcgccagctacagcggccctggccctggcatgggcatcagcgccaacaaccagatgcacggccagggccccagccagccctgtggggctgtgcccctgggccgcatgcccagcgctggcatgcagaaccggcccttccctggcaacatgagctccatgacccccagcagccctggcatgagccagcagggcggccctggcatgggcccccccatgcccaccgtgaacaggaaggcccaggaggccgctgctgctgtgatgcaggccgccgccaacagcgcccagagccggcagggcagcttccctggcatgaaccagagcggcctgatggccagcagcagcccctacagccagcccatgaacaacagcagcagcctgatgaacacccaggccccaccctacagcatggccccagccatggtgaacagcagcgctgcctctgtgggcctggccgacatgatgagccctggagagagcaagctgcccctgcccctgaaggcagatggcaaggaggagggcaccccccagcctgagagcaagagcaaggacagctacagcagccagggcatcagccagccccccaccccaggcaacctgcctgtgcccagccccatgagccccagcagcgccagcatcagcagcttccatggagatgaaagtgacagcatcagcagccctggctggcccaagacccccagcagccccaagagcagcagcagcaccaccactggagagaagatcaccaaggtgtatgagctgggcaatgaacctgagaggaagctgtgggtggaccgctacctgaccttcatggaggagcggggcagccctgtgagcagcctgcctgctgtgggcaagaagcccctggacctcttccggctgtatgtgtgtgtgaaggagatcggcggcctggcccaggtgaacaagaacaagaagtggagggagctggccaccaacctgaatgtgggcaccagcagcagcgctgccagcagcctgaagaagcagtacatccagtacctgtttgcctttgagtgcaagattgaaagaggagaggagcccccacctgaggtgttcagcactggagacaccaagaagcagcccaagctgcagccccccagccctgccaacagcggcagcctgcagggcccccagaccccccagagcacaggcagcaacagcatggccgaggtgcctggggacctgaagccacccaccccagccagcaccccccacggccagatgacccccatgcagggcggccgcagcagcaccatctctgtgcatgaccccttcagtgatgtgtctgacagcagcttccccaagagaaattccatgaccccaaatgccccctaccagcagggcatgtccatgccagatgtgatgggccgcatgccctatgagcccaacaaggacccctttggaggcatgaggaaggtgcccggcagcagcgagcccttcatgacccagggccagatgcccaacagctccatgcaggacatgtacaaccagagccccagcggggccatgagcaacctgggcatgggccagaggcagcagttcccctatggagccagctatgacagaagacatgagccctacggccagcagtacccaggccagggccccccatctggccagcccccctacggcggccaccagcccggcctgtacccccagcagcccaactacaagaggcacatggatggcatgtatggccccccagccaagagacatgaaggagacatgtacaacatgcagtacagcagccagcagcaggagatgtacaaccagtatggaggcagctacagcggccctgaccggcggcccatccagggccagtacccctacccctacagccgggagaggatgcagggccctggccagatccagacccacggcatccccccccagatgatgggcggccccctgcagagcagcagcagcgagggcccccagcagaacatgtgggccgccagaaatgacatgccctacccctaccagaaccggcagggccctgggggccccacccaggccccaccctacccaggcatgaacagaacagatgacatgatggtgcctgaccagaggatcaaccacgagagccagtggcccagccacgtgtcccagaggcagccctacatgagcagcagcgcctccatgcagcccatcaccaggcctccccagcccagctaccagaccccacccagcctgcccaaccacatcagccgggcccccagccctgccagcttccagaggagcctggagaacaggatgagccccagcaagagccccttcctgcccagcatgaagatgcagaaggtgatgcccaccgtgcccaccagccaggtgactggacctccaccccagcccccacccatcagaagagagatcaccttccccccaggctctgtggaggccagccagcctgtgctgaagcagaggaggaagatcaccagcaaggacatcgtgaccccagaggcctggagggtgatgatgagcctgaagagcggcctgctggccgagagcacctgggccctggacaccatcaacatcctgctgtatgatgacagcacagtggccaccttcaacctgagccagctgagcggcttcctggagctgctggtggagtacttcaggaagtgcctgattgacatcttcggcatcctgatggagtatgaggtgggggaccccagccagaaggccctggaccacaatgctgccaggaaggatgacagccagagcctggctgatgacagcggcaaggaggaggaggatgctgagtgcattgatgatgatgaagaagatgaggaggatgaggaggaggacagcgagaagacagaaagtgatgagaagagcagcatcgccctgacagccccagatgctgctgctgaccccaaggagaagcccaagcaggccagcaagtttgacaagctgcccatcaagatcgtgaagaagaacaacctgtttgtggtggacagaagtgacaagctgggccgggtgcaggagttcaacagcggcctgctgcactggcagctgggcggcggggacaccacagagcacatccagacccactttgagagcaagatggagatccccccaagaagaagacctcctccacccctgagcagcgctggcaggaagaaggagcaggagggcaagggggacagcgaggagcagcaggagaagagcatcatcgccaccattgatgatgtgctgagcgcccggcctggggccctgcctgaagatgccaaccctggcccccagacagagagcagcaagttccccttcggcatccagcaggccaagagccacaggaacatcaagctgctggaggatgagcccaggagcagagatgagacccccctgtgcaccatcgcccactggcaggacagcctggccaagcgctgcatctgtgtgagcaacatcgtgcgcagcctgagctttgtgcctggaaatgatgctgagatgagcaagcaccctggcctggtgctgatcctgggcaagctgatcctgctgcaccacgagcaccctgagaggaagagggccccccagacctatgagaaggaggaggatgaagataaaggagtggcctgcagcaaggatgagtggtggtgggactgcctggaggtgctgcgggacaacaccctggtgaccctggccaacatcagcggccagctggacctgagcgcctacacagagagcatctgcctgcccatcctggatggcctgctgcactggatggtgtgccccagcgctgaggcccaggaccccttccccaccgtgggccccaacagcgtgctgagcccccagaggctggtgctggagaccctgtgcaagctgagcatccaggacaacaacgtggacctgatcctggccaccccacccttcagccggcaggagaagttctacgccaccctggtgcgctacgtgggggacaggaagaaccctgtgtgccgggagatgtccatggccctgctgagcaacctggcccagggagatgccctggccgcccgggccatcgctgtgcagaagggcagcatcggcaacctgatctccttcctggaggatggagtgaccatggcccagtaccagcagagccagcacaacctgatgcacatgcagcccccacccctggagcccccatctgtggacatgatgtgccgggccgccaaggccctgctggccatggcccgggtggatgagaacagaagtgagttcctgctgcacgagggccgcctgctggacatcagcatctctgctgtgctgaacagcctggtggccagcgtcatctgtgatgtgctcttccagatcggccagctgtag

SEQ ID NO: 15023 - DNA, 822 bp, Artificial Sequence
  Description of Artificial Sequence: Synthetic coding sequence
gctgctgtgatgcaggccgccgccaacagcgcccagagccggcagggcagcttccctggcatgaaccagagcggcctgatggccagcagcagcccctacagccagcccatgaacaacagcagcagcctgatgaacacccaggccccaccctacagcatggccccagccatggtgaacagcagcgctgcctctgtgggcctggccgacatgatgagccctggagagagcaagctgcccctgcccctgaaggcagatggcaaggaggagggcaccccccagcctgagagcaagagcaagaagagcagcagcagcaccaccactggagagaagatcaccaaggtgtatgagctgggcaatgaacctgagaggaagctgtgggtggaccgctacctgaccttcatggaggagcggggcagccctgtgagcagcctgcctgctgtgggcaagaagcccctggacctcttccggctgtatgtgtgtgtgaaggagatcggcggcctggcccaggtgaacaagaacaagaagtggagggagctggccaccaacctgaatgtgggcaccagcagcagcgctgccagcagcctgaagaagcagtacatccagtacctgtttgcctttgagtgcaagattgaaagaggagaggagcccccacctgaggtgttcagcactggagacaccaagaagcagcccaagctgcagccccccagccctgggaagtggaggcgctgcagccactggcccaggaaggcccaggcccctggcctgggcggcagcggcaaggtggtgtcccagagcggccagcagggcacctgggacttctag

SEQ ID NO: 15024 - DNA, 1053 bp, Artificial Sequence
  Description of Artificial Sequence: Synthetic coding sequence
atgagccaggagggctacggcaccaggagccagccccccctggcccctgggaagcccaaccacgaggacctgaacctgatccagcaggagcggcccagcagcctgcctgtggaggtgctggcctctgaagatgctgccttcggcctgaaggacctgagcggcagcattgatgacctgcccactggaacagaggccaccctgagcagcgctgtgtctgccagcggcagcaccagcagccagggcgaccagagcaacccagcccagagccccttcagcccccacgccagcccccacctgagcagcatccctgggggccccagccccagccctgtgggcagccctgtgggcagcaaccagagccgcagcggccccatcagccctgccagcatccctggcagccagatgccaccccagcccccaggcagccagagcgagagcagcagccacccagccctgagccagagccccatgccccaggagcggggcttcatggccggcacccagaggaacccccagatggcccagtatggcccccagcagacaggccccagcatgagcccccaccccagccctgggggccagatgcatgctggcatcagcagcttccagcagagcaacagcagcggcacctacggcccccagatgagccagtatggcccccagggcaactacagccggcccccagcctacagcggcgtgcccagcgccagctacagcggccctggccctggcatgggcatcagcgccaacaaccagatgcacggccagggccccagccagccctgtggggctgtgcccctgggccgcatgcccagcgctggcatgcagaaccggcccttccctggcaacatgagctccatgacccccagcagccctggcatgagccagcagggcggccctggcatgggcccccccatgcccaccgtgaacaggaaggcccaggaggccgctgctgctgtgatgcaggccgccgccaacagcgcccagagccgctatgccacccaggagcacgcccctggccgctatgctgtgtgcctgcctgtgaccacctag

SEQ ID NO: 15025 - DNA, 5508 bp, Artificial Sequence
  Description of Artificial Sequence: Synthetic coding sequence
atggccaacagcacaggcaaggcccccccagatgaaagaaggaagggcctggccttcctggatgagctgcggcagttccaccacagccggggcagccccttcaagaagatcccagctgtgggcggcaaggagctggacctgcacggcctgtacaccagggtgaccaccctgggcggctttgccaaggtgtctgagaagaaccagtggggcgagatcgtggaggagttcaacttccccaggagctgcagcaatgctgcctttgccctgaagcagtactacctgcgctacctggagaagtatgagaaggtgcaccactttggagaagatgatgatgaggtgcccccaggcaaccccaagccccagctgcccatcggggccatccccagcagctacaactaccagcagcacagcgtgtctgactacctgcggcagagctatggcctgtccatggacttcaacagccccaatgactacaacaagctggtgctgagcctgctgagcggcctgcccaatgaggtggactttgccatcaacgtgtgcaccctgctgagcaatgaaagcaagcacgtgatgcagctggagaaggaccccaagatcatcaccctgctgctggccaatgctggggtgtttgatgacaccctgggcagcttcagcacagtgtttggagaggagtggaaggagaagacagaccgggactttgtgaagttctggaaggacatcgtggatgacaatgaggtgcgggacctgatcagtgacaggaacaagagccatgagggcaccagcggggagtggatctgggagagcctcttccacccccccaggaagctgggcatcaatgacatcgagggccagagggtgctgcagattgctgtgatcctgaggaacctgagctttgaggagggcaatgtgaagctgctggccgccaacagaacctgcctgcgcttcctgctgctgagcgcccacagccacttcatcagcctgcggcagctgggcctggacaccctgggcaacattgctgctgagctgctgctggaccctgtggacttcaagaccacccacctgatgttccacacagtgaccaagtgcctgatgagccgggaccgcttcctgaagatgaggggcatggagatcctgggcaacctgtgcaaggcagaagataatggagtgctgatctgtgaatatgtggaccaggacagctaccgggagatcatctgccacctgaccctgcctgatgtgctgctggtgatcagcaccctggaggtgctgtacatgctgacagagatgggagatgtggcctgcaccaagatcgccaaggtggagaagagcattgacatgctggtgtgcctggtgtccatggacatccagatgtttggaccagatgccctggccgctgtgaagctgattgagcaccccagcagcagccaccagatgctgtctgagatccggccccaggccatcgagcaggtgcagacccagacccacgtggccagcgccccagccagcagagctgtggtggcccagcacgtggcccctcctcctggcatcgtggagattgacagcgagaagtttgcctgccagtggctgaatgcccactttgaggtgaacccagactgcagcgtgtccagagctgagatgtacagcgagtacctgagcacctgcagcaagctggcccggggcggcatcctgaccagcacaggcttctacaagtgcctgaggacagtgttccccaaccacacagtgaagagggtggaggacagcagcagcaatggccaggcccacatccacgtggtgggcgtgaagagaagagccatccccctgcccatccagatgtactaccagcagcagcctgtgtccacctctgtggtgcgggtggacagcgtgcctgatgtgtccccagcccccagccctgctggcatcccccacggcagccagaccatcggcaaccacttccagaggacccctgtggccaaccagagcagcaacctgacagccacccagatgtccttccctgtgcagggcgtgcacacagtggcccagacagtgagccgcatcccccagaaccccagcccccacacccaccagcagcagaatgcccctgtgaccgtcatccagagcaaggcccccatcccctgtgaggtggtgaaggccaccgtcatccagaacagcatcccccagacaggagtgcctgtgtccattgctgtgggcggcggccccccccagagctctgtggtgcagaaccacagcacaggcccccagcctgtgacagtggtgaacagccagaccctgctgcaccaccccagcgtcatcccccagcagagccccctgcacacagtggtgcccggccagatccccagcggcacccctgtgaccgtcatccagcaggccgtgccccagagccacatgtttggccgggtgcagaacatcccagcctgcaccagcacagtgtcccagggccagcagctgatcaccaccagcccccagcctgtgcagaccagcagccagcagaccagcgctggcagccagagccaggacaccgtcatcatcgccccaccccagtatgtgaccaccagcgccagcaacatcgtgtctgccacctctgtgcagaacttccaggtggccaccggccagatggtgaccatcgccggcgtgcccagcccccaggccagccgggtgggcttccagaacatcgcccccaagcccctgcccagccagcaggtgagcagcacagtggtgcagcagcccatccagcagccccagcagcccacccagcagagcgtggtgattgtgtcccagcctgcccagcagggccagacctacgccccagccatccaccagatcgtgctggccaacccagctgccctgcctgctggccagacagtgcagctgaccggccagcccaacatcacccccagcagcagccccagccctgtgcctgccaccaacaaccaggtgcccacagccatgagcagcagcagcaccccccagagccagggccccccacccaccgtgtcccagatgctgtctgtgaagaggcagcagcagcagcagcacagccctgcccccccaccccagcaggtgcaggtgcaggtgcagcagccccagcaggtgcagatgcaggtgcagccccagcagagcaatgccggcgtgggccagcctgccagcggggagagcagcctcatcaagcagctgctgctgcccaagaggggccccagcaccccaggcggcaagctgatcctgcctgccccccagatccccccacccaacaatgcccgggcccccagcccccaggtggtgtaccaggtggccagcaaccaggccgccggctttggagtgcagggccagaccccagcccagcagctgctggtgggccagcagaatgtgcagctggtgcccagcgccatgcctccttctggaggagtgcagacagtgcccatcagcaacctgcagatcctgcccggccccctcatcagcaacagccctgccaccatcttccagggcaccagcggcaaccaggtgaccatcaccgtggtgcccaacaccagctttgccccagccaccgtgtcccagggcaatgccacccagctgattgccccagctggcatcaccatgagcggcacccagacaggagtgggcctgcctgtgcagaccctgcctgccacccaggccagccctgctggccagagcagctgcaccacagccaccccacccttcaagggggacaagatcatctgccagaaggaggaggaggccaaggaggccaccggcctgcacgtgcatgagaggaagattgaggtgatggagaaccccagctgccggcggggggccaccaacaccagcaatggagacaccaaggaaaatgagatgcacgtgggcagcctgctgaatggaaggaagtacagcgacagcagcctgccccccagcaacagcggcaagatccagagcgagaccaaccagtgcagcctcatcagcaatggccccagcctggagctgggggagaatggagccagcggcaagcagaacagcgagcagattgacatgcaggacatcaagagtgacctgaggaagcccctggtgaatggcatctgtgactttgacaagggagatggcagccacctgagcaagaacatccccaaccacaagaccagcaaccacgtgggcaatggagagatcagccccatggagccccagggcaccctggacatcacccagcaggacacagccaagggggaccagctggagcgcatcagcaatggacctgtgctgaccctgggcggcagctctgtgagcagcatccaggaggccagcaatgctgccacccagcagttctctggaacagacctgctgaatggccccctggccagcagcctgaacagtgatgtgccccagcagaggcccagcgtggtggtgagcccccacagcaccaccagcgtcatccagggccaccagatcatcgctgtgcctgattctggcagcaaggtgagccacagccctgccctgagcagtgatgtgcgcagcaccaatggaacagctgagtgcaagacagtgaagaggcctgctgaggacacagaccgggagaccgtggccggcatccccaacaaggtgggcgtgcgcatcgtgaccatcagtgaccccaacaatgccggctgcagcgccaccatggtggccgtgcctgctggagctgaccccagcacagtggccaaggtggccatcgagagcgctgtgcagcagaagcagcagcacccccccacctacgtgcagaatgtggtgccccagaacacccccatgccacccagccctgctgtgcaggtgcagggccagcccaacagcagccagcccagccccttcagcggcagcagccagcccggggaccccatgaggaagccaggccagaacttcatgtgcctgtggcagagctgcaagaagtggttccagacccccagccaggtgttctaccacgccgccacagaacatggaggcaaggatgtgtacccaggccagtgcctgtgggagggctgtgagcccttccagaggcagcgcttctccttcatcacccacctgcaggacaagcactgcagcaaggatgccctgctggccggcctgaagcaggatgagcccggccaggccggcagccagaagagcagcaccaagcagcccaccgtgggcggcaccagcagcaccccccgggcccagaaggccatcgtgaaccaccccagcgctgccctgatggccctgcggcggggcagcaggaacctggtgttccgggacttcacagatgagaaggagggccccatcaccaagcacatccggctgacagctgccctgatcctgaagaacatcggcaagtacagtgaatgtggccgccgcctgctgaagagacatgagaacaacctgtctgtgctggccatcagcaacatggaggccagcagcaccctggccaagtgcctgtatgagctgaacttcaccgtgcagagcaaggagcaggagaaggacagcgagatgctgcagtag

SEQ ID NO: 15026 - DNA, 2859 bp, Artificial Sequence
  Description of Artificial Sequence: Synthetic coding sequence
atgatgatgagataccaccaggccatccagagccacagcttcctgctggtgcagttccacctgcccaccatcaccagcaacacagtgtgccgcatcatctgtgtgaaggtgatgggctgcccctggaccctcatccggcagatgatcatcatcaactggtgcttccactgctacctggacagccagatgaagtggaccctgctgctgacctacgccctgagctaccagatgaaggccagcaccagctgcaacctgaagaagatcctgaagagcagccctgtgcctgccaccaacaaccaggtgcccacagccatgagcagcagcagcaccccccagagccagggccccccacccaccgtgtcccagatgctgtctgtgaagaggcagcagcagcagcagcacagccctgcccccccaccccagcaggtgcaggtgcaggtgcagcagccccagcaggtgcagatgcaggtgcagccccagcagagcaatgctggggtgggccagcctgccagcggggagagcagcctcatcaagcagctgctgctgcccaagaggggccccagcacccctgggggcaagctgatcctgcctgccccccagatccccccacccaacaatgcccgggcccccagcccccaggtggtgtaccaggtggccagcaaccaggccgccggcttcggcgtgcagggccagaccccagcccagcagctgctggtgggccagcagaatgtgcagctggtgcccagcgccatgccacccagcggcggcgtgcagacagtgcccatcagcaacctgcagatcctgcccggccccctcatcagcaacagccctgccaccatcttccagggcaccagcggcaaccaggtgaccatcaccgtggtgcccaacaccagctttgccccagccaccgtgtcccagggcaatgccacccagctgattgccccagctggcatcaccatgagcggcacccagacaggagtgggcctgcctgtgcagaccctgcctgccacccaggccagccctgctggccagagcagctgcaccacagccaccccacccttcaagggggacaagatcatctgccagaaggaggaggaggccaaggaggccaccggcctgcacgtgcatgagaggaagattgaggtgatggagaaccccagctgcagaagaggagccaccaacaccagcaatggagacaccaaggaaaatgagatgcacgtgggcagcctgctgaatggaaggaagtacagcgacagcagcctgccccccagcaacagcggcaagatccagagcgagaccaaccagtgcagcctcatcagcaatggccccagcctggagctgggagaaaatggagccagcggcaagcagaacagcgagcagattgacatgcaggacatcaagagtgacctgaggaagcccctggtgaatggcatctgtgactttgataaaggagatggcagccacctgagcaagaacatccccaaccacaagaccagcaaccacgtgggcaatggagagatcagccccatggagccccagggcaccctggacatcacccagcaggacacagccaagggggaccagctggagcgcatcagcaatggacctgtgctgaccctgggcggcagctctgtgagcagcatccaggaggccagcaatgctgccacccagcagttcagcggcacagacctgctgaatggccccctggccagcagcctgaacagtgatgtgccccagcagaggccttctgtggtggtgagcccccacagcaccaccagcgtcatccagggccaccagatcatcgctgtgcctgacagcggcagcaaggtgagccacagccctgccctgagcagtgatgtgcgcagcaccaacggcacagctgagtgcaagacagtgaagaggcctgctgaggacacagaccgggagaccgtggccggcatccccaacaaggtgggcgtgagaattgtgaccatcagtgaccccaacaatgccggctgcagcgccaccatggtggccgtgcctgctggagctgaccccagcacagtggccaaggtggccattgaatctgctgtgcagcagaagcagcagcacccccccacctacgtgcagaatgtggtgccccagaacacccccatgccacccagccctgctgtgcaggtgcagggccagcccaacagcagccagcccagccccttcagcggcagcagccagcccggggaccccatgaggaagccaggccagaacttcatgtgcctgtggcagagctgcaagaagtggttccagacccccagccaggtgttctaccacgccgccacagagcacggcggcaaggatgtgtacccaggccagtgcctgtgggagggctgtgagcccttccagaggcagcgcttctccttcatcacccacctgcaggacaagcactgcagcaaggatgccctgctggccggcctgaagcaggatgagcccggccaggccggcagccagaagagcagcaccaagcagcccaccgtgggcggcaccagcagcaccccccgggcccagaaggccatcgtgaaccaccccagcgctgccctgatggccctgcggcggggcagcaggaacctggtgttccgggacttcacagatgagaaggagggccccatcaccaagcacatccggctgacagctgccctgatcctgaagaacatcggcaagtacagtgaatgtggccggcggctgctgaagagacatgagaacaacctgtctgtgctggccatcagcaacatggaggccagcagcaccctggccaagtgcctgtatgagctgaacttcaccgtgcagagcaaggagcaggagaaggacagcgagatgctgcagtag

SEQ ID NO: 15027 - DNA, 4338 bp, Artificial Sequence
  Description of Artificial Sequence: Synthetic coding sequence
atgaggggcatggagatcctgggcaacctgtgcaaggccgaggacaacggggtgctgatctgtgaatatgtggaccaggacagctaccgggagatcatctgccacctgaccctgcctgatgtgctgctggtgatcagcaccctggaggtgctgtacatgctgacagagatgggagatgtggcctgcaccaagatcgccaaggtggagaagagcattgctgctgtgaagctgattgagcaccccagcagcagccaccagatgctgtctgagatccggccccaggccatcgagcaggtgcagacccagacccacgtggccagcgccccagccagcagagctgtggtggcccagcacgtggcccctcctcctggcatcgtggagattgacagcgagaagtttgcctgccagtggctgaatgcccactttgaggtgaacccagactgcagcgtgtccagagctgagatgtacagcgagtacctgagcacctgcagcaagctggcccggggcggcatcctgaccagcacaggcttctacaagtgcctgaggacagtgttccccaaccacacagtgaagagggtggaggacagcagcagcaatggccaggcccacatccacgtggtgggcgtgaagagaagagccatccccctgcccatccagatgtactaccagcagcagcctgtgtccacctctgtggtgcgggtggacagcgtgcctgatgtgtccccagcccccagccctgctggcatcccccacggcagccagaccatcggcaaccacttccagaggacccctgtggccaaccagagcagcaacctgacagccacccagatgtccttccctgtgcagggcgtgcacacagtggcccagacagtgagccgcatcccccagaaccccagcccccacacccaccagcagcagaatgcccctgtgaccgtcatccagagcaaggcccccatcccctgtgaggtggtgaaggccaccgtcatccagaacagcatcccccagacaggagtgcctgtgtccattgctgtgggcggcggccccccccagagctctgtggtgcagaaccacagcacaggcccccagcctgtgacagtggtgaacagccagaccctgctgcaccaccccagcgtcatcccccagcagagccccctgcacacagtggtgcccggccagatccccagcggcacccctgtgaccgtcatccagcaggccgtgccccagagccacatgtttggccgggtgcagaacatcccagcctgcaccagcacagtgtcccagggccagcagctgatcaccaccagcccccagcctgtgcagaccagcagccagcagaccagcgctggcagccagagccaggacaccgtcatcatcgccccaccccagtatgtgaccaccagcgccagcaacatcgtgtctgccacctctgtgcagaacttccaggtggccaccggccagatggtgaccatcgccggcgtgcccagcccccaggccagccgggtgggcttccagaacatcgcccccaagcccctgcccagccagcaggtgagcagcacagtggtgcagcagcccatccagcagccccagcagcccacccagcagagcgtggtgattgtgtcccagcctgcccagcagggccagacctacgccccagccatccaccagatcgtgctggccaacccagctgccctgcctgctggccagacagtgcagctgaccggccagcccaacatcacccccagcagcagccccagccctgtgcctgccaccaacaaccaggtgcccacagccatgagcagcagcagcaccccccagagccagggccccccacccaccgtgtcccagatgctgtctgtgaagaggcagcagcagcagcagcacagccctgcccccccaccccagcaggtgcaggtgcaggtgcagcagccccagcaggtgcagatgcaggtgcagccccagcagagcaatgccggcgtgggccagcctgccagcggggagagcagcctcatcaagcagctgctgctgcccaagaggggccccagcaccccaggcggcaagctgatcctgcctgccccccagatccccccacccaacaatgcccgggcccccagcccccaggtggtgtaccaggtggccagcaaccaggccgccggctttggagtgcagggccagaccccagcccagcagctgctggtgggccagcagaatgtgcagctggtgcccagcgccatgcctccttctggaggagtgcagacagtgcccatcagcaacctgcagatcctgcccggccccctcatcagcaacagccctgccaccatcttccagggcaccagcggcaaccaggtgaccatcaccgtggtgcccaacaccagctttgccccagccaccgtgtcccagggcaatgccacccagctgattgccccagctggcatcaccatgagcggcacccagacaggagtgggcctgcctgtgcagaccctgcctgccacccaggccagccctgctggccagagcagctgcaccacagccaccccacccttcaagggggacaagatcatctgccagaaggaggaggaggccaaggaggccaccggcctgcacgtgcatgagaggaagattgaggtgatggagaaccccagctgccggcggggggccaccaacaccagcaatggagacaccaaggaaaatgagatgcacgtgggcagcctgctgaatggaaggaagtacagcgacagcagcctgccccccagcaacagcggcaagatccagagcgagaccaaccagtgcagcctcatcagcaatggccccagcctggagctgggggagaatggagccagcggcaagcagaacagcgagcagattgacatgcaggacatcaagagtgacctgaggaagcccctggtgaatggcatctgtgactttgacaagggagatggcagccacctgagcaagaacatccccaaccacaagaccagcaaccacgtgggcaatggagagatcagccccatggagccccagggcaccctggacatcacccagcaggacacagccaagggggaccagctggagcgcatcagcaatggacctgtgctgaccctgggcggcagctctgtgagcagcatccaggaggccagcaatgctgccacccagcagttctctggaacagacctgctgaatggccccctggccagcagcctgaacagtgatgtgccccagcagaggcccagcgtggtggtgagcccccacagcaccaccagcgtcatccagggccaccagatcatcgctgtgcctgattctggcagcaaggtgagccacagccctgccctgagcagtgatgtgcgcagcaccaatggaacagctgagtgcaagacagtgaagaggcctgctgaggacacagaccgggagaccgtggccggcatccccaacaaggtgggcgtgcgcatcgtgaccatcagtgaccccaacaatgccggctgcagcgccaccatggtggccgtgcctgctggagctgaccccagcacagtggccaaggtggccatcgagagcgctgtgcagcagaagcagcagcacccccccacctacgtgcagaatgtggtgccccagaacacccccatgccacccagccctgctgtgcaggtgcagggccagcccaacagcagccagcccagccccttcagcggcagcagccagcccggggaccccatgaggaagccaggccagaacttcatgtgcctgtggcagagctgcaagaagtggttccagacccccagccaggtgttctaccacgccgccacagaacatggaggcaaggatgtgtacccaggccagtgcctgtgggagggctgtgagcccttccagaggcagcgcttctccttcatcacccacctgcaggacaagcactgcagcaaggatgccctgctggccggcctgaagcaggatgagcccggccaggccggcagccagaagagcagcaccaagcagcccaccgtgggcggcaccagcagcaccccccgggcccagaaggccatcgtgaaccaccccagcgctgccctgatggccctgcggcggggcagcaggaacctggtgttccgggacttcacagatgagaaggagggccccatcaccaagcacatccggctgacagctgccctgatcctgaagaacatcggcaagtacagtgaatgtggccgccgcctgctgaagagacatgagaacaacctgtctgtgctggccatcagcaacatggaggccagcagcaccctggccaagtgcctgtatgagctgaacttcaccgtgcagagcaaggagcaggagaaggacagcgagatgctgcagtag

SEQ ID NO: 15028 - DNA, 2859 bp, Artificial Sequence; identical to SEQ ID NO: 15026
  Description of Artificial Sequence: Synthetic coding sequence

SEQ ID NO: 15029 - DNA, 1044 bp, Artificial Sequence
  Description of Artificial Sequence: Synthetic coding sequence
atgaagatggaggagatgagcctgagcggcctggacaacagcaagctggaggccatcgcccaggagatctatgctgacctggtggaggacagctgcctgggcttctgctttgaggtgcacagagctgtgaagtgtggctacttcttcctggatgacacagatcctgacagcatgaaggactttgaaattgtggaccagcccggcctggacatcttcggccaggtgttcaaccagtggaagagcaaagaatgtgtgtgccccaactgcagccgcagcattgctgccagcagatttgccccccacctggagaagtgcctgggcatgggcaggaacagcagcagaattgccaacagacgcatcgccaacagcaacaacatgaacaagtctgagagtgaccaggaggacaatgatgacatcaatgacaatgactggagctatggcagcgagaagaaggccaagaagaggaagagtgacaagaaccccaacagccccaggaggagcaagagcctgaagcacaagaatggagagctgagcaacagcgaccccttcaagtacaacaacagcacaggcatctcctatgagaccctgggccctgaggagctgcggagcctgctgaccacccagtgtggggtcatcagcgagcacaccaagaagatgtgcaccaggagcctgcgctgcccccagcacacagatgagcagaggagaacagtgcgcatctacttcctgggccccagcgctgtgctgcctgaggtggagagcagcctggacaatgacagctttgacatgacagacagccaggccctgatcagccggctgcagtgggatggcagcagtgacctgagccccagcgacagcggcagcagcaagaccagcgagaaccagggctggggcctgggcaccaacagcagcgagagcaggaagaccaagaagaagaagagccacctgagcctggtgggcacagccagcggcctgggcagcaacaagaagaagaagcccaagcccccagccccacccacccccagcatctatgatgacatcaactag

SEQ ID NO: 15030 - DNA, 1065 bp, Artificial Sequence
  Description of Artificial Sequence: Synthetic coding sequence
atgaagatggaggagatgagcctgagcggcctggacaacagcaagctggaggccatcgcccaggagatctatgctgacctggtggaggacagctgcctgggcttctgctttgaggtgcacagagctgtgaagtgtggctacttcttcctggatgacacagatcctgacagcatgaaggactttgaaattgtggaccagcccggcctggacatcttcggccaggtgttcaaccagtggaagagcaaagaatgtgtgtgccccaactgcagccgcagcattgctgccagcagatttgccccccacctggagaagtgcctgggcatgggcaggaacagcagcagaattgccaacagacgcatcgccaacagcaacaacatgaacaagtctgagagtgaccaggaggacaatgatgacatcaatgacaatgactggagctatggcagcgagaagaaggccaagaagaggaagagtgacaagctgtggtacctgcccttccagaaccccaacagcccccggcgcagcaagagcctgaagcacaagaatggagagctgagcaacagcgaccccttcaagtacaacaacagcacaggcatctcctatgagaccctgggccctgaggagctgcggagcctgctgaccacccagtgtggggtcatcagcgagcacaccaagaagatgtgcaccaggagcctgcgctgcccccagcacacagatgagcagaggagaacagtgcgcatctacttcctgggccccagcgctgtgctgcctgaggtggagagcagcctggacaatgacagctttgacatgacagacagccaggccctgatcagccggctgcagtgggatggcagcagtgacctgagccccagcgacagcggcagcagcaagaccagcgagaaccagggctggggcctgggcaccaacagcagcgagagcaggaagaccaagaagaagaagagccacctgagcctggtgggcacagccagcggcctgggcagcaacaagaagaagaagcccaagcccccagccccacccacccccagcatctatgatgacatcaactag

SEQ ID NO: 15031 - DNA, 390 bp, Artificial Sequence
  Description of Artificial Sequence: Synthetic coding sequence
atgtgcaccaggagcctgcgctgcccccagcacacagatgagcagaggagaacagtgcgcatctacttcctgggccccagcgctgtgctgcctgaggtggagagcagcctggacaatgacagctttgacatgacagacagccaggccctgatcagccggctgcagtgggatggcagcagtgacctgagccccagcgacagcggcagcagcaagaccagcgagaaccagggctggggcctgggcaccaacagcagcgagagcaggaagaccaagaagaagaagagccacctgagcctggtgggcacagccagcggcctgggcagcaacaagaagaagaagcccaagcccccagccccacccacccccagcatctatgatgacatcaactag

SEQ ID NO: 15032 - DNA, 5031 bp, Artificial Sequence
  Description of Artificial Sequence: Synthetic coding sequence
atgggcctgctgggcatcctgtgcttcctgatcttcctgggcaagacctggggccaggagcagacctacgtgatcagcgcccccaagatcttccgggtgggcgcctctgaaaatattgtcatccaggtgtatggctacacagaggcctttgatgccaccatcagcatcaagagctacccagacaagaagttctcctacagcagcggccacgtgcacctgagcagcgagaacaagttccagaacagcgccatcctgaccatccagcccaagcagctgcccggcggccagaaccctgtgtcctatgtgtacctggaggtggtgtccaagcacttcagcaagagcaagaggatgcccatcacctatgacaatggcttcctgttcatccacacagacaagcctgtgtacaccccagaccagagcgtgaaggtgcgggtgtacagcctgaatgatgacctgaagccagccaagcgggagaccgtgctgaccttcatcgaccctgagggcagcgaggtggacatggtggaggagattgaccacatcggcatcatctccttcccagacttcaagatccccagcaaccccaggtatggcatgtggaccatcaaggccaagtacaaggaggacttcagcaccaccggcacagcctactttgaggtgaaggagtatgtgctgccccacttctctgtgtccattgagcctgagtacaacttcatcggctacaagaacttcaagaactttgagatcaccatcaaggcccgctacttctacaacaaggtggtgacagaagcagatgtgtacatcaccttcggcatccgggaggacctgaaggatgaccagaaggagatgatgcagacagccatgcagaacaccatgctgatcaatggcatcgcccaggtgacctttgattctgaaacagctgtgaaggagctgagctactacagcctggaggacctgaacaacaagtacctgtacatcgctgtgaccgtcatcgagagcactggaggcttcagcgaggaggccgagatccctggcatcaagtatgtgctgagcccctacaagctgaacctggtggccacccccctcttcctgaagccaggcatcccctaccccatcaaggtgcaggtgaaggacagcctggaccagctggtgggcggcgtgcctgtgaccctgaatgcccagaccattgatgtgaaccaggagaccagtgacctggaccccagcaagtctgtgaccagggtggatgatggagtggccagctttgtgctgaacctgcccagcggcgtgacagtgctggagttcaacgtgaagacagatgccccagacctgcctgaggagaaccaggcccgggagggctaccgggccatcgcctacagcagcctgagccagagctacctgtacatcgactggacagacaaccacaaggccctgctggtgggggagcacctgaacatcatcgtgacccccaagagcccctacatcgacaagatcacccactacaactacctgatcctgagcaagggcaagatcatccacttcggcacccgggagaagttcagtgatgccagctaccagagcatcaacatccctgtgacccagaacatggtgcccagcagccggctgctggtgtactacatcgtgactggagagcagacagctgagctggtgtctgacagcgtgtggctgaacatcgaggagaagtgtggcaaccagctgcaggtgcacctgagcccagatgctgatgcctacagccctggccagacagtgtccctgaacatggccaccggcatggacagctgggtggccctggccgctgtggacagcgctgtgtatggagtgcagagaggagccaagaagcccctggagagggtcttccagttcctggagaagagtgacctgggctgtggggccggcggcggcctgaacaatgccaacgtgttccacctggccggcctgaccttcctgaccaatgccaatgctgatgacagccaggagaatgatgagccctgcaaggagatcctgcggcccaggaggaccctgcagaagaagattgaggagattgctgccaagtacaagcacagcgtggtgaagaagtgctgctatgatggagcctgtgtgaacaatgatgagacctgtgagcagagagctgcccgcatcagcctgggcccccgctgcatcaaggccttcacagagtgctgcgtggtggccagccagctgcgggccaacatcagccacaaggacatgcagctgggccgcctgcacatgaagaccctgctgcctgtgtccaagccagagatccgcagctacttccctgagagctggctgtgggaggtgcacctggtgcccaggaggaagcagctgcagtttgccctgcctgacagcctgaccacctgggagatccagggcgtgggcatcagcaacacaggcatctgtgtggccgacacagtgaaggccaaggtgttcaaggatgtgttcctggagatgaacatcccctacagcgtggtgcggggggagcagatccagctgaagggcaccgtgtacaactaccgcaccagcggcatgcagttctgtgtgaagatgtctgctgtggagggcatctgcaccagcgagagccctgtgattgaccaccagggcaccaagagcagcaaatgtgtgcggcagaaggtggagggcagcagcagccacctggtgaccttcaccgtgctgcccctggagatcggcctgcacaacatcaacttcagcctggagacctggtttgggaaggagatcctggtgaagaccctgcgggtggtgcctgagggcgtgaagcgggagagctacagcggcgtgaccctggacccccggggcatctacggcaccatcagcaggaggaaggagttcccctaccgcatccccctggacctggtgcccaagacagagatcaagaggatcctgtctgtgaagggcctgctggtgggggagatcctgtctgctgtgctgagccaggagggcatcaacatcctgacccacctgcccaagggcagcgctgaggccgagctgatgtctgtggtgcctgtgttctacgtgttccactacctggagactggaaaccactggaacatcttccacagcgaccccctcatcgagaagcagaagctgaagaagaagctgaaggagggcatgctgagcatcatgagctacagaaatgctgactacagctacagcgtgtggaagggcggcagcgccagcacctggctgacagcctttgccctgcgggtgctgggccaggtgaacaagtatgtggagcagaaccagaacagcatctgcaacagcctgctgtggctggtggagaactaccagctggacaatggcagcttcaaggagaacagccagtaccagcccatcaagctgcagggcaccctgcctgtggaggcccgggagaacagcctgtacctgacagccttcaccgtcatcggcatcaggaaggcctttgacatctgccccctggtgaagattgacacagccctgatcaaggctgacaacttcctgctggagaacaccctgcctgcccagagcaccttcaccctggccatcagcgcctatgccctgagcctgggggacaagacccacccccagttccgcagcatcgtgtctgccctgaagcgggaggccctggtgaagggcaacccccccatctaccgcttctggaaggacaacctgcagcacaaggacagctctgtgcccaacacaggaacagccaggatggtggagaccacagcctatgccctgctgaccagcctgaacctgaaggacatcaactacgtgaaccctgtgatcaagtggctgtctgaggagcagagatatggaggcggcttctacagcacccaggacaccatcaatgccatcgagggcctgacagagtacagcctgctggtgaagcagctgcggctgtccatggacattgatgtgtcctacaagcacaagggggccctgcacaactacaagatgacagacaagaacttcctgggccggcctgtggaggtgctgctgaatgatgacctgattgtgtccacaggcttcggcagcggcctggccaccgtgcacgtgaccaccgtggtgcacaagaccagcaccagcgaggaggtgtgcagcttctacctgaagattgacacccaggacatcgaggccagccactaccggggctacggcaacagcgactacaagagaattgtggcctgtgccagctacaagcccagccgggaggagagcagcagcggcagcagccatgctgtgatggacatcagcctgcccaccggcatcagcgccaatgaggaggacctgaaggccctggtggagggcgtggaccagctgttcacagactaccagatcaaggatggccacgtgatcctgcagctgaacagcatccccagcagtgacttcctgtgtgtgcgcttccgcatctttgagctgtttgaggtgggcttcctgagccctgccaccttcaccgtgtatgagtaccacaggccagacaagcagtgcaccatgttctacagcaccagcaacatcaagatccagaaggtgtgtgagggcgccgcctgcaagtgtgtggaggccgactgtggccagatgcaggaggagctggacctgaccatctctgctgagaccaggaagcagacagcctgcaagccagaaattgcctatgcctacaaggtgtccatcaccagcatcaccgtggagaatgtgtttgtgaagtacaaggccaccctgctggacatctacaagacaggagaggccgtggccgagaaggacagcgagatcaccttcatcaagaaggtgacctgcaccaatgctgagctggtgaagggccggcagtacctgatcatgggcaaggaggccctgcagatcaagtacaacttctccttccgctacatctaccccctggacagcctgacctggattgagtactggccccgggacaccacctgcagcagctgccaggccttcctggccaacctggatgaatttgctgaggacatcttcctgaatggctgctag

SEQ ID NO: 15033 - DNA, 4320 bp, Artificial Sequence
  Description of Artificial Sequence: Synthetic coding sequence
atggccagcagcgagacagagatccgctgggccgagcccggcctgggcaagggcccccagaggcggcgctgggcctgggccgaggacaagagagatgtggacaggagcagcagccagagctgggaggaggagcggctcttccccaatgccaccagccctgagctgctggaggacttccggctggcccagcagcacctgccccccctggagtgggacccccacccccagccagatggccaccaggacagcgagagcggggagaccagcggggaggaggccgaggccgaggatgtggacagccctgccagcagccatgagcccctggcctggctgccccagcagggccggcagctggacatgacagaggaggagccagatggcaccctgggcagcctggaggtggaggaggccggggagagcagcagccggctgggctatgaggccggcctgagcctggagggccacggcaacaccagccccatggccctgggccacggccaggcccggggctgggtggccagcggggagcaggccagcggggacaagctgtctgagcacagcgaggtgaaccccagcgtggagctgagccctgcccgctcctggagcagcggcaccgtgtccctggaccaccccagcgacagcctggacagcacctgggagggggagacagatggcccccagcccacagccctggccgagaccctgcctgagggccccagccaccacctgctgagcccagatggccgcactggaggctctgtggcccgggccacccccatggagttccaggacagcagcgcccccccagcccagagcccccagcacgccacagaccgctggaggcgggagaccacccgcttcttctgcccccagcccaaggagcacatctggaagcagaccaagaccagccccaagcccctgcccagccgcttcatcggcagcatcagccccctgaacccccagccccggcccacccggcagggccggcccctgccccggcagggcgccaccctggccggccgcagcagcagcaatgcccccaagtatggccggggccagctgaactaccccctgcctgacttcagcaaggtgggcccccgggtgcgcttccccaaggatgagagctaccggccccccaagagccgcagccacaacaggaagccccaggccccagcccggcccctcatcttcaagagccctgctgagatcgtgcaggaggtgctgctgagcagtggagaggccgccctggccaaggacaccccaccagcccaccccatcaccagggtgccccaggagttccagaccccagagcaggccacagagctggtgcaccagctgcaggaggactaccaccggctgctgaccaagtatgcagaggccgagaacaccatcgaccagctgcggctgggcgccaaggtgaacctcttcagtgaccccccccagcccaaccacagcatccacacaggcatggtgccccagggcaccaaggtgctgtccttcaccatcccccagcccaggtctgctgagtggtggccaggccctgctgaggacccccaggccagcgctgccagcggctggcccagcgcccggggggacctgagccccagcagcctgacctccatgcccaccctgggctggctgcctgaaaatagagacatcagcgaggaccagagcagcgctgagcagacccaggccctggccagccaggccagccagttcctggccaaggtggagagctttgagcggctcatccaggccggccgcctgatgccccaggaccaggtgaagggcttccagaggctgaaggccgcccacgccgccctggaggaggagtacctgaaggcctgccgggagcagcacccagcccagcccctggccggcagcaagggcaccccaggccgctttgacccccggcgggagctggaggccgagatctaccgcctgggcagctgcctggaggagctgaaggagcacatcgaccagacccagcaggagcctgagcccccaggcagtgacagcgccctggacagcaccccagccctgccctgcctgcaccagcccacccacctgcctgcccccagcggccaggcccccatgcctgccatcaagaccagctgcccagagcccgccaccaccacagctgctgccagcacaggcccctgccccctgcacgtgaatgtggaggtgagcagcggcaacagcgaggtggaggaccggccccaggaccccctggcccggctgcggcacaaggagctgcagatggagcaggtgtaccacggcctgatggagcgctacctgtctgtgaagagcctgcctgaggccatgaggatggaggaggaggaggagggggaggaggaggaggaggaggagggcggcggggacagcctggaggtggatggagtggccgccaccccaggcaaggccgaggccaccagggtgctgccccggcagtgccctgtgcaggccgagaagagccacggggcccccctggaggaggccacagagaagatggtgtccatgaagcccccaggcttccaggccagcctggccagagatggccacatgagcggcctgggcaaggccgaggccgcccctcctggccctggggtgcccccccaccccccaggcaccaagtctgctgccagccaccagagctccatgaccagcctggagggcagcggcatcagcgagcggctgccccagaagcccctgcacagaggaggcggcccccacctggaggagacctggatggccagccctgagacagacagcggctttgtgggcagcgagaccagccgggtgagccccctgacccagaccccagagcaccggctgagccacatcagcacagctggcaccctggcccagccctttgctgcctctgtgcccagagatggagccagctaccccaaggcccggggcagcctcatcccccggcgggccacagagcccagcacccccaggagccaggcccagcgctacctgagcagccccagcggccccctgcggcagagggcccccaacttcagcctggagaggaccctggccgctgagatggctgtgcccggcagcgagtttgagggccacaagaggatcagcgagcagcccctgcccaacaagaccatcagccccccaccagccccagccccagctgctgcccccctgccctgtggccccacagagaccatccccagcttcctgctgaccagggctggccgggaccaggccatctgtgagctgcaggaggaggtgtcccggctgcggctgcggctggaggacagcctgcaccagcccctgcagggcagccccaccaggcctgccagcgcctttgacaggcctgcccggacccggggccggcctgctgacagccctgccacctggggcagccactacggcagcaagagcacagagcggctgcccggggagcccagaggagaggagcagatcgtgcccccaggccggcagagggcccggagcagctctgtgccccgggaggtgctgcggctgagcctgagcagcgagagcgagctgcccagcctgcccctcttcagcgagaagagcaagaccaccaaggacagcccccaggccgccagagatggcaagaggggcgtgggcagcgctggctggccagacagagtgaccttccggggccagtacacaggccacgagtaccacgtgctgagccccaaggctgtgcccaagggaaatggcaccgtgtcctgcccccactgccggcccatccgcacccaggatgctgggggcgctgtgactggagaccccctgggccccccacctgctgacaccctgcagtgccccctgtgtggccaggtgggcagccccccagaggctgatggccctggcagcgccaccagcggggctgagaaggccaccaccaggaggaaggccagcagcacccccagccccaagcagaggagcaagcaggccggcagcagccccaggcctcctcctggcctgtggtacctggccacagcccccccagccccagcccccccagcctttgcctacatcagctctgtgcccatcatgccctaccccccagctgctgtgtactatgccccagctggccccaccagcgcccagcctgctgccaagtggcccccaacagccagccccccaccagcccggcggcaccgccacagcatccagctggacctgggggacctggaggagctgaacaaggccctgagcagagctgtgcaggccgctgagagcgtgcgcagcaccacccggcagatgaggagcagcctgtctgctgacctgcggcaggcccacagcctgcggggcagctgcctcttctag

SEQ ID NO: 15034 - DNA, 2496 bp, Artificial Sequence
  Description of Artificial Sequence: Synthetic coding sequence
atggccagcagcgagacagagatccgctgggccgagcccggcctgggcaagggcccccagaggcggcgctgggcctgggccgaggacaagagagatgtggacaggagcagcagccagagctgggaggaggagcggctcttccccaatgccaccagccctgagctgctggaggacttccggctggcccagcagcacctgccccccctggagtgggacccccacccccagccagatggccaccaggacagcgagagcggggagaccagcggggaggaggccgaggccgaggatgtggacagccctgccagcagccatgagcccctggcctggctgccccagcagggccggcagctggacatgacagaggaggagccagatggcaccctgggcagcctggaggtggaggaggccggggagagcagcagccggctgggctatgaggccggcctgagcctggagggccacggcaacaccagccccatggccctgggccacggccaggcccggggctgggtggccagcggggagcaggccagcggggacaagctgtctgagcacagcgaggtgaaccccagcgtggagctgagccctgcccgctcctggagcagcggcaccgtgtccctggaccaccccagcgacagcctggacagcacctgggagggggagacagatggcccccagcccacagccctggccgagaccctgcctgagggccccagccaccacctgctgagcccagatggccgcactggaggctctgtggcccgggccacccccatggagttccaggacagcagcgcccccccagcccagagcccccagcacgccacagaccgctggaggcgggagaccacccgcttcttctgcccccagcccaaggagcacatctggaagcagaccaagaccagccccaagcccctgcccagccgcttcatcggcagcatcagccccctgaacccccagccccggcccacccggcagggccggcccctgccccggcagggcgccaccctggccggccgcagcagcagcaatgcccccaagtatggccggggccagctgaactaccccctgcctgacttcagcaaggtgggcccccgggtgcgcttccccaaggatgagagctaccggccccccaagagccgcagccacaacaggaagccccaggccccagcccggcccctcatcttcaagagccctgctgagatcgtgcaggaggtgctgctgagcagtggagaggccgccctggccaaggacaccccaccagcccaccccatcaccagggtgccccaggagttccagaccccagagcaggccacagagctggtgcaccagctgcaggaggactaccaccggctgctgaccaagtatgcagaggccgagaacaccatcgaccagctgcggctgggcgccaaggtgaacctcttcagtgaccccccccagcccaaccacagcatccacacaggcatggtgccccagggcaccaaggtgctgtccttcaccatcccccagcccaggtctgctgagtggtggccaggccctgctgaggacccccaggccagcgctgccagcggctggcccagcgcccggggggacctgagccccagcagcctgacctccatgcccaccctgggctggctgcctgaaaatagagacatcagcgaggaccagagcagcgctgagcagacccaggccctggccagccaggccagccagttcctggccaaggtggagagctttgagcggctcatccaggccggccgcctgatgccccaggaccaggtgaagggcttccagaggctgaaggccgcccacgccgccctggaggaggagtacctgaaggcctgccgggagcagcacccagcccagcccctggccggcagcaagggcaccccaggccgctttgacccccggcgggagctggaggccgagatctaccgcctgggcagctgcctggaggagctgaaggagcacatcgaccagacccagcaggagcctgagcccccaggcagtgacagcgccctggacagcaccccagccctgccctgcctgcaccagcccacccacctgcctgcccccagcggccaggcccccatgcctgccatcaagaccagctgcccagagcccgccaccaccacagctgctgccagcacaggcccctgccccctgcacgtgaatgtggaggtgagcagcggcaacagcgaggtggaggaccggccccaggaccccctggcccggctgcggcacaaggagctgcagatggagcaggtgtaccacggcctgatggagcgctacctgtctgtgaagagcctgcctgaggccatgaggatggaggaggaggaggagggggaggaggaggaggaggaggagggcggcggggacagcctggaggtggatggagtggccgccaccccaggcaaggccgaggccaccagggtgctgccccggcagtgccctgtgcaggccgagaagagccacggggcccccctggagtag

SEQ ID NO: 15035 - DNA, 1218 bp, Artificial Sequence
  Description of Artificial Sequence: Synthetic coding sequence
ctcaacctgtgcctgagcatcttcctgaccccagcctgctaccaccactgccggcggcagcactggcccctgcccatcgccaggaaatgtggggctgtgcccggcagcgagtttgagggccacaagaggatcagcgagcagcccctgcccaacaagaccatcagccccccaccagccccagccccagctgctgcccccctgccctgtggccccacagagaccatccccagcttcctgctgaccagggctggccgggaccaggccatctgtgagctgcaggaggaggtgtcccggctgcggctgcggctggaggacagcctgcaccagcccctgcagggcagccccaccaggcctgccagcgcctttgacaggcctgcccggacccggggccggcctgctgacagccctgccacctggggcagccactacggcagcaagagcacagagcggctgcccggggagcccagaggagaggagcagatcgtgcccccaggccggcagagggcccggagcagctctgtgccccgggaggtgctgcggctgagcctgagcagcgagagcgagctgcccagcctgcccctcttcagcgagaagagcaagaccaccaaggacagcccccaggccgccagagatggcaagaggggcgtgggcagcgctggctggccagacagagtgaccttccggggccagtacacaggccacgagtaccacgtgctgctgcggcgcagccagaaggccatggcccagagccctgtgcccacagctggccccctgggccccaggatgagggtggtgctgagccagggcacccactgggaccggctgcccctcatccccttctctgtgccctgtgtggtgaagctgggcctgccccagaggcagatggtgcaggcccagccccccctgggccagaggcggcccccaagaggagagaagcacctgcagctgcctgcccccagcagaggagccagcagaagaggaagaagacatgcccaccccccagactgtggcatctggcagcagaggccccagcaccagcccctgcagcccctgcccaccagcccccgcttccccagctgcctgatccacctgcccctgtgcaccatgaggctgcaggacctgccccagcccaaccagctgcccagcggccggccccagcccctgccccaccagcccggggacaccggcacccccagcagcagcacctgggccacctag

SEQ ID NO: 15036 - DNA, 4077 bp, Artificial Sequence
  Description of Artificial Sequence: Synthetic coding sequence
atgctgcggtctgagtggcctgtgtttcctgaggccgaggctgaagatgtggacagccctgccagcagccatgagcccctggcctggctgccccagcagggccggcagctggacatgacagaggaggagccagatggcaccctgggcagcctggaggtggaggaggccggggagagcagcagccggctgggctatgaagctggcctgagcctggagggccacggcaacaccagccccatggccctgggccacggccaggcccggggctgggtggccagcggggagcaggccagcggggacaagctgtctgagcacagcgaggtgaaccccagcgtggagctgagccctgcccgctcctggagcagcggcaccgtgtccctggaccaccccagcgacagcctggacagcacctgggagggggagacagatggcccccagcccacagccctggccgagaccctgcctgagggccccagccaccacctgctgagcccagatggccgcactggaggctctgtggcccgggccacccccatggagttccaggacagcagcgcccccccagcccagagcccccagcacgccacagaccgctggaggcgggagaccacccgcttcttctgcccccagcccaaggagcacatctggaagcagaccaagaccagccccaagcccctgcccagccgcttcatcggcagcatcagccccctgaacccccagccccggcccacccggcagggccggcccctgccccggcagggcgccaccctggccggccgcagcagcagcaatgcccccaagtatggccggggccagctgaactaccccctgcctgacttcagcaaggtgggcccccgggtgcgcttccccaaggatgagagctacagaccacccaagagccgcagccacaacaggaagccccaggccccagcccggcccctcatcttcaagagccctgctgagatcgtgcaggaggtgctgctgagcagcggggaggccgccctggccaaggacaccccaccagcccaccccatcaccagggtgccccaggagttccagaccccagagcaggccacagagctggtgcaccagctgcaggaggactaccaccggctgctgaccaagtatgcagaggccgagaacaccatcgaccagctgcggctgggcgccaaggtgaacctcttcagtgaccccccccagcccaaccacagcatccacacaggcatggtgccccagggcaccaaggtgctgtccttcaccatcccccagcccaggtctgctgagtggtggccaggccctgctgaggacccccaggccagcgctgccagcggctggcccagcgcccggggggacctgagccccagcagcctgacctccatgcccaccctgggctggctgcctgagaacagagacatcagcgaggaccagagcagcgctgagcagacccaggccctggccagccaggccagccagttcctggccaaggtggagagctttgagcggctcatccaggccggccgcctgatgccccaggaccaggtgaagggcttccagaggctgaaggccgcccatgctgccctggaggaggagtacctgaaggcctgccgggagcagcacccagcccagcccctggccggcagcaagggcaccccaggccgctttgacccccggcgggagctggaggccgagatctaccgcctgggcagctgcctggaggagctgaaggagcacatcgaccagacccagcaggagcctgagcccccaggcagtgacagcgccctggacagcaccccagccctgccctgcctgcaccagcccacccacctgcctgcccccagcggccaggcccccatgcctgccatcaagaccagctgcccagagcccgccaccaccacagctgctgccagcacaggcccctgccccctgcacgtgaatgtggaggtgagcagcggcaacagcgaggtggaggaccggccccaggaccccctggcccggctgcggcacaaggagctgcagatggagcaggtgtaccacggcctgatggagcgctacctgtctgtgaagagcctgcctgaggccatgaggatggaggaggaggaggagggggaggaggaggaggaggaggagggcggcggggacagcctggaggtggatggagtggccgccacccctgggaaggccgaggccaccagggtgctgccccggcagtgccctgtgcaggccgagaagagccatggagcccccctggaggaggccacagagaagatggtgtccatgaagcccccaggcttccaggccagcctggccagagatggccacatgagcggcctgggcaaggccgaggccgcccctcctggccctggggtgcccccccaccccccaggcaccaagtctgctgccagccaccagagctccatgaccagcctggagggcagcggcatcagcgagcggctgccccagaagcccctgcaccggggcggcggcccccacctggaggagacctggatggccagccctgagacagattctggctttgtgggcagcgagaccagccgggtgagccccctgacccagaccccagagcaccggctgagccacatcagcacagctggcaccctggcccagccctttgctgcctctgtgcccagagatggagccagctaccccaaggcccggggcagcctcatcccccggcgggccacagagcccagcacccccaggagccaggcccagcgctacctgagcagccccagcggccccctgcggcagagggcccccaacttcagcctggagaggaccctggccgctgagatggctgtgcccggcagcgagtttgagggccacaagaggatcagcgagcagcccctgcccaacaagaccatcagccccccaccagccccagccccagctgctgcccccctgccctgtggccccacagagaccatccccagcttcctgctgacccgggccggccgggaccaggccatctgtgagctgcaggaggaggtgtcccggctgcggctgcggctggaggacagcctgcaccagcccctgcagggcagccccaccaggcctgccagcgcctttgacaggcctgcccggacccggggccggcctgctgacagccctgccacctggggcagccactacggcagcaagagcacagagcggctgcctggagagcccagaggagaggagcagatcgtgcccccaggccggcagagggcccggagcagctctgtgccccgggaggtgctgcggctgagcctgagcagcgagagcgagctgcccagcctgcccctcttcagcgagaagagcaagaccaccaaggacagcccccaggccgccagagatggcaagaggggcgtgggcagcgctggctggccagacagagtgaccttccggggccagtacacaggccacgagtaccacgtgctgagccccaaggctgtgcccaagggaaatggaacagtgtcctgcccccactgccggcccatccgcacccaggatgctggaggagctgtgactggagaccccctgggccccccacctgctgacaccctgcagtgccccctgtgtggccaggtgggcagccccccagaggctgatggccctggcagcgccaccagcggggctgagaaggccaccaccaggaggaaggccagcagcacccccagccccaagcagaggagcaagcaggccggcagcagcccccggcccccacctggcctgtggtacctggccacagcccccccagccccagcccccccagcctttgcctacatcagctctgtgcccatcatgccctacccacctgctgctgtgtactatgccccagctggccccaccagcgcccagcctgctgccaagtggccacccacagccagccccccaccagcccggcggcaccgccacagcatccagctggacctgggggacctggaggagctgaacaaggccctgagcagagctgtgcaggccgctgagagcgtgcgcagcaccacccggcagatgaggagcagcctgtctgctgacctgcggcaggcccacagcctgcggggcagctgcctcttctag

SEQ ID NO: 15037 - DNA, 1155 bp, Artificial Sequence
  Description of Artificial Sequence: Synthetic coding sequence
atgtctgctgggggcggcacccggggctacagccccaggagccctggggccaccagccaggccatctgtgagctgcaggaggaggtgtcccggctgcggctgcggctggaggacagcctgcaccagcccctgcagggcagccccaccaggcctgccagcgcctttgacaggcctgcccggacccggggccggcctgctgacagccctgccacctggggcagccactacggcagcaagagcacagagcggctgcctggagagcccagaggagaggagcagatcgtgcccccaggccggcagagggcccggagcagctctgtgccccgggaggtgctgcggctgagcctgagcagcgagagcgagctgcccagcctgcccctcttcagcgagaagagcaagaccaccaaggacagcccccaggccgccagagatggcaagaggggcgtgggcagcgctggctggccagacagagtgaccttccggggccagtacacaggccacgagtaccacgtgctgagccccaaggctgtgcccaagggaaatggaacagtgtcctgcccccactgccggcccatccgcacccaggatgctggaggagctgtgactggagaccccctgggccccccacctgctgacaccctgcagtgccccctgtgtggccaggtgggcagccccccagaggctgatggccctggcagcgccaccagcggggctgagaaggccaccaccaggaggaaggccagcagcacccccagccccaagcagaggagcaagcaggccggcagcagcccccggcccccacctggcctgtggtacctggccacagcccccccagccccagcccccccagcctttgcctacatcagctctgtgcccatcatgccctacccacctgctgctgtgtactatgccccagctggccccaccagcgcccagcctgctgccaagtggccacccacagccagccccccaccagcccggcggcaccgccacagcatccagctggacctgggggacctggaggagctgaacaaggccctgagcagagctgtgcaggccgctgagagcgtgcgcagcaccacccggcagatgaggagcagcctgtctgctgacctgcggcaggcccacagcctgcggggcagctgcctcttctag

SEQ ID NO: 15038 - DNA, 4320 bp, Artificial Sequence; identical to SEQ ID NO: 15033
  Description of Artificial Sequence: Synthetic coding sequence

SEQ ID NO: 15039 - DNA, 1719 bp, Artificial Sequence
  Description of Artificial Sequence: Synthetic coding sequence
atggccagcagcgagacagagatccgctgggccgagcccggcctgggcaagggcccccagaggcggcgctgggcctgggccgaggacaagagagatgtggacaggagcagcagccagagctgggaggaggagcggctcttccccaatgccaccagccctgagctgctggaggacttccggctggcccagcagcacctgccccccctggagtgggacccccacccccagccagatggccaccaggacagcgagagcggggagaccagcggggaggaggccgaggccgaggatgtggacagccctgccagcagccatgagcccctggcctggctgccccagcagggccggcagctggacatgacagaggaggagccagatggcaccctgggcagcctggaggtggaggaggccggggagagcagcagccggctgggctatgaggccggcctgagcctggagggccacggcaacaccagccccatggccctgggccacggccaggcccggggctgggtggccagcggggagcaggccagcggggacaagctgtctgagcacagcgaggtgaaccccagcgtggagctgagccctgcccgctcctggagcagcggcaccgtgtccctggaccaccccagcgacagcctggacagcacctgggagggggagacagatggcccccagcccacagccctggccgagaccctgcctgagggccccagccaccacctgctgagcccagatggccgcactggaggctctgtggcccgggccacccccatggagttccaggacagcagcgcccccccagcccagagcccccagcacgccacagaccgctggaggcgggagaccacccgcttcttctgcccccagcccaaggagcacatctggaagcagaccaagaccagccccaagcccctgcccagccgcttcatcggcagcatcagccccctgaacccccagccccggcccacccggcagggccggcccctgccccggcagggcgccaccctggccggccgcagcagcagcaatgcccccaagtatggccggggccagctgaactaccccctgcctgacttcagcaaggtgggcccccgggtgcgcttccccaaggatgagagctaccggccccccaagagccgcagccacaacaggaagccccaggccccagcccggcccctcatcttcaagagccctgctgagatcgtgcaggaggtgctgctgagcagtggagaggccgccctggccaaggacaccccaccagcccaccccatcaccagggtgccccaggagttccagaccccagagcaggccacagagctggtgcaccagctgcaggtgtctggcacccacggctgcggctgtgtgaccaaggcccctgtgggcctgggctggaggctgattggagtgggccggcctggggtggaggccggctggggcggggaggcctgggaccgggcctggctgggctgggaggccctgggccgccgcctggtgggctggggcggcctgggctggaggctggcccgggtgggcagccctggcatggaggccagcggcgtgggccggcctggggtgggcagccctggggtggagcccggcggcgtgggccggcctggggtggaggccggctggggcaggaagccctgggaccggggctggtggggcggggaggcctggggcggcggctggctgggccaggaggccctgggctag

SEQ ID NO: 15040 - DNA, 2016 bp, Artificial Sequence
  Description of Artificial Sequence: Synthetic coding sequence
cctggcttcggcaccaagaacagccaggccggccccctgaagctgggccggcaggacggcggcggggcccgggagagagctgcccagggagatgtggacaggagcagcagccagagctgggaggaggagcggctcttccccaatgccaccagccctgagctgctggaggacttccggggccctgctgccccagctgcccctggggtgggccccaccccagctgcccgctgggccagcggcttccgggtgcggcgggactttggaagaagaactggaggctctgtggcccgggccacccccatggagttccaggacagcagcgcccccccagcccagagcccccagcacgccacagaccgctggaggcgggagaccacccgcttcttctgcccccagcccaaggagcacatctggaagcagaccaagaccagccccaagcccctgcccagccgcttcatcggcagcatcagccccctgaacccccagccccggcccacccggcagggccggcccctgccccggcagggcgccaccctggccggccgcagcagcagcaatgcccccaagtatggccggggccagctgaactaccccctgcctgacttcagcaaggtgggcccccgggtgcgcttccccaaggatgagagctacagaccacccaagagccgcagccacaacaggaagccccaggccccagcccggcccctcatcttcaagagccctgctgagatcgtgcaggaggtgctgctgagcagcggggaggccgccctggccaaggacaccccaccagcccaccccatcaccagggtgccccaggagttccagaccccagagcaggccacagagctggtgcaccagctgcaggaggactaccaccggctgctgaccaagtatgcagaggccgagaacaccatcgaccagctgcggctgggcgccaaggtgaacctcttcagtgaccccccccagcccaaccacagcatccacacaggcatggtgccccagggcaccaaggtgctgtccttcaccatcccccagcccaggtctgctgagtggtggccaggccctgctgaggacccccaggccagcgctgccagcggctggcccagcgcccggggggacctgagccccagcagcctgacctccatgcccaccctgggctggctgcctgagaacagagacatcagcgaggaccagagcagcgctgagcagacccaggccctggccagccaggccagccagttcctggccaaggtggagagctttgagcggctcatccaggccggccgcctgatgccccaggaccaggtgaagggcttccagaggctgaaggccgcccatgctgccctggaggaggagtacctgaaggcctgccgggagcagcacccagcccagcccctggccggcagcaagggcaccccaggccgctttgacccccggcgggagctggaggccgagatctaccgcctgggcagctgcctggaggagctgaaggagcacatcgaccagacccagcaggagcctgagcccccaggcagtgacagcgccctggacagcaccccagccctgccctgcctgcaccagcccacccacctgcctgcccccagcggccaggcccccatgcctgccatcaagaccagctgcccagagcccgccaccaccacagctgctgccagcacaggcccctgccccctgcacgtgaatgtggaggtgagcagcggcaacagcgaggtggaggaccggccccaggaccccctggcccggctgcggcacaaggagctgcagatggagcaggtgtaccacggcctgatggagcgctacctgtctgtgaagagcctgcctgaggccatgaggatggaggaggaggaggagggggaggaggaggaggaggaggagggcggcggggacagcctggaggtggatggagtggccgccacccctgggaaggccgaggccaccagggtgctgccccggcagtgccctgtgcaggccgagaagagccatggagcccccctgtag

SEQ ID NO: 15041 - DNA, 2472 bp, Artificial Sequence
  Description of Artificial Sequence: Synthetic coding sequence
atggccgccagcgaggccgctgctgctgctggcagcgctgccctggccgccggggcccgggctgtgcctgctgccaccactggagctgctgctgctgccagcggcccctgggtgcccccaggcccccggctgcggggcagccggcccaggcctgctggggccacccagcagcctgctgtgcctgcccctcctgctggggagctgatccagcccagcgtgtctgagctgagcagagctgtgaggaccaacatcctgtgcaccgtgcggggctgcggcaagatcctgcccaacagccctgccctgaacatgcacctggtgaagagccaccggctgcaggacggcatcgtgaaccccaccatcaggaaggacctgaagacaggccccaagttctactgctgccccatcgagggctgcccccggggccctgagcggcccttcagccagttcagcctggtgaagcagcacttcatgaagatgcatgctgagaagaagcacaagtgcagcaagtgcagcaacagctatggaacagagtgggacctgaagagacatgctgaggactgtgggaagaccttccgctgcacctgtggctgcccctatgccagcaggacagccctgcagagccacatctacagaacaggccacgagatcccagctgagcaccgggacccccccagcaagaagaggaagatggagaactgtgcccagaaccagaagctgagcaacaagaccatcgagagcctgaacaaccagcccatccccaggccagacacccaggagctggaggccagcgagatcaagctggagcccagctttgaggacagctgtggcagcaacacagacaagcagaccctgaccaccccaccccgctacccccagaagctgctgctgcccaagcccaaggtggccctggtgaagctgcctgtgatgcagttctctgtgatgcctgtgtttgtgcccacagctgacagcagcgcccagcctgtggtgctgggcgtggaccagggcagcgccaccggggctgtgcacctgatgcccctgtctgtgggcaccctcatcctgggcctggacagcgaggcctgcagcctgaaggagagcctgcccctcttcaagatcgccaaccccatcgccggggagcccatcagcactggagtgcaggtgaactttgggaagagccccagcaaccccctgcaggagctgggcaacacctgccagaagaacagcatcagcagcatcaacgtgcagacagacctgtcctatgccagccagaacttcatccccagcgcccagtgggccacagctgacagctctgtgagcagctgcagccagacagacctgagctttgacagccaggtgtccctgcccatctctgtgcacacccagaccttcctgcccagcagcaaggtgaccagcagcattgctgcccagacagatgccttcatggacacctgcttccagagcggcggcgtgtcccgggagacccagaccagcggcatcgagagccccacagatgaccacgtgcagatggaccaggccggcatgtgtggggacatctttgagagcgtgcacagcagctacaacgtggccactggaaacatcatcagcaacagcctggtggccgagaccgtgacccacagcctgctgccccagaatgagcccaagaccctgaaccaggacatcgagaagagcgcccccatcatcaacttcagcgcccagaacagcatgctgcccagccagaacatgacagacaaccagacccagaccatcgacctgctgagtgacctggagaacatcctgagcagcaacctgcctgcccagaccctggaccacaggagcctgctgagtgacaccaaccctggccctgacacccagctgcccagcggccctgcccagaaccctggcatcgactttgacatcgaggagttcttcagcgccagcaacatccagacccagacagaggagagcgagctgagcaccatgaccacagagcctgtgctggagagcctggacatcgagacccagacagacttcctgctggccgacaccagcgcccagagctatggctgccggggcaacagcaacttcctgggcctggagatgtttgacacccagacccagacagacctgaacttcttcctggacagcagcccccacctgcccctgggcagcatcctgaagcacagcagcttctctgtgtccacagacagcagtgacacagagacccagacagagggcgtgtccacagccaagaacatcccagccctggagagcaaggtgcagctgaacagcacagagacccagaccatgagcagcggctttgagaccctgggcagcctcttcttcaccagcaatgagacccagacagccatggatgacttcctgctggccgacctggcctggaacaccatggagagccagttcagctctgtggagacccagaccagcgctgagccccacacagtgagcaacttctag

SEQ ID NO: 15042 - DNA, 1785 bp, Artificial Sequence
  Description of Artificial Sequence: Synthetic coding sequence
atggagaactgtgcccagaaccagaagctgagcaacaagaccatcgagagcctgaacaaccagcccatccccaggccagacacccaggagctggaggccagcgagatcaagctggagcccagctttgaggacagctgtggcagcaacacagacaagcagaccctgaccaccccaccccgctacccccagaagctgctgctgcccaagcccaaggtggccctggtgaagctgcctgtgatgcagttctctgtgatgcctgtgtttgtgcccacagctgacagcagcgcccagcctgtggtgctgggcgtggaccagggcagcgccactggagctgtgcacctgatgcccctgtctgtgggcaccctcatcctgggcctggacagcgaggcctgcagcctgaaggagagcctgcccctcttcaagatcgccaaccccatcgccggggagcccatcagcactggagtgcaggtgaactttgggaagagccccagcaaccccctgcaggagctgggcaacacctgccagaagaacagcatcagcagcatcaacgtgcagacagacctgtcctatgccagccagaacttcatccccagcgcccagtgggccacagctgacagctctgtgagcagctgcagccagacagacctgagctttgacagccaggtgtccctgcccatctctgtgcacacccagaccttcctgcccagcagcaaggtgaccagcagcattgctgcccagacagatgccttcatggacacctgcttccagagcggaggagtgtcccgggagacccagaccagcggcatcgagagccccacagatgaccacgtgcagatggaccaggccggcatgtgtggggacatctttgaatctgtgcacagcagctacaacgtggccaccggcaacatcatcagcaacagcctggtggccgagaccgtgacccacagcctgctgccccagaatgagcccaagaccctgaaccaggacatcgagaagagcgcccccatcatcaacttcagcgcccagaacagcatgctgcccagccagaacatgacagacaaccagacccagaccatcgacctgctgagtgacctggagaacatcctgagcagcaacctgcctgcccagaccctggaccacaggagcctgctgagtgacaccaaccctggccctgacacccagctgcccagcggccctgcccagaaccctggcatcgactttgatattgaggagttcttcagcgccagcaacatccagacccagacagaggagagcgagctgagcaccatgaccacagagcctgtgctggagagcctggacatcgagacccagacagacttcctgctggccgacaccagcgcccagagctatggctgccggggcaacagcaacttcctgggcctggagatgtttgacacccagacccagacagacctgaacttcttcctggacagcagcccccacctgcccctgggcagcatcctgaagcacagcagcttctctgtgtccacagacagcagtgacacagagacccagacagaaggagtgtccacagccaagaacatcccagccctggagagcaaggtgcagctgaacagcacagagacccagaccatgagcagcggctttgagaccctgggcagcctcttcttcaccagcaatgagacccagacagccatggatgacttcctgctggccgacctggcctggaacaccatggagagccagttcagctctgtggagacccagaccagcgctgagccccacacagtgagcaacttctag

SEQ ID NO: 15043 - DNA, 966 bp, Artificial Sequence
  Description of Artificial Sequence: Synthetic coding sequence
atgaagcacatccctgtgctggaggatggcccctggaagacagtgtgtgtgaaggagctgaatggcctgaagaagctgaagaggaagggcaaggagcccgcccggcgggccaacggctacaagaccttccggctggacctggaggcccctgagcccagggctgtggccaccaacggcctgcgggacaggacccaccggctgcagcctgtgcctgtgcctgtgcctgtgcctgtgcctgtggccccagctgtgcccccccggggcggcacagacacagctggggagcggggcggcagccgggcccctgaggtgtctgatgccaggaagcgctgctttgccctgggcgctgtgggccctggcctgcccaccccacctcctcctcctcctccagccccccagagccaggcccctgggggccctgaggcccagcccttccgggagcccggcctgcggccccgcatcctgctgtgtgcccccccagcccggcctgcccccagcgcccccccagcccccccagcccctcctgagagcacagtgcggcctgccccacccaccaggcctggagagagcagctacagcagcatcagccacgtgatctacaacaaccaccaggacagcagcgccagccccaggaagaggcctggagaggccacagctgccagcagcgagatcaaggccctgcagcagacccggcggctgctggccaatgcccgggagaggaccagggtgcacaccatctctgctgcctttgaggccctgaggaagcaggtgccctgctacagctatggccagaagctgagcaagctggccatcctgcgcatcgcctgcaactacatcctgagcctggcccggctggccgacctggactacagcgctgaccacagcaacctgtccttctctgaatgtgtgcagcgctgcaccaggaccctgcaggccgagggccgggccaagaagaggaaggagtag

SEQ ID NO: 15044 - DNA, 1164 bp, Artificial Sequence
  Description of Artificial Sequence: Synthetic coding sequence
atgaccatggagggcgccagcggcagcagctttggaattgacaccatcctgagcagcgccagcagcggcagccctggcatgatgaatggagacttccggcccctgggggaggccaggacagctgacttccgcagccaggccacccccagcccctgcagcgagattgacacagtgggcacagcccccagcagccccatctctgtgaccatggagcccccagagccccacctggtggctgatgccacccagcaccaccaccacctgcaccacagccagcagcccccacctcctgctgctgcccccacccagagcctgcagcccctgccccagcagcagcagcccctgcccccccagcagcccccacctcctccaccccagcagctgggcagcgctgccagcgcccccaggaccagcaccagcagcttcctgatcaaggacatcctgggggacagcaagcccctggccgcctgtgccccctacagcacctctgtgagcagcccccaccacacccccaagcaggagagcaatgctgtgcatgagagcttccggcccaagctggagcaggaggacagcaagaccaagctggacaagcgggaggacagccagagcgacatcaagtgccacggcaccaaggaggagggggaccgggagatcaccagcagccgggagagcccccctgtgcgggccaagaagcccaggaaggccaggacagccttcagtgaccaccagctgaaccagctggagaggagctttgagcggcagaagtacctgtctgtgcaggacaggatggacctggccgccgccctgaacctgacagacacccaggtgaagacctggtaccagaacagaaggaccaagtggaagaggcagacagctgtgggcctggagctgctggccgaggccggcaactacagcgccctgcagaggatgttccccagcccctacttctaccaccccagcctgctgggctccatggacagcaccacagctgctgctgctgctgctgccatgtacagctccatgtaccgcaccccaccagccccccacccccagctgcagaggcccctggtgccccgggtgctgattcatggcctgggccctgggggccagcctgccctgaaccccctgagcagccccatccctggcaccccccaccccaggtag

SEQ ID NO: 15045 - DNA, 321 bp, Artificial Sequence
  Description of Artificial Sequence: Synthetic coding sequence
atgatgaccctggtgccccgggcccggacccgggccggccaggaccactacagccacccctgcccccgcttcagccaggtgctgctgacagagggcatcatgacctactgcctgaccaagaacctgagtgatgtgaacatcctgcaccggctgctgaagaatggaaatgtgaggaacaccctgctgcagagcaaggtgggcctgctgacctactacgtgaagctgtacccaggagaggtgaccctgctgacccggcccagcatccagatgaggctgtgctgcatcaccggctctgtgtcccggcccaggagccagaagtag

SEQ ID NO: 15046 - DNA, 321 bp, Artificial Sequence; identical to SEQ ID NO: 15045
  Description of Artificial Sequence: Synthetic coding sequence

SEQ ID NO: 15047 - DNA, 570 bp, Artificial Sequence
  Description of Artificial Sequence: Synthetic coding sequence
atgaagaccaagaacagacctccaagaagaagagcccctgtgcaggacacagaggccaccccaggagagggcaccccagatggcagcctgcccaaccctggccctgagcccgccaagggcctgcggagcaggcctgcccgggctgctgcccgggcccctggagagggcagaagaagaagacctggccccagcggccctgggggcagaagagacagcagcatccagaggcggctggagagcaatgaaagagagcggcagaggatgcacaagctgaacaatgccttccaggccctgcgggaggtgatcccccacgtgcgggctgacaagaagctgagcaagattgagaccctgaccctggccaagaactacatcaagagcctgacagccaccatcctgaccatgagcagcagccggctgcccggcctggagggccctggccccaagctgtaccagcactaccagcagcagcagcaggtggccggcggggccctgggcgccacagaggcccagccccagggccacctgcagcgctacagcacccagatccacagcttccgggagggcacctag

SEQ ID NO: 15048 - DNA, 708 bp, Artificial Sequence
  Description of Artificial Sequence: Synthetic coding sequence
atgctgcggggggcccctggcctgggcctgacagccaggaaaggagcagaagattctgctgaggacctgggcggcccctgcccagagcccggcggggacagcggcgtgctgggcgccaacggggccagctgcagcagaggagaggccgaggagcctgctggaagaagaagagcccggcctgtgcgcagcaaggcccggaggatggccgccaacgtgcgggagaggaagaggatcctggactacaatgaggccttcaatgccctgcggcgggccctgcggcatgacctgggcggcaagaggctgagcaagatcgccaccctgcggcgggccatccacagaattgctgccctgagcctggtgctgcgggccagccctgccccccggggcccctgtggccacctggagtgccacggccctgctgcccggggggacacaggagacaccggggccagccccccacctcctgctggccccagcctggcccggccagatgctgcccggcccagcgtgcccagcgccccccgctgtgccagctgccccccccacgcccccctggcccggcccagcgctgtggccgagggccctggcctggcccaggccagcggcggctcctggaggcgctgccctggggccagcagcgctggccccccaccctggccccggggctacctgcggagcgcccctggcatgggccaccccaggagctag

SEQ ID NO: 15049 - DNA, 825 bp, Artificial Sequence
  Description of Artificial Sequence: Synthetic coding sequence
atgcacctgtgtggcggcaatggcctgctgacccagacagaccccaaggagcagcagaggcagctgaagaagcagaagaacagagctgctgcccagaggagccggcagaagcacacagacaaggcagatgccctgcaccagcagcacgagagcctggagaaggacaacctggccctgaggaaggagatccagagcctgcaggccgagctggcctggtggagcaggaccctgcacgtgcatgagcggctgtgccccatggactgtgccagctgcagcgcccctggcctgctgggctgctgggaccaggccgagggcctgctgggccctggcccccagggccagcacggctgccgggagcagctggagctgttccagaccccaggcagctgctacccagcccagcccctgagccctggcccccagccccatgacagccccagcctgctgcagtgccccctgcccagcctgagcctgggccctgctgtggtggccgagccccctgtgcagctgagccccagccccctgctgtttgccagccacacaggcagcagcctgcagggcagcagcagcaagctgagcgccctgcagcccagcctgacagcccagacagccccaccccagcccctggagctggagcaccccacccggggcaagctgggcagcagcccagacaaccccagcagcgccctgggcctggcccggctgcagagccgggagcacaagccagccctgtctgctgccacctggcagggcctggtggtggaccccagcccccaccccctgctggccttccccctgctgagcagcgcccaggtgcacttctag

SEQ ID NO: 15050 - DNA, 2031 bp, Artificial Sequence
  Description of Artificial Sequence: Synthetic coding sequence
atgaagaagttcagcaggatgcccaagtctgagggcggcagcggcggcggcgctgctgggggcggggccggcggggccggggccggggccggctgcggcagcggcggcagctctgtgggcgtgcgggtgtttgctgtgggccgccaccaggtgaccctggaggagagcctggccgagggcggcttcagcaccgtcttcctggtgaggacccatggaggcatccgctgtgccctgaagaggatgtatgtgaacaacatgccagacctgaatgtgtgcaagcgggagatcaccatcatgaaggagctgagcggccacaagaacatcgtgggctacctggactgtgctgtgaacagcatcagtgacaacgtgtgggaggtgctgatcctgatggagtactgcagagctggccaggtggtgaaccagatgaacaagaagctgcagacaggcttcacagagcctgaggtgctgcagatcttctgtgacacctgtgaggccgtggcccggctgcaccagtgcaagacccccatcatccaccgggacctgaaggtggagaacatcctgctgaatgatggcggcaactacgtgctgtgtgactttggaagtgccaccaacaagttcctgaacccccagaaggatggagtgaatgtggtggaggaggagatcaagaagtacaccaccctgagctaccgggcccctgagatgatcaacctgtatggaggcaagcccatcaccaccaaggctgacatctgggccctgggctgcctgctgtacaagctgtgcttcttcaccctgccctttggagagagccaggtggccatctgtgatggcaacttcaccatcccagacaacagccgctacagcaggaacatccactgcctgatccgcttcatgctggagccagaccctgagcacaggccagacatcttccaggtgtcctactttgccttcaagtttgccaagaaggactgccctgtgagcaacatcaacaagtgctgcaagcagctgctgcggcacggggccctgctgacagagatcctgctcttcctgcagctgttcctgaacatgacagccagcgaggccgccgccaggaagagccagatcaaggcccgcatcacagacaccatcggccccacagagaccagcatcgccccccggcagaggcccaaggccaacagcgccaccacagccaccccatctgtgctgaccatccagagcagcgccacccctgtgaaggtgctggcccctggagaatttggaaaccaccggcccaagggggccctgcggcctggaaatggacctgagatcctgctgggccagggccccccccagcagcccccccagcagcaccgggtgctgcagcagctgcagcagggcgactggaggctgcagcagctgcacctgcagcaccgccacccccaccagcagcagcagcagcagcagcagcagcagcagcagcagcagcagcagcagcagcagcagcagcagcagcagcagcagcagcaccaccaccaccaccaccaccacctgctgcaggatgcctacatgcagcagtaccagcacgccacccagcagcagcagatgctgcagcagcagttcctgatgcacagcgtgtaccagccccagcccagcgccagccagtaccccaccatgatgccccagtaccagcaggccttcttccagcagcagatgctggcccagcaccagcccagccagcagcaggccagccctgagtacctgaccagcccccaggagttctccccagccctggtgtcctacaccagcagcctgcctgcccaggtgggcaccatcatggacagcagctacagcgccaacagatctgtggccgacaaggaggccatcgccaacttcaccaaccagaagaacatcagcaaccccccagacatgagcggctggaacccctttggagaggacaacttcagcaagctgacagaggaggagctgctggaccgggagtttgacctgctgcggagcagcaagggccacctgaaggcctactttgccagccagtag

SEQ ID NO: 15051 - DNA, 3486 bp, Artificial Sequence
  Description of Artificial Sequence: Synthetic coding sequence
atgaagaagttcagcaggatgcccaagtctgagggcggcagcggcggcggcgctgctgggggcggggccggcggggccggggccggggccggctgcggcagcggcggcagctctgtgggcgtgcgggtgtttgctgtgggccgccaccaggtgaccctggaggagagcctggccgagggcggcttcagcaccgtcttcctggtgaggacccatggaggcatccgctgtgccctgaagaggatgtatgtgaacaacatgccagacctgaatgtgtgcaagcgggagatcaccatcatgaaggagctgagcggccacaagaacatcgtgggctacctggactgtgctgtgaacagcatcagtgacaacgtgtgggaggtgctgatcctgatggagtactgcagagctggccaggtggtgaaccagatgaacaagaagctgcagacaggcttcacagagcctgaggtgctgcagatcttctgtgacacctgtgaggccgtggcccggctgcaccagtgcaagacccccatcatccaccgggacctgaaggtggagaacatcctgctgaatgatggcggcaactacgtgctgtgtgactttggaagtgccaccaacaagttcctgaacccccagaaggatggagtgaatgtggtggaggaggagatcaagaagtacaccaccctgagctaccgggcccctgagatgatcaacctgtatggaggcaagcccatcaccaccaaggctgacatctgggccctgggctgcctgctgtacaagctgtgcttcttcaccctgccctttggagagagccaggtggccatctgtgatggcaacttcaccatcccagacaacagccgctacagcaggaacatccactgcctgatccgcttcatgctggagccagaccctgagcacaggccagacatcttccaggtgtcctactttgccttcaagtttgccaagaaggactgccctgtgagcaacatcaacaacagcagcatccccagcgccctgcctgagcccatgacagccagcgaggccgccgccaggaagagccagatcaaggcccgcatcacagacaccatcggccccacagagaccagcatcgccccccggcagaggcccaaggccaacagcgccaccacagccaccccatctgtgctgaccatccagagcagcgccacccctgtgaaggtgctggcccctggagaatttggaaaccaccggcccaagggggccctgcggcctggaaatggacctgagatcctgctgggccagggccccccccagcagcccccccagcagcaccgggtgctgcagcagctgcagcagggcgactggaggctgcagcagctgcacctgcagcaccgccacccccaccagcagcagcagcagcagcagcagcagcagcagcagcagcagcagcagcagcagcagcagcagcagcagcagcagcagcagcaccaccaccaccaccaccaccacctgctgcaggatgcctacatgcagcagtaccagcacgccacccagcagcagcagatgctgcagcagcagttcctgatgcacagcgtgtaccagccccagcccagcgccagccagtaccccaccatgatgccccagtaccagcaggccttcttccagcagcagatgctggcccagcaccagcccagccagcagcaggccagccctgagtacctgaccagcccccaggagttctccccagccctggtgtcctacaccagcagcctgcctgcccaggtgggcaccatcatggacagcagctacagcgccaacagatctgtggccgacaaggaggccatcgccaacttcaccaaccagaagaacatcagcaaccccccagacatgagcggctggaacccctttggagaggacaacttcagcaagctgacagaggaggagctgctggaccgggagtttgacctgctgcggagcaaccggctggaggagcgggccagcagtgacaagaatgtggacagcctgagcgccccccacaaccaccccccagaggaccccttcggctctgtgcccttcatcagccacagcggcagccctgagaagaaggccgagcacagcagcatcaaccaggagaatggaacagccaaccccatcaagaatggcaagaccagccctgccagcaaggaccagaggacaggcaagaagacctctgtgcagggccaggtgcagaagggaaatgatgagagcgagagtgactttgaaagtgacccccccagccccaagagcagcgaggaggaggagcaggatgatgaggaggtgctgcagggcgagcagggcgacttcaatgatgatgacacagagcctgagaacctgggccaccggcccctgctgatggattctgaagatgaggaggaggaggagaagcacagcagtgacagcgactatgagcaggccaaggccaagtacagcgacatgagctctgtgtacagagacaggagcggcagcggccccacccaggacctgaacaccatcctgctgaccagcgcccagctgagcagtgatgtggccgtggagacccccaagcaggagtttgatgtgtttggagctgtgcccttctttgctgtgcgggcccagcagccccagcaggagaagaatgagaagaacctgccccagcaccgcttccctgctgctggcctggagcaggaggagtttgatgtgttcaccaaggcccccttcagcaagaaggtgaatgtgcaggagtgccacgctgtgggccctgaggcccacaccatccctggctaccccaagtctgtggatgtgtttggcagcacccccttccagcccttcctgaccagcaccagcaagtctgagagcaatgaagacctgtttggcctggtgccctttgatgagatcaccggcagccagcagcagaaggtgaagcagaggagcctgcagaagctgagcagccggcagaggaggaccaagcaggacatgagcaagagcaatggcaagaggcaccacggcacccccaccagcaccaagaagaccctgaagcccacctaccgcaccccagagcgggcccggcggcacaagaaggtgggccggcgggacagccagagcagcaatgagttcctgaccatcagtgacagcaaagaaaacatctctgtggccctgacagatggcaaggacagaggaaatgtgctgcagcctgaggagagcctgctggacccctttggagccaagcccttccacagcccagacctgtcctggcaccccccccaccagggcctgagtgacatccgggctgaccacaacacagtgctgcccggccggccccggcagaacagcctgcacggcagcttccacagcgcagatgtgctgaagatggatgactttggagctgtgcccttcacagagctggtggtgcagagcatcaccccccaccagagccagcagagccagcctgtggagctggacccctttggagctgcccccttccccagcaagcagtag

SEQ ID NO: 15052 - DNA, 1989 bp, Artificial Sequence
  Description of Artificial Sequence: Synthetic coding sequence
atgaagaagttcagcaggatgcccaagtctgagggcggcagcggcggcggcgctgctgggggcggggccggcggggccggggccggggccggctgcggcagcggcggcagctctgtgggcgtgcgggtgtttgctgtgggccgccaccaggtgaccctggaggagagcctggccgagggcggcttcagcaccgtcttcctggtgaggacccatggaggcatccgctgtgccctgaagaggatgtatgtgaacaacatgccagacctgaatgtgtgcaagcgggagatcaccatcatgaaggagctgagcggccacaagaacatcgtgggctacctggactgtgctgtgaacagcatcagtgacaacgtgtgggaggtgctgatcctgatggagtactgcagagctggccaggtggtgaaccagatgaacaagaagctgcagacaggcttcacagagcctgaggtgctgcagatcttctgtgacacctgtgaggccgtggcccggctgcaccagtgcaagacccccatcatccaccgggacctgaaggtggagaacatcctgctgaatgatggcggcaactacgtgctgtgtgactttggaagtgccaccaacaagttcctgaacccccagaaggatggagtgaatgtggtggaggaggagatcaagaagtacaccaccctgagctaccgggcccctgagatgatcaacctgtatggaggcaagcccatcaccaccaaggctgacatctgggccctgggctgcctgctgtacaagctgtgcttcttcaccctgccctttggagagagccaggtggccatctgtgatggcaacttcaccatcccagacaacagccgctacagcaggaacatccactgcctgatccgcttcatgctggagccagaccctgagcacaggccagacatcttccaggtgtcctactttgccttcaagtttgccaagaaggactgccctgtgagcaacatcaacaacagcagcatccccagcgccctgcctgagcccatgacagccagcgaggccgccgccaggaagagccagatcaaggcccgcatcacagacaccatcggccccacagagaccagcatcgccccccggcagaggcccaaggccaacagcgccaccacagccaccccatctgtgctgaccatccagagcagcgccacccctgtgaaggtgctggcccctggagaatttggaaaccaccggcccaagggggccctgcggcctggaaatggacctgagatcctgctgggccagggccccccccagcagcccccccagcagcaccgggtgctgcagcagctgcagcagggcgactggaggctgcagcagctgcacctgcagcaccgccacccccaccagcagcagcagcagcagcagcagcagcagcagcagcagcagcagcagcagcagcagcagcagcagcagcagcagcagcagcaccaccaccaccaccaccaccacctgctgcaggatgcctacatgcagcagtaccagcacgccacccagcagcagcagatgctgcagcagcagttcctgatgcacagcgtgtaccagccccagcccagcgccagccagtaccccaccatgatgccccagtaccagcaggccttcttccagcagcagatgctggcccagcaccagcccagccagcagcaggccagccctgagtacctgaccagcccccaggagttctccccagccctggtgtcctacaccagcagcctgcctgcccaggtgggcaccatcatggacagcagctacagcgccaacagatctgtggccgacaaggaggccatcgccaacttcaccaaccagaagaacatcagcaaccccccagacatgagcggctggaacccctttggagaggacaacttcagcaagctgacagaggaggagctgctggaccgggagtttgacctgctgcggagcagcaagggccacctgaaggcctactttgccagccagtag

SEQ ID NO: 15053 - DNA, 3849 bp, Artificial Sequence
  Description of Artificial Sequence: Synthetic coding sequence
atggaggccaaggaccagaagaagcacaggaagaagaacagcggccccaaggccgccaagaagaagaagaggctgctgcaggacctgcagctgggagatgaagaagatgccaggaagaggaaccccaaggcctttgctgtgcagagcgctgtgaggatggcccggagcttccacaggacccaggacctgaagaccaagaagcaccacatccctgtggtggacaggacccccctggagcccccacccatcgtggtggtggtgatgggcccccccaaggtgggcaagagcaccctcatccagtgcctgatccggaacttcacccggcagaagctgacagagatccggggccctgtgaccatcgtgtctgggaagaagaggcggctgaccatcattgaatgtggctgtgacatcaacatgatgattgacctggccaaggtggccgacctggtgctgatgctgattgatgccagctttggatttgagatggagacctttgagttcctgaacatctgccaggtgcacggcttccccaagatcatgggcgtgctgacccacctggacagcttcaagcacaacaagcagctgaagaagaccaagaagaggctgaagcaccgcttctggacagaggtgtacccaggggccaagctgttctacctgagcggcatggtgcacggggagtaccagaaccaggagatccacaacctgggccgcttcatcaccgtgatgaagttccggcccctgacctggcagaccagccacccctacatcctggccgacaggatggaggacctgaccaaccctgaggacatccgcaccaacatcaagtgtgacaggaaggtgtccctgtatggctacctgcggggggcccacctgaagaacaagagccagatccacatgcctggggtgggggactttgctgtgtctgacatctccttcctgcctgacccctgtgccctgcctgagcagcagaagaagcgctgcctgaatgagaaggagaagctggtgtatgcccccctgagcggcgtgggcggcgtgctgtatgacaaggatgctgtgtatgtggacctgggcggcagccacgtgttccaggatgaggtgggccccacccatgagctggtgcagagcctcatcagcacccacagcaccattgatgccaagatggccagcagccgggtgaccctcttcagtgacagcaagcccctgggcagcgaggacatcgacaaccagggcctgatgatgcccaaggaggagaagcagatggacctgaacacaggccgcatgaggaggaaggccatctttggagatgaagatgaaagtggggacagtgatgatgaggaggatgatgagatgtctgaagatgatggcctggagaatggcagcagtgatgaggaggccgaggaggaggagaatgctgagatgacagaccagtacatggctgtgaagggcatcaagaggaggaagctggagctggaggaggacagcgagatggacctgcctgcctttgctgacagtgatgatgacctggagaggagcagcgctgaggagggggaggccgaggaggctgatgagagcagcgaggaggaggactgcacagctggggagaagggcatcagcggcagcaaggctgctggggagggcagcaaggccggcctgagccctgccaactgccagagcgacagagtgaacctggagaagagcctgctgatgaagaaggccgccctgcccacctttgattctggccactgcacagctgaggaggtgtttgcctctgaagatgagagcgaggagagcagcagcctgtctgctgaggaggaggacagtgaaaatgaggaggccatcaggaagaagctgagcaagcccagccaggtgagcagcggccagaagctgggcccccagaacttcattgatgagaccagtgacatcgagaacctgctgaaggaggaggaggactacaaggaggagaacaatgacagcaaggagaccagcggggccctgaagtggaaggaggacctgagcaggaaggctgctgaggccttcctgcggcagcagcaggccgcccccaacctgaggaagctgatctacggcaccgtgacagaagataatgaggaggaggatgatgacaccctggaggagctgggcggcctcttccgggtgaaccagcctgaccgggagtgcaagcacaaggctgacagcctggactgcagccgcttcctggtggaggcccctcatgactgggacctggaggaggtgatgaacagcatccgggactgctttgtgacaggcaagtgggaggatgacaaggatgctgccaaggtgctggctgaagatgaggagctgtatggagactttgaggacctggagactggagatgtgcacaagggcaagagcggccccaacacccagaatgaagatattgagaaggaggtgaaggaggagattgatcctgatgaggaggagagcgccaagaagaagcacctggacaagaagaggaagctgaaggagatgtttgatgctgaatatgatgaaggagagagcacctactttgatgacctgaagggggagatgcagaagcaggcccagctgaacagagctgagtttgaggaccaggatgatgaggcccgggtgcagtatgagggcttccggcccggcatgtatgtgcgcatcgagattgaaaatgtgccctgtgaatttgtgcagaactttgacccccactaccccatcatcctgggcggcctgggcaacagcgagggcaatgtgggctacgtgcagatgaggctgaagaagcaccgctggtacaagaagatcctgaagagccgggaccccatcatcttctctgtgggctggaggcgcttccagaccatccccctgtactacatcgaggaccacaacggccggcagaggctgctgaagtacaccccccagcacatgcactgtggggccgccttctggggccccatcaccccccagggcaccggcttcctggccatccagagcgtgtctggcatcatgccagacttcagaattgctgccactggagtggtgctggacctggacaagagcatcaagatcgtgaagaagctgaagctgaccggcttcccctacaagatcttcaagaacaccagcttcatcaagggcatgttcaacagcgccctggaggtggccaagtttgagggcgctgtgatcagaacagtgtctggcatccggggccagatcaagaaggccctgcgggcccctgagggcgccttccgggccagctttgaggacaagctgctgatgtctgacatcgtgttcatgaggacctggtaccctgtgtccatcccagccttctacaaccctgtgaccagcctgctgaagcctgtgggggagaaggacacctggagcggcatgaggaccaccggccagctgcggctggcccatggagtgcggctgaaggccaacaaggacagcctgtacaagcccatcctgcggcagaagaagcacttcaacagcctgcacatccccaaggccctgcagaaggccctgcccttcaagaacaagcccaagacccaggccaaggccggcaaggtgcccaaggacagaagaagacctgctgtgatccgggagccccatgagaggaagatcctggccctgctggatgccctgagcacagtgcacagccagaagatgaagaaggccaaggagcagaggcacctgcacaacaaggagcacttccgggccaagcagaaggaggaggaggagaagctgaagaggcagaaggacctgaggaagaagctgttccgcatccagggccagaaggagaggaggaaccagaagagcagcctgaagggagctgagggccagctgcagtag

SEQ ID NO: 15054 - DNA, 909 bp, Artificial Sequence
  Description of Artificial Sequence: Synthetic coding sequence
atggtgtcctaccacaagcaggcctgtgagatcccccccaccgtgaaccccaggaagaagctgtgggccttccccagcgacagcagccgggacctgcccagccccaagaaggccaagacagaggagatgccccagctgaactttggcatggctgaccccacccagatgggcggcctgtccatgctgctgctggccggggagcacgccctgggcaccccagaggtgagcagcggcacctgcaggccagatgtgtctgagagccctgagctgcggcagaagagccccctcttccagtttgctgagatcagcagcagcaccagccacagtgatgccagcaccaagcagtgccagaccagcgccctcttccagtttgctgagatcagcagcaacaccagccagctgggcggcgctgagcctgtgaagagatgtgggaagagcgccctcttccagctggccgagatgtgcctggccagcgagggcatgaagatggaggagagcaagctgatcaaggccaaggagagtgatggcggccgcatcaaggagctggagaagggcaaggaggagaaggagatcaagatggagaagacagatgagacccggctgcagaaggaggccgagtttgagaagagcgccaaggagaacctgcgggacagcaaggagctgaggaactttgaggccctgcagattgatgacatcatggccatcaagatggaggaccccaaggagatcaggaaggaggagctggaggaggaccacaagtgcagccacttcccagacttctcctacagcgccagcagcaagatcatcatcagtgatgtgcccagcaggaaggaccacatgtgccacccccacggcatcatgatcatcgaggaccctgctgccctgaacaagccagagaagctgaagtag

SEQ ID NO: 15055 - DNA, 2826 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaatgccttcctgctcttctgcaagaggcacaggagcctggtgcggcaggagcacccccggctggacaacagaggagccaccaagatcctggccgactggtgggccgtgctggaccccaaggagaagcagaagtacacagacatggccaaggagtacaaggatgccttcatgaaggccaaccctggctacaagtggtgccccaccaccaacaagcctgtgaagagccccacccccaccgtgaaccccaggaagaagctgtgggccttccccagcgacagcagccgggacctgcccagccccaagaaggccaagacagaggagatgccccagctgaactttggcatggctgaccccacccagatgggcggcctgtccatgctgctgctggccggggagcacgccctgggcaccccagaggtgagcagcggcacctgcaggccagatgtgtctgagagccctgagctgcggcagaagagccccctcttccagtttgctgagatcagcagcagcaccagccacagtgatgccagcaccaagcagtgccagaccagcgccctcttccagtttgctgagatcagcagcaacaccagccagctgggcggcgctgagcctgtgaagagatgtgggaagagcgccctcttccagctggccgagatgtgcctggccagcgagggcatgaagatggaggagagcaagctgatcaaggccaaggagagtgatggcggccgcatcaaggagctggagaagggcaaggaggagaaggagatcaagatggagaagacagatgagacccggctgcagaaggaggccgagtttgagaagagcgccaaggagaacctgcgggacagcaaggagctgaggaactttgaggccctgcagattgatgacatcatggccatcaagatggaggaccccaaggagatcaggaaggaggagctggaggaggaccacaagtgcagccacttcccagacttctcctacagcgccagcagcaagatcatcatcagtgatgtgcccagcaggaaggaccacatgtgccacccccacggcatcatgatcattgaagatcctgctgccctgaacaagccagagaagctgaagaagaagaagaagaagagcaagatggacagacatggaaatgacaagagcacccccaagaagacctgcaagaagaggcagagcagcgagagtgacattgaatctgtcatctacaccatcgaggccgtggccaagggggactggggcatcgagaagctgggggacacccccaggaagaaggtgaggaccagcagcagcggcaagggcagcatcctggatgccaagccacccaagaagaaggtgaagagccgggagaagaagatgagcaaggagaagagcagtgacaccaccaaggagagccggcccccagacttcatcagcatcagcgccagcaagaacatctctggagagaccccagagggcatcaaggccgagcccctgacccccatggaggatgccctgccccccagcctgagcggccaggccaagccagaagattctgactgccacaggaagattgagacctgtggcagcaggaagtctgagaggagctgcaagggggccctgtacaagaccctggtgtctgagggcatgctgaccagcctgcgggccaacgtggaccggggcaagaggagcagtggaaaaggaaacagcagtgaccacgagggctgctggaatgaggagagctggaccttcagccagagcggcaccagcggcagcaagaagttcaagaagaccaagcccaaggaggactgcctgctgggcagcgccaagctggatgaggagtttgagaagaagttcaacagcctgccccagtacagccctgtgacctttgacagaaaatgtgtgcctgtgcccaggaagaagaagaagacaggaaatgtgtcctctgagcccaccaagaccagcaagggccccttccagagccagaagaagaacctcttccacaagatcgtgtccaagtacaagcacaagaaggagaagcccaacgtgcctgagaagggcagcggggacaagtggagcaacaagcagctgttcctggatgccatccaccccacagaggccatcttctctgaagatagaaacaccatggagcctgtgcacaaggtgaagaacatccccagcatcttcaacaccccagagcccaccaccacccaggagcccctggtgggcagccagaagaggaaggccaggaagaccaagatcacccacctggtgaggacagcagatggccgggtgtccccagctgggggcaccctggatgacaagcccaaggagcagctgcagaggagcctgcccaaggccacagaaacagactgcaatgacaagtgcagccacaacacagaggtgggggagaccaggagcagcaccccagagatgcctgctgtgtctgccttcttcagcctggccgccctggccgaggtggccgccatggagaatgtgcaccggggccagaggagcacccccctgacccatgatggccagcccaaggagatgccccaggcccctgtgctgatcagctgtgccgaccagtag

SEQ ID NO: 15056 - DNA, 1347 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaatgccttcctgctcttctgcaagaggcacaggagcctggtgcggcaggagcacccccggctggacaacagaggagccaccaagatcctggccgactggtgggccgtgctggaccccaaggagaagcagaagtacacagacatggccaaggagtacaaggatgccttcatgaaggccaaccctggctacaagtggtgccccaccaccaacaagcctgtgaagagccccacccccaccgtgaaccccaggaagaagctgtgggccttccccagcgacagcagccgggacctgcccagccccaagaaggccaagacagaggagatgccccagctgaactttggcatggctgaccccacccagatgggcggcctgtccatgctgctgctggccggggagcacgccctgggcaccccagaggtgagcagcggcacctgcaggccagatgtgtctgagagccctgagctgcggcagaagagccccctcttccagtttgctgagatcagcagcagcaccagccacagtgatgccagcaccaagcagtgccagaccagcgccctcttccagtttgctgagatcagcagcaacaccagccagctgggcggcgctgagcctgtgaagagatgtgggaagagcgccctcttccagctggccgagatgtgcctggccagcgagggcatgaagatggaggagagcaagctgatcaaggccaaggagagtgatggcggccgcatcaaggagctggagaagggcaaggaggagaaggagatcaagatggagaagacagatgagacccggctgcagaaggaggccgagtttgagaagagcgccaaggagaacctgcgggacagcaaggagctgaggaactttgaggccctgcagattgatgacatcatggccatcaagatggaggaccccaaggagatcaggaaggaggagctggaggaggaccacaagtgcagccacttcccagacttctcctacagcgccagcagcaagatcatcatcagtgatgtgcccagcaggaaggaccacatgtgccacccccacggcatcatgatcattgaagatcctgctgccctgaacaagccagagtag

SEQ ID NO: 15057 - DNA, 2736 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaatgccttcctgctcttctgcaagaggcacaggagcctggtgcggcaggagcacccccggctggacaacagaggagccaccaagatcctggccgactggtgggccgtgctggaccccaaggagaagcagaagtacacagacatggccaaggagtacaaggatgccttcatgaaggccaaccctggctacaagtggtgccccaccaccaacaagcctgtgaagagccccacccccaccgtgaaccccaggaagaagctgtgggccttccccagcgacagcagccgggacctgcccagccccaagaaggccaagacagaggagatgccccagctgaactttggcatggctgaccccacccagatgggcggcctgtccatgctgctgctggccggggagcacgccctgggcaccccagaggtgagcagcggcacctgcaggccagatgtgtctgagagccctgagctgcggcagaagagccccctcttccagtttgctgagatcagcagcagcaccagccacagtgatgccagcaccaagcagtgccagaccagcgccctcttccagtttgctgagatcagcagcaacaccagccagctgggcggcgctgagcctgtgaagagatgtgggaagagcgccctcttccagctggccgagatgtgcctggccagcgagggcatgaagatggaggagagcaagctgatcaaggccaaggagagtgatggcggccgcatcaaggagctggagaagggcaaggaggagaaggagatcaagatggagaagacagatgagacccggctgcagaaggaggccgagtttgagaagagcgccaaggagaacctgcgggacagcaaggagctgaggaactttgaggccctgcagattgatgacatcatggccatcaagatggaggaccccaaggagatcaggaaggaggagctggaggaggaccacaagtgcagccacttcccagacttctcctacagcgccagcagcaagatcatcatcagtgatgtgcccagcaggaaggaccacatgtgccacccccacggcatcatgatcattgaagatcctgctgccctgaacaagccagagaagctgaagaagaagaagaagaagagcaagatggacagacatggaaatgacaagagcacccccaagaagacctgcaagaagaggcagagcagcgagagtgacattgaatctgtcatctacaccatcgaggccgtggccaagggggactggggcatcgagaagctgggggacacccccaggaagaaggtgaggaccagcagcagcggcaagggcagcatcctggatgccaagccacccaagaagaaggtgaagagccgggagaagaagatgagcaaggagaagagcagtgacaccaccaaggagagccggcccccagacttcatcagcatcagcgccagcaagaacatctctggagagaccccagagggcatcaaggccgagcccctgacccccatggaggatgccctgccccccagcctgagcggccaggccaagccagaagattctgactgccacaggaagattgagacctgtggcagcaggaagtctgagaggagctgcaagggggccctgtacaagaccctggtgtctgagggcatgctgaccagcctgcgggccaacgtggaccggggcaagaggagcagtggaaaaggaaacagcagtgaccacgagggctgctggaatgaggagagctggaccttcagccagagcggcaccagcggcagcaagaagttcaagaagaccaagcccaaggaggactgcctgctgggcagcgccaagctggatgaggagtttgagaagaagttcaacagcctgccccagtacagccctgtgacctttgacagaaaatgtgtgcctgtgcccaggaagaagaagaagacaggaaatgtgtcctctgagcccaccaagaccagcaagggcagcggggacaagtggagcaacaagcagctgttcctggatgccatccaccccacagaggccatcttctctgaagatagaaacaccatggagcctgtgcacaaggtgaagaacatccccagcatcttcaacaccccagagcccaccaccacccaggagcccctggtgggcagccagaagaggaaggccaggaagaccaagatcacccacctggtgaggacagcagatggccgggtgtccccagctgggggcaccctggatgacaagcccaaggagcagctgcagaggagcctgcccaaggccacagaaacagactgcaatgacaagtgcagccacaacacagaggtgggggagaccaggagcagcaccccagagatgcctgctgtgtctgccttcttcagcctggccgccctggccgaggtggccgccatggagaatgtgcaccggggccagaggagcacccccctgacccatgatggccagcccaaggagatgccccaggcccctgtgctgatcagctgtgccgaccagtag

SEQ ID NO: 15058 - DNA, 450 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaatgccttcctgctcttctgcaagaggcacaggagcctggtgcggcaggagcacccccggctggacaacagaggagccaccaagatcctggccgactggtgggccgtgctggaccccaaggagaagcagaagtacacagacatggccaaggagtacaaggatgccttcatgaaggccaaccctggctacaagtggtag

SEQ ID NO: 15059 - DNA, 2736 bp, Artificial Sequence; identical to SEQ ID NO: 15057
  Description of Artificial Sequence: Synthetic coding sequence

SEQ ID NO: 15060 - DNA, 75 bp, Artificial Sequence
  Description of Artificial Sequence: Synthetic coding sequence
atgaagggcagcaacagaaacaaggaccacagcgctgagggggagggcgtgggcaagaggcccaagaggaagtag

SEQ ID NO: 15061 - DNA, 582 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaatgccttcctgctcttctgcaagaggcacaggagcctggtgcggcaggagcacccccggctggacaacagaggagccaccaagatcctggccgactggtgggccgtgctggaccccaaggagaagcagaagtacacagacatggccaaggagtacaaggatgccttcatgaaggccaaccctggctacaagtggtgccccaccaccaacaagcctgtgaagagccccacccccaccgtgaaccccaggaagaagctgtgggccttccccagcgacagcagccgggacctgcccagccccaagaaggccaagacagaggagatgccctag

SEQ ID NO: 15062 - DNA, 501 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaatgccttcctgctcttctgcaagaggcacaggagcctggtgcggcaggagcacccccggctggacaacagaggagccaccaagatcctggccgactggtgggccgtgctggaccccaaggagaagcagaagtacacagacatggccaaggagtacaaggatgccttcatgaaggccaaccctggctacaagtggtgccccaccaccaacaagcctgtgaagagccccacccccaccgtgaacccctag

SEQ ID NO: 15063 - DNA, 312 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaatgccttcctgctcttctgcaagaggcacaggagcctggtgcggcaggagcacccctag

SEQ ID NO: 15064 - DNA, 480 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaatgccttcctgctcttctgcaagaggcacaggagcctggtgcggcaggagcacccccggctggacaacagaggagccaccaagatcctggccgactggtgggccgtgctggaccccaaggagaagcagaagtacacagacatggccaaggagtacaaggatgccttcatgaaggccaaccctggctacaagtggtgccccaccaccaacaagcctgtgaagagctag

SEQ ID NO: 15065 - DNA, 345 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaatgccttcctgctcttctgcaagaggcacaggagcctggtgcggcaggagcacccccggctggacaacagaggagccaccaagatcctgtag

SEQ ID NO: 15066 - DNA, 435 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaatgccttcctgctcttctgcaagaggcacaggagcctggtgcggcaggagcacccccggctggacaacagaggagccaccaagatcctggccgactggtgggccgtgctggaccccaaggagaagcagaagtacacagacatggccaaggagtacaaggatgccttcatgaaggccaactag

SEQ ID NO: 15067 - DNA, 42 bp, Artificial Sequence
  Description of Artificial Sequence: Synthetic coding sequence
atgaagggcagcaacagaaacaaggaccacagcgctgagtag

SEQ ID NO: 15068 - DNA, 618 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaatgccttcctgctcttctgcaagaggcacaggagcctggtgcggcaggagcacccccggctggacaacagaggagccaccaagatcctggccgactggtgggccgtgctggaccccaaggagaagcagaagtacacagacatggccaaggagtacaaggatgccttcatgaaggccaaccctggctacaagtggtgccccaccaccaacaagcctgtgaagagccccacccccaccgtgaaccccaggaagaagctgtgggccttccccagcgacagcagccgggacctgcccagccccaagaaggccaagacagaggagatgccccagctgaactttggcatggctgaccccacccagatgtag

SEQ ID NO: 15069 - DNA, 216 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaatag

SEQ ID NO: 15070 - DNA, 258 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaactag

SEQ ID NO: 15071 - DNA, 297 bp, Artificial Sequence
  Description of Artificial Sequence: Synthetic coding sequence
atgaagggcagcaacagaaacaaggaccacagcgctgagggggagggcgtgggcaagaggcccaagaggaagtgcctgcagtggcaccccctgctggccaagaagctgctggacttcagcgaggaggaggaggaggaggatgaggaggaggacatcgacaaggtgcagctgctgggcgcagatggcctggagcaggatgtgggggagacagaagatgatgagagccctgagcagagggcccggcggcccatgaatgccttcctgctcttctgcaagaggcacaggagcctggtgtag

SEQ ID NO: 15072 - DNA, 2466 bp, Artificial Sequence
  Description of Artificial Sequence: Synthetic coding sequence
atggaccctgaatgtgcccagctgctgcctgccctgtgtgctgtgctggtggacccccggcagcctgtggctgatgacacctgcctggagaagctgctggactggttcaagacagtgacagaaggagagagctctgtggtgctgctgcaggagcacccctgcctggtggagctgctgagccacgtgctgaaggtgcaggacctgagcagcggcgtgctgtccttcagcctgcggctggccggcacctttgctgcccaggagaactgcttccagtacctgcagcagggcgagctgctgcccggcctgtttggagagcccggccccctgggccgggccacctgggccgtgcccaccgtgcgcagcggctggatccagggcctgcggagcctggcccagcaccccagcgccctgcgcttcctggccgaccatggagctgtggacaccatcttcagcctgcagggcgacagcagcctgtttgtggccagcgctgccagccagctgctggtgcacgtgctggccctgtccatgaggggcggcgctgagggccagccctgcctgcctggaggagactggccagcctgtgcccagaagatcatggaccacgtggaggagagcctgtgcagcgctgccacccccaaggtgacccaggccctgaatgtgctgaccaccaccttcggccgctgccagagcccctggacagaggccctgtgggtgcggctgagcccccgggtggcctgcctgctggagcgggaccccatcccagctgcccacagctttgtggacctgctgctgtgtgtggcccggagccctgtgttcagcagcagtgatggcagcctgtgggagaccgtggcccgggccctgagctgcctgggccccacccacatgggccccctggccctgggcatcctgaagctggagcactgcccccaggccctgcggacccaggccttccaggtgctgctgcagcccctggcctgtgtgctgaaggccaccgtgcaggcccctggccccccaggcctgctggatggaacagcagatgatgccaccaccgtggacaccctgctggccagcaagagcagctgtgccggcctgctgtgcaggaccctggcccacctggaggagctgcagcccctgccccagaggcccagcccctggccccaggccagcctgctgggcgccaccgtgacagtgctgcggctgtgtgatggcagcgctgccccagccagctctgtgggcggccacctgtgtggcaccctggccggctgtgtgcgggtgcagagagctgccctggacttcctgggcaccctgagccagggcaccggcccccaggagctggtgacccaggccctggccgtgctgctggagtgcctggagagccctggcagcagccccaccgtgctgaagaaggccttccaggccaccctgcgctggctgctgagcagccccaagaccccaggctgcagcgacctgggccccctcatcccccagttcctgcgggagctgtttcctgtgctgcagaagaggctgtgccacccctgctgggaggtgcgggacagcgccctggagttcctgacccagctgagccgccactggggcggccaggccgacttccgctgtgccctgctggccagcgaggtgccccagctggccctgcagctgctgcaggaccctgagagctatgtgcgggccagcgctgtgacagccatgggccagctgagcagccagggcctgcacgcccccaccagccctgagcacgccgaggcccggcagagcctcttcctggagctgctgcacatcctgtctgtggacagcgagggcttccccaggagagctgtgatgcaggtgttcacagagtggctgagagatggccatgctgatgctgcccaggacacagagcagtttgtggccaccgtgctgcaggccgccagccgggacctggactgggaggtgcgggcccagggcctggagctggccctggtgttcctgggccagaccctgggcccccccaggacccactgcccctatgctgtggccctgcctgaggtggccccagcccagcccctgacagaggccctgcgggccctgtgccacgtgggcctgtttgattttgccttctgtgccctgtttgactgtgacaggcctgtggcccagaagagctgtgacctgctgctcttcctgcgggacaagatcgccagctacagcagcctgcgggaggcccggggcagccccaacacagccagcgctgaggccaccctgccccgctggagggctggggagcaggcccagcccccaggggaccaggagcctgaggccgtgctggccatgctgcggagcctggacctggagggcctgcggagcaccctggccgagagcagtgaccacgtggagaagagcccccagagcctgctgcaggacatgctggccactggaggcttcctgcagggagatgaggccgactgctactag

SEQ ID NO: 15073 - DNA, 720 bp, Artificial Sequence
  Description of Artificial Sequence: Synthetic coding sequence
atggccaagccctgtggggtgcggctgagcggggaggccaggaagcaggtggaggtgttccggcagaacctcttccaggaggccgaggagttcctgtaccgcttcctgccccagaagatcatctacctgaaccagctgctgcaggaggacagcctgaatgtggccgacctgaccagcctgcgggcccccctggacatccccatcccagaccccccacccaaggatgatgagatggagacagacaagcaggagaagaaggaggtgcacaagtgtggcttcctgcctggaaatgagaaggtgctgagcctgctggccctggtgaagccagaggtgtggaccctgaaggagaagtgcatcctggtgatcacctggatccagcacctgatccccaagattgaagatggaaatgactttggagtggccatccaggagaaggtgctggagcgggtgaatgctgtgaagaccaaggtggaggccttccagaccaccatcagcaagtacttcagcgagagaggagatgctgtggccaaggccagcaaggagacccacgtgatggactaccgggccctggtgcatgaaagagatgaagctgcctatggagagctgcgggccatggtgctggacctgcgggccttctacgccgagctgtaccacatcatcagcagcaacctggagaagatcgtgaaccccaagggggaggagaagcccagcatgtactag

SEQ ID NO: 15074 - DNA, 828 bp, Artificial Sequence
  Description of Artificial Sequence: Synthetic coding sequence
atggatgatgaggactgtgagaggaggaggatggagtgcctggatgagatgagcaacctggagaagcagttcacagacctgaaggaccagctgtacaaggagcggctgagccaggtggatgccaagctgcaggaggtgattgctgggaaggcccctgagtacctggagcccctggccaccctgcaggagaacatgcagatccgcaccaaggtggccggcatctaccgggagctgtgcctggagagcgtgaagaacaagtatgaatgtgagatccaggccagccggcagcactgtgagagcgagaagctgctgctgtatgacacagtgcagagcgagctggaggagaagatccggcggctggaggaggacagacacagcattgacatcaccagcgagctgtggaatgatgagctgcagagcaggaagaagaggaaggaccccttctccccagacaagaagaagcctgtggtggtgtctggcccctacatcgtgtacatgctgcaggacctggacatcctggaggactggaccaccatcaggaaggccatggccaccctgggcccccaccgggtgaagacagagccccctgtgaagctggagaagcacctgcacagcgcccggtctgaggagggccgcctgtactatgatggagagtggtacatccggggccagaccatctgcatcgacaagaaggatgaatgtcccaccagcgctgtgatcaccaccatcaaccatgatgaggtgtggttcaagaggccagatggcagcaagagcaagctgtacatcagccagctgcagaagggcaagtacagcatcaagcacagctag

SEQ ID NO: 15075 - DNA, 1614 bp, Artificial Sequence
  Description of Artificial Sequence: Synthetic coding sequence
atgggcgccaccggggctgctgagcccctgcagagcgtgctgtgggtgaagcagcagagatgtgctgtgtccctggagcccgcccgggccctgctgcgctggtggaggagccctggccctggggccggggcccctggagcagatgcctgcagcgtgcctgtgtctgagatcatcgctgtggaggagacagatgtgcacggcaagcaccagggcagcggcaagtggcagaagatggagaagccctatgccttcaccgtgcactgtgtgaagagggcccggcggcaccgctggaagtgggcccaggtgaccttctggtgcccagaggagcagctgtgccacctgtggctgcagaccctgcgggagatgctggagaagctgaccagccggcccaagcacctgctggtgttcatcaacccctttggaggcaagggccagggcaagaggatctatgaaaggaaggtggcccccctcttcaccctggccagcatcaccacagacatcatcgtgacagagcacgccaaccaggccaaggagaccctgtatgagatcaacatcgacaagtatgatggcatcgtgtgtgtgggcggagatggcatgttttctgaggtgctgcacggcctcatcggccgcacccagaggtctgctggggtggaccagaaccaccccagggctgtgctggtgcccagcagcctgagaattggcatcatcccagctggcagcacagactgtgtgtgctacagcacagtgggcaccagtgatgctgagaccagcgccctgcacatcgtggtgggggacagcctggccatggatgtgtcctctgtgcaccacaacagcaccctgctgcgctacagcgtgtccctgctgggctacggcttctatggagacatcatcaaggacagcgagaagaagcgctggctgggcctggcccgctatgacttcagcggcctgaagaccttcctgagccaccactgctatgagggcaccgtgtccttcctgcctgcccagcacacagtgggcagcccccgggacaggaagccctgcagagctggctgctttgtgtgccggcagagcaagcagcagctggaggaggagcagaagaaggccctgtatggcctggaggccgcagaagatgtggaggagtggcaggtggtgtgtgggaagttcctggccatcaatgccaccaacatgagctgtgcctgcagaagaagcccccggggcctgagccctgctgcccacctgggagatggcagcagtgacctgatcctgatcaggaagtgcagccgcttcaacttcctgcgcttcctgatccgccacaccaaccagcaggaccagtttgacttcacctttgtggaggtgtacagagtgaagaagttccagttcaccagcaagcacatggaggatgaggacagcgacctgaaggagggcggcaagaagcgcttcggccacatctgcagcagccaccccagctgctgctgcaccgtgagcaacagctcctggaactgtgatggagaggtgctgcacagccctgccatcgaggtgcgggtgcactgccagctggtgcggctgtttgcccggggcatcgaggagaaccccaagccagacagccacagctag

SEQ ID NO: 15076 - DNA, 2355 bp, Artificial Sequence
  Description of Artificial Sequence: Synthetic coding sequence
atgcagagcaggaagtgcctgaagagggactgtgaccagcaggctgatggcctgtgccgcttcggcagctttgactgcttccgcagcagcagaagaagcagcagcaccacccgggcctggaccagcgccagcaggaccaggaccagtgaccggctgaacagaattgccaaccaggtggccatccagaggaagaagcagtttgtggagcgggcccacagctactggctgctgaagaggctgagcagaaatggagcccccctgctgcggcggctgcagagcagcctgcagagccagaggagcagccagcagagagaaaatgatgaggagatgaaggccgccaaggagaagctgaagtactggcagaggctgcggcatgacctggagcgggcccggctgctgattgagctgctgaggaagcgggagaagctgaagcgggagcaggtgaaggtggagcaggtggccatggagctgcggctgacccccctgactgtgctgctgcggtctgtgctggaccagctgcaggacaaggaccctgcccgcatctttgcccagcctgtgtccctgaaggaggtgcctgactacctggaccacatcaagcaccccatggactttgccaccatgaggaagaggctggaggcccagggctacaagaacctgcacgagtttgaggaggactttgacctgatcatcgacaactgcatgaagtacaatgcccgggacacagtgttctacagagctgctgtgcggctgcgggaccagggcggcgtggtgctgcggcaggcccggcgggaggtggacagcatcggcctggaggaggccagcggcatgcacctgcctgagaggcctgctgctgccccccggcggcccttctcctgggaggatgtggaccggctgctggaccctgccaacagagcccacctgggcctggaggagcagctgcgggagctgctggacatgctggacctgacctgtgccatgaagagcagcggcagccgcagcaagagggccaagctgctgaagaaggagatcgccctgctgaggaacaagctgagccagcagcacagccagcccctgcccaccggccctggcctggagggctttgaagaagatggagctgccctgggccctgaggccggggaggagggggacaagagcccccccaagctggagcccagtgatgccctgcccctgcccagcaacagcgagaccaacagcgagccccccaccctgaagcctgtggagctgaaccctgagcagagcaagctgttcaagagggtgacctttgacaatgaaagccacagcgcctgcacccagagcgccctggtgtctggccggcccccagagcccacccgggccagcagtggagatgtgcctgctgctgctgccagcgctgtggccgagcccgccagtgatgtgaacagaaggacctctgtgctcttctgcaagagcaagtctgtgagcccccccaagagcgccaagaacacagagacccagcccaccagcccccagctgggcaccaagaccttcctgtctgtggtgctgccccggctggagaccctgctgcagcccaggaagaggagccgcagcacctgtggggacagcgaggtggaggaggagagccctgggaagaggctggatgctggcctgaccaatggatttggaggagcccggtctgagcaggagcccggcggcggcctgggcaggaaggccaccccaagaagaagatgtgccagcgagagcagcatcagcagcagcaacagccccctgtgtgacagcagcttcaatgcccccaagtgtggccggggcaagccagccctggtgcggcggcacaccctggaggacagaagtgagctgatcagctgcattgaaaatggaaattatgccaaggccgccagaattgctgctgaggtgggccagagctccatgtggatcagcacagatgctgctgcctctgtgctggagcccctgaaggtggtgtgggccaagtgcagcggctaccccagctacccagccctgatcatcgaccccaagatgccccgggtgcccggccaccacaacggggtgaccatcccagccccacccctggatgtgctgaagatcggggagcacatgcagaccaagagtgatgagaagctgttcctggtgctcttctttgacaacaagaggtcctggcagtggctgcccaagagcaagatggtgcccctgggcattgatgagaccatcgacaagctgaagatgatggagggcaggaacagcagcatcaggaaggctgtgcgcatcgcctttgaccgggccatgaaccacctgagccgggtgcatggagagcccaccagtgacctgagtgacattgattag

SEQ ID NO: 15077 - DNA, 3177 bp, Artificial Sequence
  Description of Artificial Sequence: Synthetic coding sequence
atgaggaggaagggccgctgccaccggggcagcgctgcccggcaccccagcagcccctgcagcgtgaagcacagccccacccgggagaccctgacctacgcccaggcccagaggatggtggagattgaaattgagggccgcctgcaccgcatcagcatctttgaccccctggagatcatcctggaggatgacctgacagcccaggagatgtctgagtgcaacagcaacaaggagaacagcgagaggcctcctgtgtgcctgcggaccaagaggcacaagaacaacagagtgaagaagaagaatgaggccctgcccagcgcccacggcaccccagccagcgccagcgccctgcctgagcccaaggtgcgcatcgtggagtacagccccccatctgccccccggcggccccctgtgtactacaagttcatcgagaagtctgctgaggagctggacaatgaggtggagtatgacatggatgaagaagattatgcctggctggagatcgtgaatgagaagaggaagggggactgtgtgcctgctgtgtcccagagcatgtttgagttcctgatggacagatttgagaaggagagccactgtgagaaccagaagcagggcgagcagcagagcctgattgatgaagatgctgtgtgctgcatctgcatggatggagagtgccagaacagcaatgtcatcctcttctgtgacatgtgcaacctggccgtgcaccaggagtgctacggcgtgccctacatccctgagggccagtggctgtgccgccactgcctgcagagccgggcccggcctgctgactgtgtgctgtgccccaacaagggcggggccttcaagaagacagatgatgaccgctggggccacgtggtgtgtgccctgtggatccctgaggtgggctttgccaacacagtgttcatcgagcccattgatggagtgaggaacatccccccagcccgctggaagctgacctgctacctgtgcaagcagaagggcgtgggcgcctgcatccagtgccacaaggccaactgctacacagccttccacgtgacctgtgcccagaaggccggcctgtacatgaagatggagcctgtgaaggagctgactggaggcggcaccaccttctctgtgaggaagacagcctactgtgatgtgcacaccccacctggctgcacccggcggcccctgaacatctatggagatgtggagatgaagaatggagtgtgcaggaaggagagctctgtgaagacagtgcgcagcaccagcaaggtgaggaagaaggccaagaaggccaagaaggccctggccgagccctgtgctgtgctgcccaccgtgtgtgccccctacatccccccccagaggctgaaccgcatcgccaaccaggtggccatccagaggaagaagcagtttgtggagcgggcccacagctactggctgctgaagaggctgagcagaaatggagcccccctgctgcggcggctgcagagcagcctgcagagccagaggagcagccagcagcgggagaatgatgaggagatgaaggccgccaaggagaagctgaagtactggcagaggctgcggcatgacctggagcgggcccggctgctgattgagctgctgaggaagcgggagaagctgaagcgggagcaggtgaaggtggagcaggtggccatggagctgcggctgacccccctgactgtgctgctgcggtctgtgctggaccagctgcaggacaaggaccctgcccgcatctttgcccagcctgtgtccctgaaggaggtgcctgactacctggaccacatcaagcaccccatggactttgccaccatgaggaagaggctggaggcccagggctacaagaacctgcatgaatttgaagaagattttgacctgatcatcgacaactgcatgaagtacaatgcccgggacaccgtcttctacagagctgctgtgcggctgcgggaccagggcggcgtggtgctgcggcaggcccggcgggaggtggacagcatcggcctggaggaggccagcggcatgcacctgcctgagaggcctgctgctgccccccggcggcccttctcctgggaggatgtggaccggctgctggaccctgccaacagagcccacctgggcctggaggagcagctgcgggagctgctggacatgctggacctgacctgtgccatgaagagcagcggcagccgcagcaagagggccaagctgctgaagaaggagatcgccctgctgaggaacaagctgagccagcagcacagccagcccctgcccactggacctggcctggagggctttgaggaggatggagctgccctgggccctgaggccggggaggaggtgctgccccggctggagaccctgctgcagcccaggaagaggagccgcagcacctgtggggacagcgaggtggaggaggagagccctgggaagaggctggatgctggcctgaccaatggatttggaggagcccggtctgagcaggagcccggcggcggcctgggcaggaaggccaccccaagaagaagatgtgccagcgagagcagcatcagcagcagcaacagccccctgtgtgacagcagcttcaatgcccccaagtgtggccggggcaagccagccctggtgcggcggcacaccctggaggacagaagtgagctgatcagctgcattgaaaatggaaattatgccaaggccgccagaattgctgctgaggtgggccagagctccatgtggatcagcacagatgctgctgcctctgtgctggagcccctgaaggtggtgtgggccaagtgcagcggctaccccagctacccagccctgatcatcgaccccaagatgccccgggtgcccggccaccacaacggggtgaccatcccagccccacccctggatgtgctgaagatcggggagcacatgcagaccaagagtgatgagaagctgttcctggtgctcttctttgacaacaagaggtcctggcagtggctgcccaagagcaagatggtgcccctgggcattgatgagaccatcgacaagctgaagatgatggagggcaggaacagcagcatcaggaaggctgtgcgcatcgcctttgaccgggccatgaaccacctgagccgggtgcatggagagcccaccagtgacctgagtgacattgattag

SEQ ID NO: 15078 - DNA, 1950 bp, Artificial Sequence
  Description of Artificial Sequence: Synthetic coding sequence
atgaaggccgccaaggagaagctgaagcgggagcaggtgaaggtggagcaggtggccatggagctgcggctgacccccctgactgtgctgctgcggtctgtgctggaccagctgcaggacaaggaccctgcccgcatctttgcccagcctgtgtccctgaaggaggtgcctgactacctggaccacatcaagcaccccatggactttgccaccatgaggaagaggctggaggcccagggctacaagaacctgcatgaatttgaagaagattttgacctgatcatcgacaactgcatgaagtacaatgcccgggacaccgtcttctacagagctgctgtgcggctgcgggaccagggcggcgtggtgctgcggcaggcccggcgggaggtggacagcatcggcctggaggaggccagcggcatgcacctgcctgagaggcctgctgctgccccccggcggcccttctcctgggaggatgtggaccggctgctggaccctgccaacagagcccacctgggcctggaggagcagctgcgggagctgctggacatgctggacctgacctgtgccatgaagagcagcggcagccgcagcaagagggccaagctgctgaagaaggagatcgccctgctgaggaacaagctgagccagcagcacagccagcccctgcccactggacctggcctggagggctttgaggaggatggagctgccctgggccctgaggccggggaggagggggacaagagcccccccaagctggagcccagtgatgccctgcccctgcccagcaacagcgagaccaacagcgagccccccaccctgaagcctgtggagctgaaccctgagcagagcaagctgttcaagagggtgacctttgacaatgaaagccacagcgcctgcacccagagcgccctggtgtctggccggcccccagagcccacccgggccagcagtggagatgtgcctgctgctgctgccagcgctgtggccgagcccgccagtgatgtgaacagaaggacctctgtgctcttctgcaagagcaagtctgtgtccccacccaagagcgccaagaacacagagacccagcccaccagcccccagctgggcaccaagaccttcctgtctgtggtgctgccccggctggagaccctgctgcagcccaggaagaggagccgcagcacctgtggggacagcgaggtggaggaggagagccctgggaagaggctggatgctggcctgaccaacggctttggaggagcccggtctgagcaggagcccggcggcggcctgggcaggaaggccacccccaggagaagatgtgccagcgagagcagcatcagcagcagcaacagccccctgtgtgacagcagcttcaatgcccccaagtgtggccggggcaagccagccctggtgagaagacacaccctggaggacagaagtgagctgatcagctgcattgaaaatggaaattatgccaaggccgccagaattgctgctgaggtgggccagagctccatgtggatcagcacagatgctgctgcctctgtgctggagcccctgaaggtggtgtgggccaagtgcagcggctaccccagctacccagccctgatcatcgaccccaagatgccccgggtgcccggccaccacaatggagtgaccatcccagccccacccctggatgtgctgaagattggagagcacatgcagaccaagagtgatgagaagctgttcctggtgctcttctttgacaacaagaggtcctggcagtggctgcccaagagcaagatggtgcccctgggcattgatgagaccatcgacaagctgaagatgatggagggcaggaacagcagcatcaggaaggctgtgagaattgcctttgaccgggccatgaaccacctgagccgggtgcacggggagcccaccagtgacctgagtgacatcgactag

SEQ ID NO: 15079 - DNA, 2988 bp, Artificial Sequence
  Description of Artificial Sequence: Synthetic coding sequence
atgaggaggaagggccgctgccaccggggcagcgctgcccggcaccccagcagcccctgcagcgtgaagcacagccccacccgggagaccctgacctacgcccaggcccagaggatggtggagattgaaattgagggccgcctgcaccgcatcagcatctttgaccccctggagatcatcctggaggatgacctgacagcccaggagatgtctgagtgcaacagcaacaaggagaacagcgagaggcctcctgtgtgcctgcggaccaagaggcacaagaacaacagagtgaagaagaagaatgaggccctgcccagcgcccacggcaccccagccagcgccagcgccctgcctgagcccaaggtgcgcatcgtggagtacagccccccatctgccccccggcggccccctgtgtactacaagttcatcgagaagtctgctgaggagctggacaatgaggtggagtatgacatggatgaagaagattatgcctggctggagatcgtgaatgagaagaggaagggggactgtgtgcctgctgtgtcccagagcatgtttgagttcctgatggacagatttgagaaggagagccactgtgagaaccagaagcagggcgagcagcagagcctgattgatgaagatgctgtgtgctgcatctgcatggatggagagtgccagaacagcaatgtcatcctcttctgtgacatgtgcaacctggccgtgcaccaggagtgctacggcgtgccctacatccctgagggccagtggctgtgccgccactgcctgcagagccgggcccggcctgctgactgtgtgctgtgccccaacaagggcggggccttcaagaagacagatgatgaccgctggggccacgtggtgtgtgccctgtggatccctgaggtgggctttgccaacacagtgttcatcgagcccattgatggagtgaggaacatccccccagcccgctggaagctgacctgctacctgtgcaagcagaagggcgtgggcgcctgcatccagtgccacaaggccaactgctacacagccttccacgtgacctgtgcccagaaggccggcctgtacatgaagatggagcctgtgaaggagctgactggaggcggcaccaccttctctgtgaggaagacagcctactgtgatgtgcacaccccacctggctgcacccggcggcccctgaacatctatggagatgtggagatgaagaatggagtgtgcaggaaggagagctctgtgaagacagtgcgcagcaccagcaaggtgaggaagaaggccaagaaggccaagaaggccctggccgagccctgtgctgtgctgcccaccgtgtgtgccccctacatccccccccagaggctgaaccgcatcgccaaccaggtggccatccagaggaagaagcagtttgtggagcgggcccacagctactggctgctgaagaggctgagcagaaatggagcccccctgctgcggcggctgcagagcagcctgcagagccagaggagcagccagcagcgggagaatgatgaggagatgaaggccgccaaggagaagctgaagtactggcagaggctgcggcatgacctggagcgggcccggctgctgattgagctgctgaggaagcgggagaagctgaagcgggagcaggtgaaggtggagcaggtggccatggagctgcggctgacccccctgactgtgctgctgcggtctgtgctggaccagctgcaggacaaggaccctgcccgcatctttgcccagcctgtgtccctgaaggaggtgcctgactacctggaccacatcaagcaccccatggactttgccaccatgaggaagaggctggaggcccagggctacaagaacctgcatgaatttgaagaagattttgacctgatcatcgacaactgcatgaagtacaatgcccgggacaccgtcttctacagagctgctgtgcggctgcgggaccagggcggcgtggtgctgcggcaggcccggcgggaggtggacagcatcggcctggaggaggccagcggcatgcacctgcctgagaggcctgctgctgccccccggcggcccttctcctgggaggatgtggaccggctgctggaccctgccaacagagcccacctgggcctggaggagcagctgcgggagctgctggacatgctggacctgacctgtgccatgaagagcagcggcagccgcagcaagagggccaagctgctgaagaaggagatcgccctgctgaggaacaagctgagccagcagcacagccagcccctgcccactggacctggcctggagggctttgaggaggatggagctgccctgggccctgaggccggggaggagggggacaagagcccccccaagctggagcccagtgatgccctgcccctgcccagcaacagcgagaccaacagcgagccccccaccctgaagcctgtggagctgaaccctgagcagagcaagctgttcaagagggtgacctttgacaatgaaagccacagcgcctgcacccagagcgccctggtgtctggccggcccccagagcccacccgggccagcagtggagatgtgcctgctgctgctgccagcgctgtggccgagcccgccagtgatgtgaacagaaggacctctgtgctcttctgcaagagcaagagcagcttccggggctggaggctcttctgcagccagggcaagggccgcggggcccatgctgagaccccccgctggaggaggagcccccaggagagcgcctggacccaggtgagccccacagccctgggcgtgcggggggccagccgcagcagagctgctgcctggggcggccggccccacccagatgatgctgtgccccccagccctgccagccccccagccacagcccggagcgccacccgggccctgatgaggcccaacgtgggcggggccaaccggctgctgtgtgatggcacccgctggaggacagctgtgtcctag

SEQ ID NO: 15080 - DNA, 2241 bp, Artificial Sequence
  Description of Artificial Sequence: Synthetic coding sequence
atgaagatggagcctgtgaaggagctgaccggcggcggcaccaccttctctgtgaggaagacagcctactgtgatgtgcacaccccacctggctgcacccggcggcccctgaacatctatggagatgtggagatgaagaatggagtgtgcaggaaggagagctctgtgaagacagtgcgcagcaccagcaaggtgaggaagaaggccaagaaggccaagaaggccctggccgagccctgtgctgtgctgcccaccgtgtgtgccccctacatccccccccagcgcttcatccgcatgcagagcaggaagtgcctgaagagggactgtgaccagcaggctgatggcctgtgccgcttcggcagctttgactgcttccgcagcagcagaagaagcagcagcaccacccgggcctggaccagcgccagcaggaccaggaccagtgaccggctgaacagaattgccaaccaggtggccatccagaggaagaagcagtttgtggagcgggcccacagctactggctgctgaagaggctgagcagaaatggagcccccctgctgcggcggctgcagagcagcctgcagagccagaggagcagccagcagagagaaaatgatgaggagatgaaggccgccaaggagaagctgaagtactggcagaggctgcggcatgacctggagcgggcccggctgctgattgagctgctgaggaagcgggagaagctgaagcgggagcaggtgaaggtggagcaggtggccatggagctgcggctgacccccctgactgtgctgctgcggtctgtgctggaccagctgcaggacaaggaccctgcccgcatctttgcccagcctgtgcctgactacctggaccacatcaagcaccccatggactttgccaccatgaggaagaggctggaggcccagggctacaagaacctgcatgaatttgaagaagattttgacctgatcatcgacaactgcatgaagtacaatgcccgggacaccgtcttctacagagctgctgtgcggctgcgggaccagggcggcgtggtgctgcggcaggcccggcgggaggtggacagcatcggcctggaggaggccagcggcatgcacctgcctgagaggcctgctgctgccccccggcggcccttctcctgggaggatgtggaccggctgctggaccctgccaacagagcccacctgggcctggaggagcagctgcgggagctgctggacatgctggacctgacctgtgccatgaagagcagcggcagccgcagcaagagggccaagctgctgaagaaggagatcgccctgctgaggaacaagctgagccagcagcacagccagcccctgcccactggacctggcctggagggctttgaggaggatggagctgccctgggccctgaggccggggaggaggtgctgccccggctggagaccctgctgcagcccaggaagaggagccgcagcacctgtggggacagcgaggtggaggaggagagccctgggaagaggctggatgctggcctgaccaatggatttggaggagcccggtctgagcaggagcccggcggcggcctgggcaggaaggccaccccaagaagaagatgtgccagcgagagcagcatcagcagcagcaacagccccctgtgtgacagcagcttcaatgcccccaagtgtggccggggcaagccagccctggtgcggcggcacaccctggaggacagaagtgagctgatcagctgcattgaaaatggaaattatgccaaggccgccagaattgctgctgaggtgggccagagctccatgtggatcagcacagatgctgctgcctctgtgctggagcccctgaaggtggtgtgggccaagtgcagcggctaccccagctacccagccctgatcatcgaccccaagatgccccgggtgcccggccaccacaacggggtgaccatcccagccccacccctggatgtgctgaagatcggggagcacatgcagaccaagagtgatgagaagctgttcctggtgctcttctttgacaacaagaggtcctggcagtggctgcccaagagcaagatggtgcccctgggcattgatgagaccatcgacaagctgaagatgatggagggcaggaacagcagcatcaggaaggctgtgcgcatcgcctttgaccgggccatgaaccacctgagccgggtgcatggagagcccaccagtgacctgagtgacattgattag

SEQ ID NO: 15081 - DNA, 2181 bp, Artificial Sequence
  Description of Artificial Sequence: Synthetic coding sequence
atgagcacagccaccaccgtggccccagctggcatcccagccaccccaggccctgtgaaccccccacctcctgaggtgagcaaccccagcaagccaggcaggaagaccaaccagctgcagtacatgcagaatgtggtggtgaagaccctgtggaagcaccagtttgcctggcccttctaccagcctgtggatgccatcaagctgaacctgcctgactaccacaagatcatcaagaaccccatggacatgggcaccatcaagaagaggctggagaacaactactactggagcgccagcgagtgcatgcaggacttcaacaccatgttcaccaactgctacatctacaacaagcccacagatgacatcgtgctgatggcccaggccctggagaagatcttcctgcagaaggtggcccagatgccccaggaggaggtggagctgctgcccccagcccccaagggcaaaggaaggaagccagctgctggggcccagagcgctggcacccagcaggtggccgctgtgtcctctgtgtccccagccacccccttccagagcgtgcccccaacagtgtcccagacccctgtgattgctgccacccctgtgcccaccatcacagccaacgtgacctctgtgcctgtgcccccagctgctgcccctcctcctccagccacccccatcgtgcctgtggtgccccccaccccacctgtggtgaagaagaagggcgtgaagaggaaggctgacaccaccacccccaccaccagcgccatcacagccagccgctctgagagccccccacccctgagtgaccccaagcaggccaaggtggtggcccggcgggagagcggcggccggcccatcaagccacccaagaaggacctggaggatggagaggtgccccagcacgccggcaagaagggcaagctgtctgagcacctgcgctactgtgacagcatcctgcgggagatgctgagcaagaagcacgccgcctatgcctggcccttctacaagcctgtggatgctgaggccctggagctgcatgactaccatgacatcatcaagcaccccatggacctgagcacagtgaagaggaagatggatggccgggagtacccagatgcccagggctttgctgctgatgtgcggctgatgttcagcaactgctacaagtacaaccccccagaccacgaggtggtggccatggccaggaagctgcaggatgtgtttgagatgagatttgccaagatgccagatgagcctgtggaggccccagccctgcctgccccagctgcccccatggtgtccaaaggagctgagagcagccgcagcagcgaggagagcagcagtgacagcggcagcagtgacagcgaggaggagcgggccacccggctggccgagctgcaggagcagctgaaggctgtgcatgagcagctggccgccctgagccaggcccctgtgaacaagcccaagaagaagaaggagaagaaggagaaggagaagaagaagaaggacaaggagaaggagaaggagaagcacaaggtgaaggccgaggaggagaagaaggccaaggtggcccccccagccaagcaggcccagcagaagaaggccccagccaagaaggccaacagcaccaccacagctggccggcagctgaagaagggcggcaagcaggccagcgccagctatgattctgaggaggaggaggagggcctgcccatgtcctatgatgagaagaggcagctgagcctggacatcaaccggctgcccggggagaagctgggccgggtggtgcacatcatccagagccgggagcccagcctgcgggacagcaacccagatgaaattgaaattgactttgagaccctgaagcccaccaccctgcgggagctggagcgctacgtgaagagctgcctgcagaagaagcagaggaagcccttcagcgccagcggcaagaagcaggccgccaagagcaaggaggagctggcccaggagaagaagaaggagctggagaagaggctgcaggatgtgtctggccagctgagcagcagcaagaagccagccaggaaggagaagccaggcagcgcccccagcggcggccccagccggctgagcagcagcagcagcagcgagagcggcagcagcagcagcagcggcagcagcagtgacagcagtgacagcgagtag

SEQ ID NO: 15082 - DNA, 1671 bp, Artificial Sequence
  Description of Artificial Sequence: Synthetic coding sequence
atgagcacagccaccaccgtggccccagctggcatcccagccaccccaggccctgtgaaccccccacctcctgaggtgagcaaccccagcaagccaggcaggaagaccaaccagctgcagtacatgcagaatgtggtggtgaagaccctgtggaagcaccagtttgcctggcccttctaccagcctgtggatgccatcaagctgaacctgcctgactaccacaagatcatcaagaaccccatggacatgggcaccatcaagaagaggctggagaacaactactactggagcgccagcgagtgcatgcaggacttcaacaccatgttcaccaactgctacatctacaacaagcccacagatgacatcgtgctgatggcccaggccctggagaagatcttcctgcagaaggtggcccagatgccccaggaggaggtggagctgctgcccccagcccccaagggcaaaggaaggaagccagctgctggggcccagagcgctggcacccagcaggtggccgctgtgtcctctgtgtccccagccacccccttccagagcgtgcccccaacagtgtcccagacccctgtgattgctgccacccctgtgcccaccatcacagccaacgtgacctctgtgcctgtgcccccagctgctgcccctcctcctccagccacccccatcgtgcctgtggtgccccccaccccacctgtggtgaagaagaagggcgtgaagaggaaggctgacaccaccacccccaccaccagcgccatcacagccagccgctctgagagccccccacccctgagtgaccccaagcaggccaaggtggtggcccggcgggagagcggcggccggcccatcaagccacccaagaaggacctggaggatggagaggtgccccagcacgccggcaagaagggcaagctgtctgagcacctgcgctactgtgacagcatcctgcgggagatgctgagcaagaagcacgccgcctatgcctggcccttctacaagcctgtggatgctgaggccctggagctgcatgactaccatgacatcatcaagcaccccatggacctgagcacagtgaagaggaagatggatggccgggagtacccagatgcccagggctttgctgctgatgtgcggctgatgttcagcaactgctacaagtacaaccccccagaccacgaggtggtggccatggccaggaagctgcaggatgtgtttgagatgagatttgccaagatgccagatgagcctgtggaggccccagccctgcctgccccagctgcccccatggtgtccaaaggagctgagagcagccgcagcagcgaggagagcagcagtgacagcggcagcagtgacagcgaggaggagcgggccacccggctggccgagctgcaggagcagctgaaggctgtgcatgagcagctggccgccctgagccaggcccctgtgaacaagcccaagaagaagaaggagaagaaggagaaggagaagaagaagaaggacaaggagaaggagaaggagaagcacaaggtgaaggccgaggaggagaagaaggccaaggtggcccccccagccaagcaggcccagcagaagaaggccccagccaagaaggccaacagcaccaccacagctggccgggaccacttcctgacctgtggggtgtag

SEQ ID NO: 15083 - DNA, 1671 bp, Artificial Sequence; identical to SEQ ID NO: 15082
  Description of Artificial Sequence: Synthetic coding sequence

SEQ ID NO: 15084 - DNA, 225 bp, Artificial Sequence
  Description of Artificial Sequence: Synthetic coding sequence
atgagcacagccaccaccgtggccccagctggcatcccagccaccccaggccctgtgaaccccccacctcctgaggtgagcaaccccagcaagccaggcaggaagaccaaccagctgcagtacatgcagaatgtggtggtgaagaccctgtggaagcaccagtttgcctggcccttctaccagcctgtggatgccatcaagctgaacctgcctgactaccactag

SEQ ID NO: 15085 - DNA, 63 bp, Artificial Sequence
  Description of Artificial Sequence: Synthetic coding sequence
atgagcacagccaccaccgtggccccagctggcatcccagccaccccaggccctgtgaactag

SEQ ID NO: 15086 - DNA, 1218 bp, Artificial Sequence
  Description of Artificial Sequence: Synthetic coding sequence
atgctgagcaagaagcatgctgcctatgcctggcccttctacaagcctgtggatgctgaggccctggagctgcatgactaccatgacatcatcaagcaccccatggacctgagcacagtgaagaggaagatggatggccgggagtacccagatgcccagggctttgctgctgatgtgcggctgatgttcagcaactgctacaagtacaaccccccagaccacgaggtggtggccatggccaggaagctgcaggatgtgtttgagatgagatttgccaagatgccagatgagcctgtggaggccccagccctgcctgccccagctgcccccatggtgtccaaaggagctgagagcagccgcagcagcgaggagagcagcagtgacagcggcagcagtgacagcgaggaggagcgggccacccggctggccgagctgcaggagcagctgaaggctgtgcatgagcagctggccgccctgagccaggcccctgtgaacaagcccaagaagaagaaggagaagaaggagaaggagaagaagaagaaggacaaggagaaggagaaggagaagcacaaggtgaaggccgaggaggagaagaaggccaaggtggcccccccagccaagcaggcccagcagaagaaggccccagccaagaaggccaacagcaccaccacagctggccggcagctgaagaagggcggcaagcaggccagcgccagctatgacagcgaggaggaggaggagggcctgcccatgtcctatgatgagaagaggcagctgagcctggacatcaaccggctgcctggagagaagctgggccgggtggtgcacatcatccagagccgggagcccagcctgcgggacagcaacccagatgaaattgaaattgactttgagaccctgaagcccaccaccctgcgggagctggagagatatgtgaagagctgcctgcagaagaagcagaggaagcccttcagcgccagcggcaagaagcaggccgccaagagcaaggaggagctggcccaggagaagaagaaggagctggagaagaggctgcaggatgtgtctggccagctgagcagcagcaagaagccagccaggaaggagaagccaggcagcgcccccagcggcggccccagccggctgagcagcagcagcagcagcgagagcggcagcagcagcagcagcggcagcagcagtgacagcagtgacagcgagtag

SEQ ID NO: 15087 - DNA, 1062 bp, Artificial Sequence
  Description of Artificial Sequence: Synthetic coding sequence
atggccgccaccaagaggaagaggcggggcggctttgctgtgcaggccaagaagcccaagagaaatgaaattgatgctgagcccccagccaagagacatgccacagctgaggaggtggaggaggaggagcgggaccgcatccctggccctgtgtgcaagggcaagtggaagaacaaggagcgcatcctgatcttcagcagccggggcatcaacttccgcaccaggcacctgatgcaggacctgaggatgctgatgccccacagcaaggctgacaccaagatggacaggaaggacaagctgtttgtgatcaatgaggtgtgtgagatgaagaactgcaacaagtgcatctactttgaggccaagaagaagcaggacctgtacatgtggctgagcaacagcccccacggccccagcgccaagttcctggtgcagaacatccacaccctggccgagctgaagatgactggaaactgcctgaagggcagccggcccctgctgagctttgatcctgcctttgatgagctgccccactacgccctgctgaaggagctgctgatccagatcttcagcaccccccgctaccaccccaagagccagccctttgtggaccacgtgttcaccttcaccatcctggacaaccgcatctggttcaggaacttccagatcattgaagaagatgctgccctggtggagatcggccccaggtttgtgctgaacctgatcaagatcttccagggcagctttggaggccccaccctgtatgagaacccccactaccagagccccaacatgcaccggcgggtcatccgcagcatcacagctgccaagtaccgggagaagcagcaggtgaaggatgtgcagaagctgaggaagaaggagcccaagaccctgctgccccatgaccccacagcagatgtgtttgtgaccccagctgaggagaagcccatcgagatccagtgggtgaagccagagcccaaggtggacctgaaggccaggaagaagaggatctacaagaggcagaggaagatgaagcagaggatggattctgggaagaccaagtag

SEQ ID NO: 15088 - DNA, 1428 bp, Artificial Sequence
  Description of Artificial Sequence: Synthetic coding sequence
atggccggccggccccacccctatgatggcaacagcagtgaccctgagaactgggacaggaagctgcacagccggcccaggaagctgtacaagcacagcagcaccagcagcagaattgccaagggcggcgtggaccacaccaagatgagcctgcacggggccagcggcggccacgagaggagccgggacagaagaagaagcagtgacaggagccgggacagcagccatgagaggacagagagccagctgaccccctgcatcagaaatgtgaccagccccacccggcagcaccacgtggagcgggagaaggaccacagcagcagccggcccagcagcccccggccccagaaggccagccccaacggcagcatcagcagcgctggcaacagcagcaggaacagcagccagagcagcagtgatggcagctgcaagacagctggggagatggtgtttgtgtatgaaaatgccaaggagggcgccaggaacatccgcaccagcgagcgggtgaccctcatcgtggacaacaccaggtttgtggtggaccccagcatcttcaccgcccagcccaacaccatgctgggccgcatgtttggaagtggccgggagcacaacttcacccggcccaatgaaaaaggagaatatgaggtggccgagggcatcggcagcacagtgttccgggccatcctggactactacaagacaggcatcatccgctgcccagatggcatcagcatccctgagctgcgggaggcctgtgactacctgtgcatcagctttgagtacagcaccatcaagtgccgggacctgagcgccctgatgcatgagctgagcaatgatggagcccggcggcagtttgagttctacctggaggagatgatcctgcccctgatggtggccagcgcccagagcggggagcgggagtgccacatcgtggtgctgacagatgatgatgtggtggactgggatgaggagtacccaccccagatgggagaggagtacagccagatcatctacagcaccaagctgtaccgcttcttcaagtacatcgagaacagagatgtggccaagtctgtgctgaaggagcggggcctgaagaagatccggctgggcatcgagggctaccccacctacaaggagaaggtgaagaagaggcctgggggccggcctgaggtgatctacaactacgtgcagaggcccttcatccgcatgtcctgggagaaggaggagggcaagagccgccacgtggacttccagtgtgtgaagagcaagagcatcaccaacctggccgctgctgctgctgacatcccccaggaccagctggtggtgatgcaccccaccccccaggtggatgagctggacatcctgcccatccaccccccatctggcaacagcgacctggaccctgatgcccagaaccccatgctgtag

SEQ ID NO: 15089 - DNA, 195 bp, Artificial Sequence
  Description of Artificial Sequence: Synthetic coding sequence
atggccggccggccccacccctatgatggcaacagcagtgaccctgagaactgggacaggaagctgcacagccggcccaggaagctgtacaagcacagcagcaccagcagcagaattgccaagggcggcgtggaccacaccaagatgagcctgcacggggccagcggcggccacgagaggagccgggacagatag

SEQ ID NO: 15090 - DNA, 201 bp, Artificial Sequence
  Description of Artificial Sequence: Synthetic coding sequence
atggccggccggccccacccctatgatggcaacagcagtgaccctgagaactgggacaggaagctgcacagccggcccaggaagctgtacaagcacagcagcaccagcagcagaattgccaagggcggcgtggaccacaccaagatgagcctgcacggggccagcggcggccacgagaggagccgggacagaagaagatag

SEQ ID NO: 15091 - DNA, 1137 bp, Artificial Sequence
  Description of Artificial Sequence: Synthetic coding sequence
atggcccgctgtggggagggcagcgctgcccccatggtgctgctgggcagcgctggggtgtgcagcaagggcctgcagaggaagggcccctgtgaaagaagaaggctgaaggccaccgtgtctgagcagctgagccaggacctgctgcggctgctgcgggaggagttccacacagatgtgaccttctctgtgggctgcaccctcttcaaggcccacaaggctgtgctgctggcccgggtgcctgacttctacttccacaccatcggccagaccagcaacagcctgaccaaccaggagcccatcgctgtggagaatgtggaggccctggagttccgcaccttcctgcagatcatctacagcagcaacagaaacatcaagaactatgaggaggagatcctgaggaagaagatcatggagatcggcatcagccagaagcagctggacatctccttccccaagtgtgagaacagcagtgactgcagcctgcagaagcatgagatccctgaggacatcagtgacagagatgatgacttcatcagcaatgacaactatgacctggagcccgccagcgagctgggggaggacctgctgaagctgtatgtgaagccctgctgcccagacatcgacatctttgtggatggcaagcgcttcaaggcccaccgggccatcctgagcgcccggagcagctactttgctgccatgctgagcggctgctgggccgagagcagccaggagtatgtgaccctgcagggcatcagccacgtggagctgaatgtgatgatgcacttcatctatggaggcaccctggacatcccagacaagaccaacgtgggccagatcctgaacatggctgacatgtatggcctggagggcctgaaggaggtggccatctacatcctgcggcgggactactgcaacttcttccagaagcctgtgcccaggaccctgaccagcatcctggagtgcctgatcatcgcccacagcgtgggcgtggagagcctgtttgctgactgcatgaagtggatcgtgaagcactttgcccgcttctggagcgagaggagctttgccaacatccccccagagatccagaagagctgcctgaacatgctgatccagagcctggtgtccatcacctag

SEQ ID NO: 15092 - DNA, 918 bp, Artificial Sequence
  Description of Artificial Sequence: Synthetic coding sequence
atggcccgctgtggggagggcagcgctgcccccatggtgctgctgggcagcgctggggtgtgcagcaagggcctgcagaggaagggcccctgtgaaagaagaaggctgaaggccaccgtgtctgagcagctgagccaggacctgctgcggctgctgcgggaggagttccacacagatgtgaccttctctgtgggctgcaccctcttcaaggcccacaaggctgtgctgctggcccgggtgcctgacttctacttccacaccatcggccagaccagcaacagcctgaccaaccaggagcccatcgctgtggagaatgtggaggccctggagttccgcaccttcctgcagatcatctacagcagcaacagaaacatcaagaactatgaggaggagatcctgaggaagaagatcatggagatcggcatcagccagaagcagctggacatctccttccccaagtgtgagaacagcagtgactgcagcctgcagaagcatgagatccctgaggacatcagtgacagagatgatgacttcatcagcaatgacaactatgacctggagcccgccagcgagctgggggaggacctgctgaagctgtatgtgaagccctgctgcccagacatcgacatctttgtggatggcaagcgcttcaaggcccaccgggccatcctgagcgcccggagcagctactttgctgccatgctgagcggctgctgggccgagagcagccaggagtatgtgaccctgcagggcatcagccacgtggagctgaatgtgatgatgcacttcatctatggaggcaccctggacatcccagacaagaccaacgtgggctacgtgttcctgttcaacaacctgaagtacaagagggtgcgcttctgctttgtggagctgtgctgcaaggtgctgatgaagtag

SEQ ID NO: 15093 - DNA, 852 bp, Artificial Sequence
  Description of Artificial Sequence: Synthetic coding sequence
atggcccgctgtggggagggcagcgctgcccccatggtgctgctgggcagcgctggggtgtgcagcaagggcctgcagaggaagggcccctgtgaaagaagaaggctgaaggccaccgtgtctgagcagctgagccaggacctgctgcggctgctgcgggaggagttccacacagatgtgaccttctctgtgggctgcaccctcttcaaggcccacaaggctgtgctgctggcccgggtgcctgacttctacttccacaccatcggccagaccagcaacagcctgaccaaccaggagcccatcgctgtggagaatgtggaggccctggagttccgcaccttcctgcagatcatctacagcagcaacagaaacatcaagaactatgaggaggagatcctgaggaagaagatcatggagatcggcatcagccagaagcagctggacatctccttccccaagtgtgagaacagcagtgactgcagcctgcagaagcatgagatccctgaggacatcagtgacagagatgatgacttcatcagcaatgacaactatgacctggagcccgccagcgagctgggggaggacctgctgaagctgtatgtgaagccctgctgcccagacatcgacatctttgtggatggcaagcgcttcaaggcccaccgggccatcctgagcgcccggagcagctactttgctgccatgctgagcggctgctgggccgagagcagccaggagtatgtgaccctgcagggcatcagccacgtggagctgaatgtgatgatgcacttcatctatggaggcaccctggacatcccagacaagaccaacgtgggcctcttccctgagcactag

SEQ ID NO: 15094 - DNA, 360 bp, Artificial Sequence
  Description of Artificial Sequence: Synthetic coding sequence
atggccggcctgatgaccatcgtgaccagcctgctcttcctgggcgtgtgtgcccaccacatcatccccaccggctctgtggtgatccccagcccctgctgcatgttctttgtgtccaagagaattcctgagaacagagtggtgtcctaccagctgagcagccgcagcacctgcctgaaggccggggtcatcttcaccaccaagaagggccagcagttctgtggggaccccaagcaggagtgggtgcagcgctacatgaagaacctggatgccaagcagaagaaggccagcccccgggcccgggctgtggccgtgaagggccctgtgcagcgctacccaggcaaccagaccacctgctag

SEQ ID NO: 15095 - DNA, 435 bp, Artificial Sequence
  Description of Artificial Sequence: Synthetic coding sequence
atgcccaaggtgaagaggagcaggaaggcccccccagatggctgggagctgattgagcccaccctggatgagctggaccagaagatgagggaggccgagacagagccccatgagggcaagaggaaggtggagagcctgtggcccatcttccgcatccaccaccagaagacccgctacatctttgacctcttctacaagaggaaggccatcagccgggagctgtatgagtactgcatcaaggagggctacgccgacaagaacctgattgccaagtggaagaagcagggctatgagaacctgtgctgcctgcgctgcatccagacccgggacaccaactttggcaccaactgcatctgccgggtgcccaagagcaagctggaggtgggccgcatcattgaatgtacccactgcggctgccggggctgcagcggctag

SEQ ID NO: 15096 - DNA, 312 bp, Artificial Sequence
  Description of Artificial Sequence: Synthetic coding sequence
atgcccaaggtgaagaggagcaggaaggcccccccagatggctgggagctgattgagcccaccctggatgagctggaccagaagatgagggaggagctgtatgagtactgcatcaaggagggctatgctgacaagaacctgattgccaagtggaagaagcagggctatgagaacctgtgctgcctgcgctgcatccagacccgggacaccaactttggcaccaactgcatctgccgggtgcccaagagcaagctggaggtgggccgcatcatcgagtgcacccactgcggctgccggggctgcagcggctag

SEQ ID NO: 15097 - DNA, 1527 bp, Artificial Sequence
  Description of Artificial Sequence: Synthetic coding sequence
atgatctatgaggagagcaagatgaacctggagcaggagcggccctttgtgtgcagcgcccctggctgcagccagcgcttccccacagaggaccacctgatgatccaccgccacaagcatgagatgaccctgaagttccccagcatcaagacagacaacatgctgagtgaccagacccccacccccacccgcttcctgaagaactgtgaggaggtgggcctcttcagcgagctggactgcagcctggagcacgagttcaggaaggcccaggaggaggagagcagcaagaggaacatctccatgcacaatgctgtgggcggggccatgacaggccctggcacccaccagctgagcagcgcccggctgcccaaccacgacaccaacgtggtgatccagcaggccatgcccagcccccagagcagcagcgtcatcacccaggcccccagcaccaaccggcagatcggccctgtgcccggcagcctgagcagcctgctgcacctgcacaaccggcagaggcagcccatgcctgcctccatgcctggcaccctgcccaaccccaccatgcctggcagcagcgctgtgctgatgcccatggagcggcagatgtctgtgaacagcagcatcatgggcatgcagggccccaacctgagcaacccctgtgccagcccccaggtgcagcccatgcacagcgaggccaagatgaggctgaaggccgccctgacccaccaccctgctgccatgagcaatggaaacatgaacaccatgggccacatgatggagatgatgggcagccggcaggaccagaccccccaccaccacatgcacagccacccccaccagcaccagaccctgcccccccaccacccctacccccaccagcaccagcacccagcccaccacccccacccccagccccaccaccagcagaaccacccccaccaccacagccacagccacctgcacgcccacccagcccaccaccagaccagcccccacccccccctgcacactggaaaccaggcccaggtgtccccagccacccagcagatgcagcccacccagaccatccagcccccccagcccaccggcggcagaagaagaagagtggtggatgaggaccctgatgaaagaagaaggaagttcctggagaggaacagagctgctgccacccgctgccggcagaagaggaaggtgtgggtgatgagcctggagaagaaggccgaggagctgacccagaccaacatgcagctgcagaatgaggtgtccatgctgaagaatgaggtggcccagctgaagcagctgctgctgacccacaaggactgccccatcacagccatgcagaaggagagccagggctacctgagccctgagagcagccccccagccagccctgtgcctgcctgcagccagcagcaggtgatccagcacaacaccatcaccaccagcagctctgtgtctgaggtggtgggcagcagcaccctgagccagctgaccacccacaggacagacctgaaccccatcctgtag

SEQ ID NO: 15098 - DNA, 1110 bp, Artificial Sequence
  Description of Artificial Sequence: Synthetic coding sequence
atgttctgcaccagcggcggcaacagcgcctctgtgatgtccatgaggcctgtgcccggcagcctgagcagcctgctgcacctgcacaaccggcagaggcagcccatgcctgcctccatgcctggcaccctgcccaaccccaccatgcctggcagcagcgctgtgctgatgcccatggagcggcagatgtctgtgaacagcagcatcatgggcatgcagggccccaacctgagcaacccctgtgccagcccccaggtgcagcccatgcacagcgaggccaagatgaggctgaaggccgccctgacccaccaccctgctgccatgagcaatggaaacatgaacaccatgggccacatgatggagatgatgggcagccggcaggaccagaccccccaccaccacatgcacagccacccccaccagcaccagaccctgcccccccaccacccctacccccaccagcaccagcacccagcccaccacccccacccccagccccaccaccagcagaaccacccccaccaccacagccacagccacctgcacgcccacccagcccaccaccagaccagcccccacccccccctgcacacaggcaaccaggcccaggtgtccccagccacccagcagatgcagcccacccagaccatccagcccccccagcccactggaggaagaagaagaagagtggtggatgaagatcctgatgagaggaggaggaagttcctggagaggaacagagctgctgccacccgctgccggcagaagaggaaggtgtgggtgatgagcctggagaagaaggccgaggagctgacccagaccaacatgcagctgcagaatgaggtgtccatgctgaagaatgaggtggcccagctgaagcagctgctgctgacccacaaggactgccccatcacagccatgcagaaggagagccagggctacctgagccctgagagcagccccccagccagccctgtgcctgcctgcagccagcagcaggtgatccagcacaacaccatcaccaccagcagctctgtgtctgaggtggtgggcagcagcaccctgagccagctgaccacccacaggacagacctgaaccccatcctgtag

SEQ ID NO: 15099 - DNA, 1428 bp, Artificial Sequence
  Description of Artificial Sequence: Synthetic coding sequence
atgatccaccgccacaagcatgagatgaccctgaagttccccagcatcaagacagacaacatgctgagtgaccagacccccacccccacccgcttcctgaagaactgtgaggaggtgggcctcttcagcgagctggactgcagcctggagcacgagttcaggaaggcccaggaggaggagagcagcaagaggaacatctccatgcacaatgctgtgggcggggccatgactggacctggcacccaccagctgagcagcgcccggctgcccaaccacgacaccaacgtggtgatccagcaggccatgcccagcccccagagcagcagcgtcatcacccaggcccccagcaccaaccggcagatcggccctgtgcccggcagcctgagcagcctgctgcacctgcacaaccggcagaggcagcccatgcctgcctccatgcctggcaccctgcccaaccccaccatgcctggcagcagcgctgtgctgatgcccatggagcggcagatgtctgtgaacagcagcatcatgggcatgcagggccccaacctgagcaacccctgtgccagcccccaggtgcagcccatgcacagcgaggccaagatgaggctgaaggccgccctgacccaccaccctgctgccatgagcaatggaaacatgaacaccatgggccacatgatggagatgatgggcagccggcaggaccagaccccccaccaccacatgcacagccacccccaccagcaccagaccctgcccccccaccacccctacccccaccagcaccagcacccagcccaccacccccacccccagccccaccaccagcagaaccacccccaccaccacagccacagccacctgcacgcccacccagcccaccaccagaccagcccccacccccccctgcacacaggcaaccaggcccaggtgtccccagccacccagcagatgcagcccacccagaccatccagcccccccagcccactggaggaagaagaagaagagtggtggatgaagatcctgatgagaggaggaggaagttcctggagaggaacagagctgctgccacccgctgccggcagaagaggaaggtgtgggtgatgagcctggagaagaaggccgaggagctgacccagaccaacatgcagctgcagaatgaggtgtccatgctgaagaatgaggtggcccagctgaagcagctgctgctgacccacaaggactgccccatcacagccatgcagaaggagagccagggctacctgagccctgagagcagccccccagccagccctgtgcctgcctgcagccagcagcaggtgatccagcacaacaccatcaccaccagcagctctgtgtctgaggtggtgggcagcagcaccctgagccagctgaccacccacaggacagacctgaaccccatcctgtag

SEQ ID NO: 15100 - DNA, 1506 bp, Artificial Sequence
  Description of Artificial Sequence: Synthetic coding sequence
atgaacctggagcaggagcggccctttgtgtgcagcgcccctggctgcagccagcgcttccccacagaggaccacctgatgatccaccgccacaagcatgagatgaccctgaagttccccagcatcaagacagacaacatgctgagtgaccagacccccacccccacccgcttcctgaagaactgtgaggaggtgggcctcttcagcgagctggactgcagcctggagcacgagttcaggaaggcccaggaggaggagagcagcaagaggaacatctccatgcacaatgctgtgggcggggccatgactggacctggcacccaccagctgagcagcgcccggctgcccaaccacgacaccaacgtggtgatccagcaggccatgcccagcccccagagcagcagcgtcatcacccaggcccccagcaccaaccggcagatcggccctgtgcccggcagcctgagcagcctgctgcacctgcacaaccggcagaggcagcccatgcctgcctccatgcctggcaccctgcccaaccccaccatgcctggcagcagcgctgtgctgatgcccatggagcggcagatgtctgtgaacagcagcatcatgggcatgcagggccccaacctgagcaacccctgtgccagcccccaggtgcagcccatgcacagcgaggccaagatgaggctgaaggccgccctgacccaccaccctgctgccatgagcaatggaaacatgaacaccatgggccacatgatggagatgatgggcagccggcaggaccagaccccccaccaccacatgcacagccacccccaccagcaccagaccctgcccccccaccacccctacccccaccagcaccagcacccagcccaccacccccacccccagccccaccaccagcagaaccacccccaccaccacagccacagccacctgcacgcccacccagcccaccaccagaccagcccccacccccccctgcacacaggcaaccaggcccaggtgtccccagccacccagcagatgcagcccacccagaccatccagcccccccagcccactggaggaagaagaagaagagtggtggatgaagatcctgatgagaggaggaggaagttcctggagaggaacagagctgctgccacccgctgccggcagaagaggaaggtgtgggtgatgagcctggagaagaaggccgaggagctgacccagaccaacatgcagctgcagaatgaggtgtccatgctgaagaatgaggtggcccagctgaagcagctgctgctgacccacaaggactgccccatcacagccatgcagaaggagagccagggctacctgagccctgagagcagccccccagccagccctgtgcctgcctgcagccagcagcaggtgatccagcacaacaccatcaccaccagcagctctgtgtctgaggtggtgggcagcagcaccctgagccagctgaccacccacaggacagacctgaaccccatcctgtag

SEQ ID NO: 15101 - DNA, 1428 bp, Artificial Sequence; identical to SEQ ID NO: 15099
  Description of Artificial Sequence: Synthetic coding sequence

SEQ ID NO: 15102 - DNA, 348 bp, Artificial Sequence
  Description of Artificial Sequence: Synthetic coding sequence
atgaacctggagcaggagcggccctttgtgtgcagcgcccctggctgcagccagcgcttccccacagaggaccacctgatgatccaccgccacaagcatgagatgaccctgaagttccccagcatcaagacagacaacatgctgagtgaccagacccccacccccacccgcttcctgaagaactgtgaggaggtgggcctcttcagcgagctggactgcagcctggagcacgagttcaggaaggcccaggaggaggagagcagcaagaggaacatctccatgcacaatgctgtgggcggggccatgactggacctggcacccaccagctgagcagcgcccggctgtag

SEQ ID NO: 15103 - DNA, 453 bp, Artificial Sequence
  Description of Artificial Sequence: Synthetic coding sequence
atgagcaagatcagccagcagaacagcaccccaggagtgaatggcatcagcgtcatccacacccaggcccacgccagcggcctgcagcaggtgccccagctggtgcctgctggccctgggggcggcggcaaggctgtggcccccagcaagcagagcaagaagagcagccccatggacaggaacagtgatgagtaccggcagaggcgggagaggaacaacatggctgtgaagaagagccggctgaagagcaagcagaaggcccaggacaccctgcagagggtgaaccagctgaaggaggagaatgaaaggctggaggccaagatcaagctgctgaccaaggagctgtctgtgctgaaggacctcttcctggagcacgcccacaacctggccgacaacgtgcagagcatcagcacagagaacaccacagcagatggagacaatgccggccagtag

SEQ ID NO: 15104 - DNA, 1509 bp, Artificial Sequence
  Description of Artificial Sequence: Synthetic coding sequence
atggagaccctgcaggagagcctgaacaccctgctgaagcagctggaggaggagaagaagaccctggagagccaggtgaagtactatgccctgaagctggagcaggagagcaaggcctaccagaagatcaacaatgaaagaaggacctacctggccgagatgagccagggcagcggcctgcaccaggtgtccaagaggcagcaggtggaccagctgcccaggatgcaggagaacctggtgaagaccctgctgctgaaggaggagctggaccccctgaaggccaagattgacatcctgctggtgggagatgtgacagtgggctacctggccgacacagtgcagaagctgtttgccaacattgctgaggtgaccatcaccatcagtgacaccaaggaggccgccgccctgctggatgactgcatcttcaacatggtgctgctgaaggtgcccagcagcctgtctgctgaggagctggaggccatcaagctgatccgctttgggaagaagaagaacacccacagcctgtttgtgttcatcatccctgagaacttcaagggctgcatcagcggccacggcatggacatcgccctgacagagcccctgaccatggagaagatgagcaatgtggtgaagtactggaccacctgccccagcaacacagtgaagacagaaaatgccactggacctgaggagctgggcctgcccctgcagaggagctacagcgagcacctgggctacttccccacagacctgtttgcctgcagcgagagcctgagaaatggaaatggcctggagctgaatgccagcctgtctgaatttgagaagaacaagaagatcagcctgctgcacagcagcaaggagaagctgcggcgggagcgcatcaagtactgctgtgagcagctgcggaccctgctgccctacgtgaagggcaggaagaatgatgctgcctctgtgctggaggccaccgtggactatgtgaagtacatccgggagaagatcagccctgctgtgatggcccagatcacagaggccctgcagagcaacatgaggttctgcaagaagcagcagacccccatcgagctgagcctgcccggcaccgtgatggcccagcgggagaacagcgtgatgagcacctacagccctgagcggggcctgcagttcctgaccaacacctgctggaatggctgcagcaccccagatgctgagagcagcctggatgaggccgtgcgggtgcccagcagcagcgcctctgaaaatgccatcggggacccctacaagacccacatcagcagcgctgccctgagcctgaacagcctgcacacagtgcgctactacagcaaggtgacccccagctatgatgccacagctgtgaccaaccagaacatcagcatccacctgcccagcgccatgcctcctgtgtccaagctgctgcccaggcactgcaccagcggcctgggccagacctgcaccacccaccccaactgcctgcagcagttctgggcctactag

SEQ ID NO: 15105 - DNA, 1533 bp, Artificial Sequence
  Description of Artificial Sequence: Synthetic coding sequence
atggaggagccccaggccggagatgctgcccgcttcagctgcccccccaacttcaccgccaagcccccagccagcgagagcccccgcttcagcctggaggccctgaccggccctgacacagagctgtggctgatccaggccccagctgactttgcccctgagtgcttcaacggccgccacgtgcccctgagcggcagccagatcgtgaagggcaagctggccggcaagaggcaccgctacagagtgctgagcagctgcccccaggccggggaggccaccctgctggcccccagcacagaagctgggggcggcctgacctgtgccagcgccccccagggcaccctgcgcatcctggagggcccccagcagagcctgagcggcagccccctgcagcccatcccagccagccccccaccccagatccccccaggcctgcggccccgcttctgtgccttcggcggcaacccccctgtgacaggccccaggtctgccctggcccccaacctgctgaccagcggcaagaagaagaaggagatgcaggtgacagaggcccctgtgacccaggaggccgtgaatggccacggggccctggaggtggacatggccctgggcagccctgagatggatgtgaggaagaagaagaagaagaagaaccagcagctgaaggagcctgaggccgccggccctgtgggcacagagcccaccgtggagaccctggagcccctgggcgtgctcttccccagcaccaccaagaagaggaagaagcccaagggcaaggagacctttgagcctgaggacaagacagtgaagcaggagcagatcaacacagagcccctggaggacacagtgctgagccccaccaagaagaggaagaggcagaagggcacagagggcatggagcctgaggagggcgtgacagtggagagccagccccaggtgaaggtggagcccctggaggaggccatccccctgccccccaccaagaagaggaagaaggagaagggccagatggccatgatggagcccggcacagaggccatggagcctgtggagcctgagatgaagcccctggagagccctgggggcaccatggccccccagcagcctgagggcgccaagccccaggcccaggccgccctggccgcccccaagaagaagaccaagaaggagaagcagcaggatgccaccgtggagcctgagacagaggtggtgggccctgagctgcctgatgacctggagccccaggccgcccccaccagcaccaagaagaagaagaagaagaaggagcggggccacacagtgacagagcccatccagcccctggagcctgagctgcccggggagggccagcctgaggcccgggccaccccaggcagcaccaagaagaggaagaagcagagccaggagagcaggatgcctgagaccgtgccccaggaggagatgcctggcccccccctgaacagcgagagcggggaggaggcccccaccggccgggacaagaagaggaagcagcagcagcagcagcctgtgtag

SEQ ID NO: 15106 - DNA, 1446 bp, Artificial Sequence
  Description of Artificial Sequence: Synthetic coding sequence
atgaggcacagcaagaggacccactgcccagactgggacagccgggagagctggggccacgagagctaccggggcagccacaagaggaagagaagaagccacagcagcacccaggagaacagacactgcaagccccaccaccagttcaaggagagtgactgccactacctggaggcccggagcctgaatgaaagagactacagagaccggcgctacgtggatgagtacagaaatgactactgtgagggctacgtgcccaggcactaccaccgggacattgaaagtggctaccgcatccactgcagcaagagctctgtgcgcagcagaagaagcagccccaagaggaagaggaacagacactgcagcagccaccagagccgcagcaagagccacaggaggaagaggagccgcagcattgaagatgatgaggagggccacctgatctgccagagcggagatgtgctgcgggcccgctatgaaattgtggacaccctgggggagggcgccttcggcaaggtggtggagtgcatcgaccacggcatggatggcatgcacgtggccgtgaagatcgtgaagaatgtgggccgctaccgggaggccgcccggtctgagatccaggtgctggagcacctgaacagcacagaccccaacagcgtcttccgctgtgtgcagatgctggagtggtttgaccaccacggccacgtgtgcatcgtgtttgagctgctgggcctgagcacctatgacttcatcaaggagaacagcttcctgcccttccagattgaccacatccggcagatggcctaccagatctgccagagcatcaacttcctgcaccacaacaagctgacccacacagacctgaagccagagaacatcctgtttgtgaagagtgactatgtggtgaagtacaacagcaagatgaagagagatgagaggaccctgaagaacacagacatcaaggtggtggactttggcagcgccacctatgatgatgagcaccacagcaccctggtgtccaccaggcactaccgggcccctgaggtgatcctggccctgggctggagccagccctgtgatgtgtggagcatcggctgcatcctgattgagtactacctgggcttcaccgtcttccagacccatgacagcaaggagcacctggccatgatggagcgcatcctgggccccatcccccagcacatgatccagaagaccaggaagaggaagtacttccaccacaaccagctggactgggatgagcacagcagcgctggccgctacgtgagaagacgctgcaagcccctgaaggagttcatgctgtgccatgatgaggagcacgagaagctgtttgacctggtgcggaggatgctggagtatgaccccacccagaggatcaccctggatgaggccctgcagcaccccttctttgacctgctgaagaagaagtag

SEQ ID NO: 15107 - DNA, 165 bp, Artificial Sequence
  Description of Artificial Sequence: Synthetic coding sequence
atgaggcacagcaagaggacccactgcccagactgggacagccgggagagctggggccacgagagctaccggggcagccacaagaggaagagaagaagccacagcagcacccaggagaacagacactgcaagccccaccaccagttcaaggagagtgactggtag

SEQ ID NO: 15108 - DNA, 162 bp, Artificial Sequence
  Description of Artificial Sequence: Synthetic coding sequence
atgaggcacagcaagaggacccactgcccagactgggacagccgggagagctggggccacgagagctaccggggcagccacaagaggaagagaagaagccacagcagcacccaggagaacagacactgcaagccccaccaccagttcaaggagagtgactag

SEQ ID NO: 15109 - DNA, 432 bp, Artificial Sequence
  Description of Artificial Sequence: Synthetic coding sequence
atgaggcacagcaagaggacccactgcccagactgggacagccgggagagctggggccacgagagctaccggggcagccacaagaggaagagaagaagccacagcagcacccaggagaacagacactgcaagccccaccaccagttcaaggagagtgactgccactacctggaggcccggagcctgaatgaaagagactacagagaccggcgctacgtggatgagtacagaaatgactactgtgagggctacgtgcccaggcactaccaccgggacattgaaagtggctaccgcatccactgcagcaagagctctgtgcgcagcagaagaagcagccccaagaggaagaggaacagacactgcagcagccaccagagccgctccatgaagtcctggaccctgtgggtgaaggagcccctggccaagctgtag

SEQ ID NO: 15110 - DNA, 270 bp, Artificial Sequence
  Description of Artificial Sequence: Synthetic coding sequence
atgaggcacagcaagaggacccactgcccagactgggacagccgggagagctggggccacgagagctaccggggcagccacaagaggaagagaagaagccacagcagcacccaggagaacagacactgcaagccccaccaccagttcaaggagagtgactggacctgtgtggacatcaagaccaatgccctgaccctcatccggctgggctacctgaagggctacagcgagatcttcaccggccacagcgtggacatcctgaagaactag

SEQ ID NO: 15111 - DNA, 1122 bp, Artificial Sequence
  Description of Artificial Sequence: Synthetic coding sequence
atgaggcacagcaagaggacccactgcccagactgggacagccgggagagctggggccacgagagctaccggggcagccacaagaggaagagaagaagccacagcagcacccaggagaacagacactgcaagccccaccaccagttcaaggagagtgactgccactacctggaggcccggagcctgaatgaaagagactacagagaccggcgctacgtggatgagtacagaaatgactactgtgagggctacgtgcccaggcactaccaccgggacattgaaagtggctaccgcatccactgcagcaagagctctgtgcgcagcagaagaagcagccccaagaggaagaggaacagacactgcagcagccaccagagccgcagcaagagccacaggaggaagaggagccgcagcattgaagatgatgaggagggccacctgatctgccagagcggagatgtgctgcgggcccgctatgaaattgtggacaccctgggggagggcgccttcggcaaggtggtggagtgcatcgaccacggcatggatggcatgcacgtggccgtgaagatcgtgaagaatgtgggccgctaccgggaggccgcccggtctgagatccaggtgctggagcacctgaacagcacagaccccaacagcgtcttccgctgtgtgcagatgctggagtggtttgaccaccacggccacgtgtgcatcgtgtttgagctgctgggcctgagcacctatgacttcatcaaggagaacagcttcctgcccttccagattgaccacatccggcagatggcctaccagatctgccagagcatcaacttcctgcaccacaacaagctgacccacacagacctgaagccagagaacatcctgtttgtgaagagtgactatgtggtgaagtacaacagcaagatgaagagagatgagcacagcagcgctggccgctacgtgagaagacgctgcaagcccctgaaggagttcatgctgtgccatgatgaggagcacgagaagctgtttgacctggtgcggaggatgctggagtatgaccccacccagaggatcaccctggatgaggccctgcagcaccccttctttgacctgctgaagaagaagtag

SEQ ID NO: 15112 - DNA, 2613 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggctgtgtcccggggcctgcccccccagcagccccagcagcccctgctgaacctgcagggcaccaacagcgccagcctgctgaatggctccatgctgcagagggccctgctgctgcagcagctgcagggcctggaccagtttgccatgcccccagccacctatgacacagctggcctgaccatgcccacagccaccctgggcaacctgcggggctacggcatggccagccctggcctggccgcccccagcctgaccccaccccagctggccacccccaacctgcagcagttcttcccccaggccacccggcagagcctgctgggccccccacctgtgggcgtgcccatgaaccccagccagttcaacctgtctggaagaaacccccagaagcaggcccggaccagcagcagcaccacccccaacaggaaggacagcagcagccagaccatgcctgtggaggacaagagtgaccccccagagggcagcgaggaggccgctgagcccaggatggacaccccagaggaccaggacctgcccccctgcccagaggacatcgccaaggagaagaggaccccagcccctgagcctgagccctgtgaggccagcgagctgcctgccaagaggctgcggagcagcgaggagcccacagagaaggagcccccaggccagctgcaggtgaaggcccagccccaggccaggatgacagtgcccaagcagacccagaccccagacctgctgcctgaggccctggaggcccaggtgctgccccgcttccagccccgggtgctgcaggtgcaggcccaggtgcagagccagacccagccccgcatccccagcacagacacccaggtgcagcccaagctgcagaagcaggcccagacccagaccagccctgagcacctggtgctgcagcagaagcaggtgcagccccagctgcagcaggaggccgagccccagaagcaggtgcagccccaggtgcagccccaggcccacagccagggcccccggcaggtgcagctgcagcaggaggccgagcccctgaagcaggtgcagccccaggtgcacacccaggcccagcccagcgtgcagccccaggagcaccccccagcccaggtgtctgtgcagcccccagagcagacccatgagcagccccacacccagccccaggtgtccctgctggcccctgagcagacccctgtggtggtgcacgtgtgtggcctggagatgcccccagatgctgtggaggccggcggcggcatggagaagaccctgcctgagcctgtgggcacccaggtgtccatggaggagatccagaatgaaagtgcctgtggcctggatgtgggggagtgtgagaacagagcccgggagatgcctggggtgtggggcgctgggggcagcctgaaggtgaccatcctgcagagcagtgacagccgggccttcagcacagtgcccctgacccctgtgccccggcccagcgacagcgtgagcagcaccccagctgccaccagcacccccagcaagcaggccctgcagttcttctgctacatctgcaaggccagctgcagcagccagcaggagttccaggaccacatgtctgagccccagcaccagcagaggctgggggagatccagcacatgagccaggcctgcctgctgagcctgctgcctgtgcccagagatgtgctggagacagaagatgaggagcccccaccccggcgctggtgcaacacctgccagctgtactacatgggagacctgatccagcacaggaggacccaggaccacaagatcgccaagcagagcctgcggcccttctgcaccgtgtgcaaccgctacttcaagacccccaggaagtttgtggagcacgtgaagagccagggccacaaggacaaggccaaggagctgaagagcctggagaaggagattgctggccaggatgaggaccacttcatcaccgtggatgctgtgggctgctttgaaggagatgaggaggaggaggaggatgatgaagatgaggaggagattgaggtggaggaggagctgtgcaagcaggtgcgcagccgggacatcagccgggaggagtggaagggcagcgagacctacagccccaacacagcctacggcgtggacttcctggtgcctgtgatgggctacatctgccgcatctgccacaagttctaccacagcaacagcggggcccagctgagccactgcaagagcctgggccactttgagaacctgcagaagtacaaggccgccaagaaccccagccccaccaccaggcctgtgagccgccgctgtgccatcaatgccagaaatgccctgacagccctcttcaccagcagcggccggccccccagccagcccaacacccaggacaagacccccagcaaggtgacagcccggcccagccagccccccctgcccaggaggagcacccggctgaagacctag

SEQ ID NO: 15113 - DNA, 759 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggctgtgtcccggggcctgcccccccagcagccccagcagcccctgctgaacctgcagggcaccaacagcgccagcctgctgaatggctccatgctgcagagggccctgctgctgcagcagctgcagggcctggaccagtttgccatgcccccagccacctatgacacagctggcctgaccatgcccacagccaccctgggcaacctgcggggctacggcatggccagccctggcctggccgcccccagcctgaccccaccccagctggccacccccaacctgcagcagttcttcccccaggccacccggcagagcctgctgggccccccacctgtgggcgtgcccatgaaccccagccagttcaacctgtctggaagaaacccccagaagcaggcccggaccagcagcagcaccacccccaacaggaaggacagcagcagccagaccatgcctgtggaggacaagagtgaccccccagagggcagcgaggaggccgctgagcccaggatggacaccccagaggaccaggacctgcccccctgcccagaggacatcgccaaggagaagaggaccccagcccctgagcctgagccctgctag

SEQ ID NO: 15114 - DNA, 2610 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggctgtgtcccggggcctgcccccccagcagccccagcagcccctgctgaacctgcagggcaccaacagcgccagcctgctgaatggctccatgctgcagagggccctgctgctgcagcagctgcagggcaacctgcggggctacggcatggccagccctggcctggccgcccccagcctgaccccaccccagctggccacccccaacctgcagcagttcttcccccaggccacccggcagagcctgctgggccccccacctgtgggcgtgcccatgaaccccagccagttcaacctgtctggaagaaacccccagaagcaggcccggaccagcagcagcaccacccccaacaggaagaccatgcctgtggaggacaagagtgaccccccagagggcagcgaggaggccgctgagcccaggatggacaccccagaggaccaggacctgcccccctgcccagaagatattgccaaggagaagaggaccccagcccctgagcctgagccctgtgaggccagcgagctgcctgccaagaggctgcggagcagcgaggagcccacagagaaggagcccccaggccagctgcaggtgaaggcccagccccaggccaggatgacagtgcccaagcagacccagaccccagacctgctgcctgaggccctggaggcccaggtgctgccccgcttccagccccgggtgctgcaggtgcaggcccaggtgcagagccagacccagccccgcatccccagcacagacacccaggtgcagcccaagctgcagaagcaggcccagacccagaccagccctgagcacctggtgctgcagcagaagcaggtgcagccccagctgcagcaggaggccgagccccagaagcaggtgcagccccaggtgcagccccaggcccacagccagggcccccggcaggtgcagctgcagcaggaggccgagcccctgaagcaggtgcagccccaggtgcagccccaggcccacagccagcccccccggcaggtgcagctgcagctgcagaagcaggtgcagacccagacctacccccaggtgcacacccaggcccagcccagcgtgcagccccaggagcaccccccagcccaggtgtctgtgcagcccccagagcagacccatgagcagccccacacccagccccaggtgtccctgctggcccctgagcagacccctgtggtggtgcacgtgtgtggcctggagatgcccccagatgctgtggaggccggcggcggcatggagaagaccctgcctgagcctgtgggcacccaggtgtccatggaggagatccagaatgaaagtgcctgtggcctggatgtgggagaatgtgaaaatagagcccgggagatgcctggggtgtggggcgccggcggcagcctgaaggtgaccatcctgcagagcagtgacagccgggccttcagcacagtgcccctgacccctgtgccccggcccagcgacagcgtgagcagcaccccagctgccaccagcacccccagcaagcaggccctgcagttcttctgctacatctgcaaggccagctgcagcagccagcaggagttccaggaccacatgtctgagccccagcaccagcagaggctgggggagatccagcacatgagccaggcctgcctgctgagcctgctgcctgtgcccagagatgtgctggagacagaagatgaggagcccccaccccggcgctggtgcaacacctgccagctgtactacatgggagacctgatccagcacaggaggacccaggaccacaagatcgccaagcagagcctgcggcccttctgcaccgtgtgcaaccgctacttcaagacccccaggaagtttgtggagcacgtgaagagccagggccacaaggacaaggccaaggagctgaagagcctggagaaggagattgctggccaggatgaggaccacttcatcaccgtggatgctgtgggctgctttgaaggagatgaggaggaggaggaggatgatgaagatgaggaggagattgaggtggaggaggagctgtgcaagcaggtgcgcagccgggacatcagccgggaggagtggaagggcagcgagacctacagccccaacacagcctatggagtggacttcctggtgcctgtgatgggctacatctgccgcatctgccacaagttctaccacagcaacagcggggcccagctgagccactgcaagagcctgggccactttgagaacctgcagaagtacaaggccgccaagaaccccagccccaccaccaggcctgtgtccagaagatgtgccatcaatgccagaaatgccctgacagccctcttcaccagcagcggccggccccccagccagcccaacacccaggacaagacccccagcaaggtgacagcccggcccagccagccccccctgccccggcgcagcacccggctgaagacctag

SEQ ID NO: 15115 - DNA, 2613 bp, Artificial Sequence; identical to SEQ ID NO: 15112
  Description of Artificial Sequence: Synthetic coding sequence

SEQ ID NO: 15116 - DNA, 2697 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggctgtgtcccggggcctgcccccccagcagccccagcagcccctgctgaacctgcagggcaccaacagcgccagcctgctgaatggctccatgctgcagagggccctgctgctgcagcagctgcagggcctggaccagtttgccatgcccccagccacctatgacacagctggcctgaccatgcccacagccaccctgggcaacctgcggggctacggcatggccagccctggcctggccgcccccagcctgaccccaccccagctggccacccccaacctgcagcagttcttcccccaggccacccggcagagcctgctgggccccccacctgtgggcgtgcccatgaaccccagccagttcaacctgtctggaagaaacccccagaagcaggcccggaccagcagcagcaccacccccaacaggaaggacagcagcagccagaccatgcctgtggaggacaagagtgaccccccagagggcagcgaggaggccgctgagcccaggatggacaccccagaggaccaggacctgcccccctgcccagaggacatcgccaaggagaagaggaccccagcccctgagcctgagccctgtgaggccagcgagctgcctgccaagaggctgcggagcagcgaggagcccacagagaaggagcccccaggccagctgcaggtgaaggcccagccccaggccaggatgacagtgcccaagcagacccagaccccagacctgctgcctgaggccctggaggcccaggtgctgccccgcttccagccccgggtgctgcaggtgcaggcccaggtgcagagccagacccagccccgcatccccagcacagacacccaggtgcagcccaagctgcagaagcaggcccagacccagaccagccctgagcacctggtgctgcagcagaagcaggtgcagccccagctgcagcaggaggccgagccccagaagcaggtgcagccccaggtgcagccccaggcccacagccagggcccccggcaggtgcagctgcagcaggaggccgagcccctgaagcaggtgcagccccaggtgcagccccaggcccacagccagcccccccggcaggtgcagctgcagctgcagaagcaggtgcagacccagacctacccccaggtgcacacccaggcccagcccagcgtgcagccccaggagcaccccccagcccaggtgtctgtgcagcccccagagcagacccatgagcagccccacacccagccccaggtgtccctgctggcccctgagcagacccctgtggtggtgcacgtgtgtggcctggagatgcccccagatgctgtggaggccggcggcggcatggagaagaccctgcctgagcctgtgggcacccaggtgtccatggaggagatccagaatgaaagtgcctgtggcctggatgtgggggagtgtgagaacagagcccgggagatgcctggggtgtggggcgctgggggcagcctgaaggtgaccatcctgcagagcagtgacagccgggccttcagcacagtgcccctgacccctgtgccccggcccagcgacagcgtgagcagcaccccagctgccaccagcacccccagcaagcaggccctgcagttcttctgctacatctgcaaggccagctgcagcagccagcaggagttccaggaccacatgtctgagccccagcaccagcagaggctgggggagatccagcacatgagccaggcctgcctgctgagcctgctgcctgtgcccagagatgtgctggagacagaagatgaggagcccccaccccggcgctggtgcaacacctgccagctgtactacatgggagacctgatccagcacaggaggacccaggaccacaagatcgccaagcagagcctgcggcccttctgcaccgtgtgcaaccgctacttcaagacccccaggaagtttgtggagcacgtgaagagccagggccacaaggacaaggccaaggagctgaagagcctggagaaggagattgctggccaggatgaggaccacttcatcaccgtggatgctgtgggctgctttgaaggagatgaggaggaggaggaggatgatgaagatgaggaggagattgaggtggaggaggagctgtgcaagcaggtgcgcagccgggacatcagccgggaggagtggaagggcagcgagacctacagccccaacacagcctacggcgtggacttcctggtgcctgtgatgggctacatctgccgcatctgccacaagttctaccacagcaacagcggggcccagctgagccactgcaagagcctgggccactttgagaacctgcagaagtacaaggccgccaagaaccccagccccaccaccaggcctgtgagccgccgctgtgccatcaatgccagaaatgccctgacagccctcttcaccagcagcggccggccccccagccagcccaacacccaggacaagacccccagcaaggtgacagcccggcccagccagccccccctgcccaggaggagcacccggctgaagacctag

SEQ ID NO: 15117 - DNA, 1245 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggctgtgtcccggggcctgcccccccagcagccccagcagcccctgctgaacctgcagggcaccaacagcgccagcctgctgaatggctccatgctgcagagggccctgctgctgcagcagctgcagggcaacctgcggggctacggcatggccagccctggcctggccgcccccagcctgaccccaccccagctggccacccccaacctgcagcagttcttcccccaggccacccggcagagcctgctgggccccccacctgtgggcgtgcccatgaaccccagccagttcaacctgtctggaagaaacccccagaagcaggcccggaccagcagcagcaccacccccaacaggaaggacagcagcagccagaccatgcctgtggaggacaagagtgaccccccagagggcagcgaggaggccgctgagcccaggatggacaccccagaggaccaggacctgcccccctgcccagaggacatcgccaaggagaagaggaccccagcccctgagcctgagccctgtgaggccagcgagctgcctgccaagaggctgcggagcagcgaggagcccacagagaaggagcccccaggccagctgcaggtgaaggcccagccccaggccaggatgacagtgcccaagcagacccagaccccagacctgctgcctgaggccctggaggcccaggtgctgccccgcttccagccccgggtgctgcaggtgcaggcccaggtgcagagccagacccagccccgcatccccagcacagacacccaggtgcagcccaagctgcagaagcaggcccagacccagaccagccctgagcacctggtgctgcagcagaagcaggtgcagccccagctgcagcaggaggccgagccccagaagcaggtgcagccccaggtgcagccccaggcccacagccagggcccccggcaggtgcagctgcagcaggaggccgagcccctgaagcaggtgcagccccaggtgcagccccaggcccacagccagccccacctgccccaggtgctgagccagcagctgcggggcacagccctgcccctgcaggtgcccggccccctgtag

SEQ ID NO: 15118 - DNA, 2529 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggctgtgtcccggggcctgcccccccagcagccccagcagcccctgctgaacctgcagggcaccaacagcgccagcctgctgaatggctccatgctgcagagggccctgctgctgcagcagctgcagggcctggaccagtttgccatgcccccagccacctatgacacagctggcctgaccatgcccacagccaccctgggcaacctgcggggctacggcatggccagccctggcctggccgcccccagcctgaccccaccccagctggccacccccaacctgcagcagttcttcccccaggccacccggcagagcctgctgggccccccacctgtgggcgtgcccatgaaccccagccagttcaacctgtctggaagaaacccccagaagcaggcccggaccagcagcagcaccacccccaacaggaaggacagcagcagccagaccatgcctgtggaggacaagagtgaccccccagagggcagcgaggaggccgctgagcccaggatggacaccccagaggaccaggacctgcccccctgcccagaggacatcgccaaggagaagaggaccccagcccctgagcctgagccctgtgaggccagcgagctgcctgccaagaggctgcggagcagcgaggagcccacagagaaggagcccccaggccagctgcaggtgaaggcccagccccaggccaggatgacagtgcccaagcagacccagaccccagacctgctgcctgaggccctggaggcccaggtgctgccccgcttccagccccgggtgctgcaggtgcaggcccaggtgcagagccagacccagccccgcatccccagcacagacacccaggtgcagcccaagctgcagaagcaggcccagacccagaccagccctgagcacctggtgctgcagcagaagcaggtgcagccccagctgcagcaggaggccgagccccagaagcaggtgcagccccaggtgcacacccaggcccagcccagcgtgcagccccaggagcaccccccagcccaggtgtctgtgcagcccccagagcagacccatgagcagccccacacccagccccaggtgtccctgctggcccctgagcagacccctgtggtggtgcacgtgtgtggcctggagatgcccccagatgctgtggaggccggcggcggcatggagaagaccctgcctgagcctgtgggcacccaggtgtccatggaggagatccagaatgaaagtgcctgtggcctggatgtgggggagtgtgagaacagagcccgggagatgcctggggtgtggggcgctgggggcagcctgaaggtgaccatcctgcagagcagtgacagccgggccttcagcacagtgcccctgacccctgtgccccggcccagcgacagcgtgagcagcaccccagctgccaccagcacccccagcaagcaggccctgcagttcttctgctacatctgcaaggccagctgcagcagccagcaggagttccaggaccacatgtctgagccccagcaccagcagaggctgggggagatccagcacatgagccaggcctgcctgctgagcctgctgcctgtgcccagagatgtgctggagacagaagatgaggagcccccaccccggcgctggtgcaacacctgccagctgtactacatgggagacctgatccagcacaggaggacccaggaccacaagatcgccaagcagagcctgcggcccttctgcaccgtgtgcaaccgctacttcaagacccccaggaagtttgtggagcacgtgaagagccagggccacaaggacaaggccaaggagctgaagagcctggagaaggagattgctggccaggatgaggaccacttcatcaccgtggatgctgtgggctgctttgaaggagatgaggaggaggaggaggatgatgaagatgaggaggagattgaggtggaggaggagctgtgcaagcaggtgcgcagccgggacatcagccgggaggagtggaagggcagcgagacctacagccccaacacagcctacggcgtggacttcctggtgcctgtgatgggctacatctgccgcatctgccacaagttctaccacagcaacagcggggcccagctgagccactgcaagagcctgggccactttgagaacctgcagaagtacaaggccgccaagaaccccagccccaccaccaggcctgtgagccgccgctgtgccatcaatgccagaaatgccctgacagccctcttcaccagcagcggccggccccccagccagcccaacacccaggacaagacccccagcaaggtgacagcccggcccagccagccccccctgcccaggaggagcacccggctgaagacctag

SEQ ID NO: 15119 - DNA, 2457 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggctgtgtcccggggcctgcccccccagcagccccagcagcccctgctgaacctgcagggcaccaacagcgccagcctgctgaatggctccatgctgcagagggccctgctgctgcagcagctgcagggcaacctgcggggctacggcatggccagccctggcctggccgcccccagcctgaccccaccccagctggccacccccaacctgcagcagttcttcccccaggccacccggcagagcctgctgggccccccacctgtgggcgtgcccatgaaccccagccagttcaacctgtctggaagaaacccccagaagcaggcccggaccagcagcagcaccacccccaacaggaaggacagcagcagccagaccatgcctgtggaggacaagagtgaccccccagagggcagcgaggaggccgctgagcccaggatggacaccccagaggaccaggacctgcccccctgcccagaggacatcgccaaggagaagaggaccccagcccctgagcctgagccctgtgaggccagcgagctgcctgccaagaggctgcggagcagcgaggagcccacagagaaggagcccccaggccagctgcaggtgaaggcccagccccaggccaggatgacagtgcccaagcagacccagaccccagacctgctgcctgaggccctggaggcccaggtgctgccccgcttccagccccgggtgctgcaggtgcaggcccaggtgcagagccagacccagccccgcatccccagcacagacacccaggtgcagcccaagctgcagaagcaggcccagacccagaccagccctgagcacctggtgctgcagcagaagcaggtgcagccccagctgcagcaggaggccgagccccagaagcaggtgcagccccaggtgcacacccaggcccagcccagcgtgcagccccaggagcaccccccagcccaggtgtctgtgcagcccccagagcagacccatgagcagccccacacccagccccaggtgtccctgctggcccctgagcagacccctgtggtggtgcacgtgtgtggcctggagatgcccccagatgctgtggaggccggcggcggcatggagaagaccctgcctgagcctgtgggcacccaggtgtccatggaggagatccagaatgaaagtgcctgtggcctggatgtgggggagtgtgagaacagagcccgggagatgcctggggtgtggggcgctgggggcagcctgaaggtgaccatcctgcagagcagtgacagccgggccttcagcacagtgcccctgacccctgtgccccggcccagcgacagcgtgagcagcaccccagctgccaccagcacccccagcaagcaggccctgcagttcttctgctacatctgcaaggccagctgcagcagccagcaggagttccaggaccacatgtctgagccccagcaccagcagaggctgggggagatccagcacatgagccaggcctgcctgctgagcctgctgcctgtgcccagagatgtgctggagacagaagatgaggagcccccaccccggcgctggtgcaacacctgccagctgtactacatgggagacctgatccagcacaggaggacccaggaccacaagatcgccaagcagagcctgcggcccttctgcaccgtgtgcaaccgctacttcaagacccccaggaagtttgtggagcacgtgaagagccagggccacaaggacaaggccaaggagctgaagagcctggagaaggagattgctggccaggatgaggaccacttcatcaccgtggatgctgtgggctgctttgaaggagatgaggaggaggaggaggatgatgaagatgaggaggagattgaggtggaggaggagctgtgcaagcaggtgcgcagccgggacatcagccgggaggagtggaagggcagcgagacctacagccccaacacagcctacggcgtggacttcctggtgcctgtgatgggctacatctgccgcatctgccacaagttctaccacagcaacagcggggcccagctgagccactgcaagagcctgggccactttgagaacctgcagaagtacaaggccgccaagaaccccagccccaccaccaggcctgtgagccgccgctgtgccatcaatgccagaaatgccctgacagccctcttcaccagcagcggccggccccccagccagcccaacacccaggacaagacccccagcaaggtgacagcccggcccagccagccccccctgcccaggaggagcacccggctgaagacctag

SEQ ID NO: 15120 - DNA, 2697 bp, Artificial Sequence; identical to SEQ ID NO: 15116
  Description of Artificial Sequence: Synthetic coding sequence

SEQ ID NO: 15121 - DNA, 2463 bp, Artificial Sequence
  Description of Artificial Sequence: Synthetic coding sequence
cccctgcccatggctgtgtcccggggcctgcccccccagcagccccagcagcccctgctgaacctgcagggcaccaacagcgccagcctgctgaatggctccatgctgcagagggccctgctgctgcagcagctgcagggcaacctgcggggctacggcatggccagccctggcctggccgcccccagcctgaccccaccccagctggccacccccaacctgcagcagttcttcccccaggccacccggcagagcctgctgggccccccacctgtgggcgtgcccatgaaccccagccagttcaacctgagcggcaggaacccccagaagcaggcccggaccagcagcagcaccacccccaacaggaagaccatgcctgtggaggacaagagtgaccccccagagggcagcgaggaggccgctgagcccaggatggacaccccagaggaccaggacctgcccccctgcccagaggacatcgccaaggagaagaggaccccagcccctgagcctgagccctgtgaggccagcgagctgcctgccaagaggctgcggagcagcgaggagcccacagagaaggagcccccaggccagctgcaggtgaaggcccagccccaggccaggatgacagtgcccaagcagacccagaccccagacctgctgcctgaggccctggaggcccaggtgctgccccgcttccagccccgggtgctgcaggtgcaggcccaggtgcagagccagacccagccccgcatccccagcacagacacccaggtgcagcccaagctgcagaagcaggcccagacccagaccagccctgagcacctggtgctgcagcagaagcaggtgcagccccagctgcagcaggaggccgagccccagaagcaggtgcagccccaggtgcagccccaggcccacagccagggcccccggcaggtgcagctgcagcaggaggccgagcccctgaagcaggtgcagccccaggtgcagccccaggcccacagccagcccccccggcaggtgcagctgcagctgcagaagcaggtgcagacccagacctacccccaggtgcacacccaggcccagcccagcgtgcagccccaggagcaccccccagcccaggtgtctgtgcagcccccagagcagacccatgagcagccccacacccagccccaggtgtccctgctggcccctgagcagacccctgtggtggtgcacgtgtgtggcctggagatgcccccagatgctgtggaggccggcggcggcatggagaagaccctgcctgagcctgtgggcacccaggtgtccatggaggagatccagaatgaaagtgcctgtggcctggatgtgggggagtgtgagaacagagcccgggagatgcctggggtgtggggcgctgggggcagcctgaaggtgaccatcctgcagagcagtgacagccgggccttcagcacagtgcccctgacccctgtgccccggcccagcgacagcgtgagcagcaccccagctgccaccagcacccccagcaagcaggccctgcagttcttctgctacatctgcaaggccagctgcagcagccagcaggagttccaggaccacatgtctgagccccagcaccagcagaggctgggggagatccagcacatgagccaggcctgcctgctgagcctgctgcctgtgcccagagatgtgctggagacagaagatgaggagcccccaccccggcgctggtgcaacacctgccagctgtactacatgggagacctgatccagcacaggaggacccaggaccacaagatcgccaagcagagcctgcggcccttctgcaccgtgtgcaaccgctacttcaagacccccaggaagtttgtggagcacgtgaagagccagggccacaaggacaaggccaaggagctgaagagcctggagaaggagattgctggccaggatgaggaccacttcatcaccgtggatgctgtgggctgctttgaaggagatgaggaggaggaggaggatgatgaagatgaggaggagattgaggtggaggaggagctgtgcaagcaggtgcgcagccgggacatcagccgggaggagtggaagggcagcgagacctacagccccaacacagcctacggcgtggacttcctggtgcctgtgatgggctacatctgccgcatctgccacaagttctaccacagcaacagcggggcccagctgagccactgcaagagcctgggccactttgagaacctgcagaagtacaaggccgccaagaaccccagccccaccaccaggcctgtgagccgccgctgtgccatcaatgccagaaatgccctgacagccctcttcaccagcagcggccggccccccagccagcccaacacccaggacaagacccccagcaaggtgacagcccggcccagccagccccccctgcccaggaggagcacccggctgaagacctag

SEQ ID NO: 15122 - DNA, 507 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggctgtgtcccggggcctgcccccccagcagccccagcagcccctgctgaacctgcagggcaccaacagcgccagcctgctgaatggctccatgctgcagagggccctgctgctgcagcagctgcagggcctggaccagtttgccatgcccccagccacctatgacacagctggcctgaccatgcccacagccaccctgggcaacctgcggggctacggcatggccagccctggcctggccgcccccagcctgaccccaccccagctggccacccccaacctgcagcagttcttcccccaggccacccggcagagcctgctgggccccccacctgtgggcgtgccctag

SEQ ID NO: 15123 - DNA, 2514 bp, Artificial Sequence
  Description of Artificial Sequence: Synthetic coding sequence
atgttcagccagcagcagcagcagcagctgcagcagcagcagcaggcccccctgcccatggctgtgtcccggggcctgcccccccagcagccccagcagcccctgctgaacctgcagggcaccaacagcgccagcctgctgaatggctccatgctgcagagggccctgctgctgcagcagctgcagggcctggaccagtttgccatgcccccagccacctatgacacagctggcctgaccatgcccacagccaccctgggcaacctgcggggctacggcatggccagccctggcctggccgcccccagcctgaccccaccccagctggccacccccaacctgcagcagttcttcccccaggccacccggcagagcctgctgggccccccacctgtgggcgtgcccatgaaccccagccagttcaacctgagcggcaggaacccccagaagcaggcccggaccagcagcagcaccacccccaacaggaaggacagcagcagccagaccatgcctgtggaggacaagagtgaccccccagagggcagcgaggaggccgctgagcccaggatggacaccccagaggaccaggacctgcccccctgcccagaagatattgccaaggagaagaggaccccagcccctgagcctgagccctgtgaggccagcgagctgcctgccaagaggctgcggagcagcgaggagcccacagagaaggagcccccaggccagctgcaggtgaaggcccagccccaggccaggatgacagtgcccaagcagacccagaccccagacctgctgcctgaggccctggaggcccaggtgctgccccgcttccagccccgggtgctgcaggtgcaggcccaggtgcagagccagacccagccccgcatccccagcacagacacccaggtgcagcccaagctgcagaagcaggcccagacccagaccagccctgagcacctggtgctgcagcagaagcaggtgcagccccagctgcagcaggaggccgagccccagaagcaggtgcagccccaggtgcagccccaggcccacagccagggcccccggcaggtgcagctgcagcaggaggccgagcccctgaagcaggtgcagccccaggtgcacacccaggcccagcccagcgtgcagccccaggagcaccccccagcccaggtgtctgtgcagcccccagagcagacccatgagcagccccacacccagccccaggtgtccctgctggcccctgagcagacccctgtggtggtgcacgtgtgtggcctggagatgcccccagatgctgtggaggccggcggcggcatggagaagaccctgcctgagcctgtgggcacccaggtgtccatggaggagatccagaatgaaagtgcctgtggcctggatgtgggagaatgtgaaaatagagcccgggagatgcctggggtgtggggcgccggcggcagcctgaaggtgaccatcctgcagagcagtgacagccgggccttcagcacagtgcccctgacccctgtgccccggcccagcgacagcgtgagcagcaccccagctgccaccagcacccccagcaagcaggccctgcagttcttctgctacatctgcaaggccagctgcagcagccagcaggagttccaggaccacatgtctgagccccagcaccagcagaggctgggggagatccagcacatgagccaggcctgcctgctgagcctgctgcctgtgcccagagatgtgctggagacagaagatgaggagcccccaccccggcgctggtgcaacacctgccagctgtactacatgggagacctgatccagcacaggaggacccaggaccacaagatcgccaagcagagcctgcggcccttctgcaccgtgtgcaaccgctacttcaagacccccaggaagtttgtggagcacgtgaagagccagggccacaaggacaaggccaaggagctgaagagcctggagaaggagattgctggccaggatgaggaccacttcatcaccgtggatgctgtgggctgctttgaaggagatgaggaggaggaggaggatgatgaagatgaggaggagattgaggtggaggaggagctgtgcaagcaggtgcgcagccgggacatcagccgggaggagtggaagggcagcgagacctacagccccaacacagcctatggagtggacttcctggtgcctgtgatgggctacatctgccgcatctgccacaagttctaccacagcaacagcggggcccagctgagccactgcaagagcctgggccactttgagaacctgcagaagtacaaggccgccaagaaccccagccccaccaccaggcctgtgtccagaagatgtgccatcaatgccagaaatgccctgacagccctcttcaccagcagcggccggccccccagccagcccaacacccaggacaagacccccagcaaggtgacagcccggcccagccagccccccctgccccggcgcagcacccggctgaagacctag

SEQ ID NO: 15124 - DNA, 2775 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggctgtgtcccggggcctgcccccccagcagccccagcagcccctgctgaacctgcagggcaccaacagcgccagcctgctgaatggctccatgctgcagagggccctgctgctgcagcagctgcagggcctggaccagtttgccatgcccccagccacctatgacacagctggcctgaccatgcccacagccaccctgggcaacctgcggggctacggcatggccagccctggcctggccgcccccagcctgaccccaccccagctggccacccccaacctgcagcagttcttcccccaggccacccggcagagcctgctgggccccccacctgtgggcgtgcccatgaaccccagccagttcaacctgtctggaagaaacccccagaagcaggcccggaccagcagcagcaccacccccaacaggaaggacagcagcagccagaccatgcctgtggaggacaagagtgaccccccagagggcagcgaggaggccgctgagcccaggatggacaccccagaggaccaggacctgcccccctgcccagaggacatcgccaaggagaagaggaccccagcccctgagcctgagccctgtgaggccagcgagctgcctgccaagaggctgcggagcagcgaggagcccacagagaaggagcccccaggccagctgcaggtgaaggcccagccccaggccaggatgacagtgcccaagcagacccagaccccagacctgctgcctgaggccctggaggcccaggtgctgccccgcttccagccccgggtgctgcaggtgcaggcccaggtgcagagccagacccagccccgcatccccagcacagacacccaggtgcagcccaagctgcagaagcaggcccagacccagaccagccctgagcacctggtgctgcagcagaagcaggtgcagccccagctgcagcaggaggccgagccccagaagcaggtgcagccccaggtgcagccccaggcccacagccagggcccccggcaggtgcagctgcagcaggaggccgagcccctgaagcaggtgcagccccaggtgcagccccaggcccacagccagcccccccggcaggtgcagctgcagctgcagaagcaggtgcagacccagacctacccccaggtgcacacccaggcccagcccagcgtgcagccccaggagcaccccccagcccaggtgtctgtgcagcccccagagcagacccatgagcagccccacacccagccccaggtgtccctgctggcccctgagcagacccctgtggtggtgcacgtgtgtggcctggagatgcccccagatgctgtggaggccggcggcggcatggagaagaccctgcctgagcctgtgggcacccaggtgtccatggaggagatccagaatgaaagtgcctgtggcctggatgtgggggagtgtgagaacagagcccgggagatgcctggggtgtggggcgctgggggcagcctgaaggtgaccatcctgcagagcagtgacagccgggccttcagcacagtgcccctgacccctgtgccccggcccagcgacagcgtgagcagcaccccagctgccaccagcacccccagcaagcaggccctgcagttcttctgctacatctgcaaggccagctgcagcagccagcaggagttccaggaccacatgtctgagccccagcaccagcagaggctgggggagatccagcacatgagccaggcctgcctgctgagcctgctgcctgtgcccagagatgtgctggagacagaagatgaggagcccccaccccggcgctggtgcaacacctgccagctgtactacatgggagacctgatccagcacaggaggacccaggaccacaagccacccacccccaggagagatgtgtttgcccacgtgcctgtgcagggctggagcacagcccggctggtgacagacatgattgccaagcagagcctgcggcccttctgcaccgtgtgcaaccgctacttcaagacccccaggaagtttgtggagcacgtgaagagccagggccacaaggacaaggccaaggagctgaagagcctggagaaggagattgctggccaggatgaggaccacttcatcaccgtggatgctgtgggctgctttgaaggagatgaggaggaggaggaggatgatgaagatgaggaggagattgaggtggaggaggagctgtgcaagcaggtgcgcagccgggacatcagccgggaggagtggaagggcagcgagacctacagccccaacacagcctacggcgtggacttcctggtgcctgtgatgggctacatctgccgcatctgccacaagttctaccacagcaacagcggggcccagctgagccactgcaagagcctgggccactttgagaacctgcagaagtacaaggccgccaagaaccccagccccaccaccaggcctgtgagccgccgctgtgccatcaatgccagaaatgccctgacagccctcttcaccagcagcggccggccccccagccagcccaacacccaggacaagacccccagcaaggtgacagcccggcccagccagccccccctgcccaggaggagcacccggctgaagacctag

SEQ ID NO: 15125 - DNA, 2394 bp, Artificial Sequence
  Description of Artificial Sequence: Synthetic coding sequence
atgcccccagccacctatgacacagctggcctgaccatgcccacagccaccctgggcaacctgcggggctacggcatggccagccctggcctggccgcccccagcctgaccccaccccagctggccacccccaacctgcagcagttcttcccccaggccacccggcagagcctgctgggccccccacctgtgggcgtgcccatgaaccccagccagttcaacctgagcggcaggaacccccagaagcaggcccggaccagcagcagcaccacccccaacaggaaggacagcagcagccagaccatgcctgtggaggacaagagtgaccccccagagggcagcgaggaggccgctgagcccaggatggacaccccagaggaccaggacctgcccccctgcccagaagatattgccaaggagaagaggaccccagcccctgagcctgagccctgtgaggccagcgagctgcctgccaagaggctgcggagcagcgaggagcccacagagaaggagcccccaggccagctgcaggtgaaggcccagccccaggccaggatgacagtgcccaagcagacccagaccccagacctgctgcctgaggccctggaggcccaggtgctgccccgcttccagccccgggtgctgcaggtgcaggcccaggtgcagagccagacccagccccgcatccccagcacagacacccaggtgcagcccaagctgcagaagcaggcccagacccagaccagccctgagcacctggtgctgcagcagaagcaggtgcagccccagctgcagcaggaggccgagccccagaagcaggtgcagccccaggtgcagccccaggcccacagccagggcccccggcaggtgcagctgcagcaggaggccgagcccctgaagcaggtgcagccccaggtgcagccccaggcccacagccagcccccccggcaggtgcagctgcagctgcagaagcaggtgcagacccagacctacccccaggtgcacacccaggcccagcccagcgtgcagccccaggagcaccccccagcccaggtgtctgtgcagcccccagagcagacccatgagcagccccacacccagccccaggtgtccctgctggcccctgagcagacccctgtggtggtgcacgtgtgtggcctggagatgcccccagatgctgtggaggccggcggcggcatggagaagaccctgcctgagcctgtgggcacccaggtgtccatggaggagatccagaatgaaagtgcctgtggcctggatgtgggagaatgtgaaaatagagcccgggagatgcctggggtgtggggcgccggcggcagcctgaaggtgaccatcctgcagagcagtgacagccgggccttcagcacagtgcccctgacccctgtgccccggcccagcgacagcgtgagcagcaccccagctgccaccagcacccccagcaagcaggccctgcagttcttctgctacatctgcaaggccagctgcagcagccagcaggagttccaggaccacatgtctgagccccagcaccagcagaggctgggggagatccagcacatgagccaggcctgcctgctgagcctgctgcctgtgcccagagatgtgctggagacagaagatgaggagcccccaccccggcgctggtgcaacacctgccagctgtactacatgggagacctgatccagcacaggaggacccaggaccacaagatcgccaagcagagcctgcggcccttctgcaccgtgtgcaaccgctacttcaagacccccaggaagtttgtggagcacgtgaagagccagggccacaaggacaaggccaaggagctgaagagcctggagaaggagattgctggccaggatgaggaccacttcatcaccgtggatgctgtgggctgctttgaaggagatgaggaggaggaggaggatgatgaagatgaggaggagattgaggtggaggaggagctgtgcaagcaggtgcgcagccgggacatcagccgggaggagtggaagggcagcgagacctacagccccaacacagcctatggagtggacttcctggtgcctgtgatgggctacatctgccgcatctgccacaagttctaccacagcaacagcggggcccagctgagccactgcaagagcctgggccactttgagaacctgcagaagtacaaggccgccaagaaccccagccccaccaccaggcctgtgtccagaagatgtgccatcaatgccagaaatgccctgacagccctcttcaccagcagcggccggccccccagccagcccaacacccaggacaagacccccagcaaggtgacagcccggcccagccagccccccctgccccggcgcagcacccggctgaagacctag

SEQ ID NO: 15126 - DNA, 1743 bp, Artificial Sequence
  Description of Artificial Sequence: Synthetic coding sequence
atggcccaggaggtgtctgagtacctgagccagaacccccgggtggccgcctgggtggaggccctgcgctgtgatggagaaacagacaagcactggaggcacagaagagacttcctgctgagaaatgctggggacctggccccagctggaggagctgccagcgccagcacagatgaggccgcagatgctgagagcggcaccaggaaccggcagctgcagcagctgatctccttctccatggcctgggccaaccacgtgttcctgggctgccgctacccccagaaggtgatggacaagatcctgtccatggccgagggcatcaaggtgacagatgcccccacctacaccaccagagatgagctggtggccaaggtgaagaagaggggcatcagcagcagcaatgaaggagtggaggagcccagcaagaagagggtcatcgagggcaagaacagcagcgctgtggagcaggaccacgccaagaccagcgccaagacagagcgggccagcgcccagcaggagaacagcagcacctgcatcggcagcgccatcaagtctgagagcggcaacagcgcccggagcagcggcatcagcagccagaacagcagcaccagtgatggagacagatctgtgagcagccagagcagcagctctgtgagcagccaggtgaccacagctggcagcggcaaggccagcgaggccgaggccccagacaagcacggcagcgccagctttgtgtccctgctgaagagctctgtgaacagccacatgacccagagcacagacagccggcagcagagcggcagccccaagaagagcgccctggagggcagcagcgccagcgccagccagagcagcagcgagattgaggtgcccctgctgggcagcagcggcagcagcgaggtggagctgcccctgctgagcagcaagcccagcagcgagacagccagcagcggcctgaccagcaagaccagcagcgaggcctctgtgagcagctctgtggccaagaacagcagcagcagcggcaccagcctgctgacccccaagagcagcagcagcaccaacaccagcctgctgaccagcaagagcaccagccaggtggccgccagcctgctggccagcaagagcagcagccagaccagcggcagcctggtgtccaagagcaccagcctggcctctgtgtcccagctggccagcaagagcagcagccagaccagcaccagccagctgcccagcaagagcaccagccagagcagcgagagctctgtgaagttcagctgcaagctgaccaatgaagatgtgaagcagaagcagcccttcttcaacagactctacaagacagtggcctggaagctggtggccgtgggcggcttcagccccaacgtgaaccacggggagctgctgaatgctgccatcgaggccctgaaggccaccctggatgtgttctttgtgcccctgaaggagctggccgacctgccccagaacaagagcagccaggagagcatcgtgtgtgagctgcgctgcaagtctgtgtacctgggcaccggctgtgggaagagcaaagaaaatgccaaggctgtggccagccgggaggccctgaagctgttcctgaagaagaaggtggtggtgaagatctgcaagaggaagtaccggggcagcgagattgaggacctggtgctgctggatgaggagagcaggcctgtgaacctgcccccagccctgaagcacccccaggagctgctgtag

SEQ ID NO: 15127 - DNA, 564 bp, Artificial Sequence
  Description of Artificial Sequence: Synthetic coding sequence
atgcctggagagcggcccacagatgccaccgtcatccccagcgccaagcgggagaggaaggccatcaccctggacctgaagctggaggtgctgcggagatttgaggccggggagaagctgagccagatcgccaaggccctggacctggccatcagcacagtggccaccatccgggacagcaaggagaagatcaaggccagcagccagatcgccacccccctgcgggccagccggctgaccaggcacaggtctgctgtgatggagagcatggagcagctgctgagcctgtggctggaggaccagagccagcccaatgccaccctgtctgctgccatcgtgcaggagaaggccgagtttgatgacctgcagcgggagcacggggagggcagccagacagagcgcttccacgccagccagggctggctggtgcgcttcaaggagtgccactgcctgccccacttcaagatgaacagcgctgcccccagcaacaaggacatgtacacagagatgctgaagagcatcatcgaggagggggagtacaccccccaggtgtccctgacctag

SEQ ID NO: 15128 - DNA, 312 bp, Artificial Sequence
  Description of Artificial Sequence: Synthetic coding sequence
atggccctgagcaccatcgtgtcccagaggaagcagatcaagaggaaggccccccggggcttcctgaagagggtcttcaagaggaagaagccccagctgcggctggagaagagcggggacctgctggtgcgcttccaccccttcagcggctgggagtggggcactggagaggtgcacctgaactgcctgctgtttgtgcaccggctggccgaggagagcaggaccaatgcctgtgccagcaaatgtagagtcatcaacaaggagcacgtgctggccgccgccaaggtgatcctgaagaagagccggggctag

SEQ ID NO: 15129 - DNA, 204 bp, Artificial Sequence
  Description of Artificial Sequence: Synthetic coding sequence
atggccctgagcaccatcgtgtcccagaggaagcagatcaagaggaaggccccccggggcttcctgaagagggtcttcaagaggaagaagccccagctgcggctggagaagagcggggacctgctgaagagccctggccagaccctggtgcgggtgaatgtggagagcctgaccaggtccatgtactggccccagcagaggtag

SEQ ID NO: 15130 - DNA, 267 bp, Artificial Sequence
  Description of Artificial Sequence: Synthetic coding sequence
atggccctgagcaccatcgtgtcccagaggaagcagatcaagaggaaggccccccggggcttcctgaagagggtcttcaagaggaagaagccccagctgcggctggagaagagcggggacctgctggtgcacctgaactgcctgctgtttgtgcaccggctggccgaggagagcaggaccaatgcctgtgccagcaagtgcagggtcatcaacaaggagcacgtgctggccgccgccaaggtgatcctgaagaagagccggggctag

SEQ ID NO: 15131 - DNA, 3846 bp, Artificial Sequence
  Description of Artificial Sequence: Synthetic coding sequence
atggtgaggaagaagaacccccccctgagaaatgtggccagcgagggggagggccagatcctggagcccatcggcacagagagcaaggtgtctgggaagaacaaggagttctctgctgaccagatgtctgagaacacagaccagagtgatgctgctgagctgaaccacaaggaggagcacagcctgcacgtgcaggaccccagcagcagcagcaagaaggacctgaagtctgctgtgctgtctgagaaggccggcttcaactatgagagccccagcaaaggaggcaacttccccagcttcccccatgatgaggtgacagacaggaacatgctggccttcagcagccctgctgctgggggcgtgtgtgagcccctgaagagcccccagagagctgaggctgatgacccccaggacatggcctgcacccccagcggggacagcctggagaccaaggaggaccagaagatgagccccaaggccacagaggagaccggccaggcccagagcggccaggccaactgccagggcctgagccctgtgtctgtggccagcaagaacccccaggtgcccagtgatggcggcgtgcggctgaacaagagcaagacagacctgctggtgaatgacaacccagaccctgcccccctgagccctgagctgcaggacttcaagtgcaacatctgtggctacggctactatggaaatgaccccacagacctgatcaagcacttcaggaagtaccacctgggcctgcacaacagaacccggcaggatgctgagctggacagcaagatcctggccctgcacaacatggtgcagttcagccacagcaaggacttccagaaggtgaacagatctgtgttcagcggcgtgctgcaggacatcaacagcagcaggcctgtgctgctgaatggcacctatgatgtgcaggtgaccagcggcggcaccttcatcggcattggaaggaagaccccagactgccagggcaacaccaagtacttccgctgcaagttctgcaacttcacctacatgggcaacagcagcacagagctggagcagcacttcctgcagacccaccccaacaagatcaaggccagcctgcccagcagcgaggtggccaagcccagcgagaagaacagcaacaagagcatcccagccctgcagagcagtgacagcggggacctgggcaagtggcaggacaagatcaccgtgaaggctggagatgacacccctgtgggctacagcgtgcccatcaagcccctggacagcagccggcagaatggaacagaggccaccagctactactggtgcaagttctgcagcttcagctgtgagagcagcagcagcctgaagctgctggagcactacggcaagcagcacggggctgtgcagagcggcggcctgaaccctgagctgaatgacaagctgagccggggcagcgtcatcaaccagaatgacctggccaagagcagcgagggggagaccatgaccaagacagacaagagcagcagcggggccaagaagaaggacttcagcagcaaaggagctgaggacaacatggtgaccagctacaactgccagttctgtgacttccgctacagcaagagccacggcccagatgtgattgtggtgggccccctgctgcggcactaccagcagctgcacaacatccacaagtgcaccatcaagcactgccccttctgcccccggggcctgtgcagccctgagaagcacctgggggagatcacctacccctttgcctgcaggaagagcaactgcagccactgtgccctgctgctgctgcacctgagccctggagctgctggcagcagccgggtgaagcaccagtgccaccagtgcagcttcaccaccccagatgtggatgtgctgctcttccactatgaatctgtgcatgagagccaggccagtgatgtgaagcaggaggccaaccacctgcagggcagtgatggccagcagagcgtgaaggagagcaaggagcacagctgcaccaagtgtgacttcatcacccaggtggaggaggagatcagccgccactaccgccgggcccacagctgctacaagtgccggcagtgcagcttcaccgctgctgacacccagagcctgctggagcacttcaacacagtgcactgccaggagcaggacatcaccacagccaatggagaggaggatggccacgccatcagcaccatcaaggaggagcccaagattgacttccgggtgtacaacctgctgaccccagacagcaagatgggagagcctgtgtctgagagcgtggtgaagcgggagaagctggaggagaaggatggcctgaaggagaaggtgtggacagagagcagcagtgatgacctgagaaatgtgacctggagaggagctgacatcctgcggggcagccccagctacacccaggccagcctgggcctgctgacccctgtgtctggcacccaggagcagaccaagaccctgcgggacagccccaacgtggaggccgcccacctggcccggcccatctacggcctggccgtggagaccaagggcttcctgcagggcgccccagctggaggagagaagagcggggccctgccccagcagtacccagccagcggggagaacaagagcaaggatgagagccagagcctgctgcggaggagaagaggcagcggggtcttctgtgccaactgcctgaccaccaagaccagcctgtggaggaagaatgccaacggcggctacgtgtgcaatgcctgtggcctgtaccagaagctgcacagcaccccccggcccctgaacatcatcaagcagaacaacggggagcagatcatcagaagaaggaccaggaagaggctgaaccctgaggccctgcaggccgagcagctgaacaagcagcagaggggcagcaatgaggagcaggtgaatggcagccccctggagcggcgctctgaggaccacctgacagagagccaccagcgggagatccccctgcccagcctgagcaaatatgaggcccagggcagcctgaccaagagccacagcgcccagcagcctgtgctggtgtcccagaccctggacatccacaagaggatgcagcccctgcacatccagatcaagagcccccaggagagcactggagaccccggcaacagcagctctgtgtctgagggcaagggcagcagcgagcggggcagccccatcgagaagtacatgaggcctgccaagcaccccaactacagccccccaggcagccccatcgagaagtaccagtaccccctgtttggcctgccctttgtgcacaatgacttccagagcgaggccgactggctgcgcttctggagcaagtacaagctgtctgtgcccggcaacccccactacctgagccacgtgcccggcctgcccaacccctgccagaactacgtgccctaccccaccttcaacctgcccccccacttctctgctgtgggcagtgacaatgacatccccctggacctggccatcaagcacagcaggcctggccccacagccaacggggccagcaaggagaagaccaaggccccacccaacgtgaagaatgaaggccccctgaatgtggtgaagacagagaaggtggacaggagcacccaggatgagctgagcaccaagtgtgtgcactgcggcatcgtgttcctggatgaggtgatgtatgccctgcacatgagctgccacggggacagcggccccttccagtgcagcatctgccagcacctgtgcacagacaagtatgacttcaccacccacatccagaggggcctgcacaggaacaatgcccaggtggagaagaatggcaagcccaaggagtag

SEQ ID NO: 15132 - DNA, 2871 bp, Artificial Sequence
  Description of Artificial Sequence: Synthetic coding sequence
atgctggaggagctggagtgtggggcccctggggcccggggagctgccacagccatggactgcaaggacaggcctgccttccctgtgaagaagctgatccaggcccggctgcccttcaagaggctgaacctggtgcccaagggcaaggcagatgacatgtctgatgaccagggcacctctgtgcagagcaagagcccagacctggaggccagcctggacaccctggagaacaactgccacgtgggcagtgacatcgacttccggcccaagctggtgaatggcaagggccccctggacaacttcctgaggaaccgcatcgagaccagcatcggccagagcaccgtcatcatcgacctgacagaggacagcaatgagcagcctgacagcctggtggaccacaacaagctgaacagcgaggccagccccagccgggaggccatcaatggccagcgggaggacaccggggaccagcagggcctgctgaaggccatccagaatgacaagctggccttccctggagagaccctgagtgacatcccctgcaagacagaggaggagggcgtgggctgcggcggggccggcagaagaggagacagccaggagtgcagccccaggagctgcccagagctgaccagcggccccaggatgtgccccaggaaggagcaggacagctggagcgaggccggcggcatcctcttcaagggcaaggtgcccatggtggtgctgcaggacatcctggccgtgcggcccccccagatcaagagcctgcctgccaccccccagggcaagaacatgaccccagagagcgaggtgctggagagcttccctgaggaggacagcgtgctgagccacagcagcctgagcagccccagcagcaccagcagccctgagggccccccagccccacccaagcagcacagcagcaccagccccttccccaccagcacccccctgcggcgcatcaccaagaagtttgtgaagggcagcacagagaagaacaagctgcggctgcagagggaccaggagcggctgggcaagcagctgaagctgcgggcagagcgggaggagaaggagaagctgaaggaggaggccaagagggccaaggaggaggccaagaagaagaaggaggaggagaaggagctgaaggagaaggagcggcgggagaagcgggagaaggatgagaaggagaaggccgagaagcagaggctgaaggaggagaggaggaaggagcggcaggaggccctggaggccaagctggaggagaagaggaagaaggaggaggagaagaggctgcgggaggaggagaagaggatcaaggccgagaaggccgagatcacccgcttcttccagaagcccaagaccccccaggcccccaagaccctggccggcagctgtgggaagtttgccccctttgagatcaaggagcacatggtgctggcccccaggagaagaacagccttccacccagacctgtgcagccagctggaccagctgctgcagcagcagagcggggagttctccttcctgaaggacctgaagggccggcagcccctgcggagcggccccacccacgtgtccaccagaaatgctgacatcttcaacagtgatgtggtgattgtggagcggggcaaaggagatggagtgcctgagaggaggaagtttggccgcatgaagctgctgcagttctgtgagaaccacaggcctgcctactggggcacctggaacaagaagacagccctgatccgggcccgggacccctgggcccaggacaccaagctgctggactatgaggtggacagtgatgaggagtgggaggaggaggagcctggagagagcctgagccacagtgaaggagatgatgatgatgacatgggagaagatgaagatgaagatgatggcttctttgtgccccacggctacctgtctgaagatgagggcgtgacagaggagtgtgccgaccctgagaaccacaaggtgcggcagaagctgaaggccaaggagtgggatgagttcctggccaagggcaagcgcttccgggtgctgcagcctgtgaagattggctgtgtgtgggccgctgaccgggactgtgctggagatgacctgaaggtgctgcagcagtttgctgcctgcttcctggagaccctgcctgcccaggaggagcagacccccaaggccagcaagcgggagaggagagatgagcagatcctggcccagctgctgcccctgctgcacggcaatgtgaatggcagcaaggtgatcatccgggagttccaggagcactgccggcggggcctgctgagcaaccacacaggcagccccaggagccccagcaccacctacctgcacacccccaccccatctgaagatgctgccatccccagcaagagccggctgaagaggctcatcagcgagaacagcgtgtatgagaagaggccagacttcaggatgtgctggtacgtgcacccccaggtgctgcagagcttccagcaggagcacctgcctgtgccctgccagtggagctatgtgacctctgtgcccagcgcccccaaggaggacagcggctctgtgcccagcacaggccccagccagggcacccccatcagcctgaagaggaagtctgctggctccatgtgcatcacccagttcatgaagaagagaagacatgatggccagatcggggctgaggacatggatggcttccaggccgacacagaggaggaggaggaggaggagggggactgcatgattgtggatgtgcctgatgctgctgaggtgcaggccccctgtggggccgccagcggggccggcggcggcgtgggcgtggacaccgggaaggccaccctgaccagcagccccctgggcgccagctag

SEQ ID NO: 15133 - DNA, 2250 bp, Artificial Sequence
  Description of Artificial Sequence: Synthetic coding sequence
atgctggaggagctggagtgtggggcccctggggcccggggagctgccacagccatggactgcaaggacaggcctgccttccctgtgaagaagctgatccaggcccggctgcccttcaagaggctgaacctggtgcccaagggcaaggcagatgacatgtctgatgaccagggcacctctgtgcagagcaagagcccagacctggaggccagcctggacaccctggagaacaactgccacgtgggcagtgacatcgacttccggcccaagctggtgaatggcaagggccccctggacaacttcctgaggaaccgcatcgagaccagcatcggccagagcaccgtcatcatcgacctgacagaggacagcaatgagcagcctgacagcctggtggaccacaacaagctgaacagcgaggccagccccagccgggaggccatcaatggccagcgggaggacaccggggaccagcagggcctgctgaaggccatccagaatgacaagctggccttccctggagagaccctgagtgacatcccctgcaagacagaggaggagggcgtgggctgcggcggggccggcagaagaggagacagccaggagtgcagccccaggagctgcccagagctgaccagcggccccaggatgtgccccaggaaggagcaggacagctggagcgaggccggcggcatcctcttcaagggcaaggtgcccatggtggtgctgcaggacatcctggccgtgcggcccccccagatcaagagcctgcctgccaccccccagggcaagaacatgaccccagagagcgaggtgctggagagcttccctgaggaggacagcgtgctgagccacagcagcctgagcagccccagcagcaccagcagccctgagggccccccagccccacccaagcagcacagcagcaccagccccttccccaccagcacccccctgcggcgcatcaccaagaagtttgtgaagggcagcacagagaagaacaagctgcggctgcagagggaccaggagcggctgggcaagcagctgaagctgcgggcagagcgggaggagaaggagaagctgaaggaggaggccaagagggccaaggaggaggccaagaagaagaaggaggaggagaaggagctgaaggagaaggagcggcgggagaagcgggagaaggatgagaaggagaaggccgagaagcagaggctgaaggaggagaggaggaaggagcggcaggaggccctggaggccaagctggaggagaagaggaagaaggaggaggagaagaggctgcgggaggaggagaagaggatcaaggccgagaaggccgagatcacccgcttcttccagaagcccaagaccccccaggcccccaagaccctggccggcagctgtgggaagtttgccccctttgagatcaaggagcacatggtgctggcccccaggagaagaacagccttccacccagacctgtgcagccagctggaccagctgctgcagcagcagagcggggagttctccttcctgaaggacctgaagggccggcagcccctgcggagcggccccacccacgtgtccaccagaaatgctgacatcttcaacagtgatgtggtgattgtggagcggggcaaaggagatggagtgcctgagaggaggaagtttggccgcatgaagctgctgcagttctgtgagaaccacaggcctgcctactggggcacctggaacaagaagacagccctgatccgggcccgggacccctgggcccaggacaccaagctgctggactatgaggtggacagtgatgaggagtgggaggaggaggagcctggagagagcctgagccacagtgaaggagatgatgatgatgacatgggagaagatgaagatgaagatgatggcttctttgtgccccacggctacctgtctgaagatgagggcgtgacagaggagtgtgccgaccctgagaaccacaaggtgcggcagaagctgaaggccaaggagtgggatgagttcctggccaagggcaagcgcttccgggtgctgcagcctgtgaagattggctgtgtgtgggccgctgaccgggactgtgctggagatgacctgaaggtgctgcagcagtttgctgcccactgggtgcaccctgagagcagaggagatgtgtgcaggatgctgcgggtgagcagcccccagagccgctacctgaaccggctgaacagctgtgtgaagagcaccctgagctgcttcacctag

SEQ ID NO: 15134 - DNA, 2352 bp, Artificial Sequence
  Description of Artificial Sequence: Synthetic coding sequence
atgctggaggagctggagtgtggggcccctggggcccggggagctgccacagccatggactgcaaggacaggcctgccttccctgtgaagaagctgatccaggcccggctgcccttcaagaggctgaacctggtgcccaagggcaaggcagatgacatgtctgatgaccagggcacctctgtgcagagcaagagcccagacctggaggccagcctggacaccctggagaacaactgccacgtgggcagtgacatcgacttccggcccaagctggtgaatggcaagggccccctggacaacttcctgaggaaccgcatcgagaccagcatcggccagagcaccgtcatcatcgacctgacagaggacagcaatgagcagcctgacagcctggtggaccacaacaagctgaacagcgaggccagccccagccgggaggccatcaatggccagcgggaggacaccggggaccagcagggcctgctgaaggccatccagaatgacaagctggccttccctggagagaccctgagtgacatcccctgcaagacagaggaggagggcgtgggctgcggcggggccggcagaagaggagacagccaggagtgcagccccaggagctgcccagagctgaccagcggccccaggatgtgccccaggaaggagcaggacagctggagcgaggccggcggcatcctcttcaagggcaaggtgcccatggtggtgctgcaggacatcctggccgtgcggcccccccagatcaagagcctgcctgccaccccccagggcaagaacatgaccccagagagcgaggtgctggagagcttccctgaggaggacagcgtgctgagccacagcagcctgagcagccccagcagcaccagcagccctgagggccccccagccccacccaagcagcacagcagcaccagccccttccccaccagcacccccctgcggcgcatcaccaagaagtttgtgaagggcagcacagagaagaacaagctgcggctgcagagggaccaggagcggctgggcaagcagctgaagctgcgggcagagcgggaggagaaggagaagctgaaggaggaggccaagagggccaaggaggaggccaagaagaagaaggaggaggagaaggagctgaaggagaaggagcggcgggagaagcgggagaaggatgagaaggagaaggccgagaagcagaggctgaaggaggagaggaggaaggagcggcaggaggccctggaggccaagctggaggagaagaggaagaaggaggaggagaagaggctgcgggaggaggagaagaggatcaaggccgagaaggccgagatcacccgcttcttccagaagcccaagaccccccaggcccccaagaccctggccggcagctgtgggaagtttgccccctttgagatcaaggagcacatggtgctggcccccaggagaagaacagccttccacccagacctgtgcagccagctggaccagctgctgcagcagcagagcggggagttctccttcctgaaggacctgaagggccggcagcccctgcggagcggccccacccacgtgtccaccagaaatgctgacatcttcaacagtgatgtggtgattgtggagcggggcaaaggagatggagtgcctgagaggaggaagtttggccgcatgaagctgctgcagttctgtgagaaccacaggcctgcctactggggcacctggaacaagaagacagccctgatccgggcccgggacccctgggcccaggacaccaagctgctggactatgaggtggacagtgatgaggagtgggaggaggaggagcctggagagagcctgagccacagtgaaggagatgatgatgatgacatgggagaagatgaagatgaagatgatggcttctttgtgccccacggctacctgtctgaagatgagggcgtgacagaggagtgtgccgaccctgagaaccacaaggtgcggcagaagctgaaggccaaggagtgggatgagttcctggccaagggcaagcgcttccgggtgctgcagcctgtgaagattggctgtgtgtgggccgctgaccgggactgtgctggagatgacctgaaggtgctgcagcagtttgctgcctgcttcctggagaccctgcctgcccaggaggagcagacccccaaggccagcaagcgggagaggagagatgagcagatcctggcccagctgctgcccctgctgcacggcaatgtgaatggcagcaaggtgatcatccgggagttccaggagcactgccggcggggcctgctgagcaaccacacaggcaaggccaccctgaccagcagccccctgggcgccagctag

SEQ ID NO: 15135 - DNA, 519 bp, Artificial Sequence
  Description of Artificial Sequence: Synthetic coding sequence
atgaccagcgccagcaccaaggtgggggagatcttctctgctgctggagctgccttcaccaagctgggggagctgaccatgcagctgcaccctgtggccgacagcagccctgctggggccaagtggacagaaacagaaattgagatgctgcgggctgctgtgaagagatttggagatgacctgaaccacatcagctgtgtgatcaaggagaggacagtggcccagatcaaggccaccgtgaagaggaaggtgtatgaggacagcggcatccccctgcctgctgagagccccaagaagggccccaagaaggtggccagcggcgtgctgagccccccacctgctgcccccccacccagcagcagctctgtgcctgaggccggcggcccccccatcaagaagcagaaggcagatgtgaccctgagcgccctgaatgacagtgatgccaacagtgatgtggtggacatcgagggcctgggggagaccccaccagccaagaagctgaactttgaccaggcctag

SEQ ID NO: 15136 - DNA, 579 bp, Artificial Sequence
  Description of Artificial Sequence: Synthetic coding sequence
atgaccagcgccagcaccaaggtgggggagatcttctctgctgctggagctgccttcaccaagctgggggagctgaccatgcagctgcaccctgtggccgacagcagccctgctggggccaagtggacagaaacagaaattgagatgctgcgggctgctgtgaagagatttggagatgacctgaaccacatcagctgtgtgatcaaggagaggacagtggcccagatcaaggccaccgtgaagaggaaggtgtatgaggacagcggcatccccctgcctgctgagagccccaagaagggccccaagaaggtggccagcggcgtgctgagccccccacctgctgcccccccacccagcagcagctctgtgcctgaggccggcggcccccccatcaagaagcagaaggcagatgtgaccctgagcgccctgaatgacagtgatgccaacagtgatgtggtggacatcgagggcctgggggagaccccaccagccaagaagctgaactttgaccaggacagcctgaccctggacagcggcctgctgatgaccagcgctgacccccccctgctgagctgctag

SEQ ID NO: 15137 - DNA, 417 bp, Artificial Sequence
  Description of Artificial Sequence: Synthetic coding sequence
atgaccagcgccagcaccaaggtgggggagatcttctctgctgctggagctgccttcaccaagctgggggagctgaccatgcagctgcaccctgtggccgacagcagccctgctggggcccagatcaaggccaccgtgaagaggaaggtgtatgaggacagcggcatccccctgcctgctgagagccccaagaagggccccaagaaggtggccagcggcgtgctgagccccccacctgctgcccccccacccagcagcagctctgtgcctgaggccggcggcccccccatcaagaagcagaaggcagatgtgaccctgagcgccctgaatgacagtgatgccaacagtgatgtggtggacatcgagggcctgggggagaccccaccagccaagaagctgaactttgaccaggcctag

SEQ ID NO: 15138 - DNA, 306 bp, Artificial Sequence
  Description of Artificial Sequence: Synthetic coding sequence
atggccagcaacaagaccaccctgcagaagatgggcaagaagcagaatggcaagagcaagaaggtggaggaggccgagcctgaggagtttgtggtggagaaggtgctggaccggcgggtggtgaatggcaaggtggagtacttcctgaagtggaagggcttcacagagaagctggccaagaagaagatggtgcagaaggaaaatctctacctgactgtgaacctgatgacagccaaccagaggaggaaggagatgctgctgaccaaccaggaggacctgcctgaggtgctgatcctgaaggagtag

SEQ ID NO: 15139 - DNA, 2049 bp, Artificial Sequence
  Description of Artificial Sequence: Synthetic coding sequence
atgacctgcccccccaccggcctgtatggccctgagggcatcctgcctgcccggaggaccctgcggccccagggcaagggccgctggcagcagctgtgggagacccccaccctgctgtgggaggccccccggctgggcctggacacagcccagggcctggagctgctgagcctgctgggcgccctggtggccctgggcgccctgctgctgagccccctgcggcaccctgtgatctacctgctgctgtgggccgcctacctgagcgcctgccaggtgggccaggtgttcctgtacttccagtgggacagcctgctgctggagaccggcttcctggccgtgctggtggcccccctgcggcctgccagccacaggaaggaggccccccagggccggcaggccggggccctgccccatgaggacctgcccttctggctggtgcgctggctgctcttccggctgatgtttgccagcggcgtggtgaagctgaccagccgctgcccagcctggtggggcctgacagccctgacctaccactatgagacccagtgcctgcccaccccagctgcctggtttgcccaccacctgcctgtgtggctgcacaagctgtctgtggtggccaccttcctgattgaaattgctgtgcccccactcttctttgcccccatccggcggctgcggctggccgccttctacagccaggtgctgctgcaggtgctgatcatcatcactggaaactacaacttcttcaacctgatgaccctggtgctgaccacagccctgctggatgaccagcacctggccgctgagcccggccacggcagcaggaagaagacagccacctcctggcccaaggccctgctggccaccctgagcctgctgctggagctggccgtgtatggcctgctggcctacggcaccgtgcactacttcggcctggaggtggactggcagcagaggaccatccacagcaggaccaccttcaccttccaccagttcagccagtggctgaagaccctgaccctgcccaccgtgtggctgggcgtggccagcctggtgtgggagctgctgagcgccctgtggcgctggacccaggtgcggggctggctgaggaagctgtctgctgtggtgcagctgagcctggtgggcacagccaccgtggccctcttcctgatcagcctggtgccctacagctatgtggagcccggcacccacggccgcctgtggacaggagcccaccggctgtttggagctgtggagcacctgcagctggccaacagctatggcctcttccggaggatgacaggcctgggcggccggcctgaggtggtgctggagggcagctatgatggccaccactggacagaaattgagttcatgtacaagccaggcaacctgagccggcccccacctgtggtggtgccccaccagccccggctggactggcagatgtggtttgctgccctgggcccccacacccacagcccctggttcaccagcctggtgctgcggctgctgcagggcaaggagcccgtcatccggctggtgcagagccaggtggcccgctaccccttccacaagcagccccccacctacgtgcgggcccagcgctacaagtactggttcagccagcccggggagcagggccagtggtggaggcggcagtgggtggaggagttcttccccagcgtgtccctgggggaccccaccctggagaccctgctgcggcagtttggcctgcaggagaagagcccccccaggaccaggtctgccaacagcaccctggcccaggccctgcactggaccaggagccagctgagccccctggaggccccagccctgctgtggggcctgctgatggctgtgggcgctgtgcgctttgtgcaggccctgctggccccctgcagcctgcggagcagccccctggcccctgtgtctggagagaagagaagacctgccagccagaaggacagcggggccgccagcgagcaggccacagctgcccccaacccctgcagcagcagcagcaggaccaccaggaggaagaagtag

SEQ ID NO: 15140 - DNA, 1239 bp, Artificial Sequence
  Description of Artificial Sequence: Synthetic coding sequence
atggagctgtctgctgtgggggagcgggtgtttgctgctgagagcatcatcaagaggcgcatcaggaagggccgcatcgagtacctggtgaagtggaagggctgggccatcaagtacagcacctgggagcctgaggagaacatcctggacagccggctgattgctgcctttgagcagaaggagcgggagcgggagctgtatggccccaagaagaggggccccaagcccaagaccttcctgctgaaggcccgggcccaggccgaggccctgcgcatcagtgatgtgcacttctctgtgaagcccagcgccagcgccagcagccccaagctgcacagcagcgctgctgtgcaccggctgaagaaggacatccgccgctgccacaggatgagcagaagacccctgcccaggccagacccccagggcggcagccctggcctgcggccccccatcagccccttcagcgagaccgtgcgcatcatcaacaggaaggtgaagccccgggagcccaagaggaaccgcatcatcctgaacctgaaggtgattgacaagggagctgggggcggcggggccggccagggcgctggggccctggcccggcccaaggtgcccagcaggaacagagtgattggcaagagcaagaagttcagcgagagcgtgctgcggacccagatccgccacatgaagtttggagcctttgccctgtacaagcccccaccagcccccctggtggcccccagccctgggaaggccgaggccagcgcccctggccctggcctgctgctggccgccccagctgccccctatgatgcccggagcagcggcagcagcggctgccccagccccaccccccagagcagtgaccctgatgacaccccacccaagctgctgcctgagaccgtgagccccagcgcccccagctggagggagcctgaggtgctggacctgagcctgcccccagagagcgctgccaccagcaagagggcccctcctgaggtgacagctgctgctggccctgccccacccacagcccctgagcctgctggggccagcagcgagcctgaggccggggactggaggcctgagatgagcccctgcagcaatgtggtggtgacagatgtgaccagcaacctgctgactgtgaccatcaaggagttctgcaacccagaagattttgagaaggtggccgccggcgtggccggggccgccggcggcggcggcagcatcggggccagcaagtag

SEQ ID NO: 15141 - DNA, 1170 bp, Artificial Sequence
  Description of Artificial Sequence: Synthetic coding sequence
atggagctgtctgctgtgggggagcgggtgtttgctgctgaggccctgctgaagaggcgcatcagaaaaggaaggatggagtacctggtgaagtggaagggctggagccagaagtacagcacctgggagcctgaggagaacatcctggatgcccggctgctggccgcctttgaggagcgggagcgggagatggagctgtatggccccaagaagaggggccccaagcccaagaccttcctgctgaaggcccaggccaaggccaaggccaagacctatgagttcagaagtgacagcgcccggggcatccgcatcccctacccaggccgcagcccccaggacctggccagcaccagccgggcccgggagggcctgaggaacatgggcctgagccccccagccagcagcaccagcaccagcagcacctgcagagctgaggccccccgggaccgggaccgggaccgggaccgggaccgggagcgggaccgggagcgggagcgggagcgggagcgggagcgggagcgggagcgggagcgggagcggggcaccagccgggtggatgacaagcccagcagccctggggacagcagcaagaagaggggccccaagcccaggaaggagctgcctgaccccagccagaggcccctgggggagcccagcgctggcctgggggagtacctgaagggcaggaagctggatgacacccccagcggggccggcaagtttcctgctggccacagcgtcatccagctggcccggcggcaggacagcgacctggtgcagtgtggggtgaccagccccagcagcgctgaggccaccgggaagctggccgtggacaccttccctgcccgggtcatcaagcacagagctgccttcctggaggccaagggccagggcgccctggaccccaacggcaccagggtgagacatggcagcggcccccccagcagcggcggcggcctgtacagagacatgggcgcccagggcggccggcccagcctcatcgcccgcatccctgtggcccgcatcctgggggaccctgaggaggagagctggagccccagcctgaccaacctggagaaggtggtggtgacagatgtgaccagcaacttcctgactgtgaccatcaaggagagcaacacagaccagggcttcttcaaggagaagaggtag

SEQ ID NO: 15142 - DNA, 2469 bp, Artificial Sequence
  Description of Artificial Sequence: Synthetic coding sequence
atgaagatgaagatccagaagaaggagaagcagctgagcaacctgaaggtgctgaaccacagccccatgtctgatgcctctgtgaactttgactacaagagccccagcccctttgactgcagcacagaccaggaggagaagattgaagatgtggccagccactgcctgccccagaaggacctgtacacagctgaggaggaggccgccaccctcttccccaggaagatgaccagccacaacggcatggaggacagcggcggcggcggcaccggggtgaagaagaagaggaagaagaaggagcccggggaccaggagggcgccgccaagggcagcaaggaccgggagcccaagcccaagaggaagcgggagcccaaggagcccaaggagcccaggaaggccaaggagcccaagaaggccaaggagcacaaggagcccaagcagaaggatggagccaagaaggccaggaagccccgggaggccagcggcaccaaggaggccaaggagaagaggagctgcacagattctgctgcccggaccaagagcaggaaggccagcaaggagcagggccccacccctgtggagaagaagaagaagggcaagaggaagtctgagaccaccgtggagagcctggagctggaccagggcctgaccaaccccagcctgcggagccctgaggagagcacagagagcacagacagccagaagaggaggagcggccggcaggtgaagaggaggaagtacaatgaagacctggacttcaaggtggtggatgatgatggagagaccatcgctgtgctgggcgccggccgcaccagcgccctgagcgccagcaccctggcctggcaggccgaggagcccccagaagatgatgccaacatcatcgagaagatcctggccagcaagacagtgcaggaggtgcaccctggagagcccccatttgacctggagctgttctacgtgaagtacagaaacttctcctacctgcactgcaagtgggccaccatggaggagctggagaaggacccccgcatcgcccagaagatcaagcgcttcaggaacaagcaggcccagatgaagcacatcttcacagagccagatgaagatctcttcaacccagactatgtggaggtggaccgcatcctggaggtggcccacaccaaggatgctgagactggagaggaggtgacccactacctggtgaagtggtgcagcctgccctatgaggagagcacctgggagctggaggaggatgtggaccctgccaaggtgaaggagtttgagagcctgcaggtgctgcctgagatcaagcacgtggagaggcctgccagtgacagctggcagaagctggagaagagccgggagtacaagaacagcaaccagctgcgggagtaccagctggagggcatgaactggctgctcttcaactggtacaacaggaagaactgcatcctggctgatgagatgggcctgggcaagaccatccagagcatcaccttcctgtctgagatcttcctgcggggcatccacggccccttcctgatcatcgcccccctgagcaccatcaccaactgggagcgggagttccgcacctggacagagatgaatgccatcgtgtaccacggcagccagatcagccggcagatgatccagcagtatgagatggtgtacagagatgcccagggcaaccccctgtctggagtcttcaagttccacgtggtgatcaccacctttgagatgatcctggccgactgcccagacctgaagaagatcttctggggccgctggaaggacatcctgacccacggccgcttcaagtggcacctgaatgagaaggacatggagatgatctgccgggccctgctggtgtactgtgtgaagcactacaagggagatgagaagatcaagagcttcatctgggagctgatcacccccaccaaggatggccaggcccagaccctgcagaaccacagcggcctgagcgcccctgtgccccggggcaggaagggcaagaagaccaagaaccagctgctgatccctgagctgaaggatgctgactggctggccacctgcaaccctgaggtggtgctgcatgatgatggctacaagaagcacctgaagcagcactgcaacaaggtgctgctgcgggtgaggatgctgtactacctgaaggccgagatcctgggggaggccgctgagaaggcctttgagggcagccctgcccgggagctggatgtgcccctgcctgacatcgactacatggagatccctgtggactggtgggatgctgaggccgacaagagcctgctgattggagtcttcaagcacggctatgagcgctacaatgccatgagagctgaccctgccctgtgcttcctggagaaggtgggcatgccagatgagaagagcctgtctgctgagcagggcgtgacagatggcaccagtgacatccctgagcggcagcacaggtag

SEQ ID NO: 15143 - DNA, 1122 bp, Artificial Sequence
  Description of Artificial Sequence: Synthetic coding sequence
atgtgccagagccacatgattggcttctgcaccagctctgtgaatgaggagacagagacccagggcgaccagatcagctgccccaaccccaccaccctggtgttccgcacccagatcagcagcctgcccagcctgcagctgagcaacctgaaggtgctgaaccacagccccatgtctgatgcctctgtgaactttgactacaagagccccagcccctttgactgcagcacagaccaggaggagaagattgaagatgtggccagccactgcctgccccagaaggacctgtacacagctgaggaggaggccgccaccctcttccccaggaagatgaccagccacaacggcatggaggacagcggcggcggcggcactggagtgaagaagaagaggaagaagaaggagcccggggaccaggagggcgccgccaagggcagcaaggaccgggagcccaagcccaagaggaagcgggagcccaaggagcccaaggagcccaggaaggccaaggagcccaagaaggccaaggagcacaaggagcccaagcagaaggatggagccaagaaggccaggaagccccgggaggccagcggcaccaaggaggccaaggagaagaggagctgcacagacagcgctgcccggaccaagagcaggaaggccagcaaggagcagggccccacccctgtggagaagaagaagaagggcaagaggaagtctgagaccaccgtggagagcctggagctggaccagggcctgaccaaccccagcctgcggagccctgaggagagcacagagagcacagacagccagaagagaagaagtggccggcaggtgaagaggaggaagtacaatgaagacctggacttcaaggtggtggatgatgatggagagaccatcgctgtgctgggcgccggccgcaccagcgccctgagcgccagcaccctggcctggcaggccgaggagcccccagaagatgatgccaacatcatcgagaagatcctggccagcaagacagtgcaggaggtgcaccctggagagcccccatttgacctggagctgttctacgtgaagtacagaaacctgtatgtgtacctgaagtacagcctgtacctgggcttcatctag

SEQ ID NO: 15144 - DNA, 8148 bp, Artificial Sequence
  Description of Artificial Sequence: Synthetic coding sequence
atgaagatgaagatccagaagaaggagaagcagctgagcaacctgaaggtgctgaaccacagccccatgtctgatgcctctgtgaactttgactacaagagccccagcccctttgactgcagcacagaccaggaggagaagattgaagatgtggccagccactgcctgccccagaaggacctgtacacagctgaggaggaggccgccaccctcttccccaggaagatgaccagccacaacggcatggaggacagcggcggcggcggcaccggggtgaagaagaagaggaagaagaaggagcccggggaccaggagggcgccgccaagggcagcaaggaccgggagcccaagcccaagaggaagcgggagcccaaggagcccaaggagcccaggaaggccaaggagcccaagaaggccaaggagcacaaggagcccaagcagaaggatggagccaagaaggccaggaagccccgggaggccagcggcaccaaggaggccaaggagaagaggagctgcacagattctgctgcccggaccaagagcaggaaggccagcaaggagcagggccccacccctgtggagaagaagaagaagggcaagaggaagtctgagaccaccgtggagagcctggagctggaccagggcctgaccaaccccagcctgcggagccctgaggagagcacagagagcacagacagccagaagaggaggagcggccggcaggtgaagaggaggaagtacaatgaagacctggacttcaaggtggtggatgatgatggagagaccatcgctgtgctgggcgccggccgcaccagcgccctgagcgccagcaccctggcctggcaggccgaggagcccccagaagatgatgccaacatcatcgagaagatcctggccagcaagacagtgcaggaggtgcaccctggagagcccccatttgacctggagctgttctacgtgaagtacagaaacttctcctacctgcactgcaagtgggccaccatggaggagctggagaaggacccccgcatcgcccagaagatcaagcgcttcaggaacaagcaggcccagatgaagcacatcttcacagagccagatgaagatctcttcaacccagactatgtggaggtggaccgcatcctggaggtggcccacaccaaggatgctgagactggagaggaggtgacccactacctggtgaagtggtgcagcctgccctatgaggagagcacctgggagctggaggaggatgtggaccctgccaaggtgaaggagtttgagagcctgcaggtgctgcctgagatcaagcacgtggagaggcctgccagtgacagctggcagaagctggagaagagccgggagtacaagaacagcaaccagctgcgggagtaccagctggagggcatgaactggctgctcttcaactggtacaacaggaagaactgcatcctggctgatgagatgggcctgggcaagaccatccagagcatcaccttcctgtctgagatcttcctgcggggcatccacggccccttcctgatcatcgcccccctgagcaccatcaccaactgggagcgggagttccgcacctggacagagatgaatgccatcgtgtaccacggcagccagatcagccggcagatgatccagcagtatgagatggtgtacagagatgcccagggcaaccccctgtctggagtcttcaagttccacgtggtgatcaccacctttgagatgatcctggccgactgcccagagctgaagaagatccactggagctgtgtgatcattgatgaggcccaccggctgaagaacagaaactgcaagctgctggagggcctgaagctgatggccctggagcacaaggtgctgctgaccggcacccccctgcagaacagcgtggaggagctgttcagcctgctgaacttcctggagcccagccagttccccagcgagacagccttcctggaggagtttggagacctgaagacagaggagcaggtgaagaagctgcagagcatcctgaagcccatgatgctgcggcggctgaaggatgatgtggagaagaacctggcccccaagcaggagaccatcatcgaggtggagctgaccaacatccagaagaagtactaccgggccatcctggagaagaacttctccttcctgaccaagggggccaaccagcacaacatgcccaacctgatcaacaccatgatggagctgaggaagtgctgcaaccacccctacctgatcaacggggctgaggagaagatcctggaggacttcaggaagacccacagcccagatgccccagacttccagctgcaggccatgatccaggccgccggcaagctggtgctgattgacaagctgctgcccaagctgattgctgggggccacaaggtgctgatcttcagccagatggtgcgctgcctggacatcctggaggactacctgatccagaggcgctacacctatgaaagaattgatggccgggtgcggggcaacctgcggcaggccgccatcgaccgcttctgcaagccagacagcgacagatttgtgttcctgctgtgcaccagggctgggggcctgggcatcaacctgacagctgctgacacctgcatcatctttgacagcgactggaacccccagaatgacctgcaggcccaggcccgctgccaccgcatcggccagagcaaggctgtgaaggtgtaccgcctcatcaccaggaacagctatgagcgggagatgtttgacaaggccagcctgaagctgggcctggacaaggctgtgctgcaggacatcaacaggaagggcggcaccaacggggtgcagcagctgagcaagatggaggtggaggacctgctgaggaagggggcctatggagccctgatggatgaggaggatgagggcagcaagttctgtgaagaagatattgaccagatcctgcagaggaggacccacaccatcaccatccagagcgagggcaagggcagcacctttgccaaggccagctttgtggccagcggcaacagaacagacatcagcctggatgaccccaacttctggcagaagtgggccaagattgctgagctggacacagaggccaagaatgagaaggagagcctggtgattgaccggccccgggtgaggaagcagaccaagcactacaacagctttgaggaggatgagctgatggagttcagcgagctggacagcgacagtgatgagcggcccaccaggagccggcggctgaatgacaaggcccggcgctacctgcgggcagagtgcttccgggtggagaagaacctgctgatcttcggctggggccgctggaaggacatcctgacccacggccgcttcaagtggcacctgaatgagaaggacatggagatgatctgccgggccctgctggtgtactgtgtgaagcactacaagggagatgagaagatcaagagcttcatctgggagctgatcacccccaccaaggatggccaggcccagaccctgcagaaccacagcggcctgagcgcccctgtgccccggggcaggaagggcaagaagaccaagaaccagctgctgatccctgagctgaaggatgctgactggctggccacctgcaaccctgaggtggtgctgcatgatgatggctacaagaagcacctgaagcagcactgcaacaaggtgctgctgcgggtgaggatgctgtactacctgaaggccgagatcctgggggaggccgctgagaaggcctttgagggcagccctgcccgggagctggatgtgcccctgcctgacatcgactacatggagatccctgtggactggtgggatgctgaggccgacaagagcctgctgattggagtcttcaagcacggctatgaaagatacaatgccatgagagctgaccctgccctgtgcttcctggagaaggtgggcatgccagatgagaagagcctgtctgctgagcagggcgtgacagatggcaccagtgacatccctgagcggggcaacacagacaaggaggacaatgctgaggacaaggtggatggcctgcagaagcagacagagagcagcagtgatggaggagatggagtcttcagcgagaagaaggatgacagccgggccgcccaggacggcagtgaccctgacaagagcccctggcctgtgagcagcgccctgacagcccggctgcggcggctggtgacagtgtaccagcgctgcaacaggaaggagctgtgcaggcctgagatcctgggccctggcaaccagggctactgggtgcaggaggagatgttccggaggaccagcgagatggacctgatcaacaaggaggcccagaagcgctggacccggcgggagcaggccgacttctacagaacagtgagcagctttggagtggtgtatgaccaggagaagaagacctttgactggacccagttccgcatcatcagccggctggacaagaagagtgatgagagcctggagcagtacttctacagctttgtggccatgtgcagaaatgtgtgccgcctgcccacctggaaggatggcggccccccagacaccaccatctacgtggagcccatcacagaggagagagctgcccggaccctgtaccgcatcgagctgctgaggaaggtgcgggagcaggtgctgaagtgcccccagctgcacgagcggctgcagctgtgccggcccagcctgtacctgcctgtgtggtgggagtgtgggaagcatgaccgggacctgctgattggaacagccaagcacggcctgaacagaacagactgctacatcatgaatgacccccagctgtccttcctggatgcctacagaaattatgcccagcacaagaggagcggcacccaggcccctggcaacctgtgctgcctgtaccagaccaacagcaagctgtatgagagcctgacctacagccagatgagcaggaccagcgagagcctggagaatgaacctgagaacctggtgcgggtggagagcagagatgaccacctgagcctgcctgatgtgacctgtgagaacttcatcagcaaggtgcaggacgtcatcagcatcaaccatgatgagagcctgctgcctgagagcctggagagcatgatgtatggcaagaaggtgctgagccaggagcccagcagcttccaggagagccccagcaccaacacagagagcaggaaggatgtgatcaccatcagcatcagcaaggatggcaactgccagagcggcggccctgaggccgagatcgccagcggccccaccttcatgggcagcctggaggccggcggcgtggcccaggccaacatcaagaatggcaagcacctgctgatgagcatcagcaaggagggggagctgtgctgcagcgaggccggccagaggcctgagaacatcggccagctggaggccaagtgcctggccagccccagcctgaaccctggaaatgaaagtggctttgtggacatgtgcagcctgtctgtgtgtgacagcaagaggaacctgagcagtgaccagcagctgattgacctgctggagaacaagagcctggagagcaagctgatcctgagccagaaccacagtgatgaggaggaggaggaggaggagaatgaggaggagaacctggccatggctgtgggcatgggagagaggcctgaggtgctgcacctgacagagcccaccaccaacatcagccgggagaagaaccagggcttccaggatgagaccaagaagggcagcctggaggtggccaaccagaccccaggcctgcagagggccttccctgccccagctgcctgccagtgccactgcaagcacatggagcgctggatgcacggcctggagaatgatgaatttgaaattgagaagcccaaggcctacatcccagacctcttcaagagcaagaccaacaccatcgccatggagggggagcccacagccatccccagccagcccttcaaggtgaagcatgagctgctgaaggagccctggaaggagagcgctgagggccagaatgtgttccccacctaccccctggagggcagcgagctgaagtctgaggacatggactttgagaacaaggatgattatgacagagatggcaactgccacagccaggactacccaggcaagtacagcgaggaggagagcaagagcagcaccagcggcatcactggagacattggagatgagctgcaggaggcccgggcccccaccatcgcccagctgctgcaggagaagaccctgtacagcttcagcgagtggcccaaggacagagtcatcatcaaccggctggacaacatctgccacgtggtgctgaagggcaagtggcccagcagccagcagtatgagcccagcggcaccctgcccacccctgtgctgaccagcagcgctggcagcaggaccagcctgtctgagcctgaggccgctgagcacagcttcagcaatggagctgccctggccgcccagatccacaaggagagcttcctggcccctgtgttcaccaaggatgagcagaagcaccggcggccctatgaatttgaggtggagagagatgccaaggcccggggcctggagcagttcagcgccacccacggccacacccccatcatcctgaatggctggcacggggagagcgccatggacctgagctgcagcagcgagggcagccctggggccaccagccccttccctgtgtctgccagcacccccaagatcggggccatcagcagcctgcagggcgccctgggcatggacctgagcggcatcctgcaggccggcctcatccaccctgtgacaggccagatcgtgaatggcagcctgcggagagatgatgctgccaccaggagaagaagaggccgcaggaagcacgtggagggcggcatggacctgatcttcctgaaggagcagaccctgcaggccggcatcctggaggtgcatgaagatcctggccaggccaccctgagcaccacccaccctgagggccctggccctgccaccagcgcccctgagcccgccacagctgccagcagccaggccgagaagagcatccccagcaagagcctgctggactggctgcggcagcaggccgactacagcctggaggtgcccggctttggagccaacttcagtgacaagcccaagcagaggcggccccgctgcaaggagcccgggaagctggatgtgagcagcctgagcggggaggagcgggtgcctgccatccccaaggagcccggcctgcggggcttcctgcctgagaacaagttcaaccacaccctggccgagcccatcctgcgggacaccggccccaggagaagaggccggcggcccaggtctgagctgctgaaggcccccagcatcgtggccgacagccccagcggcatgggccccctcttcatgaatggcctgattgctggcatggacctggtgggcctgcagaacatgaggaacatgcctggcatccccctgaccggcctggtgggcttccctgctggctttgccaccatgcccactggagaggaggtgaagagcaccctgtccatgctgcccatgatgctgcccggcatggctgctgtgccccagatgtttggagtgggcggcctgctgagcccccccatggccaccacctgcaccagcacagccccagccagcctgagcagcaccaccaagagcggcacagctgtgacagagaagacagctgaggacaagcccagcagccatgatgtgaagacagacaccctggccgaggacaagccaggccctggccccttcagtgaccagagcgagcccgccatcaccaccagcagccctgtggccttcaaccccttcctgatccctggggtgtccccaggcctcatctaccccagcatgttcctgagccctggcatgggcatggccctgcctgccatgcagcaggcccggcacagcgagatcgtgggcctggagagccagaagaggaagaagaagaagaccaagggggacaaccccaacagccaccctgagcccgcccccagctgtgagcgggagcccagcggagatgagaactgtgccgagcccagcgcccccctgcctgctgagcgggagcacggggcccaggccggggagggcgccctgaaggacagcaacaatgacaccaactag

SEQ ID NO: 15145 - DNA, 450 bp, Artificial Sequence
  Description of Artificial Sequence: Synthetic coding sequence
atgaagatgaagatccagaagaaggagaagcagctgagcaacctgaaggtgctgaaccacagccccatgtctgatgcctctgtgaactttgactacaagagccccagcccctttgactgcagcacagaccaggaggagaagattgaagatgtggccagccactgcctgccccagaaggacctgtacacagctgaggaggaggccgccaccctcttccccaggaagatgaccagccacaacggcatggaggacagcggcggcggcggcaccggggtgaagaagaagaggaagaagaaggagcccggggaccaggagggcgccgccaagggcagcaaggaccgggagcccaagcccaagaggaagcgggagcccaaggagcccaaggagcccaggaaggccaaggagcccaagaaggccaaggagcacaaggagcccaagcagaaggactag

SEQ ID NO: 15146 - DNA, 1578 bp, Artificial Sequence
  Description of Artificial Sequence: Synthetic coding sequence
tgagccagcaagacagtgcaggaggtgcaccctggagagcccccatttgacctggagctgttctacgtgaagtacagaaacttctcctacctgcactgcaagtgggccaccatggaggagctggagaaggaccccagaattgcccagaagatcaagcgcttcaggaacaagcaggcccagatgaagcacatcttcacagagccagatgaggacctcttcaacccagactatgtggaggtggaccgcatcctggaggtggcccacaccaaggatgctgagaccggggaggaggtgacccactacctggtgaagtggtgcagcctgccctatgaggagagcacctgggagctggaggaggatgtggaccctgccaaggtgaaggagtttgagagcctgcaggtgctgcctgagatcaagcacgtggagaggcctgccagtgacagctggcagaagctggagaagagccgggagtacaagaacagcaaccagctgcgggagtaccagctggagggcatgaactggctgctcttcaactggtacaacaggaagaactgcatcctggctgatgagatgggcctgggcaagaccatccagagcatcaccttcctgtctgagatcttcctgcggggcatccacggccccttcctgatcatcgcccccctgagcaccatcaccaactgggagcgggagttccgcacctggacagagatgaatgccatcgtgtaccacggcagccagatcagccggcagatgatccagcagtatgagatggtgtacagagatgcccagggcaaccccctgagcggggtcttcaagttccacgtggtgatcaccacctttgagatgatcctggccgactgcccagagctgaagaagatccactggggccgctggaaggacatcctgacccacggccgcttcaagtggcacctgaatgagaaggacatggagatgatctgccgggccctgctggtgtactgtgtgaagcactacaagggagatgagaagatcaagagcttcatctgggagctgatcacccccaccaaggatggccaggcccagaccctgcagaaccacagcggcctgagcgcccctgtgccccggggcaggaagggcaagaagaccaagaaccagctgctgatccctgagctgaaggatgctgactggctggccacctgcaaccctgaggtggtgctgcatgatgatggctacaagaagcacctgaagcagcactgcaacaaggtgctgctgcgggtgaggatgctgtactacctgaaggccgagatcctgggggaggccgctgagaaggcctttgagggcagccctgcccgggagctggatgtgcccctgcctgacatcgactacatggagatccctgtggactggtgggatgctgaggccgacaagagcctgctgattggagtcttcaagcacggctatgaaagatacaatgccatgagagctgaccctgccctgtgcttcctggagaaggtgggcatgccagatgagaagagcctgtctgctgagcagggcgtgacagatggcaccagtgacatccctgagcggcagcacaggtag

SEQ ID NO: 15147 - DNA, 1521 bp, Artificial Sequence
  Description of Artificial Sequence: Synthetic coding sequence
atggccagcggggacctgtatgaggtggagcgcatcgtggacaagaggaagaacaagaagggcaagtgggagtacctgatccgctggaagggctacggcagcacagaggacacctgggagcctgagcaccacctgctgcactgtgaggagttcattgatgagttcaacggcctgcacatgagcaaggacaagaggatcaagagcggcaagcagagcagcaccagcaagctgctgcgggacagccggggccccagcgtggagaagctgagccaccggcccagcgaccccgggaagagcaagggcaccagccacaagaggaagaggatcaacccccccctggccaagcccaagaagggctacagcggcaagcccagcagcggcggggaccgggccaccaagacagtgtcctaccgcaccacccccagcggcctgcagatcatgcccctgaagaagagccagaatggcatggagaatggagatgctggcagcgagaaggatgagcggcactttggaaatggcagccaccagcccggcctggacctgaatgaccacgtgggggagcaggacatgggagaatgtgatgtgaaccacgccaccctggccgagaatggcctgggcagcgccctgaccaatggaggcctgaacctgcacagccctgtgaagaggaagctggaggccgagaaggactatgtgtttgacaagaggctgcgctacagcgtgcggcagaatgaaagcaactgccgcttccgggacatcgtggtgaggaaggaggagggcttcacccacatcctgctgagcagccagaccagtgacaacaatgccctgaccccagagatcatgaaggaggtgcggcgggccctgtgcaatgctgccacagatgacagcaagctgctgctgctgtctgctgtgggctctgtgttctgcagcggcctggactacagctacctgattggccgcctgagcagtgacaggaggaaggagagcaccagaattgctgaggccatccgggactttgtgaaggccttcatccagttcaagaagcccatcgtggtggccatcaatggacctgccctgggcctgggcgccagcatcctgcccctgtgtgacatcgtgtgggccagcgagaaggcctggttccagaccccctatgccaccatccggctgaccccagctggctgcagcagctacaccttcccccagatcctgggcgtggccctggccaatgagatgctgttctgtggcaggaagctgacagcccaggaggcctgcagccggggcctggtgtcccaggtgttctggcccaccaccttcagccaggaggtgatgctgcgggtgaaggagatggccagctgcagcgctgtggtgctggaggagagcaagtgcctggtgcgctccttcctgaagtctgtgctggaggatgtgaatgagaaggagtgcctgatgctgaagcagctgtggagcagcagcaagggcctggacagcctcttctcctacctgcaggacaagatctatgaggtgtag

SEQ ID NO: 15148 - DNA, 1665 bp, Artificial Sequence
  Description of Artificial Sequence: Synthetic coding sequence
atggccagccaggagtttgaggtggaggccatcgtggacaagaggcaggacaagaatggaaacacccagtacctggtgcgctggaagggctatgacaagcaggatgacacctgggagcctgagcagcacctgatgaactgtgagaagtgtgtgcatgacttcaacagacggcagacagagaagcagaagaagctgacctggaccaccaccagccgcatcttcagcaacaatgcccggcggaggaccagccgcagcaccaaggccaactacagcaagaacagccccaagacccctgtgacagacaagcaccacaggagcaagaacaggaagctgtttgctgccagcaagaatgtgcggaggaaggccgccagcatcctgagtgacaccaagaacatggagatcatcaacagcaccatcgagaccctggccccagacagcccctttgaccacaagacagtgtctggcttccagaagctggagaagctggaccccatcgctgctgaccagcaggacacagtggtgttcaaggtgacagagggcaagctgctgcgggaccccctgagcaggcctggagctgagcagacaggcatccagaacaagacccagatccaccccctgatgagccagatgagcggctctgtgacagcctccatggccaccggcagcgccaccaggaagggcatcgtggtgctgattgaccccctggccgccaacggcaccacagacatgcacacctctgtgccccgggtgaagggcggccagaggaacatcacagatgacagccgggaccagcccttcatcaagaagatgcacttcaccatccggctgacagaaagtgccagcacctacagagacatcgtggtgaagaaggaggatggcttcacccagatcgtgctgagcaccaggagcacagagaagaatgccctgaacacagaggtgatcaaggagatcgtgaatgccctgaacagcgctgctgctgatgacagcaagctggtgctcttctctgctgctggctctgtgttctgctgcggcctggactttggctactttgtgaagcacctgaggaacaacagaaacacagccagcctggagatggtggacaccatcaagaactttgtgaacaccttcatccagttcaagaagcccatcgtggtgtctgtgaatggacctgccatcggcctgggcgccagcatcctgcccctgtgtgacctggtgtgggccaatgagaaggcctggttccagaccccctacaccaccttcggccagagcccagatggctgcagcagcatcaccttccccaagatgatgggcaaggccagcgccaatgagatgctgattgctggcaggaagctgacagcccgggaggcctgtgccaagggcctggtgtcccaggtgttcctgaccggcaccttcacccaggaggtgatgatccagatcaaggagctggccagctacaaccccatcgtgctggaggagtgcaaggccctggtgcgctgcaacatcaagctggagctggagcaggccaatgaaagagaatgtgaggtgctgaggaagatctggagcagcgcccagggcatcgagagcatgctgaagatccccctgctgggctacaaggccgccttcccccccaggaagacccagaatgaccagcgctggtgcccctag

SEQ ID NO: 15149 - DNA, 1623 bp, Artificial Sequence
  Description of Artificial Sequence: Synthetic coding sequence
atggccagccaggagtttgaggtggaggccatcgtggacaagaggcaggacaagaatggaaacacccagtacctggtgcgctggaagggctatgacaagcaggatgacacctgggagcctgagcagcacctgatgaactgtgagaagtgtgtgcatgacttcaacagacggcagacagagaagcagaagaagctgacctggaccaccaccagccgcatcttcagcaacaatgcccggcggaggaccagccgcagcaccaaggccaactacagcaagaacagccccaagacccctgtgacagacaagcaccacaggagcaagaacaggaagctgtttgctgccagcaagaatgtgcggaggaaggccgccagcatcctgagtgacaccaagaacatggagatcatcaacagcaccatcgagaccctggccccagacagcccctttgaccacaagacagtgtctggcttccagaagctggagaagctggaccccatcgctgctgaccagcaggacacagtggtgttcaaggtgacagagggcaagctgctgcgggaccccctgagcaggcctggagctgagcagacaggcatccagaacaagacccagatccaccccctgatgagccagatgagcggctctgtgacagcctccatggccaccggcagcgccaccaggaagggcatcgtggtgctgattgaccccctggccgccaacggcaccacagacatgcacacctctgtgccccgggtgaagggcggccagaggaacatcacagatgacagccgggaccagcccttcatcaagaagatgcacttcaccatccggctgacagaaagtgccagcacctacagagacatcgtggtgaagaaggaggatggcttcacccagatcgtgctgagcaccaggagcacagagaagaatgccctgaacacagaggtgatcaaggagatcgtgaatgccctgaacagcgctgctgctgatgacagcaagctggtgctcttctctgctgctggctctgtgttctgctgcggcctggactttggctactttgtgaagcacctgaggaacaacagaaacacagccagcctggagatggtggacaccatcaagaactttgtgaacaccttcatccagttcaagaagcccatcgtggtgtctgtgaatggacctgccatcggcctgggcgccagcatcctgcccctgtgtgacctggtgtgggccaatgagaaggcctggttccagaccccctacaccaccttcggccagagcccagatggctgcagcagcatcaccttccccaagatgatgggcaaggccagcgccaatgagatgctgattgctggcaggaagctgacagcccgggaggcctgtgccaagggcctggtgtcccaggtgttcctgaccggcaccttcacccaggaggtgatgatccagatcaaggagctggccagctacaaccccatcgtgctggaggagtgcaaggccctggtgcgctgcaacatcaagctggagctggagcaggccaatgaaagagaatgtgaggtgctgaggaagatctggagcagcgcccagggcatcgagagcatgctgaagtatgtggagaacaagattgatgagttctag

SEQ ID NO: 15150 - DNA, 1626 bp, Artificial Sequence
  Description of Artificial Sequence: Synthetic coding sequence
atggccagccaggagtttgaggtggaggccatcgtggacaagaggcaggacaagaatggaaacacccagtacctggtgcgctggaagggctatgacaagcaggatgacacctgggagcctgagcagcacctgatgaactgtgagaagtgtgtgcatgacttcaacagacggcagacagagaagcagaagaagctgacctggaccaccaccagccgcatcttcagcaacaatgcccggcggaggaccagccgcagcaccaaggccaactacagcaagaacagccccaagacccctgtgacagacaagcaccacaggagcaagaactgcaagctgtttgctgccagcaagaatgtgcggaggaaggccgccagcaccctgagtgacaccaagaacatggagatcatcaacagcaccatcgagaccctggccccagacagcccctttgaccacaagaagacagtgtctggcttccagaagctggagaagctggaccccatcgctgctgaccagcaggacacagtggtgttcaaggtgacagagggcaagctgctgcgggaccccctgagccaccctggagctgagcagacaggcatccagaacaagacccagatgcaccccctgatgagccagatgagcggctctgtgacagcctccatggccactggaagtgccaccaggaaaggaattgtggtgctgattgaccccctggccgccaacggcaccacagacatgcacacctctgtgccccgggtgaagggcggccagaggaacatcacagatgacagccggggccagcccttcatcaagaagatgcacttcaccatccggctgacagagagcgccatcacctacagagacatcgtggtgaagaaggaggatggcttcacccagatcgtgctgagcaccaggagcacagagaagaatgccctgaacacagaggtgatcaaggagatggtgaatgccctgaacagcgctgctgctgatgacagcaagctggtgctcttctctgctgctggcagcgtcttctgctgcggcctggactttggctactttgtgcgccacctgagaaatgacaggaacacagccagcctggagatggtggacaccatcaagaactttgtgaacaccttcatccagttcaagaagcccatcgtggtgtctgtgaatggacctgccatcggcctgggcgccagcatcctgcccctgtgtgacctggtgtgggccaatgagaaggcctggttccagaccccctacaccaccttcggccagagcccagatggctgcagcagcatcaccttccccaagatgatgggcaaggccagcgccaatgagatgctgattgctggcaggaagctgacagcccgggaggcctgtgccaagggcctggtgtcccaggtgttcctgaccggcaccttcacccaggaggtgatgatccagatcaaggagctggccagctacaatgccatcgtgctggaggagtgcaaggccctggtgcgctgcaacatcaagctggagctggagcaggccaatgaaagagaatgtgaggtgctgaggaagatctggagcagcgcccagggcattgaatccatgctgaagtatgtggagaacaagattgatgagttctag

SEQ ID NO: 15151 - DNA, 1668 bp, Artificial Sequence
  Description of Artificial Sequence: Synthetic coding sequence
atggccagccaggagtttgaggtggaggccatcgtggacaagaggcaggacaagaatggaaacacccagtacctggtgcgctggaagggctatgacaagcaggatgacacctgggagcctgagcagcacctgatgaactgtgagaagtgtgtgcatgacttcaacagacggcagacagagaagcagaagaagctgacctggaccaccaccagccgcatcttcagcaacaatgcccggcggaggaccagccgcagcaccaaggccaactacagcaagaacagccccaagacccctgtgacagacaagcaccacaggagcaagaactgcaagctgtttgctgccagcaagaatgtgcggaggaaggccgccagcaccctgagtgacaccaagaacatggagatcatcaacagcaccatcgagaccctggccccagacagcccctttgaccacaagaagacagtgtctggcttccagaagctggagaagctggaccccatcgctgctgaccagcaggacacagtggtgttcaaggtgacagagggcaagctgctgcgggaccccctgagccaccctggagctgagcagacaggcatccagaacaagacccagatgcaccccctgatgagccagatgagcggctctgtgacagcctccatggccactggaagtgccaccaggaaaggaattgtggtgctgattgaccccctggccgccaacggcaccacagacatgcacacctctgtgccccgggtgaagggcggccagaggaacatcacagatgacagccggggccagcccttcatcaagaagatgcacttcaccatccggctgacagagagcgccatcacctacagagacatcgtggtgaagaaggaggatggcttcacccagatcgtgctgagcaccaggagcacagagaagaatgccctgaacacagaggtgatcaaggagatggtgaatgccctgaacagcgctgctgctgatgacagcaagctggtgctcttctctgctgctggcagcgtcttctgctgcggcctggactttggctactttgtgcgccacctgagaaatgacaggaacacagccagcctggagatggtggacaccatcaagaactttgtgaacaccttcatccagttcaagaagcccatcgtggtgtctgtgaatggacctgccatcggcctgggcgccagcatcctgcccctgtgtgacctggtgtgggccaatgagaaggcctggttccagaccccctacaccaccttcggccagagcccagatggctgcagcagcatcaccttccccaagatgatgggcaaggccagcgccaatgagatgctgattgctggcaggaagctgacagcccgggaggcctgtgccaagggcctggtgtcccaggtgttcctgaccggcaccttcacccaggaggtgatgatccagatcaaggagctggccagctacaatgccatcgtgctggaggagtgcaaggccctggtgcgctgcaacatcaagctggagctggagcaggccaatgaaagagaatgtgaggtgctgaggaagatctggagcagcgcccagggcattgaatccatgctgaagatccccctgctgggctacaaggccgccttcccccccaggaagacccagaatgaccagcgctggtgcccctag

SEQ ID NO: 15152 - DNA, 423 bp, Artificial Sequence
  Description of Artificial Sequence: Synthetic coding sequence
ggccccccagagcagagcctgctgctgacagaggcctggagctgggccagcaagaagaagcagccccacctgttcagcggcgtgattgtgggcggccacctgtggctgctgggcttcagccctggagctgggggcttctgcaccaccctgcccccatccttcctgcgggtggatgaccgggccaccagcagcaccacagacagcagccgggcccccagcagccccaggcctcctggcagcaccagccactgcggcatcagcacccgctgcacagagcgctgcctgtgtgtgctgcccctgcggaccagccaggtgcctgatgtgatggccccccagcacgaccaggagcccaagaggaggatgtacttcatctggctgggctggatccccagcgacaagcccagccagctgacagagaggtag

SEQ ID NO: 15153 - DNA, 510 bp, Artificial Sequence
  Description of Artificial Sequence: Synthetic coding sequence
cctcctgagcagagcctgctgctgacagaggcctggagctgggccagcaagaagaagcagccccacctgttctctggagtcatcgtgggcggccacctgtggctgctgggcttcagccctggggccggcggcttctgcaccaccctgccccccagcttcctgcgggtggatgaccgggccaccagcagcaccacagacagcagccgggcccccagcagcccccggcccccaggcagcaccagccactgcggcatcagcacccgctgcacagagcgctgcctgtgtgtgctgcccctgcggaccagccaggtgcctgatgtgatggccccccagcacgaccaggagaagttccatgacctggcctacagctgcctgggcaagagcttctccatgagcaaccaggacctgtatggctacagcaccagcagcctggccctgggcctggcctggctgtcctgggagaccaagaagaagaatgtgctgcacctggtgggcctggacagcctgtag

SEQ ID NO: 15154 - DNA, 567 bp, Artificial Sequence
  Description of Artificial Sequence: Synthetic coding sequence
tgagcccagaggggccctgggaaggccggcctgaccggcggccgggagcggctggagcggggggcccgggccgccaggacagaccagcaccagaggatccaggaggaggagcgggacctgactggaagtggggacatcagccccccccagcaccccagccgccacagcttcagccctggagctgggggcttctgcaccaccctgcccccatccttcctgcgggtggatgaccgggccaccagcagcaccacagacagcagccgggcccccagcagccccaggcctcctggcagcaccagccactgcggcatcagcacccgctgcacagagcgctgcctgtgtgtgctgcccctgcggaccagccaggtgcctgatgtgatggccccccagcacgaccaggagaagttccatgacctggcctacagctgcctgggcaagagcttctccatgagcaaccaggacctgtatggctacagcaccagcagcctggccctgggcctggcctggctgtcctgggagaccaagaagaagaatgtgctgcacctggtgggcctggacagcctgtag

SEQ ID NO: 15155 - DNA, 471 bp, Artificial Sequence
  Description of Artificial Sequence: Synthetic coding sequence
atgttcctgacagaagatctcatcaccttcaacctgaggaacttcctgctcttccagctgtgggagagcagcttcagccctggagctgggggcttctgcaccaccctgcccccatccttcctgcgggtggatgaccgggccaccagcagcaccacagacagcagccgggcccccagcagccccaggcctcctggcagcaccagccactgcggcatcagcacccgctgcacagagcgctgcctgtgtgtgctgcccctgcggaccagccaggtgcctgatgtgatggccccccagcacgaccaggagaagttccatgacctggcctacagctgcctgggcaagagcttctccatgagcaaccaggacctgtatggctacagcaccagcagcctggccctgggcctggcctggctgtcctgggagaccaagaagaagaatgtgctgcacctggtgggcctggacagcctgtag

SEQ ID NO: 15156 - DNA, 201 bp, Artificial Sequence
  Description of Artificial Sequence: Synthetic coding sequence
tgacagccccagggccccccagagcagagcctgctgctgacagaggcctggagctgggccagcaagaagaagcagccccacctgttcagcggcgtgattgtgggcggccacctgtggctgctgggccccaagaggaggatgtacttcatctggctgggctggatccccagcgacaagcccagccagctgacagagaggtag

SEQ ID NO: 15157 - DNA, 3615 bp, Artificial Sequence
  Description of Artificial Sequence: Synthetic coding sequence
atgggagatgccaaggaggccggggctgagggccccccagctggagctgctgcccggggcggcctgagcctgctgagccagggcgagagcgaggagagcagcgcccagggcagcgccctcttcctgggcggcaatgaggtgaagagcagagctgtggtgaagtacagcagcgccccacccaggacagcctttgcccggctggaggagaagacagacctgaagctgcccccagccaactggctgcgggagagcgccaagctgggccctgctggcaccaccatcctgggcaacagcaagaagagcaagcccttcagcagctttggcatggcctatgacttcatcgacagcgtgggcaatgatgtggatgtggtgtctgattctgagaacatcaagaagctgctgaagatcccctacagcaagagccacgtgtccatggctgtgcaccgcatcggccgcaccctgctgctggatgagctggacatccaggagctgttcatgaggagcagccagacaggagactggacctggctgaaggagttctaccagaggctgattgaccagaagtggcagaggaagaagaagagcaaggagcactggtaccagaaggccatcctgagcaagttcctgtactacagcatcaatggagatggagctgcccagcctgtgagcagcacagctgagcagcaggagagcagcagcagtgaccagaccaatgacagcgagggcgcctcctggccagccccctttgagatgcccagctctgtgtctgaggaccccagcgccagcagccagggcctgaagaatgactttgtgaggaacatcctgtggacctttgaggacatccacatgctggtgggcagcaacatgcccatctttggaggcggccgctacccagctgtgtccctgcggctgcgggacaacaacaagcccatcaacgtgctgactggaattgactactggctggacaacctgatctgcaatgtgcctgagctggtgatgtgcttccacgtgaatggcatcgtgcagaagtatgagatgatcaagacagaggagatccccaacctggagaacagcaacttcagcaccaaggtgatcaaggacatcgcccagaacatcctgtccttcctgaagagcaactgcaccaaggagggccacacctactggctgttcaaggccagcggcagtgacatcgtgaagctgtatgacctgaccaccctgtgtgaggagacagaggacaagtaccagaaccccttcaccatgcctgtggccatcctgctgtacaaggtggcctgcaacatgatgatgaagaagaaccagaacaagaagcactacggcaccatccgcaccctgctgctgaactgcctgaagctgctggacaagagccgccacccccagatcatcgccagcgccaactacatgctgtctgagctgttccagctggatgagcccaagaaggaggagaacagcgagagccccctgaatgaaaattctgatgagagctacagcgaggaggaggaggagatgccagacagtgatgaaaatggcagctacagcaccagcagtgaccccagtgatgacagcaaggctgtggccatcatcaagtctgtgggggagctgtctgtgcctgagaagtacaagagcatccaccagatccggcccagctgtgccttccctgtgtgccacgacacagaggagcgctgccgcctggtgctgtcctatgtgctggagggcctgaagtctgtggacagcagcatcaagaaggagagtgacctgcctgctgctgaccccagcacccccatccccctgaagtatgaagatgagagcagcagaggaggccctgagggcctggagaagcagatggccctcttcctggacaagatgggcagcctgcagaagggcaactacagcagccagagcggcatgatccctggctcctggcagcacaagatgaagctgcagctgatcctgaagagcagcaaggcctactacgtgctgagtgatgctgccatgagcctgcagaagtatggccgggccctgcgctacatcaagctggccctgcagagccatgacacctactgctgcctgtgcaccaacatgctgtctgaggtgctgctcttcctgagccagtacctgaccctgtgtggggacatccagctgatgctggcccagaatgccaacaacagagctgcccacctggaggagttccactaccagaccaaggaggaccaggagatcctgcacagcctgcaccgggagagcagctgccagggctttgcctgggccacagacctgagcacagacctggagagccagctgtctgtgtcctgcaagtgctatgaagctgccaatgagatcctgcagttcagtgacctgaagagccagaaccctgagcactacgtgcaggtgctgaagaggatgggcaacatcagaaatgaaattggagtcttctacatgaaccaggccgccgccctgcagagcgagcggctggtgtccaagtctgtgtctgctgctgagcagcagctgtggaagaagagcttcagctgctttgagaagggcatccacaactttgagagcattgaagatgccaccaatgctgccctgctgctgtgcaacacaggccgcctgatgaggatctgtgcccaggcccactgtggggctggagatgagctgaagcgggagttcagccctgaggagggcctgtactacaacaaggccatcgactactacctgaaggccctgcggagcctgggcacccgggacatccaccctgctgtgtgggacagcgtgaactgggagctgagcaccacctacttcaccatggccaccctgcagcaggactatgcccccctgagcaggaaggcccaggagcagatcgagaaggaggtgtctgaggccatgatgaagagcctgaagtactgtgatgtggacagcgtgtctgcccggcagcccctgtgccagtacagagctgccaccatccaccaccggctggcctccatgtaccacagctgcctgaggaaccaggtgggagatgagcacctgaggaagcagcaccgggtgctggccgacctgcactacagcaaggccgccaagctgttccagctgctgaaggatgccccctgtgagctgctgcgggtgcagctggagcgggtggcctttgctgagttccagatgaccagccagaacagcaatgtgggcaagctgaagaccctgagcggggccctggacatcatggtgaggacagagcacgccttccagctgatccagaaggagctgattgaggagtttggccagcccaagtctggagatgctgctgctgctgctgatgccagccccagcctgaaccgggaggaggtgatgaagctgctgagcatctttgagagccggctgtccttcctgctgctgcagagcatcaagctgctgagcagcaccaagaagaagaccagcaacaacattgaagatgacaccatcctgaagaccaacaagcacatctacagccagctgctgcgggccacagccaacaagacagccaccctgctggagcgcatcaacgtgattgtgcacctgctgggccagctggccgccggcagcgctgccagcagcaatgctgtgcagtag

SEQ ID NO: 15158 - DNA, 3717 bp, Artificial Sequence
  Description of Artificial Sequence: Synthetic coding sequence
atgggagatgccaaggaggccggggctgagggccccccagctggagctgctgcccggggcggcctgagcctgctgagccagggcgagagcgaggagagcagcgcccagggcagcgccctcttcctgggcggcaatgaggtgaagagcagagctgtggtgaagtacagcagcgccccacccaggacagcctttgcccggctggaggagaagacagacctgaagctgcccccagccaactggctgcgggagagcgccaagctgggccctgctggcaccaccatcctgggcaacagcaagaagagcaagcccttcagcagctttggcatggcctatgacttcatcgacagcgtgggcaatgatgtggatgtggtgtctgattctgagaacatcaagaagctgctgaagatcccctacagcaagagccacgtgtccatggctgtgcaccgcatcggccgcaccctgctgctggatgagctggacatccaggagctgttcatgaggagcagccagacaggagactggacctggctgaaggagttctaccagaggctgattgaccagaagtggcagaggaagaagaagagcaaggagcactggtaccagaaggccatcctgagcaagttcctgtactacagcatcaatggagatggagctgcccagcctgtgagcagcacagctgagcagcaggagagcagcagcagtgaccagaccaatgacagcgagggcgcctcctggccagccccctttgagatgcccagctctgtgtctgaggaccccagcgccagcagccagggcagcgagcccctggagcccagctacatcgtgggccacgtggccagcgcccccaaggagcagaacctgatcaccctcttcaatgatggagagcacagccagggcctgaagaatgactttgtgaggaacatcctgtggacctttgaggacatccacatgctggtgggcagcaacatgcccatctttggaggcggccgctacccagctgtgtccctgcggctgcgggacaacaacaagcccatcaacgtgctgactggaattgactactggctggacaacctgatctgcaatgtgcctgagctggtgatgtgcttccacgtgaatggcatcgtgcagaagtatgagatgatcaagacagaggagatccccaacctggagaacagcaacttcagcaccaaggtgatcaaggacatcgcccagaacatcctgtccttcctgaagagcaactgcaccaaggagggccacacctactggctgttcaaggccagcggcagtgacatcgtgaagctgtatgacctgaccaccctgtgtgaggagacagaggacaagtaccagaaccccttcaccatgcctgtggccatcctgctgtacaaggtggcctgcaacatgatgatgaagaagaaccagaacaagaagcactacggcaccatccgcaccctgctgctgaactgcctgaagctgctggacaagagccgccacccccagatcatcgccagcgccaactacatgctgtctgagctgttccagctggatgagcccaagaaggaggagaacagcgagagccccctgaatgaaaattctgatgagagctacagcgaggaggaggaggagatgccagacagtgatgaaaatggcagctacagcaccagcagtgaccccagtgatgacagcaaggctgtggccatcatcaagtctgtgggggagctgtctgtgcctgagaagtacaagagcatccaccagatccggcccagctgtgccttccctgtgtgccacgacacagaggagcgctgccgcctggtgctgtcctatgtgctggagggcctgaagtctgtggacagcagcatcaagaaggagagtgacctgcctgctgctgaccccagcacccccatccccctgaagtatgaagatgagagcagcagaggaggccctgagggcctggagaagcagatggccctcttcctggacaagatgggcagcctgcagaagggcaactacagcagccagagcggcatgatccctggctcctggcagcacaagatgaagctgcagctgatcctgaagagcagcaaggcctactacgtgctgagtgatgctgccatgagcctgcagaagtatggccgggccctgcgctacatcaagctggccctgcagagccatgacacctactgctgcctgtgcaccaacatgctgtctgaggtgctgctcttcctgagccagtacctgaccctgtgtggggacatccagctgatgctggcccagaatgccaacaacagagctgcccacctggaggagttccactaccagaccaaggaggaccaggagatcctgcacagcctgcaccgggagagcagctgccagggctttgcctgggccacagacctgagcacagacctggagagccagctgtctgtgtcctgcaagtgctatgaagctgccaatgagatcctgcagttcagtgacctgaagagccagaaccctgagcactacgtgcaggtgctgaagaggatgggcaacatcagaaatgaaattggagtcttctacatgaaccaggccgccgccctgcagagcgagcggctggtgtccaagtctgtgtctgctgctgagcagcagctgtggaagaagagcttcagctgctttgagaagggcatccacaactttgagagcattgaagatgccaccaatgctgccctgctgctgtgcaacacaggccgcctgatgaggatctgtgcccaggcccactgtggggctggagatgagctgaagcgggagttcagccctgaggagggcctgtactacaacaaggccatcgactactacctgaaggccctgcggagcctgggcacccgggacatccaccctgctgtgtgggacagcgtgaactgggagctgagcaccacctacttcaccatggccaccctgcagcaggactatgcccccctgagcaggaaggcccaggagcagatcgagaaggaggtgtctgaggccatgatgaagagcctgaagtactgtgatgtggacagcgtgtctgcccggcagcccctgtgccagtacagagctgccaccatccaccaccggctggcctccatgtaccacagctgcctgaggaaccaggtgggagatgagcacctgaggaagcagcaccgggtgctggccgacctgcactacagcaaggccgccaagctgttccagctgctgaaggatgccccctgtgagctgctgcgggtgcagctggagcgggtggcctttgctgagttccagatgaccagccagaacagcaatgtgggcaagctgaagaccctgagcggggccctggacatcatggtgaggacagagcacgccttccagctgatccagaaggagctgattgaggagtttggccagcccaagtctggagatgctgctgctgctgctgatgccagccccagcctgaaccgggaggaggtgatgaagctgctgagcatctttgagagccggctgtccttcctgctgctgcagagcatcaagctgctgagcagcaccaagaagaagaccagcaacaacattgaagatgacaccatcctgaagaccaacaagcacatctacagccagctgctgcgggccacagccaacaagacagccaccctgctggagcgcatcaacgtgattgtgcacctgctgggccagctggccgccggcagcgctgccagcagcaatgctgtgcagtag

SEQ ID NO: 15159 - DNA, 954 bp, Artificial Sequence
  Description of Artificial Sequence: Synthetic coding sequence
tccatccaccagatccggcccagctgtgccttccctgtgtgccacgacacagaggagcgctgccgcctggtgctgtcctatgtgctggagggcctgaagtctgtggacagcagcatcaagaaggagagtgacctgcctgctgctgaccccagcacccccatccccctgaagtatgaagatgagagcagcagaggaggccctgagggcctggagaagcagatggccctcttcctggacaagatgggcagcctgcagaagggcaactacagcagccagagcggcatgatccctggctcctggcagcacaagatgaagctgcagctgatcctgaagagcagcaaggcctactacgtgctgagtgatgctgccatgagcctgcagaagtatggccgggccctgcgctacatcaagctggccctgcagagccatgacacctactgctgcctgtgcaccaacatgctgtctgaggtgctgctcttcctgagccagtacctgaccctgtgtggggacatccagctgatgctggcccagaatgccaacaacagagctgcccacctggaggagttccactaccagaccaaggaggaccaggagatcctgcacagcctgcaccgggagagcagctgccagggcgtgccccaggcctggaccacctggttcaccgtgggcctgtgcagcctggcccacgcctacctgagcatccagaagagaggaagaaacatccgggtgctgatctttgccctgtacctgttcatctacttcctgcggcgcagctttgccctggtggcccaggccggcgtgcagtggtgcaacctgggcagcctgaagcccccacctcctggcttcaagcagttcagctgcctgagcctgcccagctcctggaactacagacatgccccaccctgcccagccagccccccctggccacccaaggtgctgggcctgcaggtgtag

SEQ ID NO: 15160 - DNA, 2391 bp, Artificial Sequence
  Description of Artificial Sequence: Synthetic coding sequence
atgggagatgccaaggaggccggggctgagggccccccagctggagctgctgcccggggcggcctgagcctgctgagccagggcgagagcgaggagagcagcgcccagggcagcgccctcttcctgggcggcaatgaggtgaagagcagagctgtggtgaagtacagcagcgccccacccaggacagcctttgcccggctggaggagaagacagacctgaagctgcccccagccaactggctgcgggagagcgccaagctgggccctgctggcaccaccatcctgggcaacagcaagaagagcaagcccttcagcagctttggcatggcctatgacttcatcgacagcgtgggcaatgatgtggatgtggtgtctgattctgagaacatcaagaagctgctgaagatcccctacagcaagagccacgtgtccatggctgtgcaccgcatcggccgcaccctgctgctggatgagctggacatccaggagctgttcatgaggagcagccagacaggagactggacctggctgaaggagttctaccagaggctgattgaccagaagtggcagaggaagaagaagagcaaggagcactggtaccagaaggccatcctgagcaagttcctgtactacagcatcaatggagatggagctgcccagcctgtgagcagcacagctgagcagcaggagagcagcagcagtgaccagaccaatgacagcgagggcgcctcctggccagccccctttgagatgcccagctctgtgtctgaggaccccagcgccagcagccagggcagcgagcccctggagcccagctacatcgtgggccacgtggccagcgcccccaaggagcagaacctgatcaccctcttcaatgatggagagcacagccagggcctgaagaatgactttgtgaggaacatcctgtggacctttgaggacatccacatgctggtgggcagcaacatgcccatctttggaggcggccgctacccagctgtgtccctgcggctgcgggacaacaacaagcccatcaacgtgctgactggaattgactactggctggacaacctgatctgcaatgtgcctgagctggtgatgtgcttccacgtgaatggcatcgtgcagaagtatgagatgatcaagacagaggagatccccaacctggagaacagcaacttcagcaccaaggtgatcaaggacatcgcccagaacatcctgtccttcctgaagagcaactgcaccaaggagggccacacctactggctgttcaaggccagcggcagtgacatcgtgaagctgtatgacctgaccaccctgtgtgaggagacagaggacaagtaccagaaccccttcaccatgcctgtggccatcctgctgtacaaggtggcctgcaacatgatgatgaagaagaaccagaacaagaagcactacggcaccatccgcaccctgctgctgaactgcctgaagctgctggacaagagccgccacccccagatcatcgccagcgccaactacatgctgtctgagctgttccagctggatgagcccaagaaggaggagaacagcgagagccccctgaatgaaaattctgatgagagctacagcgaggaggaggaggagatgccagacagtgatgaaaatggcagctacagcaccagcagtgaccccagtgatgacagcaaggctgtggccatcatcaagtctgtgggggagctgtctgtgcctgagaagtacaagagcatccaccagatccggcccagctgtgccttccctgtgtgccacgacacagaggagcgctgccgcctggtgctgtcctatgtgctggagggcctgaagtctgtggacagcagcatcaagaaggagagtgacctgcctgctgctgaccccagcacccccatccccctgaagtatgaagatgagagcagcagaggaggccctgagggcctggagaagcagatggccctcttcctggacaagatgggcagcctgcagaagggcaactacagcagccagagcggcatgatccctggctcctggcagcacaagatgaagctgcagctgatcctgaagagcagcaaggcctactacgtgctgagtgatgctgccatgagcctgcagaagtatggccgggccctgcgctacatcaagctggccctgcagagccatgacacctactgctgcctgtgcaccaacatgctgtctgaggtgctgctcttcctgagccagtacctgaccctgtgtggggacatccagctgatgctggcccagaatgccaacaacagagctgcccacctggaggagttccactaccagaccaaggaggaccaggagatcctgcacagcctgcaccgggagagcagctgccaggtgttcaggaagggcgtgtag

SEQ ID NO: 15161 - DNA, 2490 bp, Artificial Sequence
  Description of Artificial Sequence: Synthetic coding sequence
atgggagacctgaagagcggctttgaggaggtggatggagtgcggctgggctacctgatcatcaagggcaagcagatgtttgccctgagccaggtgttcacagacctgctgaagaacatccccaggaccaccgtgcacaagaggatggaccacctgaaggtgaagaagcaccactgtgacctggaggagctgaggaagctgaaggccatcaacagcatcgccttccacgccgccaagtgcaccctcatcagccgggaggatgtggaggccctgtacaccagctgcaagacagagcgggtgctgaagaccaagagaagaagagtgggccgggccctggccaccaaggcccctcctcctgagagagctgctgctgccagccccaggcctggcttctggaaggacaagcaccagctgtggaggggcctgtctggagctgcccggcccctgcccatcagcgcccagagccagaggcctggagctgctgctgcccggcctgctgcccacctgccccagatcttcagcaagtacccaggcagccactacccagagatcgtgcgcagcccctgcaagccacccctgaactatgaaacagcccccctgcagggcaactacgtggccttccccagcgaccctgcctacttccgcagcctgctgtgcagcaagcaccctgctgctgctgctgctgctgctgctgctgctgctgctgctgctgctgctggggccacctgcctggagcgcttccacctggtgaatggcttctgccccccaccccaccaccaccaccaccaccaccaccaccaccaccaccaccaccaccgggcccagcccccccagcagagccaccaccccccccaccaccaccggccccagccccacctgggcagcttccctgagagctgcagcagtgacagcgagagcagcagctacagcgaccatgctgccaatgacagcgactttggcagcagcctgagcagcagcagcaacagcgtgagcagcgaggaggaggaggaggagggggaggaggaggaggaggaggaggaggaggagggcggcagcggggccagtgacagcagcgaggtgagcagcgaggaggaggacagcagcacagaaagtgacagcagcagcggcagcagccaggtgtctgtgcagagcatccgcttccggaggaccagcttctgcaagcccccatctgtgcaggcccaggccaacttcctgtaccacctggccagcgctgctgctgccaccaagccagctgcctttgaagatgctggccgcctgcctgacctgaagagctctgtgaaggccgagagccctgctgagtggaacctgcagagctgggcccccaaggccagccctgtgtactgcccagccagcctgggcagctgctttgctgagatcagaaatgacagagtgtctgagatcaccttcccccacagcgagatcagcaatgctgtgaagaggacagacctgaccatcaactgcctggccgagggcgccagcagccccagccccaagaccaacaatgccttcccccagcagaggatcctgcgggaggccaggaagtgcctgcagaccacccccaccacccactgtgccgacaacaacaccatcgccgcccgcttcctgaacaatgacagcagtggagctgaggccaacagcgagaagtacagcaagatcctgcactgcccagagtttgccacagacctgcccagcagccagacagatcctgaggtgaatgctgctggagctgctgccaccaaggccgagaacccctgcacagacacaggagacaagaccctgcccttcctgcacaacatcaagatcaaggtggaggacagcagcgccaatgaggagtatgagccccacctgttcaccaacaagctgaagtgtgaatgtaatgacaccaagggggagttctacagcgtgacagagagcaaggaggaggatgccctgctgaccacagccaaggagggctttgcctgcccagagaaggagacccccagcctgaaccccctggcccagagccagggcctgagctgcaccctgggcagccccaagccagaagatggagagtacaagtttggagcccgggtgaggaagaactaccgcaccctggtgctgggcaagaggcctgtgctgcagaccccacctgtgaagcccaacctgaagagcgcccggagcccccggcccaccgggaagacagagaccaatgaaggcaccctggatgacttcaccgtcatcaacagaaggaagaaggtggccagcaatgtggccagcgctgtgaagaggcccttccacttcatggccaacttcccctgcccccccagcctcatcatcggcagagatggagacctgtggccagcctacagcctgaacaccaccaaggacagccagaccccccacaaggcccaccccatctggaagtggcagctgggcggcagcgccatccccctgccccccagccacaagttcaggaagttcaacagctag

SEQ ID NO: 15162 - DNA, 2727 bp, Artificial Sequence
  Description of Artificial Sequence: Synthetic coding sequence
atgggagacctgaagagcggctttgaggaggtggatggagtgcggctgggctacctgatcatcaagggcaagcagatgtttgccctgagccaggtgttcacagacctgctgaagaacatccccaggaccaccgtgcacaagaggatggaccacctgaaggtgaagaagcaccactgtgacctggaggagctgaggaagctgaaggccatcaacagcatcgccttccacgccgccaagtgcaccctcatcagccgggaggatgtggaggccctgtacaccagctgcaagacagagcgggtgctgaagaccaagagaagaagagtgggccgggccctggccaccaaggcccctcctcctgagagagctgctgctgccagccccaggcctggcttctggaaggacaagcaccagctgtggaggggcctgtctggagctgcccggcccctgcccatcagcgcccagagccagaggcctggagctgctgctgcccggcctgctgcccacctgccccagatcttcagcaagtacccaggcagccactacccagagatcgtgcgcagcccctgcaagccacccctgaactatgaaacagcccccctgcagggcaactacgtggccttccccagcgaccctgcctacttccgcagcctgctgtgcagcaagcaccctgctgctgctgctgctgctgctgctgctgctgctgctgctgctgctgctgctgctgctgctgcctactaccaggtgtctgctgctggcccccagcccaaggctgctgctggagctgggggccctggcagcctgagctaccgctgcaagaggaagaggggcggggccaaggactgcctgctggcccctcatgctggggcccggcggctgctgctgctgcccaggagctacaaggccaaggctgctgctgctgctgctgctgctgctgctgctgctgctgctgctgctggggccacctgcctggagcgcttccacctggtgaatggcttctgccccccaccccaccaccaccaccaccaccaccaccaccaccaccaccaccaccaccgggcccagcccccccagcagagccaccaccccccccaccaccaccggccccagccccacctgggcagcttccctgagagctgcagcagtgacagcgagagcagcagctacagcgaccacgccgccaatgacagcgactttggcagcagcctgagcagcagcagcaacagcgtgtcctctgaggaggaggaggaggagggggaggaggaggaggaggaggaggaggaggagggcggcagcggggccagtgacagcagcgaggtgtcctctgaggaggaggacagcagcacagaaagtgacagcagcagcggcagcagccaggtgtctgtgcagagcatccgcttccggaggaccagcttctgcaagccacccagcgtgcaggcccaggccaacttcctgtaccacctggccagcgctgctgctgccaccaagccagctgcctttgaagatgctggccgcctgcctgacctgaagagctctgtgaaggccgagagccctgctgagtggaacctgcagagctgggcccccaaggccagccctgtgtactgcccagccagcctgggcagctgctttgctgagatcagaaatgacagagtgtctgagatcaccttcccccacagcgagatcagcaatgctgtgaagaggacagacctgaccatcaactgcctggccgagggcgccagcagccccagccccaagaccaacaatgccttcccccagcagaggatcctgcgggaggccaggaagtgcctgcagaccacccccaccacccactgtgccgacaacaacaccatcgccgcccgcttcctgaacaatgacagcagcggggctgaggccaacagcgagaagtacagcaagatcctgcactgcccagagtttgccacagacctgcccagcagccagacagatcctgaggtgaatgctgctggagctgctgccaccaaggccgagaacccctgcacagacaccggggacaagaccctgcccttcctgcacaacatcaagatcaaggtggaggacagcagcgccaatgaggagtatgagccccacctgttcaccaacaagctgaagtgtgagtgcaatgacaccaagggggagttctacagcgtgacagagagcaaggaggaggatgccctgctgaccacagccaaggagggctttgcctgcccagagaaggagacccccagcctgaaccccctggcccagagccagggcctgagctgcaccctgggcagccccaagccagaagatggagagtacaagtttggagcccgggtgaggaagaactaccgcaccctggtgctgggcaagaggcctgtgctgcagaccccacctgtgaagcccaacctgaagagcgcccggagcccccggcccaccgggaagacagagaccaatgaaggcaccctggatgacttcaccgtcatcaacagaaggaagaaggtggccagcaatgtggccagcgctgtgaagaggcccttccacttcatggccaacttcccctgcccccccagcctcatcatcggcagagatggagacctgtggccagcctacagcctgaacaccaccaaggacagccagaccccccacaaggcccaccccatctggaagtggcagctgggcggcagcgccatccccctgccccccagccacaagttcaggaagttcaacagctag

SEQ ID NO: 15163 - DNA, 453 bp, Artificial Sequence
  Description of Artificial Sequence: Synthetic coding sequence
atggccgccagccagtgcctgtgctgcagcaagttcctgttccagaggcagaacctggcctgcttcctgaccaacccccactgcggcagcctggtgaatgctgatggccatggagaggtgtggacagactggaacaacatgagcaagttcttccagtatggctggcgctgcaccaccaatgaaaacacctacagcaacagaaccctgatgggcaactggaaccaggagagatatgacctgagaaatattgtgcagcccaagcccctgcccagccagtttggccactactttgagaccacctatgacaccagctacaacaacaagatgcccctgagcacccaccgcttcaagcgggagccccactggttccctggccaccagcctgagctggaccccccacgctacaagtgcacagagaagagcacctacatgaacagctacagcaagccctag

SEQ ID NO: 15164 - DNA, 948 bp, Artificial Sequence
  Description of Artificial Sequence: Synthetic coding sequence
atggcctgtgccgagttctccttccacgtgcccagcctggaggagctggccggcgtgatgcagaagggcctgaaggacaactttgctgatgtgcaggtgtctgtggtggactgcccagacctgaccaaggagcccttcaccttccctgtgaagggcatctgtgggaagaccagaattgctgaggtgggcggcgtgccctacctgctgcccctggtgaaccagaagaaggtgtatgacctgaacaagatcgccaaggagatcaagctgcccggggccttcatcctgggcgctggggccggccccttccagaccctgggcttcaacagcgagttcatgcctgtgatccagacagaaagtgagcacaagccccctgtgaatggcagctactttgcccacgtgaacccagcagatggcggctgcctgctggagaagtacagcgagaagtgccacgacttccagtgtgccctgctggccaacctgtttgccagcgagggccagcccgggaaggtgattgaggtgaaggccaagagaagaacaggccccctgaactttgtgacctgcatgagggagaccctggagaagcactacggcaacaagcccatcggcatgggcggcaccttcatcatccagaagggcaaggtgaagagccacatcatgcctgctgagttcagcagctgccccctgaacagtgatgaggaggtgaacaagtggctgcacttctatgagatgaaggcccccctggtgtgcctgcctgtgtttgtgtcccgggaccccggctttgacctgcggctggagcacacccacttcttcagcagacatggagagggcggccactaccactatgacaccaccccagacatcgtggagtacctgggctacttcctgcctgctgagttcctgtacagaattgaccagcccaaggagacccacagcatcggccgggactag

SEQ ID NO: 15165 - DNA, 948 bp, Artificial Sequence; identical to SEQ ID NO: 15164
  Description of Artificial Sequence: Synthetic coding sequence

SEQ ID NO: 15166 - DNA, 891 bp, Artificial Sequence
  Description of Artificial Sequence: Synthetic coding sequence
atgcagaagggcctgaaggacaactttgctgatgtgcaggtgtctgtggtggactgcccagacctgaccaaggagcccttcaccttccctgtgaagggcatctgtgggaagaccagaattgctgaggtgggcggcgtgccctacctgctgcccctggtgaaccagaagaaggtgtatgacctgaacaagatcgccaaggagatcaagctgcccggggccttcatcctgggcgctggggccggccccttccagaccctgggcttcaacagcgagttcatgcctgtgatccagacagagagcgagcacaagccccctgtgaatggcagctactttgcccacgtgaacccagcagatggcggctgcctgctggagaagtacagcgagaagtgccacgacttccagtgtgccctgctggccaacctgtttgccagcgagggccagcccgggaaggtgattgaggtgaaggccaagagaagaacaggccccctgaactttgtgacctgcatgagggagaccctggagaagcactacggcaacaagcccatcggcatgggcggcaccttcatcatccagaagggcaaggtgaagagccacatcatgcctgctgagttcagcagctgccccctgaacagtgatgaggaggtgaacaagtggctgcacttctatgagatgaaggcccccctggtgtgcctgcctgtgtttgtgtcccgggaccccggctttgacctgcggctggagcacacccacttcttcagccgccacggggagggcggccactaccactatgacaccaccccagacatcgtggagtacctgggctacttcctgcctgctgagttcctgtacagaattgaccagcccaaggagacccacagcatcggccgggactag

SEQ ID NO: 15167 - DNA, 450 bp, Artificial Sequence
  Description of Artificial Sequence: Synthetic coding sequence
atggcctgtgccgagttctccttccacgtgcccagcctggaggagctggccggcgtgatgcagaagggcctgaaggacaactttgctgatgtgcaggtgtctgtggtggactgcccagacctgaccaaggagcccttcaccttccctgtgaagggcatctgtgggaagaccagaattgctgaggtgggcggcgtgccctacctgctgcccctggtgaaccagaagaaggtgtatgacctgaacaagatcgccaaggagatcaagctgcccggggccttcatcctgggcgctggggccggccccttccagaccctgggcttcaacagcgagttcatgcctgtgatccagacagaaagtgagcacaagccccctgtgaatggcagctactttgcccacgtgaacccagcagatggcggctgcctgctggagaagtacagcgagaagtgctag

SEQ ID NO: 15168 - DNA, 234 bp, Artificial Sequence
  Description of Artificial Sequence: Synthetic coding sequence
atggcctgtgccgagttctccttccacgtgcccagcctggaggagctggccggcgtgatgcagaagggcctgaaggacaactttgctgatgtgcaggtgtctgtggtggactgcccagacctgaccaaggagcccttcaccttccctgtgaagggcatctgtgggaagaccagaattgctgaggtgggcggcgtgccctacctgctgcccctggtgaaccagaagaaggtgtag

SEQ ID NO: 15169 - DNA, 516 bp, Artificial Sequence
  Description of Artificial Sequence: Synthetic coding sequence
atggcctgtgccgagttctccttccacgtgcccagcctggaggagctggccggcgtgatgcagaagggcctgaaggacaactttgctgatgtgcaggtgtctgtggtggactgcccagacctgaccaaggagcccttcaccttccctgtgaagggcatctgtgggaagaccagaattgctgaggtgggcggcgtgccctacctgctgcccctggtgaaccagaagaaggtgtatgacctgaacaagatcgccaaggagatcaagctgcccggggccttcatcctgggcgctggggccggccccttccagaccctgggcttcaacagcgagttcatgcctgtgatccagacagaaagtgagcacaagccccctgtgaatggcagctactttgcccacgtgaacccagcagatggcggctgcctgctggagaagtacagcgagaagtgccacgacttccagtgtgccctgctggccaacctgtttgccagcgagggccagcccgggaaggtgatctag

SEQ ID NO: 15170 - DNA, 948 bp, Artificial Sequence; identical to SEQ ID NO: 15164
  Description of Artificial Sequence: Synthetic coding sequence

SEQ ID NO: 15171 - DNA, 798 bp, Artificial Sequence
  Description of Artificial Sequence: Synthetic coding sequence
atggcctgtgccgagttctccttccacgtgcccagcctggaggagctggccggcgtgatgcagaagggcctgaaggacaactttgctgatgtgcaggtgtctgtggtggactgcccagacctgaccaaggagcccttcaccttccctgtgaagggcatctgtgggaagaccagaattgctgaggtgggcggcgtgccctacctgctgcccctggtgaaccagaagaaggtgtatgacctgaacaagatcgccaaggagatcaagctgcccggggccttcatcctgggcgctggggccggccccttccagaccctgggcttcaacagcgagttcatgcctgtgatccagacagaaagtgagcacaagccccctgtgaatggcagctactttgcccacgtgaacccagcagatggcggctgcctgctggagaagtacagcgagaagtgccacgacttccagtgtgccctgctggccaacctgtttgccagcgagggccagcccgggaagccagctgagttcagcagctgccccctgaacagtgatgaggaggtgaacaagtggctgcacttctatgagatgaaggcccccctggtgtgcctgcctgtgtttgtgtcccgggaccccggctttgacctgcggctggagcacacccacttcttcagcagacatggagagggcggccactaccactatgacaccaccccagacatcgtggagtacctgggctacttcctgcctgctgagttcctgtacagaattgaccagcccaaggagacccacagcatcggccgggactag

SEQ ID NO: 15172 - DNA, 291 bp, Artificial Sequence
  Description of Artificial Sequence: Synthetic coding sequence
atggcctgtgccgagttctccttccacgtgcccagcctggaggagctggccggcgtgatgcagaagggcctgaaggacaactttgctgatgtgcaggtgtctgtggtggactgcccagacctgaccaaggagcccttcaccttccctgtgaagggcatctgtgggaagaccagaattgctgaggtgggcggcgtgccctacctgctgcccctggtgaaccagaagaaggtgtatgacctgaacaagatcgccaaggagatcaagctgcccggggccttcatcctgggctag

SEQ ID NO: 15173 - DNA, 720 bp, Artificial Sequence
  Description of Artificial Sequence: Synthetic coding sequence
atgcagaagggcctgaaggacaactttgctgatgtgcaggtgtctgtggtggactgcccagacctgaccaaggagcccttcaccttccctgtgaagggcatctgtgggaagaccagaattgctgaggtgggcggcgtgccctacctgctgcccctggtgaaccagaagaaggtgtatgacctgaacaagatcgccaaggagatcaagctgcccggggccttcatcctgggcgctggggccggccccttccagaccctgggcttcaacagcgagttcatgcctgtgatccagacagagagcgagcacaagccccctgtgaatggcagctactttgcccacgtgaacccagcagatggcggctgcctgctggagaagtacagcgagaagtgccacgacttccagtgtgccctgctggccaacctgtttgccagcgagggccagcccgggaaggtgattgaggtgaaggccaagagaagaacaggccccctgaactttgtgacctgcatgagggagaccctggagaagcactacggcaacaagcccatcggcatgggcggcaccttcatcatccagaagggcaaggtgaagagccacatcatgcctgctgagttcagcagctgccccctgaacagtgatgaggaggtgaacaagtggctgcacttctatgagatgaaggcccccctggtgtgcctgcctgtgtttgtgtcccgggacccctag

SEQ ID NO: 15174 - DNA, 303 bp, Artificial Sequence
  Description of Artificial Sequence: Synthetic coding sequence
atggcctgtgccgagttctccttccacgtgcccagcctggaggagctggccggcgtgatgcagaagggcctgaaggacaactttgctgatgtgcaggtgtctgtggtggactgcccagacctgaccaaggagcccttcaccttccctgtgaagggcatctgtgggaagaccagaattgctgaggtgggcggcgtgccctacctgctgcccctggtgaaccagaagaaggtgtatgacctgaacaagatcgccaaggagatcaagctgcccggggccttcatcctgggcgctggggccggctag

SEQ ID NO: 15175 - DNA, 891 bp, Artificial Sequence; identical to SEQ ID NO: 15166
  Description of Artificial Sequence: Synthetic coding sequence

SEQ ID NO: 15176 - DNA, 1221 bp, Artificial Sequence
  Description of Artificial Sequence: Synthetic coding sequence
atgacccagaccctggacacccgggaggaccccctgaacctgggcggcggcggcggcggcggctgcggctgcggctgggcccacagcgccagcctgagctcctggagcagctgccacagaagaagacctggggccccagcctacaaccggccccaccgctacagccccaagacagaatatggcccccccaggaagcagcccaagcagcagcacggccctggcttctggttccagccccctgtgtgcagcaactggggctgctggggcggcccctggaggcctcctcctcctggcttctggaagttcccctgccctgtgcaggtgttccgggtgtatggcctgcaccccctgtgcttctgctgctgcagctgctggagcggctcctggaaccctggctgggtgaagcccccaggcaggaagaagcgctggggcagaagaggccggggcctgcggcaccaccccaggcacagctaccccaggagccccccagcagatgtgtccaccctgcccaggcctgtgaagctgtatgagtggagggagcccggcatgagggccccacccaacaccacccagttcatcatgaaccagatctatgaggacatgaggcagcaggagaaggtggagcggcagcaggaggccctgcgggcccagaaggccaccgtgtctggagaggccagccctgcccggagcagtggaaatgatgcccctcctgggggcagcaaggagacctggggcctgcaggagaccctgtatggctttgtgcagaaccccagcctggccttcagccccaaccctgaggagaaccagagcctggcccccctgctggtggaggaggaggaggagaagaagaatgatgatgaggaggagtatgaccaggaggtgtgtgatgccaaggaggccagcgaggaggaggaggaggtggaggatgaggaggaggaggtggaggatgaggaggaggaggaggtggaggaggccgagtatgtggaggagggggaggaggagctggaggaggaggagctggaggaggaggaggaggtgctggaggagaatgagcagagaggagaggagttccacctgcccctggagatgcccctgagcatctttgtggaggccgaggagaagcgggagaacttcatcagctgcaccttcctgaaccctgagcagatcatccccaaggtgccccaggagagcctcttcatggcccaggacttcaactgctag

SEQ ID NO: 15177 - DNA, 195 bp, Artificial Sequence
  Description of Artificial Sequence: Synthetic coding sequence
atgccacccaggaagaagaggcggcagcccagccagaaggcccccctgctcttccaccagcagcccctggagggccccaagcacagctgtgccagcacccagctgcccatcacccacacccggcaggtgcccagcaagcccatcgaccacagcaccatcacctcctgggtgtccccagactttgacacagcctag

SEQ ID NO: 15178 - DNA, 717 bp, Artificial Sequence
  Description of Artificial Sequence: Synthetic coding sequence
atgccacccaggaagaagaggcggcagcccagccagaaggcccccctgctcttccaccagcagcccctggagggccccaagcacagctgtgccagcacccagctgcccatcacccacacccggcaggtgcccagcaagcccatcgaccacagcaccatcacctcctgggtgtccccagactttgacacagctgctggcagcctcttccctgcctaccagaagcaccagaacagagcccggcacagcagcaggaagcccaccaccagcaagttcccccacctgacctttgagagcccccagagcagcagcagcgagaccctgggcatccccctcatccgggagtgccccagcgagagcgagaaggatgtgtccagaagacccctggtgcctgtgctgagcccccagagctgtggcaacatgtctgtgcaggccctgcagagcctgccctacgtgttcatccccccagacatccagaccccagagagcagctctgtgaaggaggagctgatcccccaggaccagaaggagaacagcctgctgagctgcaccctgcacacaggcacccccaacagccctgagcccggccctgtgctggtgaaggacaccccagaggacaagtatggcatcaaggtgacctggaggcggcggcagcacctgctggcctacctgcgggagcggggcaagctgagccgcagccagttcctggtgaagagctag

SEQ ID NO: 15179 - DNA, 399 bp, Artificial Sequence
  Description of Artificial Sequence: Synthetic coding sequence
atgccacccaggaagaagaggcggcagcccagccagaaggcccccctgctcttccaccagcagcccctggagggccccaagcacagctgtgccagcacccagctgcccatcacccacacccggcaggtgcccagcaagcccatcgaccacagcaccatcacctcctgggtgtccccagactttgacacagctgctggcagcctcttccctgcctaccagaagcaccagaacagagcccggcacagcagcaggaagcccaccaccagcaagttcccccacctgacctttgagagcccccagagcagcagcagcgagaccctgggcatccccctcatccgggagtgccccagcgagagcgagaaggatgtgtccagaagacccctggtgcctgtgctgtag

SEQ ID NO: 15180 - DNA, 318 bp, Artificial Sequence
  Description of Artificial Sequence: Synthetic coding sequence
atgccacccaggaagaagaggcggcagcccagccagaaggcccccctgctcttccaccagcagcccctggagggccccaagcacagctgtgccagcacccagctgcccatcacccacacccggcaggtgcccagcaagcccatcgaccacagcaccatcacctcctgggtgtccccagactttgacacagctgctggcagcctcttccctgcctaccagaagcaccagaacagagcccggcacagcagcaggaagcccaccaccagcaagttcccccacctgacctttgagagcccccagagcagcagcagcgagtag

SEQ ID NO: 15181 - DNA, 3138 bp, Artificial Sequence
  Description of Artificial Sequence: Synthetic coding sequence
atgaacctgcaggcccagcccaaggcccagaacaagaggaagcgctgcctgtttggaggccaggagcccgcccccaaggagcagcccccacccctgcagcccccccagcagagcatccgggtgaaggaggagcagtacctgggccacgagggccctgggggcgctgtgtccaccagccagcctgtggagctgcccccacccagcagcctggccctgctgaacagcgtggtgtatggccctgagaggaccagcgctgccatgctgagccagcaggtggcctctgtgaagtggcccaacagcgtgatggcccctggccggggccctgagcggggcggcggcggcggcgtgtctgacagctcctggcagcagcagcccggccagcccccaccccacagcacctggaactgccacagcctgagcctgtacagcgccaccaagggcagcccccaccctggggtgggcgtgcccacctactacaaccaccctgaggccctgaagcgggagaaggccggcggcccccagctggaccgctacgtgcggcccatgatgccccagaaggtgcagctggaggtgggccggccccaggcccccctgaacagcttccacgccgccaagaagccacccaaccagagcctgcccctgcagcccttccagctggccttcggccaccaggtgaaccggcaggtgttccggcagggccccccaccacccaaccctgtggccgccttccccccccagaagcagcagcagcagcagcagccccagcagcagcagcagcagcagcaggccgccctgccccagatgcccctgtttgagaacttctacagcatgccccagcagcccagccagcagccccaggactttggcctgcagcctgctggccccctgggccagagccacctggcccaccacagcatggccccctaccccttcccccccaacccagacatgaaccctgagctgaggaaggccctgctgcaggacagcgccccccagcctgccctgccccaggtgcagatccccttcccccggcgcagccggcggctgagcaaggagggcatcctgccccccagcgccctggatggagctggcacccagcccggccaggaggccaccggcaacctcttcctgcaccactggcccctgcagcagcccccacctggcagcctgggccagccccaccctgaggccctgggcttccccctggagctgcgggagagccagctgctgcctgatggagagcggctggccccaaatggccgggagcgggaggccccagccatgggcagcgaggagggcatgagagctgtgtccactggagactgtggccaggtgctgcggggcggcgtcatccagagcaccaggagaagaagaagagccagccaggaggccaacctgctgaccctggcccagaaggctgtggagctggccagcctgcagaatgccaaggatggcagcggcagcgaggagaagaggaagtctgtgctggccagcaccaccaagtgtggggtggagttcagcgagcccagcctggccaccaagagggcccgggaggacagcggcatggtgcccctcatcatccctgtgtctgtgcctgtgaggacagtggaccccacagaagctgcccaggccggcggcctggatgaagatggcaagggccctgagcagaacccagctgagcacaagcccagcgtcatcgtgacccggcggcgcagcacccgcatccctggaacagatgcccaggcccaggccgaggacatgaatgtgaagctggagggggagcccagcgtgaggaagcccaagcagaggcccaggcctgagcccctcatcatccccaccaaggccggcaccttcatcgcccctcctgtgtacagcaacatcaccccctaccagagccacctgcggagccctgtgcggctggccgaccaccccagcgagaggagctttgagctgcccccctacaccccaccacccatcctgagccctgtgcgggagggcagcggcctgtacttcaatgccatcatcagcaccagcaccatcccagcccccccacccatcacccccaagagcgcccacaggaccctgctgcggaccaacagcgctgaggtgaccccacctgtgctgtctgtgatgggagaggccacccctgtgtccattgagccccgcatcaacgtgggcagccgcttccaggccgagatccccctgatgagggaccgggccctggccgctgctgacccccacaaggctgacctggtgtggcagccctgggaggacctggagagcagccgggagaagcagaggcaggtggaggacctgctgacagctgcctgcagcagcatcttccctggggccggcaccaaccaggagctggccctgcactgcctgcacgagagcagaggagacatcctggagaccctgaacaagctgctgctgaagaagcccctgcggccccacaaccaccccctggccacctaccactacacaggcagtgaccagtggaagatggccgagaggaagctgttcaacaagggcatcgccatctacaagaaggacttcttcctggtgcagaagctgatccagaccaagacagtggcccagtgtgtggagttctactacacctacaagaagcaggtgaagattggaagaaatggcaccctgacctttggagatgtggacaccagtgatgagaagagcgcccaggaggaggtggaggtggacatcaagaccagccagaagttcccccgggtgcccctgccccggcgggagagccccagcgaggagcggctggagcccaagcgggaggtgaaggagcccaggaaggagggggaggaggaggtgcctgagatccaggagaaggaggagcaggaggagggccgggagaggagcagaagagctgctgctgtgaaggccacccagaccctgcaggccaatgaaagtgccagtgacatcctgatcctgcggagccatgagagcaatgcccctggcagcgctgggggccaggccagcgagaagccccgggagggcaccgggaagagcagaagagccctgcccttcagcgagaagaagaagaagacagagaccttcagcaagacccagaaccaggagaacaccttcccctgcaagaagtgtggccgctag

SEQ ID NO: 15182 - DNA, 3138 bp, Artificial Sequence; identical to SEQ ID NO: 15181
  Description of Artificial Sequence: Synthetic coding sequence

SEQ ID NO: 15183 - DNA, 201 bp, Artificial Sequence
  Description of Artificial Sequence: Synthetic coding sequence
atgaacctgcaggcccagcccaaggcccagaacaagaggaagcgctgcctgtttggaggccaggagcccgcccccaaggagcagcccccacccctgcagcccccccagcagagcatccgggtgaaggaggagcagtacctgggccacgagggccctgggggcgctgtgtccaccagccagcctgtggagctgcccccatag

SEQ ID NO: 15184 - DNA, 3138 bp, Artificial Sequence; identical to SEQ ID NO: 15181
  Description of Artificial Sequence: Synthetic coding sequence

SEQ ID NO: 15185 - DNA, 3060 bp, Artificial Sequence
  Description of Artificial Sequence: Synthetic coding sequence
atgaacctgcaggcccagcccaaggcccagaacaagaggaagcgctgcctgtttggaggccaggagcccgcccccaaggagcagcccccacccctgcagcccccccagcagagcatccgggtgaaggaggagcagtacctgggccacgagggccctgggggcgctgtgtccaccagccagcctgtggagctgcccccacccagcagcctggccctgctgaacagcgtggtgtatggccctgagaggaccagcgctgccatgctgagccagcaggtggcctctgtgaagtggcccaacagcgtgatggcccctggccggggccctgagcggggcggcggcggcggcgtgtctgacagctcctggcagcagcagcccggccagcccccaccccacagcacctggaactgccacagcctgagcctgtacagcgccaccaagggcagcccccaccctggggtgggcgtgcccacctactacaaccaccctgaggccctgaagcgggagaaggccggcggcccccagctggaccgctacgtgcggcccatgatgccccagaaggtgcagctggaggtgggccggccccaggcccccctgaacagcttccacgccgccaagaagccacccaaccagagcctgcccctgcagcccttccagctggccttcggccaccaggtgaaccggcaggtgttccggcagggccccccaccacccaaccctgtggccgccttccccccccagaagcagcagcagcagcagcagccccagcagcagcagcagcagcagcaggccgccctgccccagatgcccctgtttgagaacttctacagcatgccccagcagcccagccagcagccccaggactttggcctgcagcctgctggccccctgggccagagccacctggcccaccacagcatggccccctaccccttcccccccaacccagacatgaaccctgagctgaggaaggccctgctgcaggacagcgccccccagcctgccctgccccaggtgcagatccccttcccccggcgcagccggcggctgagcaaggagggcatcctgccccccagcgccctggatggagctggcacccagcccggccaggaggccaccggcaacctcttcctgcaccactggcccctgcagcagcccccacctggcagcctgggccagccccaccctgaggccctgggcttccccctggagctgcgggagagccagctgctgcctgatggagagcggctggccccaaatggccgggagcgggaggccccagccatgggcagcgaggagggcatgagagctgtgtccactggagactgtggccaggtgctgcggggcggcgtcatccagagcaccaggagaagaagaagagccagccaggaggccaacctgctgaccctggcccagaaggctgtggagctggccagcctgcagaatgccaaggatggcagcggcagcgaggagaagaggaagtctgtgctggccagcaccaccaagtgtggggtggagttcagcgagcccagcctggccaccaagagggcccgggaggacagcggcatggtgcccctcatcatccctgtgtctgtgcctgtgaggacagtggaccccacagaagctgcccaggccggcggcctggatgaagatggcaagggccctgagcagaacccagctgagcacaagcccagcgtcatcgtgacccggcggcgcagcacccgcatccctggaacagatgcccaggcccaggccgaggacatgaatgtgaagctggagggggagcccagcgtgaggaagcccaagcagaggcccaggcctgagcccctcatcatccccaccaaggccggcaccttcatcgcccctcctgtgtacagcaacatcaccccctaccagagccacctgcggagccctgtgcggctggccgaccaccccagcgagaggagctttgagctgcccccctacaccccaccacccatcctgagccctgtgcgggagggcagcggcctgtacttcaatgccatcatcagcaccagcaccatcccagcccccccacccatcacccccaagagcgcccacaggaccctgctgcggaccaacagcgctgaggtgaccccacctgtgctgtctgtgatgggagaggccacccctgtgtccattgagccccgcatcaacgtgggcagccgcttccaggccgagatccccctgatgagggaccgggccctggccgctgctgacccccacaaggctgacctggtgtggcagccctgggaggacctggagagcagccgggagaagcagaggcaggtggaggacctgctgacagctgcctgcagcagcatcttccctggggccggcaccaaccaggagctggccctgcactgcctgcacgagagcagaggagacatcctggagaccctgaacaagctgctgctgaagaagcccctgcggccccacaaccaccccctggccacctaccactacacaggcagtgaccagtggaagatggccgagaggaagctgttcaacaagggcatcgccatctacaagaaggacttcttcctggtgcagaagctgatccagaccaagacagtggcccagtgtgtggagttctactacacctacaagaagcaggtgaagattggaagaaatggcaccctgacctttggagatgtggacaccagtgatgagaagagcgcccaggaggaggtggaggtggacatcaagaccagccagaagttcccccgggtgcccctgccccggcgggagagccccagcgaggagcggctggagcccaagcgggaggtgaaggagcccaggaaggagggggaggaggaggtgcctgagatccaggagaaggaggagcaggaggagggccgggagaggagcagaagagctgctgctgtgaaggccacccagaccctgcaggccaatgaaagtgccagtgacatcctgatcctgcggagccatgagagcaatgcccctggcagcgctgggggccaggccagcgagaagccccgggagggcaccgggaagagcagaagagccctgcccttctcctag

SEQ ID NO: 15186 - DNA, 951 bp, Artificial Sequence
  Description of Artificial Sequence: Synthetic coding sequence
atggccgcccctgaggccccacccctggacagagtcttccgcaccacctggctgagcacagaatgtgacagccaccccctgccccccagctacaggaagttcctgtttgagacccaggccgctgacctggccggcggcaccaccgtggccgccggcaacctgctgaatgaaagtgagaaggactgtggccaggaccggcgggcccctggggtgcagccctgccgcctggtgaccatgacctctgtggtgaagacagtgtacagcctgcagcccccatctgccctgagcggcggccagcctgctgacacccagacccgggccaccagcaagagcctgctgcctgtgcgcagcaaggaggtggatgtgtccaagcagctgcacagcggcggcccagaaaatgatgtgaccaagatcaccaagctgcggcgggagaatggccagatgaaggccacagacacagccaccaggagaaatgtgaggaagggctacaagcccctgagcaagcagaagtctgaggaggagctgaaggacaagaaccagctgctggaggccgtgaacaagcagctgcaccagaagctgacagagacccagggcgagctgaaggacctgacccagaaggtggagctgctggagaagttccgggacaactgcctggccatcctggagagcaagggcctggaccctgccctgggcagcgagaccctggccagccggcaggagagcaccacagaccacatggacagcatgctgctgctggagaccctgcaggaggagctgaagctgttcaatgaaacagccaagaagcagatggaggagctgcaggccctgaaggtgaagctggagatgaaggaggagcgggtgcgcttcctggagcagcagaccctgtgcaacaaccaggtgaatgacctgaccacagccctgaaggagatggagcagctgctggagatgtag

SEQ ID NO: 15187 - DNA, 861 bp, Artificial Sequence
  Description of Artificial Sequence: Synthetic coding sequence
atggccgcccctgaggccccacccctggacagagtcttccgcaccacctggctgagcacagaatgtgacagccaccccctgccccccagctacaggaagttcctgtttgagacccaggccgctgacctggccggcggcaccaccgtggccgccggcaacctgctgaatgaaagtgagaaggactgtggccaggaccggcgggcccctggggtgcagccctgccgcctggtgaccatgacctctgtggtgaagacagtgtacagcctgcagcccccatctgccctgagcggcggccagcctgctgacacccagacccgggccaccagcaagagcctgctgcctgtgcgcagcaaggaggtggatgtgtccaagcagctgcacagcggcggcccagaaaatgatgtgaccaagatcaccaagctgcggcgggagaatggccagatgaaggccacagacacagccaccaggagaaatgtgaggaagggctacaagcccctgagcaagcagaagtctgaggaggagctgaaggacaagaaccagctgctggaggccgtgaacaagcagctgcaccagaagctgacagagacccagggcgagctgaaggacctgacccagaaggtggagctgctggagaagttccgggacaactgcctggccatcctggagagcaagggcctggaccctgccctgggcagcgagaccctggccagccggcaggagagcaccacagaccacatggacagcatgctgctgctggagaccctgcaggaggagctgaagctgttcaatgaaacagccaagaagcagatggaggagctgcagatcgcctggatgaaccacggcatcctgcaccagatgtag

SEQ ID NO: 15188 - DNA, 726 bp, Artificial Sequence
  Description of Artificial Sequence: Synthetic coding sequence
atggccgcccctgaggccccacccctggacagagtcttccgcaccacctggctgagcacagaatgtgacagccaccccctgccccccagctacaggaagttcctgtttgagacccaggccgctgacctggccggcggcaccaccgtggccgccggcaacctgctgaatgaaagtgagaaggactgtggccaggaccggcgggcccctggggtgcagccctgccgcctggtgaccatgacctctgtggtgaagacagtgtacagcctgcagcccccatctgccctgagcggcggccagcctgctgacacccagacccgggccaccagcaagagcctgctgcctgtgcgcagcaaggaggtggatgtgtccaagcagctgcacagcggcggcccagaaaatgatgtgaccaagatcaccaagctgcggcgggagaatggccagatgaaggccacagacacagccaccaggagaaatgtgaggaagggctacaagcccctgagcaagcagaagtctgaggaggagctgaaggacaagaaccagctgctggaggccgtgaacaagcagctgcaccagaagctgacagagacccagggcgagctgaaggacctgacccagaaggtggagctgctggagaagttccgggacaactgcctggccatcctggagagcaagggcctggaccctgtggccgtgaggaactttgcccggggagctgaggccttctag

SEQ ID NO: 15189 - DNA, 915 bp, Artificial Sequence
  Description of Artificial Sequence: Synthetic coding sequence
atggccagcgagacccacaacgtgaagaagaggaacttctgcaacaagattgaggaccacttcatcgacctgcccaggaagaagatcagcaacttcaccaacaagaacatgaaggaggtgaagaagagccccaagcagctggccgcctacatcaacagaacagtgggccagacagtgaagagcccagacaagctgaggaaggtgatctacagaaggaagaaggtgcaccaccccttccccaacccctgctacaggaagaagcagagccctggcagcggcggctgtgacatggccaacaaggaaaatgagctggcctgtgccggccacctgcctgagaagctgcaccacgacagcaggacctacctggtgaacagcagtgacagcggcagcagccagacagagagccccagcagcaagtacagcggcttcttcagcgaggtgtcccaggaccacgagaccatggcccaggtgctcttcagcaggaacatgaggctgaatgtggccctgaccttctggaggaagaggagcatcagcgagctggtggcctacctgctgagaattgaggacctgggcgtggtggtggactgcctgcctgtgctgaccaactgcctgcaggaggagaagcagtacatcagcctgggctgctgcgtggacctgctgcccctggtgaagagcctgctgaagagcaagtttgaggagtatgtgattgtgggcctgaactggctgcaggccgtcatcaagcgctggtggagcgagctgagcagcaagacagagatcatcaatgatggcaacatccagatcctgaagcagcagctgagcggcctgtgggagcaggagaaccacctgaccctggtgcccggctacacaggcaacatcgccaaggatgtggatgcctacctgctgcagctgcactag

SEQ ID NO: 15190 - DNA, 537 bp, Artificial Sequence
  Description of Artificial Sequence: Synthetic coding sequence
atggccagcgagacccacaacgtgaagaagaggaacttctgcaacaagattgaggaccacttcatcgacctgcccaggaagaagatcagcaacttcaccaacaagaacatgaaggaggtgaagaagagccccaagcagctggccgcctacatcaacagaacagtgggccagacagtgaagagcccagacaagctgaggaaggtgatctacagaaggaagaaggtgcaccaccccttccccaacccctgctacaggaagaagcagagccctggcagcggcggctgtgacatggccaacaaggaaaatgagctggcctgtgccggccacctgcctgagaagctgcaccacgacagcaggacctacctggtgaacagcagtgacagcggcagcagccagacagagagccccagcagcaagtacagcggcttcttcagcgaggtgtcccaggaccacgagaccatggcccaggtgctcttcagcaggaacatgaggctgaatgtggccctgaccttctggaggaagaggagcatctcctag

SEQ ID NO: 15191 - DNA, 120 bp, Artificial Sequence
  Description of Artificial Sequence: Synthetic coding sequence
atggccagcgagacccacaacgtgaagaagaggaacttctgcaacaagattgaggaccacttcatcgacctgcccaggaagaagatcagcaacttcaccaacaagaacatgaaggagtag

SEQ ID NO: 15192 - DNA, 225 bp, Artificial Sequence
  Description of Artificial Sequence: Synthetic coding sequence
atggccagcgagacccacaacgtgaagaagaggaacttctgcaacaagattgaggaccacttcatcgacctgcccaggaagaagatcagcaacttcaccaacaagaacatgaaggaggtgaagaagagccccaagcagctggccgcctacatcaacagaacagtgggccagacagtgaagagcccagacaagctgaggaaggtgatctacagaaggaagaagtag

SEQ ID NO: 15193 - DNA, 534 bp, Artificial Sequence
  Description of Artificial Sequence: Synthetic coding sequence
atggccagcgagacccacaacgtgaagaagaggaacttctgcaacaagattgaggaccacttcatcgacctgcccaggaagaagatcagcaacttcaccaacaagaacatgaaggaggtgaagaagagccccaagcagctggccgcctacatcaacagaacagtgggccagacagtgaagagcccagacaagctgaggaaggtgatctacagaaggaagaaggtgcaccaccccttccccaacccctgctacaggaagaagcagagccctggcagcggcggctgtgacatggccaacaaggaaaatgagctggcctgtgccggccacctgcctgagaagctgcaccacgacagcaggacctacctggtgaacagcagtgacagcggcagcagccagacagagagccccagcagcaagtacagcggcttcttcagcgaggtgtcccaggaccacgagaccatggcccaggtgctcttcagcaggaacatgaggctgaatgtggccctgaccttctggaggaagaggagcatctag

SEQ ID NO: 15194 - DNA, 1887 bp, Artificial Sequence
  Description of Artificial Sequence: Synthetic coding sequence
atgctgctggccaggatgaacccccaggtgcagccagaaaataatggagctgacaccggccctgagcagcccctgcgggccaggaagacagctgagctgctggtggtgaaggagagaaatggagtgcagtgcctgctggcccccagagatggagatgcccagccccgggagacctggggcaagaagattgacttcctgctgtctgtggtgggctttgctgtggacctggccaacgtgtggaggttcccctacctgtgctacaagaatggaggaggagccttcctgatcccctacaccctcttcctgatcatcgccggcatgcccctcttctacatggagctggccctgggccagtacaaccgggagggcgccgccaccgtgtggaagatctgccccttcttcaagggcgtgggctacgccgtcatcctgattgccctgtatgtgggcttctactacaacgtcatcatcgcctggagcctgtactacctgttcagcagcttcaccctgaacctgccctggacagactgtggccacacctggaacagccccaactgcacagaccccaagctgctgaatggatctgtgctgggcaaccacaccaagtacagcaagtacaagttcaccccagctgctgagttctatgaaagaggagtgctgcacctgcacgagagcagcggcatccatgacatcggcctgccccagtggcagctgctgctgtgcctgatggtggtggtgattgtgctgtacttcagcctgtggaagggcgtgaagaccagcggcaaggtggtgtggatcacagccaccctgccctactttgtgctgtttgtgctgctggtgcacggcgtgaccctgcccggggccagcaatggcatcaatgcctacctgcacatcgacttctaccgcctgaaggaggccaccgtgtggattgatgctgccacccagatcttcttcagcctgggcgccggctttggagtgctgattgcctttgccagctacaacaagtttgacaacaactgctacagagatgccctgctgaccagcagcatcaactgcatcaccagctttgtgtctggctttgccatcttcagcatcctgggctacatggcccacgagcacaaggtgaacattgaagatgtggccacagaaggagctggcctggtgttcatcctgtacccagaggccatcagcaccctgagcggcagcaccttctgggccgtggtgttctttgtgatgctgctggccctgggcctggacagctccatgggcggcatggaggccgtcatcaccggcctggctgatgacttccaggtgctgaagaggcacaggaagctgttcacctttggagtgaccttcagcaccttcctgctggccctcttctgcatcaccaagggcggcatctacgtgctgaccctgctggacacctttgctgctggcaccagcatcctgtttgctgtgctgatggaggccatcggcgtgtcctggttctacggcgtggaccgcttcagcaatgacatccagcagatgatgggcttccggcccggcctgtactggaggctgtgctggaagtttgtgtccccagccttcctgctgtttgtggtggtggtgtccatcatcaacttcaagcccctgacctatgatgactacatcttccccccctgggccaactgggtgggctggggcatcgccctgagctccatggtgctggtgcccatctacgtgatctacaagttcctgagcacccagggcagcctgtgggagcggctggcctacggcatcaccccagaaaatgagcaccacctggtggcccagagggacatccggcagttccagatgaagacccggcagggcagaagaagagccaccaacagctgccagatcagctgctag

SEQ ID NO: 15195 - DNA, 519 bp, Artificial Sequence; identical to SEQ ID NO: 15135
  Description of Artificial Sequence: Synthetic coding sequence

SEQ ID NO: 15196 - DNA, 417 bp, Artificial Sequence; identical to SEQ ID NO: 15137
  Description of Artificial Sequence: Synthetic coding sequence

SEQ ID NO: 15197 - DNA, 555 bp, Artificial Sequence
  Description of Artificial Sequence: Synthetic coding sequence
atggacctgcaggccgccggggcccaggcccagggcgctgctgagcccagccggggcccccccctgcccagcgcccggggggccccacccagccctgaggccggctttgccacagctgaccacagcagccaggagcgggagacagagaaggccatggaccggctggcccggggcacccagagcatccccaatgacagccctgcccggggggagggcacccacagcgaggaggagggctttgccatggatgaagaagattctgatggagagctgaacacctgggagctgtctgagggcaccaactgcccccccaaggagcagcccggggacctcttcaatgaagactgggacagcgagctgaaggctgaccagggcaacccctatgatgctgatgacatccaggagagcatcagccaggagctgaagccctgggtgtgctgtgccccccagggcgacatgatctatgaccccagctggcaccaccccccacccctcatcccctactacagcaagatggtgtttgagaccggccagtttgatgatgctgaagattag

SEQ ID NO: 15198 - DNA, 519 bp, Artificial Sequence
  Description of Artificial Sequence: Synthetic coding sequence
atgggaggagatgctggggaccgggagcccggccctgctgcccggagcctgggggagggccaggccggctttgccacagctgaccacagcagccaggagcgggagacagagaaggccatggaccggctggcccggggcacccagagcatccccaatgacagccctgcccggggggagggcacccacagcgaggaggagggctttgccatggatgaagaagattctgatggagagctgaacacctgggagctgtctgagggcaccaactgcccccccaaggagcagcccggggacctcttcaatgaagactgggacagcgagctgaaggctgaccagggcaacccctatgatgctgatgacatccaggagagcatcagccaggagctgaagccctgggtgtgctgtgccccccagggcgacatgatctatgaccccagctggcaccaccccccacccctcatcccctactacagcaagatggtgtttgagaccggccagtttgatgatgctgaagattag

SEQ ID NO: 15199 - DNA, 1956 bp, Artificial Sequence
  Description of Artificial Sequence: Synthetic coding sequence
atgggccctgccagccctgctgcccggggcctgagcagaagacctggccagccccccctgcccctgctgctgcccctgctgctgctgctgctgcgggcccagcctgccatcggcagcctggccggcggcagccctggagctgctgaggcccctggcagcgcccaggtggccggcctgtgtggccgcctgaccctgcaccgggacctgaggacaggccgctgggagccagacccccagaggagccgccgctgcctgcgggacccccagagggtgctggagtactgccggcagatgtacccagagctgcagatcgcccgggtggagcaggccacccaggccatccccatggagcgctggtgtggcggcagccgcagcggcagctgtgcccacccccaccaccaggtggtgcccttccgctgcctgcccggggagtttgtgtctgaggccctgctggtgcctgagggctgccgcttcctgcaccaggagaggatggaccagtgtgagagcagcacccggcggcaccaggaggcccaggaggcctgcagcagccagggcctcatcctgcacggcagcggcatgctgctgccctgtggcagtgaccgcttccggggcgtggagtatgtgtgctgccccccacctggcaccccagaccccagcggcacagctgtgggggaccccagcaccaggtcctggcccccaggcagccgggtggagggcgcagaagatgaggaggaggaggagagcttcccccagcctgtggatgactactttgtggagcccccccaggccgaggaggaggaggagaccgtgcccccacccagcagccacaccctggccgtggtgggcaaggtgacccccaccccccggcccacagatggagtggacatctacttcggcatgcctggagagatcagcgagcacgagggcttcctgcgggccaagatggacctggaggagaggaggatgaggcagatcaatgaggtgatgagggagtgggccatggctgacaaccagagcaagaacctgcccaaggctgaccggcaggccctgaatgagcacttccagagcatcctgcagaccctggaggagcaggtgtctggagagcggcagaggctggtggagacccacgccaccagggtgattgccctgatcaatgaccagaggcgggccgccctggagggcttcctggccgccctgcaggccgaccccccccaggccgagcgggtgctgctggccctgcggcgctacctgcgggcagagcagaaggagcagaggcacaccctgcggcactaccagcacgtggccgctgtggaccctgagaaggcccagcagatgaggttccaggtgcacacccacctgcaggtgattgaggagcgggtgaaccagagcctgggcctgctggaccagaacccccacctggcccaggagctgcggccccagatccaggagctgctgcacagcgagcacctgggccccagcgagctggaggccccagcccctgggggcagcagtgaagataaaggaggcctgcagcccccagacagcaaggatgctgacacccccatgaccctgcccaagggcagcacagagcaggatgctgccagccctgagaaggagaagatgaaccccctggagcagtatgaaaggaaggtgaatgcctctgtgccccggggcttccccttccacagcagcgagatccagagagatgagctggccccagctggcaccggggtgtcccgggaggccgtgtctggcctgctgatcatgggcgccggcggcggcagcctgattgtgctgtccatgctgctgctgcggaggaagaagccctacggggccatcagccatggagtggtggaggtggaccccatgctgaccctggaggagcagcagctgcgggagctgcagagacatggctatgagaaccccacctaccgcttcctggaggagcggccctag

SEQ ID NO: 15200 - DNA, 2277 bp, Artificial Sequence
  Description of Artificial Sequence: Synthetic coding sequence
atgggccgggacaccaggagccgcagccgctctgctggccggcggggcagaagacggcagagccagagcggcagccgcagccgcagccgcagccacggcagaagaaacagaagaagaagagaagatgagggcagaagaagaagaagaagaagaagccgggagaggagaagtgacagcgaggaggagcgctggcagaggagcggcatgaggagccgcagccccccccggcccaagtggcacagcagagatggcagcagccagagcgacagcggggaggagcagagccggggccagtgggccaggagaagaagaagagcccgctcctggagccccagcagcagcgccagcagcagcgccagccctggccgcagccagagccccagggctgctgctgctgccctgagccagcagcagagcctgcaggagcggctgcggctgcgggaggagaggaagcagcaggaggagctgatgaaggcctttgagaccccagaggagaagagggcccggcggctggccaagaaggaggccaaggagaggaagaagcgggagaagatgggctggggcgaggagtacatgggctacaccaacacagacaacccctttggagacaacaacctgctgggcaccttcatctggaacaaggccctggagaagaagggcatcagccacctggaggagaaggagctgaaggagaggaacaagaggatccaggaggacaaccggctggagctgcagaaggtgaagcagctgcggctggagcgggagcgggagaaggccatgagggagcaggagctggagatgctgcagcgggagaaggaggccgagcacttcaagacctgggaggagcaggaggacaacttccacctgcagcaggccaagctgcggagcaagatccgcatcagagatggccgggccaagcccatcgacctgctggccaagtacatctctgcagaagatgatgacctggccgtggagatgcatgagccctacaccttcctgaatggcctgactgtggccgacatggaggacctgctggaggacatccaggtgtacatggagctggagcagggcaagaatgctgacttctggagggacatgaccaccatcacagaagatgagatcagcaagctgaggaagctggaggccagcgggaaaggacctggagagcggcgggagggcgtgaatgcctctgtgtccagtgatgtgcagagcgtcttcaagggcaagacctacaaccagctgcaggtgatcttccagggcatcgagggcaagatccgggccggcggccccaacctggacatgggctactgggagagcctgctgcagcagctgcgggcccacatggcccgggcccggctgcgggagcggcaccaggatgtgctgcggcagaagctgtacaagctgaagcaggagcagggcgtggagagcgagcccctcttccccatcctgaagcaggagccccagagccccagccgcagcctggagccagaagatgctgcccccaccccacctggccccagcagcgagggcggccctgctgaggccgaggtggatggagccacccccacagaaggagatggagatggagatggagagggggagggggagggggaggccgtgctgatggaggaggacctgatccagcagagcctggatgattatgatgctggccgctacagcccccggctgctgacagcccacgagctgcccctggatgcccacgtgctggagccagatgaggacctgcagaggctgcagctgagccggcagcagctgcaggtgactggagatgccagcgagagcgctgaggacatcttcttccggcgggccaaggagggcatgggccaggatgaggcccagttctctgtggagatgcccctgaccgggaaggcctacctgtgggccgacaagtaccggcccaggaagccccgcttcttcaacagagtgcacactggatttgagtggaacaagtacaaccagacccactatgactttgacaaccccccacccaagatcgtgcagggctacaagttcaacatcttctacccagacctgattgacaagaggagcaccccagagtacttcctggaggcctgtgccgacaacaaggactttgccatcctgcgcttccacgccggccccccctatgaagatattgccttcaagatcgtgaaccgggagtgggagtacagccaccgccacggcttccgctgccagtttgccaacggcatcttccagctgtggttccacttcaagcgctaccgctacagaagatag

SEQ ID NO: 15201 - DNA, 2277 bp, Artificial Sequence; identical to SEQ ID NO: 15200
  Description of Artificial Sequence: Synthetic coding sequence

SEQ ID NO: 15202 - DNA, 792 bp, Artificial Sequence
  Description of Artificial Sequence: Synthetic coding sequence
atgggccgggacaccaggagccgcagccgctctgctggccggcggggcagaagacggcagagccagagcggcagccggcggggccccagccccttccccaggtctgtgcaccagcccaggcacctgcggaccaacccctgtgcccagggctcctgggtgaaggccggcccccctgtgaagcagctgcggctggagcgggagcgggagaaggccatgagggagcaggagctggagatgctgcagcgggagaaggaggccgagcacttcaagacctgggaggagcaggaggacaacttccacctgcagcaggccaagctgcggagcaagatccgcatcagagatggccgggccaagcccatcgacctgctggccaagtacatctctgcagaagatgatgacctggccgtggagatgcatgagccctacaccttcctgaatggcctgactgtggccgacatggaggacctgctggaggacatccaggtgtacatggagctggagcagggcaagaatgctgacttctggagggacatgaccaccatcacagaagatgagatcagcaagctgaggaagctggaggccagcgggaaaggacctggagagcggcgggagggcgtgaatgcctctgtgtccagtgatgtgcagagcgtcttcaagggcaagacctacaaccagctgcaggtgatcttccagggcatcgagggcaagatccgggccggcggccccaacctggacatgggctactgggagagcctgctgcagcagctgcgggcccacatggcccgggcctag

SEQ ID NO: 15203 - DNA, 321 bp, Artificial Sequence
  Description of Artificial Sequence: Synthetic coding sequence
atggagtttgacctgggcgccgccctggagcccaccagccagaagccaggagtgggcgccggccacggcggggaccccaagctgagcccccacaaggtgcagggccgctctgaggccggggccggccctggccccaagcagggccaccacagcagcagtgacagcagcagcagcagcagtgacagcgacacagatgtgaagagccacgccgccggcagcaagcagcacgagagcatccctgggaaggccaagaagcccaaggtgaagaagaaggagaagggcaagaaggagaagggcaagaagaaggaggccccccactag

SEQ ID NO: 15204 - DNA, 543 bp, Artificial Sequence
  Description of Artificial Sequence: Synthetic coding sequence
atggccggcgtgaagtacccaggccaggaccctgtggacctggacatctaccagagcagccacatggtggactaccagccctacaggaagcacaagtacagccgggtgaccccccaggagcaggccaagctggatgcccagctgcgggacaaggagttctaccggcccatccccaaccccaaccccaagctgacagatggctacccagccttcaagaggccccacatgacagccaaggacctgggcctgcccggcttcttccccagccaggagcacgaggccaccagagaagatgagaggaagttcaccagcacctgccacttcacctacccagccagccatgacctgcacctggcccagggcgaccccaaccaggtgctgcagagcgctgacttcccctgcctggtggaccccaagcaccagcctgctgctgagatggccaagggctacctgctgctgcccggctgcccctgcctgcactgccacatcgtgaaggtgcccatcctgaaccgctggggccccctgatgcccttctaccagtag

SEQ ID NO: 15205 - DNA, 1041 bp, Artificial Sequence
  Description of Artificial Sequence: Synthetic coding sequence
atggtgggcggcggcggcaagaggaggcctggaggagagggcccccagtgtgagaagaccacagatgtgaagaagagcaagttctgtgaggctgatgtgtccagtgacctgaggaaggaggtggagaaccactacaagctgagcctgcctgaggacttctaccacttctggaagttctgtgaggagctggaccctgagaagcccagcgacagcctgagcgccagcctgggcctgcagctggtgggcccctatgacatcctggccggcaagcacaagaccaagaagaagagcacaggcctgaacttcaacctgcactggaggttctactatgaccccccagagttccagaccatcatcatcggggacaacaagacccagtaccacatgggctacttccgggacagcccagatgagttccctgtgtatgtgggcatcaatgaggccaagaagaactgcatcatcgtgcccaatggagacaacgtgtttgctgctgtgaagctgttcctgaccaagaagctgcgggagatcacagacaagaagaagatcaacctgctgaagaacattgatgagaagctgacagaagctgcccgggagctgggctacagcctggagcagaggacagtgaagatgaagcagagggacaagaaggtggtgaccaagaccttccatggagctggcctggtggtgcctgtggacaagaatgatgtgggctaccgggagctgcctgagacagatgctgacctgaagaggatctgcaagaccatcgtggaggccgccagtgatgaggagcggctgaaggcctttgcccccatccaggagatgatgacctttgtgcagtttgccaatgatgaatgtgactatggcatgggcctggagctgggcatggacctcttctgctacggcagccactacttccacaaggtggccggccagctgctgcccctggcctacaacctgctgaagaggaacctgtttgctgagatcatcgaggagcacctggccaacagaagccaggagaacatcgaccagctggccgcctag

SEQ ID NO: 15206 - DNA, 780 bp, Artificial Sequence
  Description of Artificial Sequence: Synthetic coding sequence
atgagggaccggcggggccccctgggcacctgcctggcccaggtgcagcaggccggcggcggggacagcgacaagctgagctgcagcctgaagaagaggatgcctgagggcccctggccagcagatgcccccagctggatgaacaagcctgtggtggatggcaacagccagagcgaggccctgagcctggagatgaggaaggaccccagcggggccggcctgtggctgcacagcggcggccctgtgctgccctacgtgcgggagagcgtgagaagaaatcctgccagcgctgccacccccagcacagctgtgggcctcttccctgcccccacagagtgctttgcccgggtgtcctgcagcggcgtggaggccctgggcagaagagactggctgggcggcggcccccgggccacagatggccaccggggccagtgccccaagggggagccccgggtgtcccggctgcccaggcaccagaaggtgcctgagatgggcagcttccaggatgatcctccttctgccttccccaagggcctgggcagcgagctggagcccgcctgcctgcacagcatcctgagcgccaccctgcacgtgtacccagaggtgctgctgtctgaggagaccaagaggatcttcctggaccggctgaagcccatgttcagcaagcagaccatcgagttcaagaagatgctgaagagcaccagtgatggcctgcagatcaccctgggcctgctggccctgcagccctttgagctggccaacaccctgtgccacagctag

SEQ ID NO: 15207 - DNA, 363 bp, Artificial Sequence
  Description of Artificial Sequence: Synthetic coding sequence
atgagggaccggcggggccccctgggcacctgcctggcccaggtgcagcaggccggcggcggggacagcgacaagctgagctgcagcctgaagaagaggatgcctgagggcccctggccagcagatgcccccagctggatgaacaagcctgtggtggatggcaacagccagagcgaggccctgagcctggagatgaggaaggaccccagcggggccggcctgtggctgcacagcggcggccctgtgctgccctacgtgcgggagagcgtgagaagaaatcctgccagcgctgccacccccagcacagctgtgggcctcttccctgcccccacagagtgctttgcccgggtgtcctgcagctag

SEQ ID NO: 15208 - DNA, 330 bp, Artificial Sequence
  Description of Artificial Sequence: Synthetic coding sequence
atgagggaccggcggggccccctgggcacctgcctggcccaggtgcagcaggccggcggcggggacagcgacaagctgagctgcagcctgaagaagaggatgcctgagggcccctggccagcagatgcccccagctggatgaacaagcctgtggtggatggcaacagccagagcgaggccctgagcctggagatgaggaaggaccccagcggggccggcctgtggctgcacagcggcggccctgtgctgccctacgtgcgggagagcgtgagaagaaatcctgccagcgctgccacccccagcacagctgtgggcctcttccctgcctag

SEQ ID NO: 15209 - DNA, 2391 bp, Artificial Sequence
  Description of Artificial Sequence: Synthetic coding sequence
atggccgagaccaaggatgtgtttggccaggagccccaccctgtggaggatgacctgtacaaggagaggaccaggaagaggaggaagagtgaccgggaccagcgcttccgggccttccccagcatggagcagagcgccctgaaggagtatgagaagctggagagcaggacccggcgggtgctgagcaacacctaccagaagctgatccagagcgtcttcctggatgacagcatccccaacggggtgaagtacctgatcaaccggctgctggccctgattgagaagcccaccgtggaccccatctacatcgccctgtttggcagcactggagctgggaagagcagcctcatcaatgccatcatccagcaggccatgttcctgcctgtgtctggagagagcatctgcaccagctgcatcgtgcaggtgagcagcggctgctgcgtgcagtatgaggccaagatccacctgctgagtgaccaggagtggagggaggagctgaagaacctgaccaagctgctgcacaggacagaggagctgagccgggaggaggctgatgcctggaacagagatgaggccgtggaggaggccacctggaagctgcagatgatctatggaaatggagctgagagcaagaactatgaggagctgctgcgggccaagcccaagaggaagatccccaccagcagggtcatcaccctgaaggccgaggaggccgaggagctgagcatcaagctggacccctacatccgcacccagaggcgggactgggatggagaggccgctgagatgaggatctggcccctcatcaagcacgtggaggtgaccctgcccaagagtgacctgatccctgagggcgtggtgctggtggacatccctggcaccggggacttcaacagcaagagagatgagatgtggaagaagaccatcgacaagtgcagcgtcatctgggtgatcagtgacatcgagcgggtgtctgggggccaggcccacgaggacctgctgaatgaaagcatcaaggcctgccagaggggcttctgcagagatgtggccctggtggtgaccaagatggacaagctgcacctgcctgagtacctgcgggaggagaggaagggctggcaggccatccagagccagcgggaggccgtgctggagagaaatgagatgatcaagctgcagaggacccgcatcctgaaggagaagctgaagaggaagctgcctgctgacttcaaggtgctggaggccagtgacctggtgtacacagtgtctgcccaggagtactggcagcaggccctgctgacagaggaggagacagagatccccaagctgcgggagtacatcaggaagagcctgctggacaagaagaagaggacagtgaccaagtatgtgacagaggccttcggcctgctgctgctgacagacagcttcaacagcacccagaacctgcccaatgagcacctgcacatgtctgtgctgcggagatttgctgaggagaaggtggagctgctggagaaggccatcgcccagtgctttgcctgcatggagcagcccctgcaggagggcgtgaggacagcccggaccagctaccgctgcatcctgcgggcctgcctggtgcgcagcaagggcaaccagggcttccaccagaccctgaaggctgtgtgcctgaagaatggcatctatgccagcaggaccctggccagaattgacctgaatgaggccctgacccagcctgtgtatgaccagattgatcctgtgtttggcagcatcttcagaacaggcaagcccactggaagtgccctgatgccccacattgatgccttcaagcagagcctgcaggagaagatgacagaaattggcatccgcagcggctggaagtatgacagctgcaagaagaacttcctgatccaggagatcagcgccatcctgggcggcctggaggaccacatcctgcggaggaagaggcgcatctatgagagcctgacagcctctgtgcagagcgacctgaagctgtgctatgaggaggccgcccagatcaccgggaagaaggcctgtgagaggatgaaggatgccatcagaagaggagtggaccggcaggtggccgagggcatgtttgagcgggcccaggagaggatgcagcaccagttccagcagctgaagacaggaattgtggagaaggtgaagggcagcatcaccaccatgctggccctggccagcagccagggagatggcctgtacaaggagctggctgatgtgggcagcgagtacaaggagatggagaagctgcacaggagcctgcgggaggtggctgaaaatgcccggctgaggaagggcatgcaggagttcctgctgcgggccagccccagcaaggccggccccccaggcaccagcctgtag

SEQ ID NO: 15210 - DNA, 2391 bp, Artificial Sequence
  Description of Artificial Sequence: Synthetic coding sequence
atggccgagaccaaggatgtgtttggccaggagccccaccctgtggaggatgacctgtacaaggagaggaccaggaagaggaggaagagtgaccgggaccagcgcttccgggccttccccagcatggagcagagcgccctgaaggagtatgagaagctggagagcaggacccggcgggtgctgagcaacacctaccagaagctgatccagagcgtcttcctggatgacagcatccccaacggggtgaagtacctgatcaaccggctgctggccctgattgagaagcccaccgtggaccccatctacatcgccctgtttggcagcactggagctgggaagagcagcctcatcaatgccatcatccagcaggccatgttcctgcctgtgtctggagagagcatctgcaccagctgcatcgtgcaggtgagcagcggctgctgcgtgcagtatgaggccaagatccacctgctgagtgaccaggagtggagggaggagctgaagaacctgaccaagctgctgcacaggacagaggagctgagccgggaggaggctgatgcctggaacagagatgaggccgtggaggaggccacctggaagctgcagatgatctatggaaatggagctgagagcaagaactatgaggagctgctgcgggccaagcccaagaggaagatccccaccagcagggtcatcaccctgaaggccgaggaggccgaggagctgagcatcaagctggacccctacatccgcacccagaggcgggactgggatggagaggccgctgagatgaggatctggcccctcatcaagcacgtggaggtgaccctgcccaagagtgacctgatccctgagggcgtggtgctggtggacatccctggcaccggggacttcaacagcaagagagatgagatgtggaagaagaccatcgacaagtgcagcgtcatctgggtgatcagtgacatcgagcgggtgtctgggggccaggcccacgaggacctgctgaatgaaagcatcaaggcctgccagaggggcttctgcagagatgtggccctggtggtgaccaagatggacaagctgcacctgcctgagtacctgcgggagaggaaggccggcaaccaggccatccagagccagcgggaggccgtgctggagagaaatgagatgatcaagctgcagaggacccgcatcctgaaggagaagctgaagaggaagctgcctgctgacttcaaggtgctggaggccagtgacctggtgtacacagtgtctgcccaggagtactggcagcaggccctgctgacagaggaggagacagagatccccaagctgcgggagtacatcaggaagagcctgctggacaagaagaagaggacagtgaccaagtatgtgacagaggccttcggcctgctgctgctgacagacagcttcaacagcacccagaacctgcccaatgagcacctgcacatgtctgtgctgcggagatttgctgaggagaaggtggagctgctggagaaggccatcgcccagtgctttgcctgcatggagcagcccctgcaggagggcgtgaggacagcccggaccagctaccgctgcatcctgcgggcctgcctggtgcgcagcaagggcaaccagggcttccaccagaccctgaaggctgtgtgcctgaagaatggcatctatgccagcaggaccctggccagaattgacctgaatgaggccctgacccagcctgtgtatgaccagattgatcctgtgtttggcagcatcttcagaacaggcaagcccactggaagtgccctgatgccccacattgatgccttcaagcagagcctgcaggagaagatgacagaaattggcatccgcagcggctggaagtatgacagctgcaagaagaacttcctgatccaggagatcagcgccatcctgggcggcctggaggaccacatcctgcggaggaagaggcgcatctatgagagcctgacagcctctgtgcagagcgacctgaagctgtgctatgaggaggccgcccagatcaccgggaagaaggcctgtgagaggatgaaggatgccatcagaagaggagtggaccggcaggtggccgagggcatgtttgagcgggcccaggagaggatgcagcaccagttccagcagctgaagacaggaattgtggagaaggtgaagggcagcatcaccaccatgctggccctggccagcagccagggagatggcctgtacaaggagctggctgatgtgggcagcgagtacaaggagatggagaagctgcacaggagcctgcgggaggtggctgaaaatgcccggctgaggaagggcatgcaggagttcctgctgcgggccagccccagcaaggccggccccccaggcaccagcctgtag

SEQ ID NO: 15211 - DNA, 3999 bp, Artificial Sequence
  Description of Artificial Sequence: Synthetic coding sequence
atgaccggggaggtgggcagcgaggtgcacctggagatcaatgaccccaacgtcatcagccaggaggaggccgacagccccagcgacagcggccagggcagctatgagaccatcggccccctgtctgagggggacagtgatgaggagatctttgtgtccaagaagctgaagaacaggaaggtgctgcaggacagcgacagcgagacagaggacaccaatgccagccctgagaagaccacctatgattctgctgaggaggagaacaaggagaacctgtatgctgggaagaacaccaagatcaagaggatctacaagacagtggccgacagtgatgagagctacatggagaagagcctgtaccaggagaacctggaggcccaggtgaagccctgcctggagctgagcctgcagagcggcaacagcacagacttcaccacagacaggaagagcagcaagaagcacatccatgacaaggagggcacagctgggaaggccaaggtgaagagcaagaggcggctggagaaggaggagaggaagatggagaagatccggcagctgaagaagaaggagaccaagaaccaggaggatgatgtggagcagcccttcaatgattctggctgcctgctggtggacaaggacctgtttgaaacaggcctggaggatgagaacaacagccccctggaggatgaggagagcctggagagcatccgggctgctgtgaagaacaaggtgaagaagcacaagaagaaggagcccagcctggagagcggcgtgcacagctttgaggagggcagcgagctgagcaagggcaccaccaggaaggagaggaaggccgcccggctgagcaaggaggccctgaagcagctgcacagcgagacccagaggctcatccgggagagcgccctgaacctgccctaccacatgcctgagaacaagaccatccatgacttcttcaagaggaagccccggcccacctgccacggcaatgccatggccctgctgaagagcagcaagtaccagagcagccaccacaaggagatcatcgacacagccaacaccacagagatgaacagcgaccaccacagcaaaggaagtgagcagaccactggagcagaaaatgaggtggagaccaatgccctgcctgtggtgtccaaggagacccagatcatcactggaagtgatgagagctgcaggaaggacctggtgaagaatgaggagctggagatccaggagaagcagaagcagagcgacatccggcccagccctggggacagctctgtgctgcagcaggagagcaacttcctgggcaacaaccacagcgaggagtgccaggtgggcggcctggtggcctttgagccccacgccctggagggggagggcccccagaaccctgaggagacagatgagaaggtggaggagcctgagcagcagaacaagagcagcgctgtgggccccccagagaaggtgcggcgcttcaccctggaccggctgaagcagctgggcgtggatgtgtccatcaagccccggctgggcgcagatgaggacagctttgtgatcctggagcctgagaccaaccgggagctggaggccctgaagcagcgcttctggaagcacgccaacccagctgccaagcccagggctggccagacagtgaatgtgaatgtcatcgtgaaggacatgggcacagatggcaaggaggagctgaaggcagatgtggtgcctgtgaccctggcccccaagaagctggatggagccagccacaccaagccaggagagaagctgcaggtgctgaaggccaagctgcaggaggccatgaagctgcggagatttgaggagcggcagaagaggcaggccctcttcaagctggacaatgaagatggctttgaggaggaggaggaggaggaggaggagatgacagatgagagcgaggaggatggagaggagaaggtggagaaggaggagaaggaggaggagctggaggaggaggaggagaaggaggaggaggaggaggaggagggcaaccaggagacagctgagttcctgctgagcagcgaggagattgagaccaaggatgagaaggagatggacaaggagaacaatgatggcagcagcgagatcggcaaggctgtgggcttcctgtctgtgcccaagagcctgagcagtgacagcaccctgctgctcttcaaggacagcagcagcaagatgggctacttccccacagaggagaagtcagaaacagatgagaacagcggcaagcagcccagcaagctggatgaagatgacagctgcagcctgctgaccaaggagagcagccacaacagcagctttgagctgattggcagcaccatccccagctaccagccctgcaaccggcagacaggccggggcaccagcttcttccccacagctgggggcttccgcagccccagccctggcctcttccgggccagcctggtgtcctctgccagcaagagcagcggcaagctgtctgagcccagcctgcccatcgaggacagccaggacctgtacaatgccagccctgagcccaagaccctcttcctgggcgctggggacttccagttctgcctggaggatgacacccagagccagctgctggatgctgatggcttcctgaatgtgaggaaccacaggaaccagtaccaggccctgaagccccggctgcccctggcctccatggatgaaaatgccatggatgccaacatggatgagctgctggacctgtgcaccgggaagttcaccagccaggccgagaagcacctgcccaggaagagtgacaagaaggagaacatggaggagctgctgaacctgtgcagcggcaagttcaccagccaggatgccagcaccccagccagcagcgagctgaacaagcaggagaaggagagctccatgggagaccccatggaggaggccctggccctgtgcagcggcagcttccccacagacaaggaggaggaggatgaggaggaggagtttggagacttccggctggtgtccaatgacaatgaatttgacagtgatgaagatgagcacagcgacagcggaaatgacctggccctggaggaccatgaagatgatgatgaggaggagctgctgaagaggtctgagaagctgaagaggcagatgaggctgaggaagtacctggaggatgaggccgaggtgtctggcagtgatgtgggctctgaagatgaatatgatggagaggagattgatgaatatgaagaagatgtgattgatgaggtgctgcccagtgatgaggagctgcagagccagatcaagaagatccacatgaagaccatgctggatgatgacaagaggcagctgcggctgtaccaggagcgctacctggctgatggagacctgcacagtgatggccctggccgcatgaggaagttccgctggaagaacattgatgatgccagccagatggacctcttccaccgggacagtgatgatgaccagacagaggagcagctggatgagagcgaggcccgctggaggaaggagagaattgagcgggagcagtggctgcgggacatggcccagcagggcaagatcacagctgaggaggaggaggagatcggggaggacagccagttcatgatcctggccaagaaggtgacagccaaggccctgcagaagaatgccagccggcccatggtgatccaggagagcaagagcctgctgaggaacccctttgaggccatccggcccggcagcgcccagcaggtgaagacaggcagcctgctgaaccagcccaaggctgtgctgcagaagctggccgccctgagtgaccacaaccccagcgcccccaggaacagcaggaactttgtgttccacaccctgagccctgtgaaggccgaggccgccaaggagagcagcaagagccagaagatccctgagaaggacagcgactggctgacctggagcggggcccccatccctggcttcttccggctgagctttgacccccatggatag

SEQ ID NO: 15212 - DNA, 4020 bp, Artificial Sequence
  Description of Artificial Sequence: Synthetic coding sequence
atgaccggggaggtgggcagcgaggtgcacctggagatcaatgaccccaacgtcatcagccaggaggaggccgacagccccagcgacagcggccagggcagctatgagaccatcggccccctgtctgagggggacagtgatgaggagatctttgtgtccaagaagctgaagaacaggaaggtgctgcaggacagcgacagcgagacagaggacaccaatgccagccctgagaagaccacctatgattctgctgaggaggagaacaaggagaacctgtatgctgggaagaacaccaagatcaagaggatctacaagacagtggccgacagtgatgagagctacatggagaagagcctgtaccaggagaacctggaggcccaggtgaagccctgcctggagctgagcctgcagagcggcaacagcacagacttcaccacagacaggaagagcagcaagaagcacatccatgacaaggagggcacagctgggaaggccaaggtgaagagcaagaggcggctggagaaggaggagaggaagatggagaagatccggcagctgaagaagaaggagaccaagaaccaggaggatgatgtggagcagcccttcaatgattctggctgcctgctggtggacaaggacctgtttgaaacaggcctggaggatgagaacaacagccccctggaggatgaggagagcctggagagcatccgggctgctgtgaagaacaaggtgaagaagcacaagaagaaggagcccagcctggagagcggcgtgcacagctttgaggagggcagcgagctgagcaagggcaccaccaggaaggagaggaaggccgcccggctgagcaaggaggccctgaagcagctgcacagcgagacccagaggctcatccgggagagcgccctgaacctgccctaccacatgcctgagaacaagaccatccatgacttcttcaagaggaagccccggcccacctgccacggcaatgccatggccctgctgaagagcagcaagtaccagagcagccaccacaaggagatcatcgacacagccaacaccacagagatgaacagcgaccaccacagcaaaggaagtgagcagaccactggagcagaaaatgaggtggagaccaatgccctgcctgtggtgtccaaggagacccagatcatcactggaagtgatgagagctgcaggaaggacctggtgaagaatgaggagctggagatccaggagaagcagaagcagagcgacatccggcccagccctggggacagctctgtgctgcagcaggagagcaacttcctgggcaacaaccacagcgaggagtgccaggtgggcggcctggtggcctttgagccccacgccctggagggggagggcccccagaaccctgaggagacagatgagaaggtggaggagcctgagcagcagaacaagagcagcgctgtgggccccccagagaaggtgcggcgcttcaccctggaccggctgaagcagctgggcgtggatgtgtccatcaagccccggctgggcgcagatgaggacagctttgtgatcctggagcctgagaccaaccgggagctggaggccctgaagcagcgcttctggaagcacgccaacccagctgccaagcccagggctggccagacagtgaatgtgaatgtcatcgtgaaggacatgggcacagatggcaaggaggagctgaaggcagatgtggtgcctgtgaccctggcccccaagaagctggatggagccagccacaccaagccaggagagaagctgcaggtgctgaaggccaagctgcaggaggccatgaagctgcggagatttgaggagcggcagaagaggcaggccctcttcaagctggacaatgaagatggctttgaggaggaggaggaggaggaggaggagatgacagatgagagcgaggaggatggagaggagaaggtggagaaggaggagaaggaggaggagctggaggaggaggaggagaaggaggaggaggaggaggaggagggcaaccaggagacagctgagttcctgctgagcagcgaggagattgagaccaaggatgagaaggagatggacaaggagaacaatgatggcagcagcgagatcggcaaggctgtgggcttcctgtctgtgcccaagagcctgagcagtgacagcaccctgctgctcttcaaggacagcagcagcaagatgggctacttccccacagaggagaagtcagaaacagatgagaacagcggcaagcagcccagcaagctggatgaagatgacagctgcagcctgctgaccaaggagagcagccacaacagcagctttgagctgattggcagcaccatccccagctaccagccctgcaaccggcagacaggccggggcaccagcttcttccccacagctgggggcttccgcagccccagccctggcctcttccgggccagcctggtgtcctctgccagcaagagcagcggcaagctgtctgagcccagcctgcccatcgaggacagccaggacctgtacaatgccagccctgagcccaagaccctcttcctgggcgctggggacttccagttctgcctggaggatgacacccagagccagctgctggatgctgatggcttcctgaatgtgaggaaccacaggaaccagtaccaggccctgaagccccggctgcccctggcctccatggatgaaaatgccatggatgccaacatggatgagctgctggacctgtgcaccgggaagttcaccagccaggccgagaagcacctgcccaggaagagtgacaagaaggagaacatggaggagctgctgaacctgtgcagcggcaagttcaccagccaggatgccagcaccccagccagcagcgagctgaacaagcaggagaaggagagctccatgggagaccccatggaggaggccctggccctgtgcagcggcagcttccccacagacaaggaggaggaggatgaggaggaggagtttggagacttccggctggtgtccaatgacaatgaatttgacagtgatgaagatgagcacagcgacagcggaaatgacctggccctggaggaccatgaagatgatgatgaggaggagctgctgaagaggtctgagaagctgaagaggcagatgaggctgaggaagtacctggaggatgaggccgaggtgtctggcagtgatgtgggctctgaagatgaatatgatggagaggagattgatgaatatgaagaagatgtgattgatgaggtgctgcccagtgatgaggagctgcagagccagatcaagaagatccacatgaagaccatgctggatgatgacaagaggcagctgcggctgtaccaggagcgctacctggctgatggagacctgcacagtgatggccctggccgcatgaggaagttccgctggaagaacattgatgatgccagccagatggacctcttccaccgggacagtgatgatgaccagacagaggagcagctggatgagagcgaggcccgctggaggaaggagagaattgagcgggagcagtggctgcgggacatggcccagcagggcaagatcacagctgaggaggaggaggagatcggggaggacagccagttcatgatcctggccaagaaggtgacagccaaggccctgcagaagaatgccagccggcccatggtgatccaggagagcaagagcctgctgaggaacccctttgaggccatccggcccggcagcgcccagcaggtgaagacaggcagcctgctgaaccagcccaaggctgtgctgcagaagctggccgccctgagtgaccacaaccccagcgcccccaggaacagcaggaactttgtgttccacaccctgagccctgtgaaggccgaggccgccaaggagagcagcaagagccaggtgaagaagaggggccccagcttcatgaccagccccagccccaagcacctgaagacagatgacagcaccagcggcctgaccaggagcatcttcaagtacctggagagctag

SEQ ID NO: 15213 - DNA, 3828 bp, Artificial Sequence
  Description of Artificial Sequence: Synthetic coding sequence
atgaccggggaggtgggcagcgaggtgcacctggagatcaatgaccccaacgtcatcagccaggaggaggccgacagccccagcgacagcggccagggcagctatgagaccatcggccccctgtctgagggggacagtgatgaggagatctttgtgtccaagaagctgaagaacaggaaggtgctgcaggacagcgacagcgagacagaggacaccaatgccagccctgagaagaccacctatgattctgctgaggaggagaacaaggagaacctgtatgctgggaagaacaccaagatcaagaggatctacaagacagtggccgacagtgatgagagctacatggagaagagcctgtaccaggagaacctggaggcccaggtgaagccctgcctggagctgagcctgcagagcggcaacagcacagacttcaccacagacaggaagagcagcaagaagcacatccatgacaaggagggcacagctgggaaggccaaggtgaagagcaagaggcggctggagaaggaggagaggaagatggagaagatccggcagctgaagaagaaggagaccaagaaccaggaggatgatgtggagcagcccttcaatgattctggctgcctgctggtggacaaggacctgtttgaaacaggcctggaggatgagaacaacagccccctggaggatgaggagagcctggagagcatccgggctgctgtgaagaacaaggtgaagaagcacaagaagaaggagcccagcctggagagcggcgtgcacagctttgaggagggcagcgagctgagcaagggcaccaccaggaaggagaggaaggccgcccggctgagcaaggaggccctgaagcagctgcacagcgagacccagaggctcatccgggagagcgccctgaacctgccctaccacatgcctgagaacaagaccatccatgacttcttcaagaggaagccccggcccacctgccacggcaatgccatggccctgctgaagagcagcaagtaccagagcagccaccacaaggagatcatcgacacagccaacaccacagagatgaacagcgaccaccacagcaaaggaagtgagcagaccactggagcagaaaatgaggtggagaccaatgccctgcctgtggtgtccaaggagacccagatcatcactggaagtgatgagagctgcaggaaggacctggtgaagaatgaggagctggagatccaggagaagcagaagcagagcgacatccggcccagccctggggacagctctgtgctgcagcaggagagcaacttcctgggcaacaaccacagcgaggagtgccaggtgggcggcctggtggcctttgagccccacgccctggagggggagggcccccagaaccctgaggagacagatgagaaggtggaggagcctgagcagcagaacaagagcagcgctgtgggccccccagagaaggtgcggcgcttcaccctggaccggctgaagcagctgggcgtggatgtgtccatcaagccccggctgggcgcagatgaggacagctttgtgatcctggagcctgagaccaacagaggagagaagctgcaggtgctgaaggccaagctgcaggaggccatgaagctgcggagatttgaggagcggcagaagaggcaggccctcttcaagctggacaatgaagatggctttgaggaggaggaggaggaggaggaggagatgacagatgagagcgaggaggatggagaggagaaggtggagaaggaggagaaggaggaggagctggaggaggaggaggagaaggaggaggaggaggaggaggagggcaaccaggagacagctgagttcctgctgagcagcgaggagattgagaccaaggatgagaaggagatggacaaggagaacaatgatggcagcagcgagatcggcaaggctgtgggcttcctgtctgtgcccaagagcctgagcagtgacagcaccctgctgctcttcaaggacagcagcagcaagatgggctacttccccacagaggagaagtcagaaacagatgagaacagcggcaagcagcccagcaagctggatgaagatgacagctgcagcctgctgaccaaggagagcagccacaacagcagctttgagctgattggcagcaccatccccagctaccagccctgcaaccggcagacaggccggggcaccagcttcttccccacagctgggggcttccgcagccccagccctggcctcttccgggccagcctggtgtcctctgccagcaagagcagcggcaagctgtctgagcccagcctgcccatcgaggacagccaggacctgtacaatgccagccctgagcccaagaccctcttcctgggcgctggggacttccagttctgcctggaggatgacacccagagccagctgctggatgctgatggcttcctgaatgtgaggaaccacaggaaccagtaccaggccctgaagccccggctgcccctggcctccatggatgaaaatgccatggatgccaacatggatgagctgctggacctgtgcaccgggaagttcaccagccaggccgagaagcacctgcccaggaagagtgacaagaaggagaacatggaggagctgctgaacctgtgcagcggcaagttcaccagccaggatgccagcaccccagccagcagcgagctgaacaagcaggagaaggagagctccatgggagaccccatggaggaggccctggccctgtgcagcggcagcttccccacagacaaggaggaggaggatgaggaggaggagtttggagacttccggctggtgtccaatgacaatgaatttgacagtgatgaagatgagcacagcgacagcggaaatgacctggccctggaggaccatgaagatgatgatgaggaggagctgctgaagaggtctgagaagctgaagaggcagatgaggctgaggaagtacctggaggatgaggccgaggtgtctggcagtgatgtgggctctgaagatgaatatgatggagaggagattgatgaatatgaagaagatgtgattgatgaggtgctgcccagtgatgaggagctgcagagccagatcaagaagatccacatgaagaccatgctggatgatgacaagaggcagctgcggctgtaccaggagcgctacctggctgatggagacctgcacagtgatggccctggccgcatgaggaagttccgctggaagaacattgatgatgccagccagatggacctcttccaccgggacagtgatgatgaccagacagaggagcagctggatgagagcgaggcccgctggaggaaggagagaattgagcgggagcagtggctgcgggacatggcccagcagggcaagatcacagctgaggaggaggaggagatcggggaggacagccagttcatgatcctggccaagaaggtgacagccaaggccctgcagaagaatgccagccggcccatggtgatccaggagagcaagagcctgctgaggaacccctttgaggccatccggcccggcagcgcccagcaggtgaagacaggcagcctgctgaaccagcccaaggctgtgctgcagaagctggccgccctgagtgaccacaaccccagcgcccccaggaacagcaggaactttgtgttccacaccctgagccctgtgaaggccgaggccgccaaggagagcagcaagagccaggtgaagaagaggggccccagcttcatgaccagccccagccccaagcacctgaagacagatgacagcaccagcggcctgaccaggagcatcttcaagtacctggagagctag

SEQ ID NO: 15214 - DNA, 1977 bp, Artificial Sequence
  Description of Artificial Sequence: Synthetic coding sequence
atgaccggggaggtgggcagcgaggtgcacctggagatcaatgaccccaacgtcatcagccaggaggaggccgacagccccagcgacagcggccagggcagctatgagaccatcggccccctgtctgagggggacagtgatgaggagatctttgtgtccaagaagctgaagaacaggaaggtgctgcaggacagcgacagcgagacagaggacaccaatgccagccctgagaagaccacctatgattctgctgaggaggagaacaaggagaacctgtatgctgggaagaacaccaagatcaagaggatctacaagacagtggccgacagtgatgagagctacatggagaagagcctgtaccaggagaacctggaggcccaggtgaagccctgcctggagctgagcctgcagagcggcaacagcacagacttcaccacagacaggaagagcagcaagaagcacatccatgacaaggagggcacagctgggaaggccaaggtgaagagcaagaggcggctggagaaggaggagaggaagatggagaagatccggcagctgaagaagaaggagaccaagaaccaggaggatgatgtggagcagcccttcaatgattctggctgcctgctggtggacaaggacctgtttgaaacaggcctggaggatgagaacaacagccccctggaggatgaggagagcctggagagcatccgggctgctgtgaagaacaaggtgaagaagcacaagaagaaggagcccagcctggagagcggcgtgcacagctttgaggagggcagcgagctgagcaagggcaccaccaggaaggagaggaaggccgcccggctgagcaaggaggccctgaagcagctgcacagcgagacccagaggctcatccgggagagcgccctgaacctgccctaccacatgcctgagaacaagaccatccatgacttcttcaagaggaagccccggcccacctgccacggcaatgccatggccctgctgaagagcagcaagtaccagagcagccaccacaaggagatcatcgacacagccaacaccacagagatgaacagcgaccaccacagcaaaggaagtgagcagaccactggagcagaaaatgaggtggagaccaatgccctgcctgtggtgtccaaggagacccagatcatcactggaagtgatgagagctgcaggaaggacctggtgaagaatgaggagctggagatccaggagaagcagaagcagagcgacatccggcccagccctggggacagctctgtgctgcagcaggagagcaacttcctgggcaacaaccacagcgaggagtgccaggtgggcggcctggtggcctttgagccccacgccctggagggggagggcccccagaaccctgaggagacagatgagaaggtggaggagcctgagcagcagaacaagagcagcgctgtgggccccccagagaaggtgcggcgcttcaccctggaccggctgaagcagctgggcgtggatgtgtccatcaagccccggctgggcgcagatgaggacagctttgtgatcctggagcctgagaccaaccgggagctggaggccctgaagcagcgcttctggaagcacgccaacccagctgccaagcccagggctggccagacagtgaatgtgaatgtcatcgtgaaggacatgggcacagatggcaaggaggagctgaaggcagatgtggtgcctgtgaccctggcccccaagaagctggatggagccagccacaccaagccaggagagaagctgcaggtgctgaaggccaagctgcaggaggccatgaagctgcggagatttgaggagcggcagaagaggcaggccctcttcaagctggacaatgaagatggctttgaggaggaggaggaggaggaggaggagatgacagatgagagcgaggaggatggagaggagaagaagaagaagaagaagaagaagaagaactag

SEQ ID NO: 15215 - DNA, 3393 bp, Artificial Sequence
  Description of Artificial Sequence: Synthetic coding sequence
atgcgctgcctggcccccaggcctgctggcagctacctgtctgagccccagggcagcagccagtgtgccaccatggagctgggccccctggagggcggctacctggagctgctgaacagtgatgctgaccccctgtgcctgtaccacttctatgaccagatggacctggccggggaggaggagattgagctgtacagcgagccagacacagacaccatcaactgtgaccagttcagccggctgctgtgtgacatggagggagatgaggagacccgggaggcctatgccaacattgctgagctggaccagtatgtgttccaggacagccagctggagggcctgagcaaggacatcttcaagcacatcggcccagatgaagtcatcggggagagcatggagatgcctgctgaggtgggccagaagagccagaagaggcccttccctgaggagctgcctgctgacctgaagcactggaagccagctgagcccccaacagtggtgacaggcagcctgctggtgcggcctgtgtctgactgcagcaccctgccctgcctgcccctgcctgccctcttcaaccaggagcccgccagcggccagatgaggctggagaagacagaccagatccccatgcccttcagcagcagcagcctgagctgcctgaacctgcctgagggccccatccagtttgtgcccaccatcagcaccctgccccacggcctgtggcagatcagcgaggccggcaccggggtgagcagcatcttcatctaccatggagaggtgccccaggccagccaggtgcccccacccagcggcttcaccgtgcacggcctgcccaccagcccagaccggcccggcagcaccagcccctttgcccccagcgccacagacctgcccagcatgcctgagcccgccctgaccagccgggccaacatgacagagcacaagaccagccccacccagtgcccagctgctggggaggtgagcaacaagctgcccaagtggccagagcctgtggagcagttctaccgcagcctgcaggacacctatggagctgagcccgccggcccagatggcatcctggtggaggtggacctggtgcaggcccggctggagaggagcagcagcaagagcctggagcgggagctggccaccccagactgggccgagcggcagctggcccagggcggcctggccgaggtgctgctggccgccaaggagcaccggcggccccgggagaccagggtgattgctgtgctgggcaaggccggccagggcaagagctactgggccggggctgtgtcccgggcctgggcctgtggccgcctgccccagtatgactttgtgttttctgtgccctgccactgcctgaacagacctggagatgcctacggcctgcaggacctgctcttcagcctgggcccccagcccctggtggccgcagatgaggtgttcagccacatcctgaagaggccagacagagtgctgctgatcctggatggctttgaggagctggaggcccaggacggcttcctgcacagcacctgtggccctgccccagctgagccctgcagcctgcggggcctgctggccggcctcttccagaagaagctgctgcggggctgcaccctgctgctgacagcccggccccggggccgcctggtgcagagcctgagcaaggcagatgccctgtttgagctgagcggcttctccatggagcaggcccaggcctacgtgatgagatactttgagagcagcggcatgacagagcaccaggaccgggccctgaccctgctgcgggaccggcccctgctgctgagccacagccacagccccaccctgtgcagagctgtgtgccagctgtctgaggccctgctggagctgggagaagatgccaagctgcccagcaccctgaccggcctgtatgtgggcctgctgggccgggccgccctggacagccccccaggggccctggccgagctggccaagctggcctgggagctgggcagaagacaccagagcaccctgcaggaggaccagttccccagcgcagatgtgaggacctgggccatggccaagggcctggtgcagcacccccccagggctgctgagagcgagctggccttccccagcttcctgctgcagtgcttcctgggcgccctgtggctggccctgtctggagagatcaaggacaaggagctgccccagtacctggccctgacccccaggaagaagaggccctatgacaactggctggagggcgtgccccgcttcctggccggcctcatcttccagcccccagcccgctgcctgggcgccctgctgggccccagcgctgctgcctctgtggacaggaagcagaaggtgctggcccgctacctgaagaggctgcagcccggcaccctgcgggcccggcagctgctggagctgctgcactgtgcccacgaggccgaggaggccggcatctggcagcacgtggtgcaggagctgcccggccgcctgtccttcctgggcacccggctgaccccaccagatgcccacgtgctgggcaaggccctggaggccgccggccaggacttcagcctggacctgcggagcacaggcatctgccccagcggcctgggcagcctggtgggcctgagctgtgtgacccgcttccgggccgccctgagtgacacagtggccctgtgggagagcctgcagcagcacggggagaccaagctgctgcaggccgctgaggagaagttcaccatcgagcccttcaaggccaagagcctgaaggatgtggaggacctgggcaagctggtgcagacccagaggaccaggagcagcagcgaggacacagctggggagctgcctgctgtgcgggacctgaagaagctggagtttgccctgggccctgtgtctggcccccaggccttccccaagctggtgcgcatcctgacagccttcagcagcctgcagcacctggacctggatgccctgtctgagaacaagattggagatgaaggagtgtcccagctgagcgccaccttcccccagctgaagagcctggagaccctgaacctgagccagaacaacatcacagacctgggcgcctacaagctggccgaggccctgcccagcctggccgccagcctgctgcggctgagcctgtacaacaactgcatctgtgatgtgggcgctgagagcctggcccgggtgctgcctgacatggtgtccctgcgggtgatggatgtgcagtacaacaagttcaccgctgctggggcccagcagctggccgccagcctgcggcgctgcccccacgtggagaccctggccatgtggacccccaccatccccttctctgtgcaggagcacctgcagcagcaggacagccgcatcagcctgaggtag

SEQ ID NO: 15216 - DNA, 1641 bp, Artificial Sequence
  Description of Artificial Sequence: Synthetic coding sequence
atgcgctgcctggcccccaggcctgctggcagctacctgtctgagccccagggcagcagccagtgtgccaccatggagctgggccccctggagggcggctacctggagctgctgaacagtgatgctgaccccctgtgcctgtaccacttctatgaccagatggacctggccggggaggaggagattgagctgtacagcgagccagacacagacaccatcaactgtgaccagttcagccggctgctgtgtgacatggagggagatgaggagacccgggaggcctatgccaacattgctgagctggaccagtatgtgttccaggacagccagctggagggcctgagcaaggacatcttcaagcacatcggcccagatgaagtcatcggggagagcatggagatgcctgctgaggtgggccagaagagccagaagaggcccttccctgaggagctgcctgctgacctgaagcactggaagcctgtgcccttcagcagcagcagcctgagctgcctgaacctgcctgagggccccatccagtttgtgcccaccatcagcaccctgccccacggcctgtggcagatcagcgaggccggcactggagtgagcagcatcttcatctaccacggggaggtgccccaggccagccaggtgcccccaccttctggcttcaccgtgcacggcctgcccaccagcccagacaggcctggcagcaccagcccctttgcccccagcgccacagacctgcccagcatgcctgagcccgccctgaccagccgggccaacatgacagagcacaagaccagccccacccagtgcccagctgctggggaggtgagcaacaagctgcccaagtggccaggcctggcctggagcccctgcctgggcctgcggcccagcctgcacagagctgccctgagtgacacagtggccctgtgggagagcctgcagcagcacggggagaccaagctgctgcaggccgctgaggagaagttcaccatcgagcccttcaaggccaagagcctgaaggatgtggaggacctgggcaagctggtgcagacccagaggaccaggagcagcagcgaggacacagctggggagctgcctgctgtgcgggacctgaagaagctggagtttgccctgggccctgtgtctggcccccaggccttccccaagctggtgcgcatcctgacagccttcagcagcctgcagcacctggacctggatgccctgtctgagaacaagattggagatgaaggagtgtcccagctgagcgccaccttcccccagctgaagagcctggagaccctgaacctgagccagaacaacatcacagacctgggcgcctacaagctggccgaggccctgcccagcctggccgccagcctgctgcggctgagcctgtacaacaactgcatctgtgatgtgggcgctgagagcctggcccgggtgctgcctgacatggtgtccctgcgggtgatggatgtgcagtacaacaagttcaccgctgctggggcccagcagctggccgccagcctgcggcgctgcccccacgtggagaccctggccatgtggacccccaccatccccttctctgtgcaggagcacctgcagcagcaggacagccgcatcagcctgaggtag

SEQ ID NO: 15217 - DNA, 2655 bp, Artificial Sequence
  Description of Artificial Sequence: Synthetic coding sequence
atgcgctgcctggcccccaggcctgctggcagctacctgtctgagccccagggcagcagccagtgtgccaccatggagctgggccccctggagggcggctacctggagctgctgaacagtgatgctgaccccctgtgcctgtaccacttctatgaccagatggacctggccggggaggaggagattgagctgtacagcgagccagacacagacaccatcaactgtgaccagttcagccggctgctgtgtgacatggagggagatgaggagacccgggaggcctatgccaacattgctgagctggaccagtatgtgttccaggacagccagctggagggcctgagcaaggacatcttcatcgagcacatcggcccagatgaggtgattggagagagcatggagatgcctgctgaggtgggccagaagagccagaagaggcccttccctgaggagctgcctgctgacctgaagcactggaagcctgtgcccttcagcagcagcagcctgagctgcctgaacctgcctgagggccccatccagtttgtgcccaccatcagcaccctgccccacggcctgtggcagatcagcgaggccggcaccggggtgagcagcatcttcatctaccatggagaggtgccccaggccagccaggtgcccccacccagcggcttcaccgtgcacggcctgcccaccagcccagaccggcccggcagcaccagcccctttgcccccagcgccacagacctgcccagcatgcctgagcccgccctgaccagccgggccaacatgacagagcacaagaccagccccacccagtgcccagctgctggggaggtgagcaacaagctgcccaagtggccagagcctgtggagcagttctaccgcagcctgcaggacacctatggagctgagcccgccggcccagatggcatcctggtggaggtggacctggtgcaggcccggctggagaggagcagcagcaagagcctggagcgggagctggccaccccagactgggccgagcggcagctggcccagggcggcctggccgaggtgctgctggccgccaaggagcaccggcggccccgggagaccagggtgattgctgtgctgggcaaggccggccagggcaagagctactgggccggggctgtgtcccgggcctgggcctgtggccgcctgccccagtatgactttgtgttttctgtgccctgccactgcctgaacagacctggagatgcctacggcctgcaggacctgctcttcagcctgggcccccagcccctggtggccgcagatgaggtgttcagccacatcctgaagaggccagacagagtgctgctgatcctggatggctttgaggagctggaggcccaggacggcttcctgcacagcacctgtggccctgccccagctgagccctgcagcctgcggggcctgctggccggcctcttccagaagaagctgctgcggggctgcaccctgctgctgacagcccggccccggggccgcctggtgcagagcctgagcaaggcagatgccctgtttgagctgagcggcttctccatggagcaggcccaggcctacgtgatgagatactttgagagcagcggcatgacagagcaccaggaccgggccctgaccctgctgcgggaccggcccctgctgctgagccacagccacagccccaccctgtgcagagctgtgtgccagctgtctgaggccctgctggagctgggagaagatgccaagctgcccagcaccctgaccggcctgtatgtgggcctgctgggccgggccgccctggacagccccccaggggccctggccgagctggccaagctggcctgggagctgggcagaagacaccagagcaccctgcaggaggaccagttccccagcgcagatgtgaggacctgggccatggccaagggcctggtgcagcacccccccagggctgctgagagcgagctggccttccccagcttcctgctgcagtgcttcctgggcgccctgtggctggccctgtctggagagatcaaggacaaggagctgccccagtacctggccctgacccccaggaagaagaggccctatgacaactggctggagggcgtgccccgcttcctggccggcctcatcttccagcccccagcccgctgcctgggcgccctgctgggccccagcgctgctgcctctgtggacaggaagcagaaggtgctggcccgctacctgaagaggctgcagcccggcaccctgcgggcccggcagctgctggagctgctgcactgtgcccacgaggccgaggaggccggcatctggcagcacgtggtgcaggagctgcccggccgcctgtccttcctgggcacccggctgaccccaccagatgcccacgtgctgggcaaggccctggaggccgccggccaggacttcagcctggacctgcggagcacaggcatctgccccagcggcctgggcagcctggtgggcctgagctgtgtgacccgcttccgctggggcgagggcctgggccgggacatcctggtgctgggcatcaactgtggcctgggcgccaagcccagcgccctgtggggcagcttctccatgcagagcagccgggtgggccagaatggcttcagccccttcctgaggtag

SEQ ID NO: 15218 - DNA, 1062 bp, Artificial Sequence
  Description of Artificial Sequence: Synthetic coding sequence
atgcgctgcctggcccccaggcctgctggcagctacctgtctgagccccagggcagcagccagtgtgccaccatggagctgggccccctggagggcggctacctggagctgctgaacagtgatgctgaccccctgtgcctgtaccacttctatgaccagatggacctggccggggaggaggagattgagctgtacagcgagccagacacagacaccatcaactgtgaccagttcagccggctgctgtgtgacatggagggagatgaggagacccgggaggcctatgccaacattgctgagctggaccagtatgtgttccaggacagccagctggagggcctgagcaaggacatcttcaagcacatcggcccagatgaagtcatcggggagagcatggagatgcctgctgaggtgggccagaagagccagaagaggcccttccctgaggagctgcctgctgacctgaagcactggaagccagctgagcccccaacagtggtgacaggcagcctgctggtgcggcctgtgtctgactgcagcaccctgccctgcctgcccctgcctgccctcttcaaccaggagcccgccagcggccagatgaggctggagaagacagaccagatccccatgcccttcagcagcagcagcctgagctgcctgaacctgcctgagggccccatccagtttgtgcccaccatcagcaccctgccccacggcctgtggcagatcagcgaggccggcaccggggtgagcagcatcttcatctaccatggagaggtgccccaggccagccaggtgcccccacccagcggcttcaccgtgcacggcctgcccaccagcccagaccggcccggcagcaccagcccctttgcccccagcgccacagacctgcccagcatgcctgagcccgccctgaccagccgggccaacatgacagagcacaagaccagccccacccagtgcccagctgctggggaggtgagcaacaagctgcccaagtggccaggccgggaggtgcccaggaagacccagctgggcagcagcctgctgtttggcacctag

SEQ ID NO: 15219 - DNA, 4332 bp, Artificial Sequence
  Description of Artificial Sequence: Synthetic coding sequence
atgtatgctgtgtacaagcaggcccacccccccaccggcctggagttctccatgtactgcaacttcttcaacaacagcgagaggaacctggtggtggccggcaccagccagctgtatgtgtaccgcctgaacagagatgctgaggccctgaccaagaatgacaggagcacagagggcaaggcccaccgggagaagctggagctggccgccagcttctccttctttggaaatgtgatgtccatggcctctgtgcagctggccggggccaagagagatgccctgctgctgtccttcaaggatgccaagctgtctgtggtggagtatgaccccggcacccatgacctgaagaccctgagcctgcactactttgaggagcctgagctgagagatggctttgtgcagaatgtgcacaccccccgggtgcgggtggaccctgatggccgctgtgccgccatgctggtgtatggcacccggctggtggtgctgcccttcagaagagagagcctggccgaggagcacgagggcctggtgggggagggccagaggagcagcttcctgcccagctacatcattgatgtgcgggccctggatgagaagctgctgaacatcatcgacctgcagttcctgcacggctactatgagcccaccctgctgatcctgtttgagcccaaccagacctggccaggccgggtggccgtgcggcaggacacctgcagcatcgtggccatcagcctgaacatcacccagaaggtgcaccctgtgatctggagcctgaccagcctgccctttgactgcacccaggccctggccgtgcccaagcccatcggcggcgtggtggtgtttgctgtgaacagcctgctgtacctgaaccagagcgtgcccccctacggcgtggccctgaacagcctgaccaccggcaccacagccttccccctgcggacccaggagggcgtgcgcatcaccctggactgtgcccaggccaccttcatctcctatgacaagatggtgatcagcctgaagggcggggagatctacgtgctgaccctcatcacagatggcatgaggtctgtgcgggccttccactttgacaaggccgccgcctctgtgctgaccacctccatggtgaccatggagcccggctacctgttcctgggcagccggctgggcaacagcctgctgctgaagtacacagagaagctgcaggagcccccagccagcgctgtgcgggaggccgctgacaaggaggagccccccagcaagaagaagagggtggatgccacagctggctggagcgctgctgggaagtctgtgccccaggatgaggtggatgaaattgaggtgtatggcagcgaggcccagagcggcacccagctggccacctacagctttgaggtgtgtgacagcatcctgaacatcggcccctgtgccaatgctgctgtgggggagcccgccttcctgtctgaggagttccagaacagccctgagccagacctggagatcgtggtgtgcagcggccacggcaagaatggagccctgtctgtgctgcagaagagcatccggccccaggtggtgaccacctttgagctgcccggctgctatgacatgtggacagtgattgcccctgtgaggaaggaggaggaggacaaccccaagggggagggcacagagcaggagcccagcaccaccccagaggctgatgatgatggccgccgccacggcttcctgatcctgagccgggaggacagcaccatgatcctgcagacaggccaggagatcatggagctggacaccagcggctttgccacccagggccccaccgtgtttgctggcaacatcggggacaaccgctacatcgtgcaggtgagccccctgggcatccggctgctggagggcgtgaaccagctgcacttcatccctgtggacctgggcgcccccatcgtgcagtgtgctgtggccgacccctacgtggtgatcatgtctgctgagggccacgtgaccatgttcctgctgaagagtgacagctatggaggccgccaccaccggctggccctgcacaagccacccctgcaccaccagagcaaggtgatcaccctgtgcctgtacagagacctgagcggcatgttcaccacagagagccggctgggcggggccagagatgagctgggcggccgcagcggccctgaggccgagggcctgggcagcgagaccagccccaccgtggatgatgaggaggagatgctgtatggagacagcggcagcctcttcagccccagcaaggaggaggcccggcgcagcagccagcccccagctgaccgggaccctgcccccttccgggcagagcccacccactggtgcctgctggtgcgggagaatggcaccatggagatctaccagctgcctgactggaggctggtgttcctggtgaagaacttccctgtgggccagagggtgctggtggacagcagctttggccagcccaccacccagggcgaggcccggcgggaggaggccacccggcagggcgagctgcccctggtgaaggaggtgctgctggtggccctgggcagccggcagagccggccctacctgctggtgcacgtggaccaggagctgctgatctatgaggccttcccccatgacagccagctgggccagggcaacctgaaggtgcgcttcaagaaggtgccccacaacatcaacttccgggagaagaagcccaagcccagcaagaagaaggccgagggcggcggcgctgaggagggcgctggggcccggggccgggtggcccgcttccgctactttgaggacatctacggctacagcggggtcttcatctgtggccccagcccccactggctgctggtgacaggccgcggggccctgcggctgcaccccatggccattgatggccctgtggacagctttgcccccttccacaacgtgaactgcccccggggcttcctgtacttcaaccggcagggcgagctgcgcatctctgtgctgcctgcctacctgtcctatgatgccccctggcctgtgaggaagatccccctgcgctgcacagcccactacgtggcctaccacgtggagagcaaggtgtatgctgtggccaccagcaccaacaccccctgtgcccgcatccccaggatgactggagaggagaaggagtttgagaccatcgagagagatgagcgctacatccacccccagcaggaggccttcagcatccagctgatcagccctgtgtcctgggaggccatccccaatgcccgcatcgagctgcaggagtgggagcacgtgacctgcatgaagacagtgtccctgcggtctgaggagaccgtgtctggcctgaagggctacgtggccgccggcacctgcctgatgcagggcgaggaggtgacctgccggggccgcatcctgatcatggatgtgattgaggtggtgcctgagcccggccagcccctgaccaagaacaagttcaaggtgctgtatgagaaggagcagaagggccctgtgacagccctgtgccactgcaatggccacctggtgtctgccatcggccagaagatcttcctgtggagcctgcgggccagcgagctgaccggcatggccttcatcgacacccagctgtacatccaccagatgatctctgtgaagaacttcatcctggccgcagatgtgatgaagagcatcagcctgctgcgctaccaggaggagagcaagaccctgagcctggtgtccagagatgccaagcccctggaggtgtacagcgtggacttcatggtggacaatgcccagctgggcttcctggtgtctgaccgggacaggaacctgatggtgtacatgtacctgcctgaggccaaggagagctttggaggcatgaggctgctgcggcgggctgacttccacgtgggcgcccacgtgaacaccttctggaggaccccctgccgcggggccacagagggcctgagcaagaagtctgtggtgtgggagaacaagcacatcacctggtttgccaccctggatggcggcatcggcctgctgctgcccatgcaggagaagacctacagaaggctgctgatgctgcagaatgccctgaccaccatgctgccccaccacgccggcctgaacccccgggccttcaggatgctgcacgtggacaggaggaccctgcagaatgctgtgagaaatgtgctggatggagagctgctgaaccgctacctgtacctgagcaccatggagaggtctgagctggccaagaagattggcaccaccccagacatcatcctggatgacctgctggagacagacagagtgacagcccacttctag

SEQ ID NO: 15220 - DNA, 2349 bp, Artificial Sequence
  Description of Artificial Sequence: Synthetic coding sequence
atgaccagcatcatcaagctgaccaccctgtctggagtgcaggaggagagcgccctgtgctacctgctgcaggtggatgagttccgcttcctgctggactgtggctgggatgagcacttctccatggacatcatcgacagcctgaggaagcacgtgcaccagattgatgctgtgctgctgagccacccagaccccctgcacctgggcgccctgccctatgctgtgggcaagctgggcctgaactgtgccatctatgccaccatccctgtgtacaagatgggccagatgttcatgtatgacctgtaccagagccgccacaacacagaggacttcaccctcttcaccctggatgatgtggatgctgcctttgacaagatccagcagctgaagttcagccagatcgtgaacctgaagggcaagggccacggcctgagcatcacccccctgcctgctggccacatgattggaggcaccatctggaagatcgtgaaggatggagaggaggagatcgtgtatgctgtggacttcaaccacaagcgggagatccacctgaatggctgcagcctggagatgctgagccggcccagcctgctgatcacagacagcttcaatgccacctacgtgcagcccaggaggaagcagagagatgagcagctgctgaccaacgtgctggagaccctgcggggagatggaaatgtgctgattgctgtggacacagctggccgggtgctggagctggcccagctgctggaccagatctggaggaccaaggatgctggcctgggcgtgtacagcctggccctgctgaacaacgtgtcctacaacgtggtggagttcagcaagagccaggtggagtggatgtctgacaagctgatgcgctgctttgaggacaagaggaacaaccccttccagttccgccacctgagcctgtgccacggcctgagtgacctggcccgggtgcccagccccaaggtggtgctggccagccagcctgacctggagtgtggcttcagccgggacctcttcatccagtggtgccaggaccccaagaacagcatcatcctgacctaccgcaccaccccaggcaccctggcccgcttcctgattgacaaccccagcgagaagatcacagaaattgagctgaggaagagggtgaagctggagggcaaggagctggaggagtacctggagaaggagaagctgaagaaggaggccgccaagaagctggagcagagcaaggaggccgacatcgacagcagtgatgaaagtgacattgaagaagatattgaccagcccagcgcccacaagaccaagcatgacctgatgatgaagggggagggcagcaggaagggcagcttcttcaagcaggccaagaagagctaccccatgtttcctgcccctgaggagcgcatcaagtgggatgaatatggagagatcatcaagccagaggacttcctggtgcctgagctgcaggccacagaggaggagaagagcaagctggagagcggcctgaccaatggagatgagcccatggaccaggacctgagtgatgtgcccaccaagtgcatcagcaccacagagagcattgagatcaaggcccgggtgacctacatcgactatgagggccgcagtgatggagacagcatcaagaagatcatcaaccagatgaagccccggcagctgatcatcgtgcacggccccccagaggccagccaggacctggccgagtgctgccgggcctttggaggcaaggacatcaaggtgtacatgcccaagctgcacgagaccgtggatgccaccagcgagacccacatctaccaggtgcggctgaaggacagcctggtgagcagcctgcagttctgcaaggccaaggatgctgagctggcctggattgatggagtgctggacatgagggtgtccaaggtggacaccggggtcatcctggaggagggggagctgaaggatgatggagaggacagcgagatgcaggtggaggcccccagcgacagctctgtgattgcccagcagaaggccatgaagagcctgtttggagatgatgagaaggagaccggggaggagagcgagatcatccccaccctggagcccctgccccctcatgaggtgcccggccaccagagcgtcttcatgaatgagccccggctgagtgacttcaagcaggtgctgctgcgggagggcatccaggccgagtttgtgggcggcgtgctggtgtgcaacaaccaggtggccgtgagaagaacagaaacaggccgcatcggcctggagggctgcctgtgccaggacttctaccgcatccgggacctgctgtatgagcagtatgccatcgtgtag

SEQ ID NO: 15221 - DNA, 243 bp, Artificial Sequence
  Description of Artificial Sequence: Synthetic coding sequence
atgaccagcatcatcaagctgaccaccctgtctggagtgcaggaggagagcgccctgtgctacctgctgcaggtggatgagttccgcttcctgctggactgtggctgggatgagcacttctccatggacatcatcgacagcctgaggaagcacgtgcaccagattgatgctgtgctgctgagccacccagaccccctgcacctgggcgccctgccctatgctgtgggcaagctgggcctgtag

SEQ ID NO: 15222 - DNA, 2055 bp, Artificial Sequence
  Description of Artificial Sequence: Synthetic coding sequence
atgtctgccatcccagctgaggagagtgaccagctgctgatccggcccctgggcgccggccaggaggtgggccgcagctgcatcatcctggagttcaagggcaggaagatcatgctggactgtggcatccaccctggcctggagggcatggatgccctgccctacatcgacctgattgatcctgctgagattgacctgctgctgatcagccacttccacctggaccactgtggggccctgccctggttcctgcagaagaccagcttcaagggccgcaccttcatgacccacgccaccaaggccatctaccgctggctgctgagtgactatgtgaaggtgagcaacatctctgcagatgacatgctgtacacagaaacagacctggaggagagcatggacaagattgagaccatcaacttccacgaggtgaaggaggtggccggcatcaagttctggtgctaccacgccggccacgtgctgggcgccgccatgttcatgattgaaattgctggggtgaagctgctgtacacaggagacttcagccggcaggaggacagacacctgatggctgctgagatccccaacatcaagccagacatcctgatcatcgagagcacctacggcacccacatccacgagaagcgggaggagcgggaggcccgcttctgcaacacagtgcatgacatcgtgaacagaggaggccggggcctcatccctgtgtttgccctgggccgggcccaggagctgctgctgatcctggatgagtactggcagaaccaccctgagctgcatgacatccccatctactatgccagcagcctggccaagaagtgcatggctgtgtaccagacctacgtgaatgccatgaatgacaagatcaggaagcagatcaacatcaacaacccctttgtgttcaagcacatcagcaacctgaagtccatggaccactttgatgacatcggccccagcgtggtgatggccagccctggcatgatgcagagcggcctgagccgggagctgtttgagagctggtgcacagacaagagaaatggagtcatcatcgccggctactgtgtggagggcaccctggccaagcacatcatgtctgagcctgaggagatcaccaccatgagcggccagaagctgcccctgaagatgtctgtggactacatctccttcagcgcccacacagactaccagcagaccagcgagttcatccgggccctgaagccccctcatgtgatcctggtgcacggggagcagaatgagatggcccggctgaaggccgccctgatccgggagtatgaggacaatgatgaggtgcacatcgaggtgcacaaccccaggaacacagaagctgtgaccctgaacttccggggggagaagctggccaaggtgatgggcttcctggccgacaagaagccagagcagggccagagggtgtctggcatcctggtgaagaggaacttcaactaccacatcctgagcccctgtgacctgagcaactacacagacctggccatgagcacagtgaagcagacccaggccatcccctacacaggccccttcaacctgctgtgctaccagctgcagaagctgactggagatgtggaggagctggagatccaggagaagccagccctgaaggtgttcaagaacatcaccgtcatccaggagcccggcatggtggtgctggagtggctggccaaccccagcaatgacatgtatgctgacacagtgaccaccgtcatcctggaggtgcagagcaaccccaagatcagaaaaggagctgtgcagaaggtgtccaagaagctggagatgcacgtgtacagcaagaggctggagatcatgctgcaggacatctttggagaggactgtgtgtctgtgaaggatgacagcatcctgtctgtgacagtggatggcaagacagccaacctgaacctggagaccaggacagtggagtgtgaggagggctctgaagatgatgagagcctgcgggagatggtggagctggccgcccagaggctgtatgaggccctgacccctgtgcactag

SEQ ID NO: 15223 - DNA, 1641 bp, Artificial Sequence
  Description of Artificial Sequence: Synthetic coding sequence
atgtctgccatcccagctgaggagagtgaccagctgctgatccggcccctgggcgccggccaggaggtgggccgcagctgcatcatcctggagttcaagggcaggaagatcatgctggactgtggcatccaccctggcctggagggcatggatgccctgccctacatcgacctgattgatcctgctgagattgacctgctgctgatcagccacttccacctggaccactgtggggccctgccctggttcctgcagaagaccagcttcaagggccgcaccttcatgacccacgccaccaaggccatctaccgctggctgctgagtgactatgtgaaggtgagcaacatctctgcagatgacatgctgtacacagaaacagacctggaggagagcatggacaagattgagaccatcaacttccacgaggtgaaggaggtggccggcatcaagttctggtgctaccacgccggccacgtgctgggcgccgccatgttcatgattgaaattgctggggtgaagctgctgtacacaggagacttcagccggcaggaggacagacacctgatggctgctgagatccccaacatcaagccagacatcctgatcatcgagagcacctacggcacccacatccacgagaagcgggaggagcgggaggcccgcttctgcaacacagtgcatgacatcgtgaacagaggaggccggggcctcatccctgtgtttgccctgggccgggcccaggagctgctgctgatcctggatgagtactggcagaaccaccctgagctgcatgacatccccatctactatgccagcagcctggccaagaagtgcatggctgtgtaccagacctacgtgaatgccatgaatgacaagatcaggaagcagatcaacatcaacaacccctttgtgttcaagcacatcagcaacctgaagtccatggaccactttgatgacatcggccccagcgtggtgatggccagccctggcatgatgcagagcggcctgagccgggagctgtttgagagctggtgcacagacaagagaaatggagtcatcatcgccggctactgtgtggagggcaccctggccaagatcctggtgcatggagagcagaatgagatggcccggctgaaggccgccctgatccgggagtatgaagataatgatgaggtgcacatcgaggtgcacaaccccaggaacacagaggccgtgaccctgaacttccggggggagaagctggccaaggtgatgggcttcctggccgacaagaagccagagcagggccagagggtgtctggcatcctggtgaagaggaacttcaactaccacatcctgagcccctgtgacctgagcaactacacagacctggccatgagcacagtgaagcagacccaggccatcccctacacaggccccttcaacctgctgtgctaccagctgcagaagctgactggagatgtggaggagctggagatccaggagaagccagccctgaaggtgttcaagaacatcaccgtcatccaggagcccggcatggtggtgctggagtggctggccaaccccagcaatgacatgtatgctgacacagtgaccaccgtcatcctggaggtgcagagcaaccccaagatcaggaagtag

SEQ ID NO: 15224 - DNA, 1221 bp, Artificial Sequence
  Description of Artificial Sequence: Synthetic coding sequence
atggctgtgtaccagacctacgtgaatgccatgaatgacaagatcaggaagcagatcaacatcaacaacccctttgtgttcaagcacatcagcaacctgaagtccatggaccactttgatgacatcggccccagcgtggtgatggccagccctggcatgatgcagagcggcctgagccgggagctgtttgagagctggtgcacagacaagagaaatggagtcatcatcgccggctactgtgtggagggcaccctggccaagcacatcatgtctgagcctgaggagatcaccaccatgagcggccagaagctgcccctgaagatgtctgtggactacatctccttcagcgcccacacagactaccagcagaccagcgagttcatccgggccctgaagccccctcatgtgatcctggtgcacggggagcagaatgagatggcccggctgaaggccgccctgatccgggagtatgaggacaatgatgaggtgcacatcgaggtgcacaaccccaggaacacagaagctgtgaccctgaacttccggggggagaagctggccaaggtgatgggcttcctggccgacaagaagccagagcagggccagagggtgtctggcatcctggtgaagaggaacttcaactaccacatcctgagcccctgtgacctgagcaactacacagacctggccatgagcacagtgaagcagacccaggccatcccctacacaggccccttcaacctgctgtgctaccagctgcagaagctgactggagatgtggaggagctggagatccaggagaagccagccctgaaggtgttcaagaacatcaccgtcatccaggagcccggcatggtggtgctggagtggctggccaaccccagcaatgacatgtatgctgacacagtgaccaccgtcatcctggaggtgcagagcaaccccaagatcagaaaaggagctgtgcagaaggtgtccaagaagctggagatgcacgtgtacagcaagaggctggagatcatgctgcaggacatctttggagaggactgtgtgtctgtgaaggatgacagcatcctgtctgtgacagtggatggcaagacagccaacctgaacctggagaccaggacagtggagtgtgaggagggctctgaagatgatgagagcctgcgggagatggtggagctggccgcccagaggctgtatgaggccctgacccctgtgcactag

SEQ ID NO: 15225 - DNA, 1545 bp, Artificial Sequence
  Description of Artificial Sequence: Synthetic coding sequence
atgggccggcctgagagcgctgggggcggcagccggggcccctttgaaggaggcggccgggcccggcgggccggcggcatcttcctgaccctgagcatcctgcggacccgggacctgcccagcggggccatgtctgaaggagtggacctgattgacatctatgcagatgaggagttcaaccaggaccctgagttcaacaacacagaccagattgacctgtatgatgatgtgctgacagccaccagccagcccagtgatgacaggagcagcagcacagagcccccacctcctgtgcggcaggagcccagccccaagcccaacaacaagaccccagccatcctgtacacctacagcggcctgaggaacagaagagctgctgtgtatgtgggcagcttctcctggtggaccacagaccagcagctgatccaggtgatccgcagcattggagtgtatgatgtggtggagctgaagtttgctgagaacagagccaacggccagagcaagggctatgcagaggtggtggtggccagcgagaacagcgtgcacaagctgctggagctgctgcccgggaaggtgctgaatggagagaaggtggatgtgcggcctgccacccggcagaacctgagccagtttgaggcccaggccaggaagagagaatgtgtgcgggtgccccggggcggcatccccccccgggcccacagccgggacagcagtgacagcgcagatggccgggccacccccagcgagaacctggtgcccagcagcgcccgggtggacaagcccccatctgtgctgccctacttcaacagacctccttctgccctgcccctgatgggcctgcccccaccacccatccccccacctccacccctgagcagcagctttggagtgcccccacctcctcctggcatccactaccagcacctgatgcctcctccaccccggctgcccccccacctggccgtgcccccacctggggccatccccccagccctgcacctgaacccagccttcttccccccaccaaatgccaccgtgggccccccaccagacacctacatgaaggccagcgccccctacaaccaccacggcagccgggacagcggccccccacccagcacagtgtctgaggccgagtttgaggacatcatgaagaggaacagagccatcagcagcagcgccatcagcaaggctgtgtctggggccagcgctggggactacagtgatgccatcgagaccctgctgacagccatcgctgtgatcaagcagagccgggtggccaatgatgagcgctgccgggtgctgatcagcagcctgaaggactgcctgcacggcatcgaggccaagagctacagcgtgggcgccagcggcagcagcagcaggaagaggcacaggagccgggagaggagccccagccgcagccgggagagcagcagaagacaccgggacctgctgcacaatgaagatagacatgatgactacttccaggagaggaaccgggagcacgagcggcaccgggaccgggagcgggacagacaccactag

SEQ ID NO: 15226 - DNA, 1416 bp, Artificial Sequence
  Description of Artificial Sequence: Synthetic coding sequence
atgtctgagggcgtggacctgattgacatctatgcagatgaggagttcaaccaggaccctgagttcaacaacacagaccagattgacctgtatgatgatgtgctgacagccaccagccagcccagtgatgacaggagcagcagcacagagcccccacctcctgtgcggcaggagcccagccccaagcccaacaacaagaccccagccatcctgtacacctacagcggcctgaggaacagaagagctgctgtgtatgtgggcagcttctcctggtggaccacagaccagcagctgatccaggtgatccgcagcattggagtgtatgatgtggtggagctgaagtttgctgaaaatagagccaacggccagagcaagggctacgccgaggtggtggtggcctctgaaaattctgtgcacaagctgctggagctgctgcccgggaaggtgctgaatggagagaaggtggatgtgcggcctgccacccggcagaacctgagccagtttgaggcccaggccaggaagcgggagtgtgtgcgggtgccccggggcggcatccccccccgggcccacagccgggacagcagtgacagcgcagatggccgggccaccccatctgagaacctggtgcccagcagcgcccgggtggacaagccacccagcgtgctgccctacttcaaccggccccccagcgccctgcccctgatgggcctgcccccaccacccatccccccacctccacccctgagcagcagctttggagtgcccccacctcctcctggcatccactaccagcacctgatgcctcctccaccccggctgcccccccacctggccgtgcccccacctggggccatccccccagccctgcacctgaacccagccttcttccccccaccaaatgccaccgtgggccccccaccagacacctacatgaaggccagcgccccctacaaccaccacggcagccgggacagcggccccccacccagcacagtgtctgaggccgagtttgaggacatcatgaagaggaacagagccatcagcagcagcgccatcagcaaggctgtgtctggggccagcgctggggactacagtgatgccatcgagaccctgctgacagccatcgccgtcatcaagcagagccgggtggccaatgatgagcgctgccgggtgctgatcagcagcctgaaggactgcctgcatggaattgaggccaagagctacagcgtgggcgccagcggcagcagcagcaggaagaggcacaggagccgggagaggagccccagccgcagccgggagagcagccgccgccaccgggacctgctgcacaatgaagatagacatgatgactacttccaggagaggaaccgggagcacgagcggcaccgggaccgggagcgggacagacaccactag

SEQ ID NO: 15227 - DNA, 618 bp, Artificial Sequence
  Description of Artificial Sequence: Synthetic coding sequence
atgtctgagggcgtggacctgattgacatctatgcagatgaggagttcaaccaggaccctgagttcaacaacacagaccagattgacctgtatgatgatgtgctgacagccaccagccagcccagtgatgacaggagcagcagcacagagcccccacctcctgtgcggcaggagcccagccccaagcccaacaacaagaccccagccatcctgtacacctacagcggcctgaggaacagaagagctgctgtgtatgtgggcagcttctcctggtggaccacagaccagcagctgatccaggtgatccgcagcattggagtgtatgatgtggtggagctgaagtttgctgaaaatagagccaacggccagagcaagggctacgccgaggtggtggtggcctctgaaaattctgtgcacaagctgctggagctgctgcccgggaaggtgctgaatggagagaaggtggatgtgcggcctgccacccggcagaacctgagccagtttgaggcccaggccaggaagagaattcctccccgggcccacagccgggacagcagtgacagcgcagatggccgggccacccccagcgagaacctggtgcccagcagcgccaggtag

SEQ ID NO: 15228 - DNA, 1389 bp, Artificial Sequence
  Description of Artificial Sequence: Synthetic coding sequence
atgtctgagggcgtggacctgattgacatctatgcagatgaggagttcaaccaggaccctgagttcaacaacacagaccagattgacctgtatgatgatgtgctgacagccaccagccagcccagtgatgacaggagcagcagcacagagcccccacctcctgtgcggcaggagcccagccccaagcccaacaacaagaccccagccatcctgtacacctacagcggcctgaggaacagaagagctgctgtgtatgtgggcagcttctcctggtggaccacagaccagcagctgatccaggtgatccgcagcattggagtgtatgatgtggtggagctgaagtttgctgaaaatagagccaacggccagagcaagggctacgccgaggtggtggtggcctctgaaaattctgtgcacaagctgctggagctgctgcccgggaaggtgctgaatggagagaaggtggatgtgcggcctgccacccggcagaacctgagccagtttgaggcccaggccaggaagagaattcctccccgggcccacagccgggacagcagtgacagcgcagatggccgggccacccccagcgagaacctggtgcccagcagcgcccgggtggacaagcccccatctgtgctgccctacttcaacagacctccttctgccctgcccctgatgggcctgcccccaccacccatccccccacctccacccctgagcagcagctttggagtgcccccacctcctcctggcatccactaccagcacctgatgcctcctccaccccggctgcccccccacctggccgtgcccccacctggggccatccccccagccctgcacctgaacccagccttcttccccccaccaaatgccaccgtgggccccccaccagacacctacatgaaggccagcgccccctacaaccaccacggcagccgggacagcggccccccacccagcacagtgtctgaggccgagtttgaggacatcatgaagaggaacagagccatcagcagcagcgccatcagcaaggctgtgtctggggccagcgctggggactacagtgatgccatcgagaccctgctgacagccatcgctgtgatcaagcagagccgggtggccaatgatgagcgctgccgggtgctgatcagcagcctgaaggactgcctgcacggcatcgaggccaagagctacagcgtgggcgccagcggcagcagcagcaggaagaggcacaggagccgggagaggagccccagccgcagccgggagagcagcagaagacaccgggacctgctgcacaatgaagatagacatgatgactacttccaggagaggaaccgggagcacgagcggcaccgggaccgggagcgggacagacaccactag

SEQ ID NO: 15229 - DNA, 1389 bp, Artificial Sequence; identical to SEQ ID NO: 15228
  Description of Artificial Sequence: Synthetic coding sequence

SEQ ID NO: 15230 - DNA, 435 bp, Artificial Sequence
  Description of Artificial Sequence: Synthetic coding sequence
atgtctgagggcgtggacctgattgacatctatgcagatgaggagttcaaccaggaccctgagttcaacaacacagaccagattgacctgtatgatgatgtgctgacagccaccagccagcccagtgatgacaggagcagcagcacagagcccccacctcctgtgcggcaggagcccagccccaagcccaacaacaagaccccagccatcctgtacacctacagcggcctgaggaacagaagagctgctgtgtatgtgggcagcttctcctggtggaccacagaccagcagctgatccaggtgatccgcagcattggagtgtatgatgtggtggagctgaagtttgctgaaaatagagccaacggccagagcaagggctacgccgaggtggtggtggcctctgaaaattctgtgcacaagctgctggagctgtag

SEQ ID NO: 15231 - DNA, 441 bp, Artificial Sequence
  Description of Artificial Sequence: Synthetic coding sequence
atgtctgagggcgtggacctgattgacatctatgcagatgaggagttcaaccaggaccctgagttcaacaacacagaccagattgacctgtatgatgatgtgctgacagccaccagccagcccagtgatgacaggagcagcagcacagagcccccacctcctgtgcggcaggagcccagccccaagcccaacaacaagaccccagccatcctgtacacctacagcggcctgaggaacagaagagctgctgtgtatgtgggcagcttctcctggtggaccacagaccagcagctgatccaggtgatccgcagcattggagtgtatgatgtggtggagctgaagtttgctgaaaatagagccaacggccagagcaagggctacgccgaggtggtggtggcctctgaaaattctgtgcacaagctgctggagctgctgccctag

SEQ ID NO: 15232 - DNA, 867 bp, Artificial Sequence
  Description of Artificial Sequence: Synthetic coding sequence
atgtctgagggcgtggacctgattgacatctatgcagatgaggagttcaaccaggaccctgagttcaacaacacagaccagattgacctgtatgatgatgtgctgacagccaccagccagcccagtgatgacaggagcagcagcacagagcccccacctcctgtgcggcaggagcccagccccaagcccaacaacaagaccccagccatcctgtacacctacagcggcctgaggaacagaagagctgctgtgtatgtgggcagcttctcctggtggaccacagaccagcagctgatccaggtgatccgcagcattggagtgtatgatgtggtggagctgaagtttgctgaaaatagagccaacggccagagcaagggctacgccgaggtggtggtggcctctgaaaattctgtgcacaagctgctggagctgctgcccgggaaggtgctgaatggagagaaggtggatgtgcggcctgccacccggcagaacctgagccagtttgaggcccaggccaggaagagaattcctccccgggcccacagccgggacagcagtgacagcgcagatggccgggccacccccagcgagaacctggtgcccagcagcgcccgggtggacaagcccccatctgtgctgccctacttcaacagacctccttctgccctgcccctgatgggcctgcccccaccacccatccccccacctccacccctgagcagcagctttggagtgcccccacctcctcctggcatccactaccagcacctgatgcctcctccaccccggctgcccccccacctggccgtgcccccacctggggccatccccccagccctgcacctgaacccagccttcttcccctag

SEQ ID NO: 15233 - DNA, 3162 bp, Artificial Sequence
  Description of Artificial Sequence: Synthetic coding sequence
atgagcaggaggaagcaggccaagccccagcacatcaacagcgaggaggaccagggcgagcagcagccccagcagcagaccccagagtttgctgatgctgccccagctgccccagctgctggggagctgggcgcccctgtgaaccaccctggaaatgatgaggtggcctctgaagatgaggccaccgtgaagaggctgcggcgggaggagacccacgtgtgtgagaagtgctgtgccgagttcttcagcatcagcgagttcctggagcacaagaagaactgcaccaagaacccccctgtgctgatcatgaatgacagcgagggccctgtgcccagcgaggacttcagcggggctgtgctgagccaccagcccaccagccctggcagcaaggactgccacagagaaaatggaggcagcagcgaggacatgaaggagaagccagatgctgagagcgtggtgtacctgaagacagaaacagccctgccccccaccccccaggacatctcctacctggccaagggcaaggtggccaacaccaacgtgaccctgcaggccctgcggggcaccaaggtggccgtgaaccagaggtctgcagatgccctgcctgcccctgtgcctggggccaacagcatcccctgggtgctggagcagatcctgtgcctgcagcagcagcagctgcagcagatccagctgacagagcagatccgcatccaggtgaacatgtgggccagccacgccctgcacagcagcggggccggggctgacaccctgaagaccctgggcagccacatgagccagcaggtgtctgctgctgtggccctgctgagccagaaggccggcagccagggcctgagcctggatgccctgaagcaggccaagctgccccacgccaacatccccagcgccaccagcagcctgagccctggcctggcccccttcaccctgaagccagatggcaccagggtgctgcccaacgtgatgagccggctgcccagcgccctgctgccccaggcccctggctctgtgctcttccagagccccttcagcacagtggccctggacaccagcaagaagggcaagggcaagccacccaacatctctgctgtggatgtgaagcccaaggatgaagctgccctgtacaagcacaagtgcaagtactgcagcaaggtgtttggaacagacagcagcctgcagatccacctgcggagccacactggagagcggccctttgtgtgcagcgtgtgtggccaccgcttcaccaccaagggcaacctgaaggtgcacttccaccgccacccccaggtgaaggccaacccccagctgtttgctgagttccaggacaaggtggccgctggaaatggcatcccctatgccctgtctgtgcctgaccccattgatgagcccagcctgagcctggacagcaagcctgtgctggtgaccacctctgtgggcctgccccagaacctgagcagcggcaccaaccccaaggacctgactggaggcagcctgcccggggacctgcagcccggccccagccctgagagcgagggcggccccaccctgcccggggtgggccccaactacaacagccccagggctgggggcttccagggcagcggcaccccagagcccggcagcgagaccctgaagctgcagcagctggtggagaacatcgacaaggccaccacagaccccaatgaatgtctcatctgccaccgggtgctgagctgccagagcagcctgaagatgcactaccgcacccacactggagagcggcccttccagtgcaagatctgtggccgggccttcagcaccaagggcaacctgaagacccacctgggcgtgcacaggaccaacaccagcatcaagacccagcacagctgccccatctgccagaagaagttcaccaatgctgtgatgctgcagcagcacatccgcatgcacatgggcggccagatccccaacacccccctgcctgagaacccctgtgacttcaccggcagcgagcccatgacagtgggagaaaatggcagcactggagccatctgccatgatgatgtgattgagagcattgatgtggaggaggtgagcagccaggaggcccccagcagcagcagcaaggtgcccacccccctgcccagcatccacagcgccagccccaccctgggctttgccatgatggccagcctggatgcccctgggaaggtgggccctgcccccttcaacctgcagaggcagggcagccgggagaatggatctgtggagagtgatggcctgaccaatgacagcagcagcctgatgggagaccaggagtaccagagccgcagcccagacatcctggagaccaccagcttccaggccctgagccctgccaacagccaggccgagagcatcaagagcaagagcccagatgctggcagcaaggccgagagcagcgagaacagcaggacagagatggagggccgcagcagcctgcccagcaccttcatccgggccccacccacctacgtgaaggtggaggtgcccggcacctttgtgggccccagcaccctgagccctggcatgacccccctgctggccgcccagccccggcggcaggccaagcagcacggctgcacccgctgtgggaagaacttcagcagcgccagcgccctgcagatccacgagaggacccacactggagagaagccctttgtgtgcaacatctgtggccgggccttcaccaccaagggcaacctgaaggtgcactacatgacccacggggccaacaacaacagcgcccggcggggcaggaagctggccatcgagaacaccatggccctgctgggcacagatggcaagagggtgtctgagatcttccccaaggagatcctggcccccagcgtgaatgtggaccctgtggtgtggaaccagtacacctccatgctgaatggaggcctggccgtgaagaccaatgagatcagcgtcatccagagcggcggcgtgcccaccctgcctgtgtccctgggcgccacctctgtggtgaacaatgccaccgtgtccaagatggatggcagccagagcggcatctctgcagatgtggagaagcccagcgccacagatggagtgcccaagcaccagttcccccacttcctggaggagaacaagattgctgtgtcctag

SEQ ID NO: 15234 - DNA, 1038 bp, Artificial Sequence
  Description of Artificial Sequence: Synthetic coding sequence
atgtaccgcaccaaggtgggcctgaaggaccggcagcagctgtacaagctgatcatcagccagctgctgtatgatggctacatcagcatcgccaacggcctcatcaatgagatcaagccccagagcgtgtgtgcccccagcgagcagctgctgcacctgatcaagctgggcatggagaatgatgacacagctgtgcagtatgccatcggccgcagtgacacagtggcccctggcactggaattgacctggagtttgatgctgatgtgcagaccatgagccctgaggcctctgaatatgagacctgctacgtgaccagccacaagggcccctgccgggtggccacctacagcagagatggccagctgattgccactggatctgcagatgccagcatcaagatcctggacacagagaggatgctggccaagagcgccatgcccatcgaggtgatgatgaatgaaacagcccagcagaacatggagaaccaccctgtgatccgcaccctgtatgaccacgtggatgaggtgacctgcctggccttccaccccacagagcagatcctggccagcggcagccgggactacaccctgaagctgtttgactacagcaagcccagcgccaagagggccttcaagtacatccaggaggccgagatgctgcggagcatctccttccaccccagcggggacttcatcctggtgggcacccagcaccccaccctgcggctgtatgacatcaacaccttccagtgctttgtgtcctgcaacccccaggaccagcacacagatgccatctgcagcgtgaactacaacagcagcgccaacatgtatgtgacaggcagcaaggatggctgcatcaagctgtgggatggagtgagcaaccgctgcatcaccacctttgagaaggcccatgatggagctgaggtgtgcagcgccatcttcagcaagaacagcaagtacatcctgagcagcggcaaggacagcgtggccaagctgtgggagatcagcactggaagaaccctggtgcgctacacctag

SEQ ID NO: 15235 - DNA, 1257 bp, Artificial Sequence
  Description of Artificial Sequence: Synthetic coding sequence
atgtaccgcctcatcatcagccagctgctgtatgatggctacatcagcatcgccaacggcctcatcaatgagatcaagccccagagcgtgtgtgcccccagcgagcagctgctgcacctgatcaagctgggcatggagaatgatgacacagctgtgcagtatgccatcggccgcagtgacacagtggcccctggcaccggcatcgacctggagtttgatgctgatgtgcagaccatgagccctgaggcctctgaatatgagacctgctacgtgaccagccacaagggcccctgccgggtggccacctacagcagagatggccagctgattgccaccggcagcgcagatgccagcatcaagatcctggacacagagaggatgctggccaagagcgccatgcccatcgaggtgatgatgaatgaaacagcccagcagaacatggagaaccaccctgtgatccgcaccctgtatgaccacgtggatgaggtgacctgcctggccttccaccccacagagcagatcctggccagcggcagccgggactacaccctgaagctgtttgactacagcaagcccagcgccaagagggccttcaagtacatccaggaggccgagatgctgcggagcatctccttccaccccagcggggacttcatcctggtgggcacccagcaccccaccctgcggctgtatgacatcaacaccttccagtgctttgtgtcctgcaacccccaggaccagcacacagatgccatctgcagcgtgaactacaacagcagcgccaacatgtatgtgacaggcagcaaggatggctgcatcaagctgtgggatggagtgagcaaccgctgcatcaccacctttgagaaggcccatgatggagctgaggtgtgcagcgccatcttcagcaagaacagcaagtacatcctgagcagcggcaaggacagcgtggccaagctgtgggagatcagcacaggccgcaccctggtgcgctacaccggggccggcctgagcggccggcaggtgcacaggacccaggccgtgttcaaccacacagaggactatgtgctgctgcctgatgagaggaccatcagcctgtgctgctgggacagcaggacagctgagaggaggaacctgctgagcctgggccacaacaacatcgtgcgctgcatcgtgcacagccccaccaaccctggcttcatgacctgcagtgatgacttccgggcccgcttctggtacagaagaagcaccacagactag

SEQ ID NO: 15236 - DNA, 429 bp, Artificial Sequence
  Description of Artificial Sequence: Synthetic coding sequence
atgtaccgcaccaaggtgggcctgaaggaccggcagcagctgtacaagctgatcatcagccagctgctgtatgatggctacatcagcatcgccaacggcctcatcaatgagatcaagccccagagcgtgtgtgcccccagcgagcagctgctgcacctgatcaagctgggcatggagaatgatgacacagctgtgcagtatgccatcggccgcagtgacacagtggcccctggcactggaattgacctggagtttgatgctgatgtgcagaccatgagccctgaggcctctgaatatgagacctgctacgtgaccagccacaagggcccctgccgggtggccacctacagcagagatggccagctgattgccactggatctgcagatgccagcatcaagatcctggacacagagaggatgctggcctag

SEQ ID NO: 15237 - DNA, 1038 bp, Artificial Sequence; identical to SEQ ID NO: 15234
  Description of Artificial Sequence: Synthetic coding sequence

SEQ ID NO: 15238 - DNA, 1734 bp, Artificial Sequence
  Description of Artificial Sequence: Synthetic coding sequence
atggccggcctgactgtgcgggaccctgctgtggacaggagcctgcggtctgtgtttgtgggcaacatcccctatgaggccacagaggagcagctgaaggacatcttcagcgaggtgggccctgtggtgtccttccggctggtgtatgaccgggagaccgggaagcccaagggctacggcttctgtgagtaccaggaccaggagacagccctgagcgccatgaggaacctgaatggccgggagttcagcggccgggccctgcgggtggacaatgctgccagcgagaagaacaaggaggagctgaagagcctgggcaccggggcccctgtgattgagagcccctatggagagaccatcagcccagaagatgcccctgagagcatcagcaaggctgtggccagcctgcccccagagcagatgtttgagctgatgaagcagatgaagctgtgtgtgcagaacagcccccaggaggccaggaacatgctgctgcagaacccccagctggcctatgccctgctgcaggcccaggtggtgatgagaattgtggaccctgagatcgccctgaagatcctgcaccggcagaccaacatccccaccctgattgctggcaacccccagcctgtgcatggagctggccctggcagcggcagcaatgtgtccatgaaccagcagaacccccaggccccccaggcccagagcctgggcggcatgcacgtgaatggagccccacccctgatgcaggcctccatgcagggcggcgtgcctgcccctggccagatgcctgctgctgtgactggacctggccctggcagcctggcccctgggggcggcatgcaggcccaggtgggcatgcctggcagcggccctgtgtccatggagcggggccaggtgcccatgcaggacccccgggccgccatgcagaggggcagcctgcctgccaacgtgcccaccccccggggcctgctgggagatgccccaaatgacccccggggcggcaccctgctgtctgtgactggagaggtggagccccggggctacctgggccccccccaccagggcccccccatgcaccacgtgcccggccacgagagccggggccccccacctcatgagctgcggggcggccccctgcctgagccccggcccctgatggccgagccccggggccccatgctggaccagaggggcccccccctggatggccggggcggccgggacccccggggcattgatgcccggggcatggaggcccgggccatggaggcccggggcctggatgcccggggcctggaggcccgggccatggaggcccgggccatggaggcccgggccatggaggcccgggccatggaggcccgggccatggaggtgcggggcatggaggcccggggcatggacacccggggccctgtgcccggcccccggggccccatccccagcggcatgcagggccccagccccatcaacatgggcgctgtggtgccccagggcagccggcaggtgcctgtgatgcagggcaccggcatgcagggcgccagcatccagggcggcagccagcccggcggcttcagccctggccagaaccaggtgaccccccaggaccacgagaaggccgccctgatcatgcaggtgctgcagctgacagctgaccagatcgccatgctgcccccagagcagaggcagagcatcctgatcctgaaggagcagatccagaagagcactggagccccctag

SEQ ID NO: 15239 - DNA, 1662 bp, Artificial Sequence
  Description of Artificial Sequence: Synthetic coding sequence
atggccggcctgactgtgcgggaccctgctgtggacaggagcctgcggtctgtgtttgtgggcaacatcccctatgaggccacagaggagcagctgaaggacatcttcagcgaggtgggccctgtggtgtccttccggctggtgtatgaccgggagaccgggaagcccaagggctacggcttctgtgagtaccaggaccaggagacagccctgagcgccatgaggaacctgaatggccgggagttcagcggccgggccctgcgggtggacaatgctgccagcgagaagaacaaggaggagctgaagagcctgggcaccggggcccctgtgattgagagcccctatggagagaccatcagcccagaagatgcccctgagagcatcagcaaggctgtggccagcctgcccccagagcagatgtttgagctgatgaagcagatgaagctgtgtgtgcagaacagcccccaggaggccaggaacatgctgctgcagaacccccagctggcctatgccctgctgcaggcccaggtggtgatgagaattgtggaccctgagatcgccctgaagatcctgcaccggcagaccaacatccccaccctgattgctggcaacccccaggcccagagcctgggcggcatgcacgtgaatggagccccacccctgatgcaggcctccatgcagggcggcgtgcctgcccctggccagatgcctgctgctgtgactggacctggccctggcagcctggcccctgggggcggcatgcaggcccaggtgggcatgcctggcagcggccctgtgtccatggagcggggccaggtgcccatgcaggacccccgggccgccatgcagaggggcagcctgcctgccaacgtgcccaccccccggggcctgctgggagatgccccaaatgacccccggggcggcaccctgctgtctgtgactggagaggtggagccccggggctacctgggccccccccaccagggcccccccatgcaccacgtgcccggccacgagagccggggccccccacctcatgagctgcggggcggccccctgcctgagccccggcccctgatggccgagccccggggccccatgctggaccagaggggcccccccctggatggccggggcggccgggacccccggggcattgatgcccggggcatggaggcccgggccatggaggcccggggcctggatgcccggggcctggaggcccgggccatggaggcccgggccatggaggcccgggccatggaggcccgggccatggaggcccgggccatggaggtgcggggcatggaggcccggggcatggacacccggggccctgtgcccggcccccggggccccatccccagcggcatgcagggccccagccccatcaacatgggcgctgtggtgccccagggcagccggcaggtgcctgtgatgcagggcaccggcatgcagggcgccagcatccagggcggcagccagcccggcggcttcagccctggccagaaccaggtgaccccccaggaccacgagaaggccgccctgatcatgcaggtgctgcagctgacagctgaccagatcgccatgctgcccccagagcagaggcagagcatcctgatcctgaaggagcagatccagaagagcactggagccccctag

SEQ ID NO: 15240 - DNA, 2154 bp, Artificial Sequence
  Description of Artificial Sequence: Synthetic coding sequence
atgtctggagatggagccacagagcaggccgcagaatatgtgcctgagaaggtgaagaaggccgagaagaagctggaggagaacccctatgacctggatgcctggagcatcctgatccgggaggcccagaaccagcccatcgacaaggccaggaagacctatgaaaggctggtggcccagttccccagcagcggccgcttctggaagctgtacatcgaggccgagatcaaggccaagaactatgacaaggtggagaagctgttccagcgctgcctgatgaaggtgctgcacatcgacctgtggaagtgctacctgtcctatgtgcgggagaccaagggcaagctgcccagctacaaggagaagatggcccaggcctatgactttgccctggacaagattggcatggagatcatgagctaccagatctgggtggactacatcaacttcctgaagggcgtggaggccgtgggcagctatgcagagaaccagaggatcacagctgtgagaagagtgtaccagaggggctgtgtgaaccccatgatcaacatcgagcagctgtggagggactacaacaagtatgaggagggcatcaacatccacctggccaagaagatgattgaagatagaagccgggactacatgaatgccaggagagtggccaaggagtatgaaacagtgatgaagggcctggacagaaatgcccccagcgtgcccccccagaacaccccccaggaggcccagcaggtggacatgtggaagaagtacatccagtgggagaagagcaaccccctgaggacagaggaccagaccctcatcaccaagagggtgatgtttgcctatgagcagtgcctgctggtgctgggccaccacccagacatctggtatgaagctgcccagtacctggagcagagcagcaagctgctggccgagaagggggacatgaacaatgccaagctgttcagtgatgaggccgccaacatctatgaaagagccatcagcaccctgctgaagaagaacatgctgctgtactttgcctatgctgactatgaggagagcaggatgaagtatgagaaggtgcacagcatctacaaccggctgctggccatcgaggacatcgaccccaccctggtgtacatccagtacatgaagtttgcccggcgggcagagggcatcaagagcggccgcatgatcttcaagaaggcccgggaggacaccaggaccaggcaccacgtgtatgtgacagctgccctgatggagtactactgcagcaaggacaagtctgtggccttcaagatctttgagctgggcctgaagaagtacggggacatcccagaatatgtgctggcctacatcgactacctgagccacctgaatgaagacaacaacaccagggtgctgtttgagcgggtgctgaccagcggcagcctgcccccagagaagtctggagagatctgggcccgcttcctggcctttgagagcaacattggagacctggccagcatcctgaaggtggagaagaggcgcttcaccgccttcaaggaggagtatgagggcaaggagacagccctgctggtggaccgctacaagttcatggacctgtacccctgcagcgccagcgagctgaaggccctgggctacaaggatgtgtcccgggccaagctggccgccatcatcccagaccctgtggtggcccccagcatcgtgcctgtgctgaaggatgaggtggacaggaagccagagtaccccaagccagacacccagcagatgatccccttccagcccaggcacctggcccctcctggcctgcaccctgtgcctgggggcgtcttccctgtgcccccagctgctgtggtgctgatgaagctgctgcccccacccatctgcttccagggcccctttgtgcaggtggatgagctgatggagatcttccgccgctgcaagatccccaacacagtggaggaggccgtgcgcatcatcaccggcggggcccctgagctggccgtggagggcaatggacctgtggagagcaatgctgtgctgaccaaggctgtgaagaggcccaatgaagattctgatgaagatgaggagaagggagctgtggtgccccctgtgcatgacatctaccgggcccggcagcagaagaggatcagatag

SEQ ID NO: 15241 - DNA, 135 bp, Artificial Sequence
  Description of Artificial Sequence: Synthetic coding sequence
atgtctggagatggagccacagagcaggccgcagaatatgtgcctgagaaggtgaagaaggccgagaagaagctggaggagaacccctatgacctggatgcctggagcatcctgatccgggaggcccaggtgtag

SEQ ID NO: 15242 - DNA, 312 bp, Artificial Sequence
  Description of Artificial Sequence: Synthetic coding sequence
atgtctggagatggagccacagagcaggccgcagaatatgtgcctgagaaggtgaagaaggccgagaagaagctggaggagaacccctatgacctggatgcctggagcatcctgatccgggaggcccagaaccagcccatcgacaaggccaggaagacctatgaaaggctggtggcccagttccccagcagcggccgcttctggaagctgtacatcgaggccgaggtgaccatcctcttctacttcttcctgtaccagtactgcagcatccactgcagcgacaggaagcaggtgagaaatattgccaactag

SEQ ID NO: 15243 - DNA, 186 bp, Artificial Sequence
  Description of Artificial Sequence: Synthetic coding sequence
atgtctggagatggagccacagagcaggccgcagaatatgtgcctgagaaggtgaagaaggccgagaagaagctggaggagaacccctatgacctggatgcctggagcatcctgatccgggaggcccagaaccagcccatcgacaaggccaggaagacctatgaaaggctggtggcccagttctag

SEQ ID NO: 15244 - DNA, 1953 bp, Artificial Sequence
  Description of Artificial Sequence: Synthetic coding sequence
atgaccctgatgctgggcgcccagatcaaggccaagaactatgacaaggtggagaagctgttccagcgctgcctgatgaaggtgctgcacatcgacctgtggaagtgctacctgtcctatgtgcgggagaccaagggcaagctgcccagctacaaggagaagatggcccaggcctatgactttgccctggacaagattggcatggagatcatgagctaccagatctgggtggactacatcaacttcctgaagggcgtggaggccgtgggcagctatgcagagaaccagaggatcacagctgtgcggcgggtgtaccagaggggctgtgtgaaccccatgatcaacatcgagcagctgtggagggactacaacaagtatgaggagggcatcaacatccacctggccaagaagatgattgaggacaggagccgggactacatgaatgcccggcgggtggccaaggagtatgagaccgtgatgaagggcctggacagaaatgcccccagcgtgcccccccagaacaccccccaggaggcccagcaggtggacatgtggaagaagtacatccagtgggagaagagcaaccccctgaggacagaggaccagaccctcatcaccaagagggtgatgtttgcctatgagcagtgcctgctggtgctgggccaccacccagacatctggtatgaggccgcccagtacctggagcagagcagcaagctgctggccgagaagggggacatgaacaatgccaagctgttcagtgatgaagctgccaacatctatgagcgggccatcagcaccctgctgaagaagaacatgctgctgtactttgcctatgctgactatgaggagagcaggatgaagtatgagaaggtgcacagcatctacaaccggctgctggccattgaagatattgaccccaccctggtgtacatccagtacatgaagtttgccaggagagctgagggcatcaagagcggccgcatgatcttcaagaaggcccgggaggacaccaggaccaggcaccacgtgtatgtgacagctgccctgatggagtactactgcagcaaggacaagtctgtggccttcaagatctttgagctgggcctgaagaagtatggagacatcccagaatatgtgctggcctacatcgactacctgagccacctgaatgaagacaacaacaccagggtgctgtttgagcgggtgctgaccagcggcagcctgcccccagagaagagcggggagatctgggcccgcttcctggcctttgagagcaacatcggggacctggccagcatcctgaaggtggagaagaggcgcttcaccgccttcaaggaggagtatgagggcaaggagacagccctgctggtggaccgctacaagttcatggacctgtacccctgcagcgccagcgagctgaaggccctgggctacaaggatgtgtcccgggccaagctggccgccatcatcccagaccctgtggtggcccccagcatcgtgcctgtgctgaaggatgaggtggacaggaagccagagtaccccaagccagacacccagcagatgatccccttccagcccaggcacctggcccctcctggcctgcaccctgtgcctggaggagtcttccctgtgcccccagctgctgtggtgctgatgaagctgctgcccccacccatctgcttccagggcccctttgtgcaggtggatgagctgatggagatcttccgccgctgcaagatccccaacacagtggaggaggccgtgcgcatcatcactggaggagcccctgagctggccgtggagggcaatggacctgtggagagcaatgctgtgctgaccaaggctgtgaagaggcccaatgaagattctgatgaagatgaggagaagggagctgtggtgccccctgtgcatgacatctaccgggcccggcagcagaagaggatcagatag

SEQ ID NO: 15245 - DNA, 1740 bp, Artificial Sequence
  Description of Artificial Sequence: Synthetic coding sequence
atgctgcggagcggccctgccagcggccccagcgtgcccaccggccgggccatgcccagcagaagagtggcccggcccccagctgcccctgagctgggcgccctgggcagcccagacctgagcagcctgagcctggccgtgagccgcagcacagatgagctggagatcattgatgagtacatcaaggaaaatggcttcggcctggatggcggccagcccggccctggagagggcctgccccggctggtgtccagaggagctgccagcctgagcacagtgaccctgggccctgtggcccccccagccaccccaccaccctggggctgccccctgggccgcctggtgtccccagcccctggccctggcccccagccccacctggtgatcacagagcagcccaagcagaggggcatgaggttccgctatgaatgtgagggccgctctgctggcagcatcctgggggagagcagcacagaggccagcaagaccctgcctgccatcgagctgcgggactgtggcggcctgcgggaggtggaggtgacagcctgcctggtgtggaaggactggccccaccgggtgcacccccacagcctggtgggcaaggactgcacagatggcatctgccgggtgcggctgcggccccacgtgagccccaggcacagcttcaacaacctgggcatccagtgtgtgaggaagaaggagattgaagctgccattgaaaggaagatccagctgggcatcgacccctacaatgccggcagcctgaagaaccaccaggaggtggacatgaatgtggtgcgcatctgcttccaggccagctacagagaccagcagggccagatgaggaggatggaccctgtgctgtctgagcctgtgtatgacaagaagagcaccaacaccagcgagctgcgcatctgccgcatcaacaaggagagcggcccctgcaccggcggggaggagctgtacctgctgtgtgacaaggtgcagaaggaggacatctctgtggtgttcagccgggcctcctgggagggccgggctgacttcagccaggctgatgtgcaccggcagatcgccatcgtgttcaagaccccaccctatgaggacctggagatcgtggagcctgtgacagtgaatgtgttcctgcagaggctgacagatggagtgtgcagcgagcccctgcccttcacctacctgccccgggaccatgacagctatggagtggacaagaagaggaagaggggcatgccagatgtgctgggggagctgaacagcagtgacccccacggcatcgagagcaagaggaggaagaagaagccagccatcctggaccacttcctgcccaaccacggcagcggccccttcctgccccccagcgccctgctgcctgaccctgacttcttcagcggcaccgtgtccctgcccggcctggagcccccaggcggccctgacctgctggatgatggctttgcctatgaccccacagcccccaccctcttcaccatgctggacctgctgcccccagcccctcctcatgccagcgctgtggtgtgcagcggcggggccggggctgtggtgggggagaccccaggccctgagcccctgaccctggacagctaccaggcccctggccctggagatggcggcacagccagcctggtgggcagcaacatgttccccaaccactaccgggaggccgcctttggaggcggcctgctgagccctggccctgaggccacctag

SEQ ID NO: 15246 - DNA, 1785 bp, Artificial Sequence
  Description of Artificial Sequence: Synthetic coding sequence
atgtggcatgaggccaggaagcatgagaggaagctgcggggcatgatggtggactacaagaagagagctgagcggcggcgggagtactatgagaagatcaagaaggaccctgcccagttcctgcaggtgcacggccgggcctgcaaggtgcacctggacagcgctgtggccctggccgctgagagccctgtgaacatgatgccctggcagggcgacaccaacaacatgattgacagatttgatgtgcgggcccacctggaccacatcccagactacaccccacccctgctgaccaccatcagccctgagcaggagagtgatgagaggaagtgcaactatgagcgctaccggggcctggtgcagaatgactttgctggcatcagcgaggagcagtgcctgtaccagatctacattgatgagctgtatggaggcctgcagaggccttctgaagatgagaagaagaagctggccgagaagaaggccagcatcggctacacctatgaggacagcacagtggccaaggtggagaaggctgctgagaagccagaggaggaggagagcgctgctgaggaggagagcaacagtgatgaagatgaggtgatcccagacattgatgtggaggtggatgtggatgagctgaaccaggagcaggtggccgacctgaacaagcaggccaccacctacggcatggctgatggagactttgtgaggatgctgaggaaggacaaggaggaggccgaggccatcaagcacgccaaggccctggaggaggagaaggccatgtacagcggcagaagaagccggcggcagaggcgggagttccgggagaagaggctgcggggcaggaagatcagcccccccagctatgcccggcgggacagccccacctatgacccctacaagaggagccccagcgagagcagcagcgagagccgcagccgcagccgcagccccaccccaggccgggaggagaagatcaccttcatcaccagctttggaggcagtgatgaggaggccgctgctgctgctgctgctgctgctgccagcggcgtgaccaccgggaagcccccagccccaccccagcccggcggccctgcccctggaagaaatgccagcgccaggagaagaagcagcagcagcagcagcagcagcagcgccagcaggaccagcagcagccgcagcagcagccgcagcagcagccgcagcagaagaggaggcggctactacagaagtggaagacatgcccggagccgcagccgctcctggagccgcagccgcagccgcagccgccgctacagccgcagccgcagccggggccgccgccacagcggcggcggcagcagagatggccaccgctacagccgcagccctgccaggagaggaggctacggccccaggagaagaagccgcagccgcagccacagcggggaccgctaccgccggggcggccggggcctgcggcaccacagcagcagccgcagccgcagctcctggagcctgagccccagccgcagccgcagcctgaccaggagccgcagccacagccccagccccagccagagccgcagccgcagccgcagccgcagccagagccccagccccagccctgcccgggagaagctgaccaggcctgctgccagccctgctgtgggggagaagctgaagaagacagagcctgctgctgggaaggagactggagctgccaaggtgacccaggctgatgccagcggggaggccgagacagaagatgctgagggcgctgagcaggccgtgcagggcggctag

SEQ ID NO: 15247 - DNA, 1839 bp, Artificial Sequence
  Description of Artificial Sequence: Synthetic coding sequence
atgtggcatgaggccaggaagcatgagaggaagctgcggggcatgatggtggactacaagaagagagctgagcggcggcgggagtactatgagaagatcaagaaggaccctgcccagttcctgcaggagagtgatgagaggaagtgcaactatgagcgctaccggggcctggtgcagaatgactttgctggcatcagcgaggagcagtgcctgtaccagatctacattgatgagctgtatggaggcctgcagaggccttctgaagatgagaagaagaagctggccgagaagaaggccagcatcggctacacctatgaggacagcacagtggccaaggtggagaaggctgctgagaagccagaggaggaggagagcgctgctgaggaggagagcaacagtgatgaagatgaggtgatcccagacattgatgtggaggtggatgtggatgagctgaaccaggagcaggtggccgacctgaacaagcaggccaccacctacggcatggctgatggagactttgtgaggatgctgaggaaggacaaggaggaggccgaggccatcaagcacgccaaggccctggaggaggagaaggccatgtacagcggcagaagaagccggcggcagaggcgggagttccgggagaagaggctgcggggcaggaagatcagcccccccagctatgcccggcgggacagccccacctatgacccctacaagaggagccccagcgagagcagcagcgagagccgcagccgcagccgcagccccaccccaggccgggaggagaagatcaccttcatcaccagctttggaggcagtgatgaggaggccgctgctgctgctgctgctgctgctgccagcggcgtgaccaccgggaagcccccagccccaccccagcccggcggccctgcccctggaagaaatgccagcgccaggagaagaagcagcagcagcagcagcagcagcagcgccagcaggaccagcagcagccgcagcagcagccgcagcagcagccgcagcagaagaggaggcggctactacagaagtggaagacatgcccggagccgcagccgctcctggagccgcagccgcagccgcagccgccgctacagccgcagccgcagccggggccgccgccacagcggcggcggcagcagagatggccaccgctacagccgcagccctgccaggagaggaggctacggccccaggagaagaagccgcagccgcagccacagcggggaccgctaccgccggggcggccggggcctgcggcaccacagcagcagccgcagccgcagctcctggagcctgagccccagccgcagccgcagcctgaccaggagccgcagccacagccccagccccagccagagccgcagccgcagccgcagccgcagccagagccccagccccagccctgcccgggagaagctgaccaggcctgctgccagccctgctgtgggggagaagctgaagaagacagagcctgctgctgggaaggagactggagctgccaagcccaagctgaccccccaggagaagctgaagctgaggatgcagaaggccctgaaccggcagttcaaggctgacaagaaggccgcccaggagaagatgatccagcaggagcacgagcggcaggagcgggaggatgagctgcgggccatggccaggaagatccgcatgaaggagcgggagcggcgggagaaggagcgggaggagtgggagcggcagtacagccggcagagccgcagccccagcccccgctacagccgggagtacagcagcagcagaagaagaagccgcagccgcagccgcagcccccactaccgccactag

SEQ ID NO: 15248 - DNA, 1968 bp, Artificial Sequence
  Description of Artificial Sequence: Synthetic coding sequence
atgtggcatgaggccaggaagcatgagaggaagctgcggggcatgatggtggactacaagaagagagctgagcggcggcgggagtactatgagaagatcaagaaggaccctgcccagttcctgcaggtgcacggccgggcctgcaaggtgcacctggacagcgctgtggccctggccgctgagagccctgtgaacatgatgccctggcagggcgacaccaacaacatgattgacagatttgatgtgcgggcccacctggaccacatcccagactacaccccacccctgctgaccaccatcagccctgagcaggagagtgatgagaggaagtgcaactatgagcgctaccggggcctggtgcagaatgactttgctggcatcagcgaggagcagtgcctgtaccagatctacattgatgagctgtatggaggcctgcagaggccttctgaagatgagaagaagaagctggccgagaagaaggccagcatcggctacacctatgaggacagcacagtggccaaggtggagaaggctgctgagaagccagaggaggaggagagcgctgctgaggaggagagcaacagtgatgaagatgaggtgatcccagacattgatgtggaggtggatgtggatgagctgaaccaggagcaggtggccgacctgaacaagcaggccaccacctacggcatggctgatggagactttgtgaggatgctgaggaaggacaaggaggaggccgaggccatcaagcacgccaaggccctggaggaggagaaggccatgtacagcggcagaagaagccggcggcagaggcgggagttccgggagaagaggctgcggggcaggaagatcagcccccccagctatgcccggcgggacagccccacctatgacccctacaagaggagccccagcgagagcagcagcgagagccgcagccgcagccgcagccccaccccaggccgggaggagaagatcaccttcatcaccagctttggaggcagtgatgaggaggccgctgctgctgctgctgctgctgctgccagcggcgtgaccaccgggaagcccccagccccaccccagcccggcggccctgcccctggaagaaatgccagcgccaggagaagaagcagcagcagcagcagcagcagcagcgccagcaggaccagcagcagccgcagcagcagccgcagcagcagccgcagcagaagaggaggcggctactacagaagtggaagacatgcccggagccgcagccgctcctggagccgcagccgcagccgcagccgccgctacagccgcagccgcagccggggccgccgccacagcggcggcggcagcagagatggccaccgctacagccgcagccctgccaggagaggaggctacggccccaggagaagaagccgcagccgcagccacagcggggaccgctaccgccggggcggccggggcctgcggcaccacagcagcagccgcagccgcagctcctggagcctgagccccagccgcagccgcagcctgaccaggagccgcagccacagccccagccccagccagagccgcagccgcagccgcagccgcagccagagccccagccccagccctgcccgggagaagctgaccaggcctgctgccagccctgctgtgggggagaagctgaagaagacagagcctgctgctgggaaggagactggagctgccaaggtgatcaaggctgacaagaaggccgcccaggagaagatgatccagcaggagcacgagcggcaggagagagaagatgagctgcgggccatggccaggaagatccgcatgaaggagcgggagcggcgggagaaggagcgggaggagtgggagcggcagtacagccggcagagccgcagccccagcccccgctacagccgggagtacagcagcagcagaagaagaagccgcagccgcagccgcagcccccactaccgccactag

SEQ ID NO: 15249 - DNA, 1242 bp, Artificial Sequence
  Description of Artificial Sequence: Synthetic coding sequence
atgtccttccgggacctgaggaacttcacagagatgatgagggccctgggctaccccaggcacatctccatggagaacttccgcacccccaactttggcctggtgtctgaggtgctgctgtggctggtgaagagatatgagccccagacagacatccccccagatgtggacacagagcaggacagagtcttcttcatcaaggccatcgcccagttcatggccaccaaggcccacatcaagctgaacaccaagaagctgtaccaggctgatggctatgctgtgaaggagctgctgaagatcacctctgtgctgtacaatgccatgaagaccaagggcatggagggcagcgagatcgtggaggaggatgtgaacaagttcaagtttgacctgggcagcaagattgctgacctgaaggccgcccggcagctggccagcgagatcaccagcaagggggccagcctgtatgacctgctgggcatggaggtggagctgcgggagatgaggacagaggccatcgcccggcccctggagatcaatgaaacagagaaggtgatgagaattgccatcaaggagatcctgacccaggtgcagaagaccaaggacctgctgaacaacgtggccagtgatgaggccaacctggaggccaagattgagaagaggaagctggagctggagaggaacaggaagaggctggagaccctgcagagcgtgcggccctgcttcatggatgaatatgagaagacagaggaggagctgcagaagcagtatgacacctacctggagaagttccagaacctgacctacctggagcagcagctggaggaccaccacaggatggagcaggagagatttgaggaggccaagaacaccctgtgcctgatccagaacaagctgaaggaggaggagaagaggctgctgaagagcggcagcaatgatgacagcgacatcgacatccaggaggatgatgaaagtgacagcgagctggaggagcggcggctgcccaagccccagacagccatggagatgctgatgcagggccggcctgggaagagaattgtgggcaccatgcagggcggggacagtgatgacaatgaagattctgaggagagcgagattgacatggaggatgatgatgatgaagatgatgacctggaggatgagagcatcagcctgagccccaccaagcccaacagaagagtgaggaagtctgagcccctggatgaaagtgacaatgacttctag

SEQ ID NO: 15250 - DNA, 744 bp, Artificial Sequence
  Description of Artificial Sequence: Synthetic coding sequence
atgaggacagaggccatcgcccggcccctggagatcaatgaaacagagaaggtgatgagaattgccatcaaggagatcctgacccaggtgcagaagaccaaggacctgctgaacaacgtggccagtgatgaggccaacctggaggccaagattgagaagaggaagctggagctggagaggaacaggaagaggctggagaccctgcagagcgtgcggccctgcttcatggatgaatatgagaagacagaggaggagctgcagaagcagtatgacacctacctggagaagttccagaacctgacctacctggagcagcagctggaggaccaccacaggatggagcaggagagatttgaggaggccaagaacaccctgtgcctgatccagaacaagctgaaggaggaggagaagaggctgctgaagagcggcagcaatgatgacagcgacatcgacatccaggaggatgatgaaagtgacagcgagctggaggagcggcggctgcccaagccccagacagccatggagatgctgatgcagggccggcctgggaagagaattgtgggcaccatgcagggcggggacagtgatgacaatgaagattctgaggagagcgagattgacatggaggatgatgatgatgaagatgatgacctggaggatgagagcatcagcctgagccccaccaagcccaacagaagagtgaggaagtctgagcccctggatgaaagtgacaatgacttctag

SEQ ID NO: 15251 - DNA, 576 bp, Artificial Sequence
  Description of Artificial Sequence: Synthetic coding sequence
atggatgaatatgagaagacagaggaggagctgcagaagcagtatgacacctacctggagaagttccagaacctgacctacctggagcagcagctggaggaccaccacaggatggagcaggagagatttgaggaggccaagaacaccctgtgcctgatccagaacaagctgaaggaggaggagaagaggctgctgaagagcggcagcaatgatgacagcgacatcgacatccaggaggatgatgaaagtgacagcgagctggaggagcggcggctgcccaagccccagacagccatggagatgctgatgcagggccggcctgggaagagaattgtgggcaccatgcagggcggggacagtgatgacaacatggaggccgccccagccctgctgggcaagtgcaagaccagcagcagcaagaagcaggaggacagcgaggagagcgagattgacatggaggatgatgatgatgaagatgatgacctggaggatgagagcatcagcctgagccccaccaagcccaacagaagagtgaggaagtctgagcccctggatgaaagtgacaatgacttctag

SEQ ID NO: 15252 - DNA, 1242 bp, Artificial Sequence; identical to SEQ ID NO: 15249
  Description of Artificial Sequence: Synthetic coding sequence

SEQ ID NO: 15253 - DNA, 1116 bp, Artificial Sequence
  Description of Artificial Sequence: Synthetic coding sequence
atggctgctgctgctgctggcctgggcggcggcggggccggccctggccctgaggccggggacttcctggcccgctaccgcctggtgagcaacaagctgaagaagcgcttcctgaggaagcccaacgtggccgaggccggggagcagtttggccagctgggccgggagctgcgggcccaggagtgcctgccctatgctgcctggtgccagctggccgtggcccgctgccagcaggccctcttccacggccctggagaggccctggccctgacagaagctgcccggctcttcctgcggcaggagagagatgcccggcagaggctggtgtgcccagctgcctacggggagcccctgcaggccgccgccagcgccctgggcgctgctgtgcggctgcacctggagctgggccagcctgctgctgctgctgccctgtgcctggagctggccgccgccctgcgggacctgggccagcctgctgctgctgctggccacttccagagagctgcccagctgcagctgccccagctgcccctggccgccctgcaggccctgggggaggccgccagctgccagctgctggcccgggactacaccggggccctggccgtgttcaccaggatgcagaggctggcccgggagcacggcagccaccctgtgcagagcctgcccccacctcctcctccagccccccagcccggccctggggccaccccagccctgcctgctgccctgctgccccccaacagcggcagcgctgcccccagccctgctgccctgggcgccttcagtgatgtgctggtgcgctgtgaggtgtcccgggtgctgctgctgctgctgctgcagcccccaccagccaagctgctgcctgagcacgcccagaccctggagaagtacagctgggaggcctttgacagccacggccaggagagcagcggccagctgcctgaggagctgttcctgctgctgcagagcctggtgatggccacccatgagaaggacacagaggccatcaagagcctgcaggtggagatgtggcccctgctgacagctgagcagaaccacctgctgcacctggtgctgcaggagaccatcagccccagcggccagggcgtgtag

SEQ ID NO: 15254 - DNA, 1116 bp, Artificial Sequence; identical to SEQ ID NO: 15253
  Description of Artificial Sequence: Synthetic coding sequence

SEQ ID NO: 15255 - DNA, 1116 bp, Artificial Sequence; identical to SEQ ID NO: 15253
  Description of Artificial Sequence: Synthetic coding sequence

SEQ ID NO: 15256 - DNA, 2502 bp, Artificial Sequence
  Description of Artificial Sequence: Synthetic coding sequence
atgagccctgagaagcagcaccgggaggaggatgaggtggacagcgtgctgctgagcgccagcaagatcctgaacagcagcgagggcgtgaaggagagcggctgcagcgacacagaatatggctgcatcgccgagagcgagaaccagatccagccccagagcgccctgaaggtgctgcagcagcagctggagagcttccaggccctgaggatgcagaccctgcagaatgtgtccatggtgcagagcgagatcagcgagatcctgaacaagagcatcatcgaggtggagaacccccagttcagcagcgagaagaacctggtgtttggcacccgcatcgagaaggacctgcccacagagaaccaggaggagaacctgtccatggagaagagccaccactttgaggacagcaagaccctgcacagcgtggaggagaagctgagcggggacagcgtgaacagcctgccccagagcgtgaatgtgcccagccagatccacagcgaggacaccctgaccctgcggaccagcacagacaacctgagcagcaacatcatcatccaccccagtgaaaattctgacatcctgaagaactacaacaacttctaccgcttcctgcccacagccccacccaacgtgatgagccaggccgacaccgtcatcctggacaagagcaagatcaccgtgcccttcctgaagcacggcttctgtgagaacctggatgacatctgccacagcatcaagcagatgaaggaggagctgcagaagagccatgatggagaggtggccctgaccaatgagctgcagaccctgcagacagatcctgatgtgcacagaaatggcaagtatgacatgagccccatccaccaggacaagatgaacttcatcaaggaggagaacctggatggcaacctgaatgaagacatcaagagcaagaggatcagcgagctggaggccctggtgaagaagctgctgcccttccgggagaccgtgtccaagttccacgtgcacttctgcaggaagtgcaagaagctgagcaagtctgagatgcaccggggcaagaagaatgagaagaacaacaaggagatccccatcaccgggaagaacatcacagacctgaagttccacagccgggtgccccgctacaccctgtccttcctggaccagaccaagcatgagatgaaggacaaggagcggcagcccttcctggtgaagcagggcagcatcatcagtgaaaatgagaagaccagcaaggtgaacagcgtgacagagcagtgtgtggccaagatccagtacctgcagaactacctgaaggagagcgtgcagatccagaagaaggtgatggagctggagagcgagaacctgaacctgaagagcaagatgaagcccctcatcttcaccacccagagcctcatccagaaggtggagacctatgagaagcagctgaagaacctggtggaggagaagagcaccatccagagcaagctgagcaagacagaggagtacagcaaagaatgtctgaaggagttcaagaagatcatcagcaagtacaacgtgctgcagggccagaacaagaccctggaggagaagaacatccagctgagcctggagaagcagcagatgatggaggccctggaccagctgaagagcaaggagcacaagacccagagcgacatggccatcgtgaacaatgaaaacaacaggatgagcattgagatggaggccatgaagaccaacatcctgctgatccaggatgagaaggagatgctggagaagaagacccaccagctgctgaaggagaagagcagcctgggcaatgagctgaaggagagccagctggagatcatccagctgaaggagaaggagcggctggccaagacagagcaggagaccctgctgcagatcatcgagaccgtgaaggatgagaagctgaacctggagaccaccctgcaggagagcacagctgcccggcagatcatggagcgggagattgagaacatccagacctaccagagcacagctgaggagaacttcctgcaggagatcaagaatgccaagtctgaggccagcatctacaagaacagcctgtctgaaattggcaaggaatgtgagatgctgagcaagatggtgatggagaccaagacagacaaccagatcctgaaggaggagctgaagaagcacagccaggagaacatcaagtttgaaaattccatcagccggctgacagaggacaagatcctgctggagaactacgtgcgcagcattgaaaatgaaagagacaccctggagtttgagatgaggcacctgcagcgggagtacctgagcctgagtgacaagatctgcaaccagcacaatgaccccagcaagaccacctacatcagcagaagagagaagttccactttgacaactacacccatgaggacaccagcagcccccagagccggcccctggccagtgacctgaagggctacttcaaggtgaaggacaggaccctgaagcaccactag

SEQ ID NO: 15257 - DNA, 2391 bp, Artificial Sequence
  Description of Artificial Sequence: Synthetic coding sequence
atgagccctgagaagcagcaccgggaggaggatgaggtggacagcgtgctgctgagcgccagcaagatcctgaacagcagcgagggcgtgaaggagagcggctgcagcgacacagaatatggctgcatcgccgagagcgagaaccagatccagccccagagcgccctgaaggtgctgcagcagcagctggagagcttccaggccctgaggatgcagaccctgcagaatgtgtccatgcccacagagaaccaggaggagaacctgtccatggagaagagccaccactttgaggacagcaagaccctgcacagcgtggaggagaagctgagcggggacagcgtgaacagcctgccccagagcgtgaatgtgcccagccagatccacagcgaggacaccctgaccctgcggaccagcacagacaacctgagcagcaacatcatcatccaccccagcgagaacagcgacatcctgaagaactacaacaacttctaccgcttcctgcccacagcccccccaaatgtgatgagccaggccgacaccgtcatcctggacaagagcaagatcaccgtgcccttcctgaagcacggcttctgtgagaacctggatgacatctgccacagcatcaagcagatgaaggaggagctgcagaagagccatgatggagaggtggccctgaccaatgagctgcagaccctgcagacagatcctgatgtgcacagaaatggcaagtatgacatgagccccatccaccaggacaagatgaacttcatcaaggaggagaacctggatggcaacctgaatgaagacatcaagagcaagaggatcagcgagctggaggccctggtgaagaagctgctgcccttccgggagaccgtgtccaagttccacgtgcacttctgcaggaagtgcaagaagctgagcaagtctgagatgcaccggggcaagaagaatgagaagaacaacaaggagatccccatcaccgggaagaacatcacagacctgaagttccacagccgggtgccccgctacaccctgtccttcctggaccagaccaagcatgagatgaaggacaaggagcggcagcccttcctggtgaagcagggcagcatcatcagtgaaaatgagaagaccagcaaggtgaacagcgtgacagagcagtgtgtggccaagatccagtacctgcagaactacctgaaggagagcgtgcagatccagaagaaggtgatggagctggagagcgagaacctgaacctgaagagcaagatgaagcccctcatcttcaccacccagagcctcatccagaaggtggagacctatgagaagcagctgaagaacctggtggaggagaagagcaccatccagagcaagctgagcaagacagaggagtacagcaaggagtgcctgaaggagttcaagaagatcatcagcaagtacaacgtgctgcagggccagaacaagaccctggaggagaagaacatccagctgagcctggagaagcagcagatgatggaggccctggaccagctgaagagcaaggagcacaagacccagagcgacatggccatcgtgaacaatgaaaacaacaggatgagcattgagatggaggccatgaagaccaacatcctgctgatccaggatgagaaggagatgctggagaagaagacccaccagctgctgaaggagaagagcagcctgggcaatgagctgaaggagagccagctggagatcatccagctgaaggagaaggagcggctggccaagacagagcaggagaccctgctgcagatcattgaaacagtgaaggatgagaagctgaacctggagaccaccctgcaggagagcacagctgcccggcagatcatggagcgggagattgagaacatccagacctaccagagcacagctgaggagaacttcctgcaggagatcaagaatgccaagtctgaggccagcatctacaagaacagcctgtctgagatcggcaaggaatgtgagatgctgagcaagatggtgatggagaccaagacagacaaccagatcctgaaggaggagctgaagaagcacagccaggagaacatcaagtttgagaacagcatcagccggctgacagaggacaagatcctgctggagaactacgtgcgcagcattgaaaatgaaagagacaccctggagtttgagatgaggcacctgcagcgggagtacctgagcctgagtgacaagatctgcaaccagcacaatgaccccagcaagaccacctacatcagccggcgggagaagttccactttgacaactacacccatgaggacaccagcagcccccagagccggcccctggccagtgacctgaagggctacttcaaggtgaaggacaggaccctgaagcaccactag

SEQ ID NO: 15258 - DNA, 726 bp, Artificial Sequence
  Description of Artificial Sequence: Synthetic coding sequence
atggcccctgtgagaagaagtgccaagtggaggcctgggggcatcgaggcccggggggagggcgtgtccacagtgggctacagaaacaagaatgtgcggcagaagacctggaggcccaaccacccccaggcctttgtgggctctgtgcgggagggccagggctttgccttccggaggaagctgaagatccagcagagctacaagaagctgctgaggaaggagaagaaggcccagaccagcctggagagccagttcacagaccgctacccagacaacctgaagcacctgtacctggccgaggaggagcggcacaggaagcaggccaggaaggtggaccaccccctgtctgagcaggtgcaccagcccctgctggaggagcagtgcagcattgatgagcccctgtttgaggaccagtgcagctttgaccagccccagcctgaggagcagtgcatcaagacagtgaacagcttcaccatccccaagaagaacaagaagaagaccagcaaccagaaggcccaggaggagtatgagcagatccaggccaagagagctgccaagaagcaggagtttgagaggaggaagcaggagcgggaggaggcccagaggcagtacaagaagaagaagatggaggtgttcaagatcctgaacaagaagaccaagaagggccagcccaacctgaatgtgcagatggagtacctgctgcagaagatccaggagaagtgctag

SEQ ID NO: 15259 - DNA, 888 bp, Artificial Sequence
  Description of Artificial Sequence: Synthetic coding sequence
atggagcaccagctgctgtgctgtgaggtggagaccatccggcgggcctacccagatgccaacctgctgaatgacagagtgctgcgggccatgctgaaggccgaggagacctgtgcccccagcgtgtcctacttcaagtgtgtgcagaaggaggtgctgcccagcatgaggaagatcgtggccacctggatgctggaggtgtgtgaggagcagaagtgtgaggaggaggtgttccccctggccatgaactacctggaccgcttcctgagcctggagcctgtgaagaagagccggctgcagctgctgggcgccacctgcatgtttgtggccagcaagatgaaggagaccatccccctgacagctgagaagctgtgcatctacacagacaacagcatccggcctgaggagctgctgcagatggagctgctgctggtgaacaagctgaagtggaacctggccgccatgacccctcatgacttcatcgagcacttcctgagcaagatgcctgaggccgaggagaacaagcagatcatcaggaagcacgcccagacctttgtggccctgtgtgccacagatgtgaagttcatcagcaaccccccatccatggtggccgccggctctgtggtggccgctgtgcagggcctgaacctgcggagccccaacaacttcctgagctactaccgcctgacccgcttcctgagcagggtcatcaagtgtgaccctgactgcctgcgggcctgccaggagcagatcgaggccctgctggagagcagcctgcggcaggcccagcagaacatggaccccaaggctgctgaggaggaggaggaggaggaggaggaggtggacctggcctgcacccccacagatgtgagagatgtggacatctag

SEQ ID NO: 15260 - DNA, 492 bp, Artificial Sequence
  Description of Artificial Sequence: Synthetic coding sequence
atggacacccccctgcggcgcagccggcggctgggcggcctgcggcctgagagccctgagagcctgacctctgtgtccaggacccggcgggccctggtggagtttgagagcaaccctgaggagacccgggagcccggcagcccccccagcgtgcagagagctggcctgggcagccctgagcggccccccaagaccagccctggcagcccccggctgcagcagggcgccggcctggagagcccccagggccagcctgagcctggagctgccagcccccagaggcagcaggacctgcacctggagagcccccagaacaaggaggagctgacccctggggccccccagcaccagctgccccctgtgcccggcagccctgagccctacccaggccagcaggccaccagctcctggggagatggagaccggcggctgcggggcaaggaggccaagcgcttcttcatccctggccccagcgtgcaggaggtggagtag

SEQ ID NO: 15261 - DNA, 315 bp, Artificial Sequence
  Description of Artificial Sequence: Synthetic coding sequence
atgctgcaggacaagcccctgcggacctcctggcagaggaagatgaaggagcggcaggagaggaagctggccaaggactttgcccggcacctggaggaggagaaggagcggcggcggcaggagaagaagcagaggagagctgagaacctgaagaggcggctggagaatgaaaggaaggccgaggtggtgcaggtgatcagaaatcctgccaagctgaagagggccaagaagaagcagctgcggagcattgagaagagggacaccctggccctgctgcagaagcagcccccccagcagcctgctgccaagatctag

SEQ ID NO: 15262 - DNA, 819 bp, Artificial Sequence
  Description of Artificial Sequence: Synthetic coding sequence
atggaggaggaggccatcgccagcctgcccggggaggagacagaggacatggacttcctgagcggcctggagctggccgacctgctggacccccggcagcctgactggcacctggaccccggcctgagcagccctggccccctgagcagcagcggcggcggcagtgacagcggcggcctgtggagaggagatgatgatgatgaagctgctgctgctgagatgcagcgcttcagtgacctgctgcagaggctgctgaatggcatcggcggctgcagcagcagcagtgacagcggcagcgctgagaagagaagaaggaagagccctgggggcggcggcggcggcggcagcggaaatgacaacaaccaggccgccaccaagagccccaggaaggctgctgctgctgctgcccggctgaaccggctgaagaagaaggagtatgtgatgggcctggagagccgggtgcggggcctggccgctgagaaccaggagctgcgggcagaaaatcgggagctgggcaagagggtgcaggccctgcaggaggagagccgctacctgcgggctgtgctggccaatgaaacaggcctggcccggctgctgagccggctgtctggagtgggcctgcggctgaccaccagcctcttccgggacagccctgctggggaccatgactatgccctgcctgtgggcaagcagaagcaggacctgctggaggaggatgattctgctgggggcgtgtgcctgcacgtggacaaggacaaggtgtctgtggagttctgcagcgcctgtgccaggaaggccagcagcagcctgaagatgtag

SEQ ID NO: 15263 - DNA, 1065 bp, Artificial Sequence
  Description of Artificial Sequence: Synthetic coding sequence
atgaggcacagcctgaccaagctgctggccgccagcggcagcaacagccccaccaggtctgagagccctgagcctgctgccacctgcagcctgcccagcgacctgaccagggctgctgctggggaggaggagacagctgctgctggcagccctggcaggaagcagcagtttggagatgaaggagagctggaggccggccggggcagcagaggaggagtggccgtgcgggcccccagccctgaggagatggaggaggaggccatcgccagcctgcccggggaggagacagaggacatggacttcctgagcggcctggagctggccgacctgctggacccccggcagcctgactggcacctggaccccggcctgagcagccctggccccctgagcagcagcggcggcggcagtgacagcggcggcctgtggagaggagatgatgatgatgaagctgctgctgctgagatgcagcgcttcagtgacctgctgcagaggctgctgaatggcatcggcggctgcagcagcagcagtgacagcggcagcgctgagaagagaagaaggaagagccctgggggcggcggcggcggcggcagcggaaatgacaacaaccaggccgccaccaagagccccaggaaggctgctgctgctgctgcccggctgaaccggctgaagaagaaggagtatgtgatgggcctggagagccgggtgcggggcctggccgctgagaaccaggagctgcgggcagaaaatcgggagctgggcaagagggtgcaggccctgcaggaggagagccgctacctgcgggctgtgctggccaatgaaacaggcctggcccggctgctgagccggctgtctggagtgggcctgcggctgaccaccagcctcttccgggacagccctgctggggaccatgactatgccctgcctgtgggcaagcagaagcaggacctgctggaggaggatgattctgctgggggcgtgtgcctgcacgtggacaaggacaaggtgtctgtggagttctgcagcgcctgtgccaggaaggccagcagcagcctgaagatgtag

SEQ ID NO: 15264 - DNA, 1065 bp, Artificial Sequence; identical to SEQ ID NO: 15263
  Description of Artificial Sequence: Synthetic coding sequence

SEQ ID NO: 15265 - DNA, 816 bp, Artificial Sequence
  Description of Artificial Sequence: Synthetic coding sequence
atggagcacggcagcatcatcacccaggccaggagagaagatgccctggtgctgaccaagcagggcctggtgtccaagagcagccccaagaagccccggggcaggaacatcttcaaggccctcttctgctgcttccgggcccagcacgtgggccagagcagcagcagcacagagctggccgcctacaaggaggaggccaacaccatcgccaagagtgacctgctgcagtgcctgcagtaccagttctaccagatccctggcacctgcctgctgcctgaggtgacagaggaggaccagggccgcatctgtgtggtgattgacctggatgagaccctggtgcacagcagcttcaagcccatcaacaatgctgacttcatcgtgcccattgaaattgagggcaccacccaccaggtgtatgtgctgaagaggccctacgtggatgagttcctgcggaggatgggagagctgtttgaatgtgtgctcttcaccgccagcctggccaagtatgctgaccctgtgacagacctgctggacagatgtggggtcttccgggcccggctcttccgggagagctgtgtgttccaccagggctgctacgtgaaggacctgagccggctgggccgggacctgaggaagaccctcatcctggacaacagccctgccagctacatcttccacccagaaaatgctgtgcctgtgcagagctggtttgatgacatggctgacacagagctgctgaacctgatccccatctttgaggagctgagcggggctgaagatgtgtacaccagcctgggccagctgcgggccccctag

SEQ ID NO: 15266 - DNA, 831 bp, Artificial Sequence
  Description of Artificial Sequence: Synthetic coding sequence
atggatggccctgccatcatcacccaggtgaccaaccccaaggaggatgagggccgcctgcctggagctggggagaaggccagccagtgcaatgtgtccctgaagaagcagaggagccgcagcatcctgagcagcttcttctgctgcttccgggactacaacgtggaggcccccccacccagcagccccagcgtgctgccccccctggtggaggagaatggaggcctgcagaagggggaccagaggcaggtgatccccatccccagccccccagccaagtacctgctgcctgaggtgacagtgctggactatggcaagaagtgtgtggtgattgacctggatgagaccctggtgcacagcagcttcaagcccatcagcaatgctgacttcatcgtgcctgtggagattgatggcaccatccaccaggtgtatgtgctgaagaggccccacgtggatgagttcctgcagaggatgggccagctgtttgaatgtgtgctcttcaccgccagcctggccaagtatgctgaccctgtggccgacctgctggaccgctggggcgtcttccgggcccggctcttccgggagagctgtgtgttccaccggggcaactacgtgaaggacctgagccggctgggccgggagctgagcaaggtgatcatcgtggacaacagccctgccagctacatcttccacccagaaaatgctgtgcctgtgcagagctggtttgatgacatgacagacacagagctgctggacctgatccccttctttgagggcctgagcagagaagatgatgtgtacagcatgctgcaccggctgtgcaacagatag

SEQ ID NO: 15267 - DNA, 798 bp, Artificial Sequence
  Description of Artificial Sequence: Synthetic coding sequence
atggatggccctgccatcatcacccaggtgaccaaccccaaggaggatgagggccgcctgcctggagctggggagaaggccagccagtgcaatgtgtccctgaagaagcagaggagccgcagcatcctgagcagcttcttctgctgcttccgggactacaacgtggaggcccccccacccagcagccccagcgtgctgccccccctggtggaggagaatggaggcctgcagaagcccccagccaagtacctgctgcctgaggtgacagtgctggactatggcaagaagtgtgtggtgattgacctggatgagaccctggtgcacagcagcttcaagcccatcagcaatgctgacttcatcgtgcctgtggagattgatggcaccatccaccaggtgtatgtgctgaagaggcctcatgtggatgagttcctgcagaggatgggccagctgtttgaatgtgtgctcttcaccgccagcctggccaagtatgctgaccctgtggccgacctgctggaccgctggggcgtcttccgggcccggctcttccgggagagctgtgtgttccaccggggcaactacgtgaaggacctgagccggctgggccgggagctgagcaaggtgatcatcgtggacaacagccctgccagctacatcttccacccagaaaatgctgtgcctgtgcagagctggtttgatgacatgacagacacagagctgctggacctgatccccttctttgagggcctgagccgggaggatgatgtgtacagcatgctgcaccggctgtgcaacagatag

SEQ ID NO: 15268 - DNA, 3522 bp, Artificial Sequence
  Description of Artificial Sequence: Synthetic coding sequence
atgagccggggcagcattgagatccccctgcgggacacagatgaggtgattgagctggactttgaccagctgcctgaaggagatgaggtgatcagcatcctgaagcaggagcacacccagctgcacatctggatcgccctggccctggagtactacaagcagggcaagacagaggagtttgtgaagctgctggaggccgccagaattgatggcaacctggactacagagaccacgagaaggaccagatgacctgcctggacaccctggccgcctactacgtgcagcaggccaggaaggagaagaacaaggacaacaagaaggacctgatcacccaggccaccctgctgtacaccatggctgacaagatcatcatgtatgaccagaaccacctgctgggccgggcctgcttctgcctgctggagggggacaagatggaccaggctgatgcccagttccactttgtgctgaaccagagccccaacaacatcccagccctgctgggcaaggcctgcatctccttcaacaagaaggactacagaggagccctggcctactacaagaaggccctgcggaccaaccctggctgcccagctgaggtgcggctgggcatgggccactgctttgtgaagctgaacaagctggagaaggcccggctggccttcagccgggccctggagctgaacagcaaatgtgtgggcgccctggtgggcctggccgtgctggagctgaacaacaaggaggccgacagcatcaagaatggagtgcagctgctgagccgggcctacaccatcgaccccagcaaccccatggtgctgaaccacctggccaaccacttcttcttcaagaaggactacagcaaggtgcagcacctggccctgcacgccttccacaacacagaggtggaggccatgcaggccgagagctgctaccagctggcccgctccttccacgtgcaggaggactatgaccaggccttccagtactactaccaggccacccagtttgccagcagcagctttgtgctgcccttcttcggcctgggccagatgtacatctacagaggagacaaggaaaatgccagccagtgctttgagaaggtgctgaaggcctaccccaacaactatgagaccatgaagatcctgggcagcctgtatgctgccagcgaggaccaggagaagagggacatcgccaagggccacctgaagaaggtgacagagcagtacccagatgatgtggaggcctggattgagctggcccagatcctggagcagacagacatccagggcgccctgagcgcctacggcacagccacccgcatcctgcaggagaaggtgcaggctgatgtgcccccagagatcctgaacaacgtgggcgccctgcacttccggctgggcaacctgggggaggccaagaagtacttcctggccagcctggaccgggccaaggccgaggccgagcatgatgagcactactacaatgccatctctgtgaccaccagctacaacctggcccggctgtatgaggccatgtgtgagttccacgaggccgagaagctgtacaagaacatcctgcgggagcaccccaactacgtggactgctacctgcggctgggcgccatggcccgggacaagggcaacttctatgaggccagtgactggttcaaggaggccctgcagatcaaccaggaccacccagatgcctggagcctgattggcaacctgcacctggccaagcaggagtggggccctggccagaagaagtttgagcgcatcctgaagcagcccagcacccagagcgacacctacagcatgctggccctgggcaatgtgtggctgcagaccctgcaccagcccacccgggaccgggagaaggagaagaggcaccaggaccgggccctggccatctacaagcaggtgctgagaaatgatgccaagaacctgtatgctgccaatggaattggagctgtgctggcccacaagggctacttccgggaggccagagatgtgtttgcccaggtgcgggaggccacagctgacatcagtgatgtgtggctgaacctggcccacatctacgtggagcagaagcagtacatctctgctgtgcagatgtatgagaactgcctgaggaagttctacaagcaccagaacacagaggtggtgctgtacctggcccgggccctcttcaagtgtgggaagctgcaggagtgcaagcagaccctgctgaaggcccggcacgtggcccccagcgacacagtgctgatgttcaacgtggccctggtgctgcagaggctggccacctctgtgctgaaggatgagaagagcaacctgaaggaggtgctgaatgctgtgaaggagctggagctggcccaccgctacttctcctacctgagcaaggtgggggacaagatgagatttgacctggccctggccgccacagaggcccggcagtgcagcgacctgctgagccaggcccagtaccacgtggcccgggccaggaagcaggatgaggaggagcgggagctgcgggccaagcaggagcaggagaaggagctgctgcggcagaagctgctgaaggagcaggaggagaagaggctgcgggagaaggaggagcagaagaagctgctggagcagagggcccagtatgtggagaagaccaagaacatcctgatgttcaccggggagacagaggccaccaaggagaagaagaggggcggcggcggcggcagaagaagcaagaagggcggggagtttgatgaatttgtgaatgatgacacagatgatgacctgcccatcagcaagaagaagaagagaagaaaaggaagtggcagcgagcaggagggggaggatgaggagggcggggagaggaagaagaagaagagaagaagacaccccaagggggaggagggcagtgatgatgatgaaacagaaaatggccccaagcccaagaagaggcggccccccaaggccgagaagaagaaggcccccaagccagagcggctgcccccatccatgaagggcaagatcaagagcaaggccatcatcagcagcagtgatgacagcagtgatgaggacaagctgaagattgctgatgagggccaccccaggaacagcaacagcaacagcgacagtgatgaagatgagcagaggaagaagtgtgccagcagcgagagtgacagtgatgagaaccagaacaagagcggcagcgaggccggcagcccccggcggccccggcggcagaggagtgaccaggacagcgacagcgaccagcccagcaggaagaggcggcccagcggcagcgagcagagcgacaatgaatctgtgcagagcggccgcagccacagcggcgtgtctgaaaatgacagcaggcctgccagccccagcgctgagagtgaccacgagagcgagcggggcagtgacaatgaaggcagcggccagggcagcggaaatgaaagtgagcctgagggcagcaacaatgaggccagtgaccggggcagcgagcacggcagtgatgacagcgactag

SEQ ID NO: 15269 - DNA, 3693 bp, Artificial Sequence
  Description of Artificial Sequence: Synthetic coding sequence
atggccagcgccagctaccacatcagcaacctgctggagaagatgaccagcagtgacaaggacttccgcttcatggccaccaatgacctgatgacagagctgcagaaggacagcatcaagctggatgatgattctgagaggaaggtggtgaagatgatcctgaagctgctggaggacaagaatggagaggtgcagaacctggccgtgaagtgcctgggccccctggtgtccaaggtgaaggagtaccaggtggagaccatcgtggacaccctgtgcaccaacatgctgagtgacaaggagcagctgcgggacatcagcagcatcggcctgaagacagtcatcggggagctgcccccagccagcagcggcagcgccctggccgccaacgtgtgcaagaagatcaccggccgcctgaccagcgccatcgccaagcaggaggatgtgtctgtgcagctggaggccctggacatcatggctgacatgctgagccggcagggcggcctgctggtgaacttccaccccagcatcctgacctgcctgctgccccagctgaccagcccccggctggccgtgaggaagaggaccatcatcgccctgggccacctggtgatgagctgtggcaacatcgtgtttgtggacctgattgagcacctgctgtctgagctgagcaagaatgacagcatgagcaccaccaggacctacatccagtgcatcgccgccatcagccggcaggccggccacagaattggagagtacctggagaagatcatccccctggtggtgaagttctgcaatgtggatgatgatgagctgcgggagtactgcatccaggcctttgagagctttgtgcggcgctgccccaaggaggtgtacccccacgtgtccaccatcatcaacatctgcctgaagtacctgacctatgaccccaactacaactatgatgatgaagatgaagatgaaaatgccatggatgctgatggaggagatgatgatgaccagggcagtgatgatgagtacagtgatgatgatgacatgtcctggaaggtgcggcgggctgctgccaagtgcctggatgctgtggtgtccaccaggcatgagatgctgcctgagttctacaagacagtgtccccagccctgatcagccgcttcaaggagcgggaggagaatgtgaaggcagatgtgttccacgcctacctgagcctgctgaagcagaccaggcctgtgcagagctggctgtgtgaccctgatgccatggagcagggcgagacccccctgaccatgctgcagagccaggtgcccaacatcgtgaaggccctgcacaagcagatgaaggagaagtctgtgaagacccggcagtgctgcttcaacatgctgacagagctggtgaatgtgctgcccggggccctgacccagcacatccctgtgctggtgcccggcatcatcttcagcctgaatgacaagagcagcagcagcaacctgaagattgatgccctgagctgcctgtatgtgatcctgtgcaaccacagcccccaggtgttccacccccacgtgcaggccctggtgccccctgtggtggcctgtgtgggggaccccttctacaagatcaccagcgaggccctgctggtgacccagcagctggtgaaggtgatccggcccctggaccagcccagcagctttgatgccaccccctacatcaaggacctcttcacctgcaccatcaagaggctgaaggctgctgacatcgaccaggaggtgaaggagcgggccatcagctgcatgggccagatcatctgcaacctgggggacaacctgggcagtgacctgcccaacaccctgcagatcttcctggagcggctgaagaatgagatcacccggctgaccaccgtgaaggccctgaccctgattgctggcagccccctgaagattgacctgcggcctgtgctgggggagggcgtgcccatcctggccagcttcctgaggaagaaccagagggccctgaagctgggcaccctgagcgccctggacatcctgatcaagaactacagcgacagcctgacagctgccatgattgatgctgtgctggatgagctgcccccactcatcagcgagagtgacatgcacgtgtcccagatggccatctccttcctgaccaccctggccaaggtgtaccccagcagcctgagcaagatcagcggcagcatcctgaatgagctgattggcctggtgcgcagccccctgctgcagggcggggccctgagcgccatgctggacttcttccaggccctggtggtgacaggcaccaacaacctgggctacatggacctgctgaggatgctgaccggccctgtgtacagccagagcacagccctgacccacaagcagagctactacagcatcgccaagtgtgtggccgccctgacccgggcctgccccaaggagggccctgctgtggtgggccagttcatccaggatgtgaagaacagccgcagcacagacagcatccggctgctggccctgctgagcctgggggaggtgggccaccacatcgacctgagcggccagctggagctgaagagcgtcatcctggaggccttcagcagccccagcgaggaggtgaagtctgctgccagctatgccctgggcagcatctctgtgggcaacctgcctgagtacctgccctttgtgctgcaggagatcaccagccagcccaagaggcagtacctgctgctgcacagcctgaaggagatcatcagcagcgcctctgtggtgggcctgaagccctacgtggagaacatctgggccctgctgctgaagcactgtgaatgtgccgaggagggcaccagaaatgtggtggctgaatgtctgggcaagctgaccctgattgatcctgagaccctgctgccccggctgaagggctacctgatcagcggcagcagctatgcccggagctctgtggtgacagctgtgaagttcaccatcagtgaccacccccagcccatcgaccccctgctgaagaactgcatcggggacttcctgaagaccctggaggaccctgacctgaatgtgagaagagtggccctggtgaccttcaacagcgctgcccacaacaagcccagcctcatccgggacctgctggacacagtgctgccccacctgtacaatgagaccaaggtgaggaaggagctgatccgggaggtggagatgggccccttcaagcacacagtggatgatggcctggacatcaggaaggccgcctttgagtgcatgtacaccctgctggacagctgcctggaccggctggacatctttgagttcctgaaccacgtggaggatggcctgaaggaccactatgacatcaagatgctgaccttcctgatgctggtgcggctgagcaccctgtgccccagcgctgtgctgcagaggctggaccggctggtggagcccctgcgggccacctgcaccaccaaggtgaaggccaacagcgtgaagcaggagtttgagaagcaggatgagctgaagaggtctgccatgagagctgtggccgccctgctgaccatccctgaggccgagaagagccccctgatgtctgagttccagagccagatcagcagcaaccctgagctggccgccatctttgagagcatccagaaggacagcagcagcaccaacctggagagcatggacaccagctag

SEQ ID NO: 15270 - DNA, 1209 bp, Artificial Sequence
  Description of Artificial Sequence: Synthetic coding sequence
tatgagctggtgtcccggcagggcggcctgctggtgaacttccaccccagcatcctgacctgcctgctgccccagctgaccagcccccggctggccgtgaggaagaggaccatcatcgccctgggccacctggtgatgagctgtggcaacatcgtgtttgtggacctgattgagcacctgctgtctgagctgagcaagaatgacagcatgagcaccaccaggacctacatccagtgcatcgccgccatcagccggcaggccggccacagaattggagagtacctggagaagatcatccccctggtggtgaagttctgcaatgtggatgatgatgagctgcgggagtactgcatccaggcctttgagagctttgtgcggcgctgccccaaggaggtgtacccccacgtgtccaccatcatcaacatctgcctgaagtacctgacctatgaccccaactacaactatgatgatgaagatgaagatgaaaatgccatggatgctgatggaggagatgatgatgaccagggcagtgatgatgagtacagtgatgatgatgacatgtcctggaaggtgcggcgggctgctgccaagtgcctggatgctgtggtgtccaccaggcatgagatgctgcctgagttctacaagacagtgtccccagccctgatcagccgcttcaaggagcgggaggagaatgtgaaggcagatgtgttccacgcctacctgagcctgctgaagcagaccaggcctgtgcagagctggctgtgtgaccctgatgccatggagcagggcgagacccccctgaccatgctgcagagccaggtgcccaacatcgtgaaggccctgcacaagcagatgaaggagaagtctgtgaagacccggcagtgctgcttcaacatgctgacagagctggtgaatgtgctgcccggggccctgacccagcacatccctgtgctggtgcccggcatcatcttcagcctgaatgacaagagcagcagcagcaacctgaagattgatgccctgagctgcctgtatgtgatcctgtgcaaccacagcccccaggtgttccacccccacgtgcaggccctggtgccccctgtggtggcctgtgtgggggaccccttctacaagatcaccagcgaggccctgctggtgacccagcagctggtgaaggcccaccacatgcctgaggcccagtggctgcggctgtag

SEQ ID NO: 15271 - DNA, 3693 bp, Artificial Sequence; identical to SEQ ID NO: 15269
  Description of Artificial Sequence: Synthetic coding sequence

SEQ ID NO: 15272 - DNA, 3360 bp, Artificial Sequence
  Description of Artificial Sequence: Synthetic coding sequence
atgagcacagctgccttccacatcagcagcctgctggagaagatgaccagcagtgacaaggacttccgcttcatggccaccagtgacctgatgtctgagctgcagaaggacagcatccagctggatgaagattctgagaggaaggtggtgaagatgctgctgcggctgctggaggacaagaatggagaggtgcagaacctggccgtgaagtggctgggcgtgcccctgggcgccttccacgccagcctgctgcactgcctgctgccccagctgagcagcccccggctggccgtgaggaagagagctgtgggcgccctgggccacctggccgccgcctgcagcacagacctgtttgtggagctggccgaccacctgctggaccggctgcccggcccccgggtgcccaccagccccacagccatccgcaccctcatccagtgcctgggctctgtgggccggcaggccggccaccggctgggcgcccacctggaccggctggtgcccctggtggaggacttctgcaacctggatgatgatgagctgcgggagagctgcctgcaggcctttgaggccttcctgaggaaatgtcccaaggagatgggcccccacgtgcccaacgtgaccagcctgtgcctgcagtacatcaagcatgaccccaactacaactatgacagtgatgaagatgaggagcagatggagacagaagattctgagttcagcgagcaggagagtgaagatgagtacagtgatgatgatgacatgtcctggaaggtgagaagagctgctgccaagtgcatcgccgccctgatcagcagcaggccagacctgctgcctgacttccactgcaccctggcccctgtgctgatccgccgcttcaaggagcgggaggagaatgtgaaggcagatgtgttcaccgcctacatcgtgctgctgcggcagacccagccccccaagggctggctggaggccatggaggagcccacccagacaggcagcaacctgcacatgctgcggggccaggtgcccctggtggtgaaggccctgcagaggcagctgaaggacagatctgtgcgggcccggcagggctgcttcagcctgctgacagagctggccggcgtgctgcccggcagcctggccgagcacatgcctgtgctggtgtctggcatcatcttcagcctggccgacaggagcagcagcagcaccatccgcatggatgccctggccttcctgcagggcctgctgggcacagagcctgctgaggccttccacccccacctgcccatcctgctgccccctgtgatggcctgtgtggccgacagcttctacaagattgctgctgaggccctggtggtgctgcaggagctggtgcgggccctgtggcccctgcaccggcccaggatgctggaccctgagccctacgtgggggagatgtctgctgtgaccctggcccggctgcgggccacagacctggaccaggaggtgaaggagcgggccatcagctgcatgggccacctggtgggccacctgggggaccggctgggagatgacctggagcccaccctgctgctgctgctggaccggctgagaaatgagatcacccggctgcctgccatcaaggccctgaccctggtggccgtgagccccctgcagctggacctgcagcccatcctggccgaggccctgcacatcctggccagcttcctgaggaagaaccagagggccctgcggctggccaccctggccgccctggatgccctggcccagagccagggcctgagcctgcccccatctgctgtgcaggccgtgctggccgagctgcctgccctggtgaatgaaagtgacatgcacgtggcccagctggccgtggacttcctggccaccgtgacccaggcccagcctgccagcctggtggaggtgtctggccctgtgctgtctgagctgctgcggctgctgcggagccccctgctgcctgctggggtgctggccgctgctgagggcttcctgcaggccctggtgggcacccggcccccctgtgtggactatgccaagctgatcagcctgctgacagcccctgtgtatgagcaggccgtggatggcggccctggcctgcacaagcaggtgttccacagcctggcccgctgtgtggccgccctgtctgctgcctgcccccaggaggccgccagcacagccagccggctggtgtgtgatgcccggagcccccacagcagcactggagtgaaggtgctggccttcctgagcctggccgaggtgggccaggtggccggccctggccaccagcgggagctgaaggctgtgctgctggaggccctgggcagccccagtgaagatgtgcgggctgctgccagctatgccctgggccgggtgggcgccggcagcctgcctgacttcctgcccttcctgctggagcagattgaagctgagccccggcggcagtacctgctgctgcacagcctgcgggaggccctgggcgccgcccagcctgacagcctgaagccctatgcagaggacatctgggccctgctcttccagagatgtgagggcgctgaggagggcacccggggcgtggtggctgaatgtattggcaagctggtgctggtgaaccccagcttcctgctgccccggctgaggaagcagctggccgccggccggccccacaccaggagcaccgtcatcacagctgtgaagttcctgatcagtgaccagccccaccccatcgaccccctgctgaagagcttcatcgctgtgcacaacaagcccagcctggtgcgggacctgctggatgacatcctgcccctgctgtaccaggagaccaagatcagaagagacctgatccgggaggtggagatgggccccttcaagcacacagtggatgatggcctggatgtgaggaaggccgcctttgagtgcatgtacagcctgctggagagctgcctgggccagctggacatctgtgagttcctgaaccacgtggaggatggcctgaaggaccactatgacatccgcatgctgaccttcatcatggtggcccggctggccaccctgtgcccagcccctgtgctgcagagggtggacaggctcatcgagcccctgcgggccacctgcacagccaaggtgaaggccggctctgtgaagcaggagtttgagaagcaggatgagctgaagaggtctgccatgagagctgtggccgccctgctgaccatccctgaggtgggcaagagccccatcatggctgacttcagcagccagatccgcagcaaccctgagctggccgccctgtttgagagcatccagaaggacagcgccagcgcccccagcacagacagcatggagctgtcctag

SEQ ID NO: 15273 - DNA, 3711 bp, Artificial Sequence
  Description of Artificial Sequence: Synthetic coding sequence
atgagcacagctgccttccacatcagcagcctgctggagaagatgaccagcagtgacaaggacttccgcttcatggccaccagtgacctgatgtctgagctgcagaaggacagcatccagctggatgaagattctgagaggaaggtggtgaagatgctgctgcggctgctggaggacaagaatggagaggtgcagaacctggccgtgaagtgcctgggccccctggtggtgaaggtgaaggagtaccaggtggagaccatcgtggacaccctgtgcaccaacatgagaagtgacaaggagcagctgcgggacattgctggcatcggcctgaagacagtgctgtctgagctgcccccagctgccaccggcagcggcctggccaccaacgtgtgcaggaagatcaccggccagctgaccagcgccatcgcccagcaggaggatgtggccgtgcagctggaggccctggacatcctgagtgacatgctgagccggctgggcgtgcccctgggcgccttccacgccagcctgctgcactgcctgctgccccagctgagcagcccccggctggccgtgaggaagagagctgtgggcgccctgggccacctggccgccgcctgcagcacagacctgtttgtggagctggccgaccacctgctggaccggctgcccggcccccgggtgcccaccagccccacagccatccgcaccctcatccagtgcctgggctctgtgggccggcaggccggccaccggctgggcgcccacctggaccggctggtgcccctggtggaggacttctgcaacctggatgatgatgagctgcgggagagctgcctgcaggcctttgaggccttcctgaggaagtgccccaaggagatgggcccccacgtgcccaacgtgaccagcctgtgcctgcagtacatcaagcatgaccccaactacaactatgacagtgatgaagatgaggagcagatggagacagaggacagcgagttcagcgagcaggagagtgaagatgagtacagtgatgatgatgacatgtcctggaaggtgcggcgggctgctgccaagtgcatcgccgccctgatcagcagcaggccagacctgctgcctgacttccactgcaccctggcccctgtgctgatccgccgcttcaaggagcgggaggagaatgtgaaggcagatgtgttcaccgcctacatcgtgctgctgcggcagacccagccccccaagggctggctggaggccatggaggagcccacccagacaggcagcaacctgcacatgctgcggggccaggtgcccctggtggtgaaggccctgcagaggcagctgaaggacagatctgtgcgggcccggcagggctgcttcagcctgctgacagagctggccggcgtgctgcccggcagcctggccgagcacatgcctgtgctggtgtctggcatcatcttcagcctggccgacaggagcagcagcagcaccatccgcatggatgccctggccttcctgcagggcctgctgggcacagagcctgctgaggccttccacccccacctgcccatcctgctgccccctgtgatggcctgtgtggccgacagcttctacaagattgctgctgaggccctggtggtgctgcaggagctggtgcgggccctgtggcccctgcaccggcccaggatgctggaccctgagccctacgtgggggagatgtctgctgtgaccctggcccggctgcgggccacagacctggaccaggaggtgaaggagcgggccatcagctgcatgggccacctggtgggccacctgggggaccggctgggagatgacctggagcccaccctgctgctgctgctggaccggctgagaaatgagatcacccggctgcctgccatcaaggccctgaccctggtggccgtgagccccctgcagctggacctgcagcccatcctggccgaggccctgcacatcctggccagcttcctgaggaagaaccagagggccctgcggctggccaccctggccgccctggatgccctggcccagagccagggcctgagcctgccccccagcgctgtgcaggccgtgctggccgagctgcctgccctggtgaatgaaagtgacatgcacgtggcccagctggccgtggacttcctggccaccgtgacccaggcccagcctgccagcctggtggaggtgtctggccctgtgctgtctgagctgctgcggctgctgcggagccccctgctgcctgctggggtgctggccgctgctgagggcttcctgcaggccctggtgggcaccaggcctccctgtgtggactatgccaagctgatcagcctgctgacagcccctgtgtatgagcaggccgtggatggcggccctggcctgcacaagcaggtgttccacagcctggcccgctgtgtggccgccctgtctgctgcctgcccccaggaggccgccagcacagccagccggctggtgtgtgatgcccggagcccccacagcagcactggagtgaaggtgctggccttcctgagcctggccgaggtgggccaggtggccggccctggccaccagcgggagctgaaggctgtgctgctggaggccctgggcagccccagtgaagatgtgcgggccgccgccagctatgccctgggccgggtgggcgccggcagcctgcctgacttcctgcccttcctgctggagcagatcgaggccgagccccggcggcagtacctgctgctgcacagcctgcgggaggccctgggcgccgcccagcctgacagcctgaagccctatgcagaggacatctgggccctgctcttccagagatgtgagggcgctgaggagggcacccggggcgtggtggccgagtgcatcggcaagctggtgctggtgaaccccagcttcctgctgccccggctgaggaagcagctggccgccggccggccccacaccaggagcaccgtcatcacagctgtgaagttcctgatcagtgaccagccccaccccatcgaccccctgctgaagagcttcatcggggagttcatggagagcctgcaggaccctgacctgaatgtgcggcgggccaccctggccttcttcaacagcgctgtgcacaacaagcccagcctggtgcgggacctgctggatgacatcctgcccctgctgtaccaggagaccaagatccggcgggacctgatccgggaggtggagatgggccccttcaagcacacagtggatgatggcctggatgtgaggaaggccgcctttgagtgcatgtacagcctgctggagagctgcctgggccagctggacatctgtgagttcctgaaccacgtggaggatggcctgaaggaccactatgacatccgcatgctgaccttcatcatggtggcccggctggccaccctgtgcccagcccctgtgctgcagagggtggaccggctgattgagcccctgcgggccacctgcacagccaaggtgaaggccggctctgtgaagcaggagtttgagaagcaggatgagctgaagaggtctgccatgagagctgtggccgccctgctgaccatccctgaggtgggcaagagccccatcatggctgacttcagcagccagatccgcagcaaccctgagctggccgccctgtttgagagcatccagaaggacagcgccagcgcccccagcacagacagcatggagctgtcctag

SEQ ID NO: 15274 - DNA, 4461 bp, Artificial Sequence
  Description of Artificial Sequence: Synthetic coding sequence
atggccgccaacgtgggctccatgttccagtactggaagagatttgacctgcggcggctgcagaaggagctgaacagcgtggccagcgagctgagcgcccggcaggaggagagcgagcacagccacaagcacctgattgagctgcggcgggagttcaagaagaatgtgcctgaggagatccgggagatggtggcccctgtgctgaagagcttccaggccgaggtggtggccctgagcaagaggagccaggaggccgaggccgccttcctgtctgtgtacaagcagctgattgaggccccagaccctgtgcctgtgtttgaggccgcccggagcctggatgaccggctgcagccccccagctttgaccccagcggccagccccggcgggacctgcacacctcctggaagagaaatcctgagctgctgagccccaaggagcagcgggagggcaccagccctgctggccccaccctgacagagggcagccggctgcccggcatccctgggaaggccctgctgacagagaccctgctgcagagaaatgaagctgagaagcagaagggcctgcaggaggtgcagatcaccctggccgcccggctgggggaggccgaggagaagatcaaggtgctgcacagcgccctgaaggccacccaggccgagctgctggagctgcggaggaaatatgatgaggaggccgccagcaaggcagatgaggtgggcctcatcatgaccaacctggagaaggccaaccagagagctgaggccgcccagcgggaggtggagagcctgcgggagcagctggcctctgtgaacagcagcatccggctggcctgctgcagcccccagggccccagcggggacaaggtgaacttcaccctgtgcagcggcccccggctggaggccgccctggccagcaaggaccgggagatcctgcggctgctgaaggatgtgcagcacctgcagagcagcctgcaggagctggaggaggccagcgccaaccagattgctgacctggagcggcagctgacagccaagtctgaggccatcgagaagctggaggagaagctgcaggcccagagcgactatgaggagatcaagacagagctgagcatcctgaaggccatgaagctggccagcagcacctgcagcctgccccagggcatggccaagccagaggacagcctgctgattgccaaggaggccttcttccccacccagaagttcctgctggagaagcccagcctgctggccagccctgaggaggaccccagtgaagatgacagcatcaaggacagcctgggcacagagcagagctaccccagcccccagcagctgcccccacctcctggccctgaggaccccctgagccccagccctggccagcccctgctgggccccagcctgggcccagatggcaccaggaccttcagcctgagccccttccccagcctggccagcggggagcggctgatgatgcctcctgctgccttcaagggggaggccggcggcctgctggtgttccccccagccttctacggggccaagccacccacagccccagccaccccagcccctggccctgagcccctgggcggccctgagccagcagatggcggcggcggcggggccgccggccctggagctgaggaggagcagctggacacagctgagatcgccttccaggtgaaggagcagctgctgaagcacaacatcggccagagggtgtttggccactacgtgctgggcctgagccagggctctgtgtctgagatcctggcccggcccaagccctggaggaagctgactgtgaagggcaaggagcccttcatcaagatgaagcagttcctgagtgatgagcagaatgtgctggccctgcggaccatccaggtgcggcagaggggcagcatcaccccccgcatccgcaccccagagactggaagtgatgatgccatcaagagcatcctggagcaggccaagaaggagattgagagccagaagggcggggagcccaagacctctgtggcccccctgagcatcgccaacggcaccaccccagccagcaccagtgaagatgccatcaagagcatcctggagcaggcccggcgggagatgcaggcccagcagcaggccctgctggagatggaggtggccccccggggccgctctgtgccccccagccccccagagcggcccagcctggccacagccagccagaatggagccccagccctggtgaagcaggaggagggcagcggcggccctgcccaggcccccctgcctgtgctgagccctgctgcctttgtgcagagcatcatcaggaaggtgaagtcagaaattggagatgctggctactttgaccaccactgggccagtgaccggggcctgctgagccggccctatgcctctgtgagccccagcctgagcagcagcagcagcagcggctacagcggccagcccaacggccgggcctggcccagaggagatgaggcccctgtgcccccagaagatgaggccgccgccggggctgaagatgagccccccaggactggagagctgaaggccgagggcgccacagctgaggccggggcccggctgccctactacccagcctacgtgcccaggaccctgaagcccaccgtgccccccctgaccccagagcagtatgagctgtacatgtaccgggaggtggacaccctggagctgacccggcaggtgaaggagaagctggccaagaatggcatctgccagaggatctttggagagaaggtgctgggcctgagccagggctctgtgtctgacatgctgagccggcccaagccctggagcaagctgacccagaagggccgggagcccttcatccgcatgcagctgtggctgagtgaccagctgggccaggccgtgggccagcagcccggggccagccaggccagccccacagagcccaggagcagccccagccccccacccagccccacagagcctgagaagagcagccaggagcccctgagcctgagcctggagagcagcaaagaaaaccagcagcctgagggccgcagcagcagcagcctgagcggcaagatgtacagcggcagccaggcccctgggggcatccaggagatcgtggccatgagccctgagctggacacctacagcatcaccaagagggtgaaggaggtgctgacagacaacaacctgggccagaggctgtttggagagagcatcctgggcctgacccagggctctgtgtctgacctgctgagccggcccaagccctggcacaagctgagcctgaagggccgggagccctttgtgaggatgcagctgtggctgaatgacccccacaacgtggagaagctgcgggacatgaagaagctggagaagaaggcctacctgaagagaagatatggcctcatcagcacaggcagtgacagcgagagccctgccaccaggtctgagtgccccagcccctgcctgcagccccaggacctgagcctgctgcagatcaagaagccccgggtggtgctggcccctgaggagaaggaggccctgaggaaggcctaccagctggagccctaccccagccagcagaccatcgagctgctgtccttccagctgaacctgaagaccaacacagtcatcaactggttccacaactaccgcagcaggatgaggcgggagatgctggtggagggcacccaggatgagccagacctggaccccagcggcggccctggcatcctgcccccaggccacagccacccagaccccaccccccagagcccagattctgaaacagaggaccagaagcccaccgtgaaggagctggagctgcaggagggccctgaggagaacagcacccccctgaccacccaggacaaggcccaggtgcgcatcaagcaggagcagatggaggaggatgctgaggaggaggccggcagccagccccaggacagcggggagctggacaagggccagggcccccccaaggaggagcacccagaccccccaggaaatgatggcctgcccaaggtggcccctggccccctgctgcccggcggcagcaccccagactgccccagcctgcacccccagcaggagagcgaggccggggagcggctgcacccagaccccctgtccttcaagagcgccagcgagagcagccgctgcagcctggaggtgtccctgaacagccccagcgctgccagcagccctggcctgatgatgtctgtgtcccctgtgcccagcagcagcgcccccatcagccccagccccccaggggcccccccagccaaggtgcccagcgccagccccacagctgacatggccggggccctgcaccccagcgccaaggtgaaccccaacctgcagaggagacatgagaagatggccaacctgaacaacatcatctacagagtggagagagctgccaaccgggaggaggccctggagtgggagttctag

SEQ ID NO: 15275 - DNA, 375 bp, Artificial Sequence
  Description of Artificial Sequence: Synthetic coding sequence
atggtggcccctgtgctgaagagcttccaggccgaggtggtggccctgagcaagaggagccaggaggccgaggccgccttcctgtctgtgtacaagcagctgattgaggccccagaccctgtgcctgtgtttgaggccgcccggagcctggatgaccggctgcagccccccagctttgaccccagcggccagccccggcgggacctgcacacctcctggaagagaaatcctgagctgctgagccccaaggagcagcgggagggcaccagccctgctggccccaccctgacagagggcagccggctgcccggcatccctgggaaggccctgctgacagagaccctgctgcagagaaatgaagctgagaagcagtag

SEQ ID NO: 15276 - DNA, 2727 bp, Artificial Sequence
  Description of Artificial Sequence: Synthetic coding sequence
atgaagagctctgtggcccagatcaagcccagcagcggccatgaccggcgggagaacctgaacagctaccagaggaacagcagccctgaggacagatatgaggagcaggagaggagcccccgggaccgggactactttgactacagcagaagtgactatgagcacagcagaagaggccgctcctatgacagctccatggagagcaggaacagagaccgggagaagaggcgggagcgggagcgggacacagacaggaagaggagcaggaagagccccagccctggaagaagaaatcctgagacctctgtgacccagagcagcagcgcccaggatgagcccgccaccaagaagaagaaggatgagctggaccccctgctgaccaggactggaggagcctacatccccccagccaagctgaggatgatgcaggagcagatcacagacaagaacagcctggcctaccagaggatgtcctgggaggccctgaagaagagcatcaatggcctcatcaacaaggtgaacatcagcaacatcagcatcatcatccaggagctgctgcaggagaacatcgtgcgggaccggggcctgctgagccgctctgtgctgcaggcccagagcgccagccccatcttcacccacgtgtatgctgccctggtggccatcatcaacagcaagttcccccagattggagagctgatcctgaagaggctcatcctgaacttcaggaagggctacagaagaaatgacaagcagctgtgcctgacagccagcaagtttgtggcccacctgatcaaccagaatgtggcccacgaggtgctgtgcctggagatgctgaccctgctgctggagcggcccacagatgattctgtggaggtggccatcggcttcctgaaggaatgtggcctgaagctgacccaggtgagcccccggggcatcaatgccatctttgagcggctgaggaacatcctgcacgagagcgagattgacaagagggtgcagtacatgattgaggtgatgtttgctgtgaggaaggatggcttcaaggaccaccccatcatcctggagggcctggacctggtggaggaggatgaccagttcacccacatgctgcccctggaggatgactacaacccagaagatgtgctgaatgtgttcaagatggaccccaacttcatggagaatgaggagaagtacaaggccatcaagaaggagatcctggatgaaggagacacagacagcaacacagaccaggatgctggcagcagcgaggaggatgaggaggaggaggaggaggagggggaggaggatgaggagggccagaaggtgaccatccatgacaagacagagatcaacctggtgtccttccggaggaccatctacctggccatccagagcagcctggactttgaagaatgtgcccacaagctgctgaagatggagttccctgagagccagaccaaggagctgtgcaacatgatcctggactgctgtgcccagcagaggacctatgagaagttcttcggcctgctggccggccgcttctgcatgctgaagaaggagtacatggagagctttgagggcatcttcaaggagcagtatgacaccatccaccggctggagaccaacaagctgagaaatgtggccaagatgtttgcccacctgctgtacacagacagcctgccctggagcgtgctggagtgcatcaagctgtctgaggagaccaccaccagcagcagccgcatctttgtgaagatcttcttccaggagctgtgtgagtacatgggcctgcccaagctgaatgcccggctgaaggatgagaccctgcagcccttctttgagggcctgctgccccgggacaaccccaggaacaccaggtttgccatcaacttcttcaccagcatcggcctgggcggcctgacagatgagctgcgggagcacctgaagaacacccccaaggtgattgtggcccagaagccagatgtggagcagaacaagagcagccccagcagcagcagcagcgccagcagcagcagcgagagtgacagcagtgacagcgacagcgacagcagtgacagcagcagcgagagcagcagcgaggagagtgacagcagcagcatcagcagccacagcagcgccagcgccaatgatgtgaggaagaagggccacggcaagaccaggagcaaggaggtggacaagctgatccggaaccagcagaccaatgacaggaagcagaaggagcggcggcaggagcacggccaccaggagaccaggacagagcgggagcggcgctctgagaagcaccgggaccagaacagcagcggcagcaactggagggaccccatcaccaagtacaccagtgacaaggatgtgcccagcgagaggaacaactacagccgggtggccaatgaccgggaccaggagatgcacatcgacctggagaacaagcacggggaccccaagaagaagagaggagagaggagaaattccttctctgaaaatgagaagcacacccaccgcatcaaggacagcgagaacttccggaggaaggacaggagcaagagcaaggagatgaacaggaagcacagcggcagcagaagtgatgaggaccgctaccagaatggagctgagcggcgctgggagaagagcagccgctacagcgagcagagccgggagagcaagaagaaccaggacagaagaagagagaagagccctgccaagcagaagtag

SEQ ID NO: 15277 - DNA, 2238 bp, Artificial Sequence
  Description of Artificial Sequence: Synthetic coding sequence
atgaagagctctgtggcccagatcaagcccagcagcggccatgaccggcgggagaacctgaacagctaccagaggaacagcagccctgaggacagatatgaggagcaggagaggagcccccgggaccgggactactttgactacagcagaagtgactatgagcacagcagaagaggccgctcctatgacagctccatggagagcaggaacagagaccgggagaagaggcgggagcgggagcgggacacagacaggaagaggagcaggaagagccccagccctggaagaagaaatcctgagacctctgtgacccagagcagcagcgcccaggatgagcccgccaccaagaagaagaaggatgagctggaccccctgctgaccaggactggaggagcctacatccccccagccaagctgaggatgatgcaggagcagatcacagacaagaacagcctggcctaccagaggatgtcctgggaggccctgaagaagagcatcaatggcctcatcaacaaggtgaacatcagcaacatcagcatcatcatccaggagctgctgcaggagaacatcgtgcggggccggggcctgctgagccgctctgtgctgcaggcccagagcgccagccccatcttcacccacgtgtatgctgccctggtggccatcatcaacagcaagttcccccagattggagagctgatcctgaagaggctcatcctgaacttcaggaagggctacagaagaaatgacaagcagctgtgcctgacagccagcaagtttgtggcccacctgatcaaccagaatgtggcccacgaggtgctgtgcctggagatgctgaccctgctgctggagcggcccacagatgattctgtggaggtggccatcggcttcctgaaggaatgtggcctgaagctgacccaggtgagcccccggggcatcaatgccatctttgagcggctgaggaacatcctgcacgagagcgagattgacaagagggtgcagtacatgattgaggtgatgtttgctgtgaggaaggatggcttcaaggaccaccccatcatcctggagggcctggacctggtggaggaggatgaccagttcacccacatgctgcccctggaggatgactacaacccagaagatgtgctgaatgtgttcaagatggaccccaacttcatggagaatgaggagaagtacaaggccatcaagaaggagatcctggatgaaggagacacagacagcaacacagaccaggatgctggcagcagcgaggaggatgaggaggaggaggaggaggagggggaggaggatgaggagggccagaaggtgaccatccatgacaagacagagatcaacctggtgtccttccggaggaccatctacctggccatccagagcagcctggactttgaagaatgtgcccacaagctgctgaagatggagttccctgagagccagaccaaggagctgtgcaacatgatcctggactgctgtgcccagcagaggacctatgagaagttcttcggcctgctggccggccgcttctgcatgctgaagaaggagtacatggagagctttgagggcatcttcaaggagcagtatgacaccatccaccggctggagaccaacaagctgagaaatgtggccaagatgtttgcccacctgctgtacacagacagcctgccctggagcgtgctggagtgcatcaagctgtctgaggagaccaccaccagcagcagccgcatctttgtgaagatcttcttccaggagctgtgtgagtacatgggcctgcccaagctgaatgcccggctgaaggatgagaccctgcagcccttctttgagggcctgctgccccgggacaaccccaggaacaccaggtttgccatcaacttcttcaccagcatcggcctgggcggcctgacagatgagctgcgggagcacctgaagaacacccccaaggtgattgtggcccagaagccagatgtggagcagaacaagagcagccccagcagcagcagcagcgccagcagcagcagcgagagtgacagcagtgacagcgacagcgacagcagtgacagcagcagcgagagcagcagcgaggagagtgacagcagcagcatcagcagccacagcagcgccagcgccaatgatgtgaggaagaagggccacggcaagaccaggagcaaggaggtggacaagctgatccggaaccagcagaccaatgacaggaagcagaagtag

SEQ ID NO: 15278 - DNA, 2727 bp, Artificial Sequence
  Description of Artificial Sequence: Synthetic coding sequence
atgaagagctctgtggcccagatcaagcccagcagcggccatgaccggcgggagaacctgaacagctaccagaggaacagcagccctgaggacagatatgaggagcaggagaggagcccccgggaccgggactactttgactacagcagaagtgactatgagcacagcagaagaggccgctcctatgacagctccatggagagcaggaacagagaccgggagaagaggcgggagcgggagcgggacacagacaggaagaggagcaggaagagccccagccctggaagaagaaatcctgagacctctgtgacccagagcagcagcgcccaggatgagcccgccaccaagaagaagaaggatgagctggaccccctgctgaccaggactggaggagcctacatccccccagccaagctgaggatgatgcaggagcagatcacagacaagaacagcctggcctaccagaggatgtcctgggaggccctgaagaagagcatcaatggcctcatcaacaaggtgaacatcagcaacatcagcatcatcatccaggagctgctgcaggagaacatcgtgcggggccggggcctgctgagccgctctgtgctgcaggcccagagcgccagccccatcttcacccacgtgtatgctgccctggtggccatcatcaacagcaagttcccccagattggagagctgatcctgaagaggctcatcctgaacttcaggaagggctacagaagaaatgacaagcagctgtgcctgacagccagcaagtttgtggcccacctgatcaaccagaatgtggcccacgaggtgctgtgcctggagatgctgaccctgctgctggagcggcccacagatgattctgtggaggtggccatcggcttcctgaaggaatgtggcctgaagctgacccaggtgagcccccggggcatcaatgccatctttgagcggctgaggaacatcctgcacgagagcgagattgacaagagggtgcagtacatgattgaggtgatgtttgctgtgaggaaggatggcttcaaggaccaccccatcatcctggagggcctggacctggtggaggaggatgaccagttcacccacatgctgcccctggaggatgactacaacccagaagatgtgctgaatgtgttcaagatggaccccaacttcatggagaatgaggagaagtacaaggccatcaagaaggagatcctggatgaaggagacacagacagcaacacagaccaggatgctggcagcagcgaggaggatgaggaggaggaggaggaggagggggaggaggatgaggagggccagaaggtgaccatccatgacaagacagagatcaacctggtgtccttccggaggaccatctacctggccatccagagcagcctggactttgaagaatgtgcccacaagctgctgaagatggagttccctgagagccagaccaaggagctgtgcaacatgatcctggactgctgtgcccagcagaggacctatgagaagttcttcggcctgctggccggccgcttctgcatgctgaagaaggagtacatggagagctttgagggcatcttcaaggagcagtatgacaccatccaccggctggagaccaacaagctgagaaatgtggccaagatgtttgcccacctgctgtacacagacagcctgccctggagcgtgctggagtgcatcaagctgtctgaggagaccaccaccagcagcagccgcatctttgtgaagatcttcttccaggagctgtgtgagtacatgggcctgcccaagctgaatgcccggctgaaggatgagaccctgcagcccttctttgagggcctgctgccccgggacaaccccaggaacaccaggtttgccatcaacttcttcaccagcatcggcctgggcggcctgacagatgagctgcgggagcacctgaagaacacccccaaggtgattgtggcccagaagccagatgtggagcagaacaagagcagccccagcagcagcagcagcgccagcagcagcagcgagagtgacagcagtgacagcgacagcgacagcagtgacagcagcagcgagagcagcagcgaggagagtgacagcagcagcatcagcagccacagcagcgccagcgccaatgatgtgaggaagaagggccacggcaagaccaggagcaaggaggtggacaagctgatccggaaccagcagaccaatgacaggaagcagaaggagcggcggcaggagcacggccaccaggagaccaggacagagcgggagcggcgctctgagaagcaccgggaccagaacagcagcggcagcaactggagggaccccatcaccaagtacaccagtgacaaggatgtgcccagcgagaggaacaactacagccgggtggccaatgaccgggaccaggagatgcacatcgacctggagaacaagcacggggaccccaagaagaagagaggagagaggagaaattccttctctgaaaatgagaagcacacccaccgcatcaaggacagcgagaacttccggaggaaggacaggagcaagagcaaggagatgaacaggaagcacagcggcagcagaagtgatgaggaccgctaccagaatggagctgagcggcgctgggagaagagcagccgctacagcgagcagagccgggagagcaagaagaaccaggacagaagaagagagaagagccctgccaagcagaagtag

SEQ ID NO: 15279 - DNA, 1419 bp, Artificial Sequence
  Description of Artificial Sequence: Synthetic coding sequence
atgagcaacatctacatccaggagccccccaccaacgggaaggtgctgctgaagaccacagctggggacatcgacatcgagctgtggagcaaggaggcccccaaggcctgcaggaacttcatccagctgtgcctggaggcctactatgacaacaccatcttccaccgggtggtgcccggcttcatcgtgcagggcggggaccccactggaactggaagtggaggagagagcatctatggagcccccttcaaggatgagttccacagccggctgcgcttcaacagaagaggcctggtggccatggccaatgccggcagccatgacaatggcagccagttcttcttcaccctgggccgggcagatgagctgaacaacaagcacaccatctttgggaaggtgactggagacacagtgtacaacatgctgcggctgtctgaggtggacattgatgatgatgagcggccccacaacccccacaagatcaagagctgtgaggtgctcttcaacccctttgatgacatcatcccccgggagatcaagaggctgaagaaggagaagccagaggaggaggtgaagaagctgaagcccaagggcaccaagaacttcagcctgctgagctttggagaggaggccgaggaggaggaggaggaggtgaacagagtgtcccagagcatgaagggcaagagcaagagcagccatgacctgctgaaggatgacccccacctgagctctgtgcctgtggtggagagcgagaagggagatgccccagacctggtggatgatggagaagatgagagcgctgagcatgatgagtacattgatggagatgagaagaacctgatgagggagagaattgccaagaagctgaagaaggacaccagcgccaacgtgaagtctgctggggagggggaggtggagaagaagtctgtgagccgctctgaggagctgaggaaggaggcccggcagctgaagcgggagctgctggccgccaagcagaagaaggtggagaatgctgccaagcaggccgagaagaggtctgaggaggaggaggcccccccagatggagctgtggccgagtacagaagagagaagcagaagtatgaggccctgaggaagcagcagagcaagaagggcaccagccgggaggaccagaccctggccctgctgaaccagttcaagagcaagctgacccaggccatcgccgagaccccagaaaatgacatccctgagacagaggtggaggatgatgagggctggatgagccacgtgctgcagtttgaggacaagagcaggaaggtgaaggatgcctccatgcaggacagcgacacctttgagatctatgaccccaggaaccctgtgaacaagagaagaagagaggagagcaagaagctgatgagggagaagaaggagaggaggtag

SEQ ID NO: 15280 - DNA, 1173 bp, Artificial Sequence
  Description of Artificial Sequence: Synthetic coding sequence
atgagcaacatctacatccaggagccccccaccaacgggaaggtgctgctgaagaccacagctggggacatcgacatcgagctgtggagcaaggaggcccccaaggcctgcaggaacttcatccagctgtgcctggaggcctactatgacaacaccatcttccaccgggtggtgcccggcttcatcgtgcagggcggggaccccactggaactggaagtggaggagagagcatctatggagcccccttcaaggatgagttccacagccggctgcgcttcaacagaagaggcctggtggccatggccaatgccggcagccatgacaatggcagccagttcttcttcaccctgggccgggcagatgagctgaacaacaagcacaccatctttgggaaggtgactggagacacagtgtacaacatgctgcggctgtctgaggtggacattgatgatgatgagcggccccacaacccccacaagatcaagagctgtgaggtgctcttcaacccctttgatgacatcatcccccgggagatcaagaggctgaagaaggagaagccagaggaggaggtgaagaagctgaagcccaagggcaccaagaacttcagcctgctgagctttggagaggaggccgaggaggaggaggaggaggtgaacagagtgtcccagagcatgaagggcaagagcaagagcagccatgacctgctgaaggatgacccccacctgagctctgtgcctgtggtggagagcgagaagggagatgccccagacctggtggatgatggagaagatgagagcgctgagcatgatgagtacattgatggagatgagaagaacctgatgagggagagaattgccaagaagctgaagaaggacaccagcgccaacgtgaagtctgctggggagggggaggtggagaagaagtctgtgagccgctctgaggagctgaggaaggaggcccggcagctgaagcgggagctgctggccgccaagcagaagaaggtggagaatgctgccaagcaggccgagaagaggtctgaggaggaggaggcccccccagatggagctgtggccgagtacagaagagagaagcagaagtatgaggccctgaggaagcagcagagcaagaagggcaccagccgggaggaccaggagatcaccaagagcagctag

SEQ ID NO: 15281 - DNA, 1971 bp, Artificial Sequence
  Description of Artificial Sequence: Synthetic coding sequence
atggagggagatggcagtgaccctgagcccccagatgctggggaggacagcaagtcagaaaatggagaaaatgcccccatctactgcatctgcaggaagccagacatcaactgcttcatgattggctgtgacaactgcaatgagtggttccatggagactgcatccgcatcacagagaagatggccaaggccatccgggagtggtactgccgggagtgccgggagaaggaccccaagctggagatccgctaccgccacaagaagagccgggagagagatggaaatgaaagagacagcagcgagcccagagatgagggcggcggcaggaagaggcctgtgcctgaccctgacctgcagaggcgggccggcagcggcaccggggtgggcgccatgctggcccggggcagcgccagcccccacaagagcagcccccagcccctggtggccacccccagccagcaccaccagcagcagcagcagcagatcaagaggtctgccaggatgtgtggagaatgtgaggcctgcagaagaacagaggactgtggccactgtgacttctgccgggacatgaagaagtttggaggccccaacaagatccggcagaagtgccgcctgcggcagtgccagctgcgggcccgggagagctacaagtacttccccagcagcctgagccctgtgaccccatctgagagcctgccccggccccggcggcccctgcccacccagcagcagccccagcccagccagaagctgggccgcatccgggaggatgaaggagctgtggccagcagcacagtgaaggagcccccagaggccacagccaccccagagcccctgagtgatgaggacctgcccctggaccctgacctgtaccaggacttctgtgccggggcctttgatgaccacggcctgccctggatgtctgacacagaggagagccccttcctggaccctgccctgaggaagagagctgtgaaggtgaagcacgtgaagaggcgggagaagaagtctgagaagaagaaggaggagcgctacaagaggcaccggcagaagcagaagcacaaggacaagtggaagcaccctgagcgggcagatgccaaggaccctgccagcctgccccagtgcctgggccctggctgtgtgcggcctgcccagcccagcagcaagtactgcagtgatgactgtggcatgaagctggccgccaaccgcatctatgagatcctgccccagaggatccagcagtggcagcagagcccctgcatcgccgaggagcacggcaagaagctgctggagcgcatccggcgggagcagcagagcgcccggacccggctgcaggagatggagcggcgcttccacgagctggaggccatcatcctgcgggccaagcagcaggccgtgcgggaggatgaggagagcaatgaaggagacagtgatgacacagacctgcagatcttctgtgtgtcctgtggccaccccatcaacccccgggtggccctgcggcacatggagcgctgctacgccaagtatgagagccagaccagctttggctccatgtaccccaccagaattgaaggagccaccaggctcttctgtgatgtgtacaacccccagagcaagacctactgcaagaggctgcaggtgctgtgcccagagcacagccgggaccccaaggtgcctgcagatgaggtgtgtggctgccccctggtgagagatgtgtttgagctgaccggggacttctgccgcctgcccaagaggcagtgcaacagacactactgctgggagaagctgcggcgggcagaggtggacctggagcgggtgcgggtgtggtacaagctggatgagctgtttgagcaggagagaaatgtgaggacagccatgaccaacagagctggcctgctggccctgatgctgcaccagaccatccagcacgaccccctgaccacagacctgcggagcagcgctgacagatag

SEQ ID NO: 15282 - DNA, 1983 bp, Artificial Sequence
  Description of Artificial Sequence: Synthetic coding sequence
atggagggagatggcagtgaccctgagcccccagatgctggggaggacagcaagtcagaaaatggagaaaatgcccccatctactgcatctgcaggaagccagacatcaactgcttcatgattggctgtgacaactgcaatgagtggttccatggagactgcatccgcatcacagagaagatggccaaggccatccgggagtggtactgccgggagtgccgggagaaggaccccaagctggagatccgctaccgccacaagaagagccgggagagagatggaaatgaaagagacagcagcgagcccagagatgagggcggcggcaggaagaggcctgtgcctgaccctgacctgcagaggcgggccggcagcggcaccggggtgggcgccatgctggcccggggcagcgccagcccccacaagagcagcccccagcccctggtggccacccccagccagcaccaccagcagcagcagcagcagatcaagaggtctgccaggatgtgtggagaatgtgaggcctgcagaagaacagaggactgtggccactgtgacttctgccgggacatgaagaagtttggaggccccaacaagatccggcagaagtgccgcctgcggcagtgccagctgcgggcccgggagagctacaagtacttccccagcagcctgagccctgtgaccccatctgagagcctgccccggccccggcggcccctgcccacccagcagcagccccagcccagccagaagctgggccgcatccgggaggatgaaggagctgtggccagcagcacagtgaaggagcccccagaggccacagccaccccagagcccctgagtgatgaggacctgcccctggaccctgacctgtaccaggacttctgtgccggggcctttgatgaccacggcctgccctggatgtctgacacagaggagagccccttcctggaccctgccctgaggaagagagctgtgaaggtgaagcacgtgaagaggcgggagaagaagtctgagaagaaggtgatggagaggaaggaggagcgctacaagaggcaccggcagaagcagaagcacaaggacaagtggaagcaccctgagcgggcagatgccaaggaccctgccagcctgccccagtgcctgggccctggctgtgtgcggcctgcccagcccagcagcaagtactgcagtgatgactgtggcatgaagctggccgccaaccgcatctatgagatcctgccccagaggatccagcagtggcagcagagcccctgcatcgccgaggagcacggcaagaagctgctggagcgcatccggcgggagcagcagagcgcccggacccggctgcaggagatggagcggcgcttccacgagctggaggccatcatcctgcgggccaagcagcaggccgtgcgggaggatgaggagagcaatgaaggagacagtgatgacacagacctgcagatcttctgtgtgtcctgtggccaccccatcaacccccgggtggccctgcggcacatggagcgctgctacgccaagtatgagagccagaccagctttggctccatgtaccccaccagaattgaaggagccaccaggctcttctgtgatgtgtacaacccccagagcaagacctactgcaagaggctgcaggtgctgtgcccagagcacagccgggaccccaaggtgcctgcagatgaggtgtgtggctgccccctggtgagagatgtgtttgagctgaccggggacttctgccgcctgcccaagaggcagtgcaacagacactactgctgggagaagctgcggcgggcagaggtggacctggagcgggtgcgggtgtggtacaagctggatgagctgtttgagcaggagagaaatgtgaggacagccatgaccaacagagctggcctgctggccctgatgctgcaccagaccatccagcacgaccccctgaccacagacctgcggagcagcgctgacagatag

SEQ ID NO: 15283 - DNA, 834 bp, Artificial Sequence
  Description of Artificial Sequence: Synthetic coding sequence
atgagcctgtgtgaggacatgctgctgtgcaactacaggaagtgccgcatcaagctgagcggctacgcctgggtgacagcctgcagccacatcttctgtgaccagcacggcagcggggagttcagccgcagccctgccatctgcccagcctgcaacagcaccctgagcggcaagctggacatcgtgaggacagagctgagccccagcgaggagtacaaggccatggtgctggccggcctgcggcctgagatcgtgctggacatcagcagccgggccctggccttctggacctaccaggtgcaccaggagcggctgtaccaggagtacaacttcagcaaggccgagggccacctgaagcagatggagaagatctacacccagcagatccagagcaaggatgtggagctgacctccatgaagggggaggtgacctccatgaagaaggtgctggaggagtacaagaagaagttcagtgacatcagcgagaagctgatggagaggaaccggcagtaccagaagctgcagggcctgtatgacagcctgcggctgaggaacatcaccatcgccaaccacgagggcaccctggagcccagcatgattgcccagagcggcgtgctgggcttccccctgggcaacaacagcaagttccccctggacaacacccctgtgaggaacagaggagatggagatggagacttccagttccggcccttctttgctggcagccccacagcccctgagcccagcaacagcttcttctcctttgtgagccccagccgggagctggagcagcagcaggtgagcagccgggccttcaaggtgaagaggatctag

SEQ ID NO: 15284 - DNA, 834 bp, Artificial Sequence; identical to SEQ ID NO: 15283
  Description of Artificial Sequence: Synthetic coding sequence

SEQ ID NO: 15285 - DNA, 834 bp, Artificial Sequence; identical to SEQ ID NO: 15283
  Description of Artificial Sequence: Synthetic coding sequence

SEQ ID NO: 15286 - DNA, 834 bp, Artificial Sequence; identical to SEQ ID NO: 15283
  Description of Artificial Sequence: Synthetic coding sequence

SEQ ID NO: 15287 - DNA, 834 bp, Artificial Sequence; identical to SEQ ID NO: 15283
  Description of Artificial Sequence: Synthetic coding sequence

SEQ ID NO: 15288 - DNA, 834 bp, Artificial Sequence; identical to SEQ ID NO: 15283
  Description of Artificial Sequence: Synthetic coding sequence

SEQ ID NO: 15289 - DNA, 15 bp, Artificial Sequence
  Description of Artificial Sequence: Synthetic coding sequence
atgagcctgtgctag

SEQ ID NO: 15290 - DNA, 465 bp, Artificial Sequence
  Description of Artificial Sequence: Synthetic coding sequence
atgagcctgtgtgaggacatgctgctgtgcaactacaggaagtgccgcatcaagctgagcggctacgcctgggtgacagcctgcagccacatcttctgtgaccagcacggcagcggggagttcagccgcagccctgccatctgcccagcctgcaacagcaccctgagcggcaagctggacatcgtgaggacagagctgagccccagcgaggagtacaaggccatggtgctggccggcctgcggcctgagatcgtgctggacatcagcagccgggccctggccttctggacctaccaggtgcaccaggagcggctgtaccaggagtacaacttcagcaaggccgagggccacctgaagcagatggagaagatctacacccagcagatccagagcaaggatgtggagctgacctccatgaagggggaggtgacctccatgaagaaggtgctggaggagtacaagtag

SEQ ID NO: 15291 - DNA, 1119 bp, Artificial Sequence
  Description of Artificial Sequence: Synthetic coding sequence
atggagctggagggccagtggtggaggggccagctggccgctgacatccaccaggccctgcgctacaaggagctgaagctgcccagctacaagggccagagcccccagctgagcctgcggcgctactttgctgacctgattgccatcgtgagcaaccgcttcaccctgtgccccagcgcccggcacctggccgtgtacctgctggacctcttcatggacagatatgacatcagcatccagcagctgcacctggtggccctgagctgcctgctgctggccagcaagtttgaggagaaggaggacagcgtgcccaagctggagcagctgaacagcctgggctgcatgaccaacatgaacctggtgctgaccaagcagaacctgctgcacatggagctgctgctgctggagaccttccagtggaacctgtgcctgcccacagctgcccacttcatcgagtactacctgtctgaggccgtgcatgaaacagacctgcatgatggctggcccatgatctgcctggagaagaccaagctgtacatggccaagtatgctgactacttcctggaggtgtccctgcaggtggccgccgcctgtgtggccagcagccgcatcatcctgcggctgagccccacctggcccacccggctgcaccggctgacagcctacagctgggacttcctggtgcagtgcatcgagcggctgctgattgcccatgacaatgatgtgaaggaggccaacaagcagaggggccaggccggcccccagagcgcccagctgagcgtcttccagacagccagccagcccagcaggcctgtgcacttccagcagccccagtacctgcaccagacccaccagaccagcctgcagtaccgccaccccaccagcgagcagcccagctgccagcagatcgtgtccaccacccacaccagcagctacaccctgcagacctgcccagctggcttccagacctctgtgcagggcctgggccacatgcagacaggagtgggcatgagcctggccatccctgtggaggtgaagccctgcctgtctgtgtcctacaacagaagctaccagatcaatgagcactacccctgcatcaccccctgctttgagaggtag

SEQ ID NO: 15292 - DNA, 1116 bp, Artificial Sequence
  Description of Artificial Sequence: Synthetic coding sequence
atggagctggagggccagtggtggaggggccagctggccgctgacatccaccaggccctgcgctacaaggagctgaagctgcccagctacaagggccagagcccccagctgagcctgcggcgctactttgctgacctgattgccatcgtgagcaaccgcttcaccctgtgccccagcgcccggcacctggccgtgtacctgctggacctcttcatggacagatatgacatcagcatccagcagctgcacctggtggccctgagctgcctgctgctggccagcaagtttgaggagaaggaggacagcgtgcccaagctggagcagctgaacagcctgggctgcatgaccaacatgaacctggtgctgaccaagcagaacctgctgcacatggagctgctgctgctggagaccttccagtggaacctgtgcctgcccacagctgcccacttcatcgagtactacctgtctgaggccgtgcatgaaacagacctgcatgatggctggcccatgatctgcctggagaagaccaagctgtacatggccaagtatgctgactacttcctggaggtgtccctgcaggccgccgcctgtgtggccagcagccgcatcatcctgcggctgagccccacctggcccacccggctgcaccggctgacagcctacagctgggacttcctggtgcagtgcatcgagcggctgctgattgcccatgacaatgatgtgaaggaggccaacaagcagaggggccaggccggcccccagagcgcccagctgtctgtgttccagacagccagccagcccagcaggcctgtgcacttccagcagccccagtacctgcaccagacccaccagaccagcctgcagtaccgccaccccaccagcgagcagcccagctgccagcagatcgtgtccaccacccacaccagcagctacaccctgcagacctgcccagctggcttccagacctctgtgcagggcctgggccacatgcagacaggagtgggcatgagcctggccatccctgtggaggtgaagccctgcctgtctgtgtcctacaacagaagctaccagatcaatgagcactacccctgcatcaccccctgctttgaaagatag

SEQ ID NO: 15293 - DNA, 1152 bp, Artificial Sequence
  Description of Artificial Sequence: Synthetic coding sequence
atggagctggagggccagtggtggaggggccagctggccgctgacatccaccaggccctgcgctacaaggagctgaagctgcccagctacaagggccagagcccccagctgagcctgcggcgctactttgctgacctgattgccatcgtgagcaaccgcttcaccctgtgccccagcgcccggcacctggccgtgtacctgctggacctcttcatggacagatatgacatcagcatccagcagctgcacctggtggccctgagctgcctgctgctggccagcaagtttgaggagaaggaggacagcgtgcccaagctggagcagctgaacagcctgggctgcatgaccaacatgaacctggtgctgaccaagcagaacctgctgcacatggagctgctgctgctggagaccttccagtggaacctgtgcctgcccacagctgcccacttcatcgagtactacctgtctgaggccgtgcatgaaacagacctgcatgatggctggcccatgatctgcctggagaagaccaagctgtacatggccaagtatgctgactacttcctggaggtgtccctgcaggactatgccttcctgaactatgcccccagcctggtggccgccgcctgtgtggccagcagccgcatcatcctgcggctgagccccacctggcccacccggctgcaccggctgacagcctacagctgggacttcctggtgcagtgcatcgagcggctgctgattgcccatgacaatgatgtgaaggaggccaacaagcagaggggccaggccggcccccagagcgcccagctgtctgtgttccagacagccagccagcccagcaggcctgtgcacttccagcagccccagtacctgcaccagacccaccagaccagcctgcagtaccgccaccccaccagcgagcagcccagctgccagcagatcgtgtccaccacccacaccagcagctacaccctgcagacctgcccagctggcttccagacctctgtgcagggcctgggccacatgcagacaggagtgggcatgagcctggccatccctgtggaggtgaagccctgcctgtctgtgtcctacaacagaagctaccagatcaatgagcactacccctgcatcaccccctgctttgaaagatag

SEQ ID NO: 15294 - DNA, 1119 bp, Artificial Sequence; identical to SEQ ID NO: 15291
  Description of Artificial Sequence: Synthetic coding sequence

SEQ ID NO: 15295 - DNA, 4446 bp, Artificial Sequence
  Description of Artificial Sequence: Synthetic coding sequence
atgcccaacagcgagagacatggaggcaagaaggatggcagcggcggggccagcggcaccctgcagcccagcagcggcggcggcagcagcaacagccgggagcggcaccggctggtgtccaagcacaagaggcacaagagcaagcacagcaaggacatgggcctggtgaccccagaggccgccagcctgggcaccgtcatcaagcccctggtggagtatgatgacatcagcagtgacagcgacaccttcagtgatgacatggccttcaagctggacagaagagaaaatgatgaaagaagaggaagtgacagaagtgaccggctgcacaagcaccgccaccaccagcacagaagaagccgggacctgctgaaggccaagcagacagagaaggagaagagccaggaggtgagcagcaagagcggctccatgaaggaccgcatcagcggcagcagcaagaggagcaatgaggagacagatgattatggcaaggcccaggtggccaagagcagcagcaaggagagccgcagcagcaagctgcacaaggagaagaccaggaaggagcgggagctgaagagcggccacaaggacaggagcaagagccacaggaagcgggagacccccaagagctacaagacagtggacagccccaagaggaggagccgcagcccccacaggaagtggagcgacagcagcaagcaggatgacagccccagcggggccagctatggccaggactatgacctgagccccagccgcagccacaccagcagcaactatgacagctacaagaagagccctggcagcaccagccggcggcagagcgtgtccccaccctacaaggagcccagcgcctaccagagcagcaccaggagccccagcccctacagccggcggcagaggtctgtgagcccctacagcagaagaagaagcagcagctatgaaagaagtggcagctacagcggccgcagccccagcccctatggaagaagaagaagcagcagccccttcctgagcaagaggagcctgagccgcagccccctgcccagcaggaagtccatgaagagccgcagccgcagccctgcctacagccgccacagcagcagccacagcaagaagaagaggagcagcagccgcagccgccacagcagcatcagccctgtgcggctgcccctgaacagcagcctgggcgctgagctgagcaggaagaagaaggagagagctgctgctgctgctgctgccaagatggatggcaaggagagcaagggcagccctgtgttcctgcccaggaaagaaaacagctctgtggaggccaaggacagcggcctggagagcaagaagctgcccaggtctgtgaagctggagaagagcgccccagacacagagctggtgaatgtgacccacctgaacacagaggtgaagaacagcagtgacaccgggaaggtgaagctggatgaaaattctgagaagcacctggtgaaggacctgaaggcccagggcacccgggacagcaagcccatcgccctgaaggaggagatcgtgacccccaaggagacagagaccagcgagaaggagaccccaccacccctgcccaccatcgccagccccccaccacccctgcccaccaccaccccaccaccccagaccccacccctgccccccctgccccccatcccagccctgccccagcagccccccctgccccccagccagcctgccttcagccaggtgcctgccagcagcaccagcaccctgccccccagcacccacagcaagaccagcgctgtgagcagccaggccaacagccagccccctgtgcaggtgtctgtgaagacccaggtgtctgtgacagctgccatcccccacctgaagaccagcaccctgccccccctgcccctgccccccctgctgcctggagatgatgacatggacagccccaaggagaccctgcccagcaagcctgtgaagaaggagaaggagcagaggaccaggcacctgctgacagacctgcccctgcccccagagctgcccggcggggacctgagccccccagacagccctgagcccaaggccatcaccccaccccagcagccctacaagaagaggcccaagatctgctgccccaggtatggagagcggcggcagacagaaagtgactggggcaagagatgtgtggacaagtttgacatcatcggcatcattggagagggcacctacggccaggtgtacaaggccaaggacaaggacacaggagagctggtggccctgaagaaggtgcggctggacaatgagaaggagggcttccccatcacagccatccgggagatcaagatcctgcggcagctgatccacaggtctgtggtgaacatgaaggagatcgtgacagacaagcaggatgccctggacttcaagaaggacaagggggccttctacctggtgtttgagtacatggaccatgacctgatgggcctgctggagagcggcctggtgcacttcagcgaggaccacatcaagagcttcatgaagcagctgatggagggcctggagtactgccacaagaagaacttcctgcaccgggacatcaagtgcagcaacatcctgctgaacaacagcggccagatcaagctggccgactttggcctggcccggctgtacaacagcgaggagagccggccctacaccaacaaggtgatcaccctgtggtacagacctcctgagctgctgctgggggaggagcgctacaccccagccattgatgtgtggagctgtggctgcatcctgggggagctgttcaccaagaagcccatcttccaggccaacctggagctggcccagctggagctgatcagccggctgtgtggcagcccctgcccagctgtgtggccagatgtgatcaagctgccctacttcaacaccatgaagcccaagaagcagtacagaagaaggctgcgggaggagttctccttcatccccagcgctgccctggacctgctggaccacatgctgaccctggaccccagcaagcgctgcacagctgagcagaccctgcagagcgacttcctgaaggatgtggagctgagcaagatggcccccccagacctgccccactggcaggactgccacgagctgtggagcaagaagagaagacggcagaggcagagcggcgtggtggtggaggagcccccacccagcaagaccagcaggaaggagaccaccagcggcaccagcacagagcctgtgaagaacagcagccctgccccaccccagcctgcccctgggaaggtggagagcggggctggagatgccatcggcctggccgacatcacccagcagctgaaccagagcgagctggccgtgctgctgaacctgctgcagagccagacagacctgagcatcccccagatggcccagctgctgaacatccacagcaaccctgagatgcagcagcagctggaggccctgaaccagagcatcagcgccctgacagaggccaccagccagcagcaggacagcgagaccatggcccctgaggagagcctgaaggaggcccccagcgcccctgtgatcctgcccagcgctgagcagaccaccctggaggccagcagcaccccagctgacatgcagaacatcctggccgtgctgctgagccagctgatgaagacccaggagcccgccggcagcctggaggagaacaacagcgacaagaacagcggcccccagggccccaggaggacccccaccatgccccaggaggaggccgctgagaagaggcctcctgagcccccaggccccccacctcctcctcctcctccacccctggtggagggggacctgagcagcgccccccaggagctgaacccagctgtgacagctgccctgctgcagctgctgagccagcctgaggccgagcccccaggccacctgccccatgagcaccaggccctgcggcccatggagtacagcacccggccccggcccaacagaacctacggcaacacagatggccctgagaccggcttcagcgccatcgacacagatgaaagaaattctggccctgccctgacagagagcctggtgcagaccctggtgaagaacagaaccttcagcggcagcctgagccacctgggggagagcagcagctaccagggcactggatctgtgcagtttcctggggaccaggacctgcgctttgcccgggtgcccctggccctgcaccctgtggtgggccagcccttcctgaaggccgagggcagcagcaacagcgtggtgcacgccgagaccaagctgcagaactatggagagctgggccctggcaccactggagccagcagcagcggggccggcctgcactggggcggccccacccagagcagcgcctacggcaagctgtaccggggccccaccagggtgcccccccggggcggccggggccggggcgtgccctactag

SEQ ID NO: 15296 - DNA, 4473 bp, Artificial Sequence
  Description of Artificial Sequence: Synthetic coding sequence
atgcccaacagcgagagacatggaggcaagaaggatggcagcggcggggccagcggcaccctgcagcccagcagcggcggcggcagcagcaacagccgggagcggcaccggctggtgtccaagcacaagaggcacaagagcaagcacagcaaggacatgggcctggtgaccccagaggccgccagcctgggcaccgtcatcaagcccctggtggagtatgatgacatcagcagtgacagcgacaccttcagtgatgacatggccttcaagctggacagaagagaaaatgatgaaagaagaggaagtgacagaagtgaccggctgcacaagcaccgccaccaccagcacagaagaagccgggacctgctgaaggccaagcagacagagaaggagaagagccaggaggtgagcagcaagagcggctccatgaaggaccgcatcagcggcagcagcaagaggagcaatgaggagacagatgattatggcaaggcccaggtggccaagagcagcagcaaggagagccgcagcagcaagctgcacaaggagaagaccaggaaggagcgggagctgaagagcggccacaaggacaggagcaagagccacaggaagcgggagacccccaagagctacaagacagtggacagccccaagaggaggagccgcagcccccacaggaagtggagcgacagcagcaagcaggatgacagccccagcggggccagctatggccaggactatgacctgagccccagccgcagccacaccagcagcaactatgacagctacaagaagagccctggcagcaccagccggcggcagagcgtgtccccaccctacaaggagcccagcgcctaccagagcagcaccaggagccccagcccctacagccggcggcagaggtctgtgagcccctacagcagaagaagaagcagcagctatgaaagaagtggcagctacagcggccgcagccccagcccctatggaagaagaagaagcagcagccccttcctgagcaagaggagcctgagccgcagccccctgcccagcaggaagtccatgaagagccgcagccgcagccctgcctacagccgccacagcagcagccacagcaagaagaagaggagcagcagccgcagccgccacagcagcatcagccctgtgcggctgcccctgaacagcagcctgggcgctgagctgagcaggaagaagaaggagagagctgctgctgctgctgctgccaagatggatggcaaggagagcaagggcagccctgtgttcctgcccaggaaagaaaacagctctgtggaggccaaggacagcggcctggagagcaagaagctgcccaggtctgtgaagctggagaagagcgccccagacacagagctggtgaatgtgacccacctgaacacagaggtgaagaacagcagtgacaccgggaaggtgaagctggatgaaaattctgagaagcacctggtgaaggacctgaaggcccagggcacccgggacagcaagcccatcgccctgaaggaggagatcgtgacccccaaggagacagagaccagcgagaaggagaccccaccacccctgcccaccatcgccagccccccaccacccctgcccaccaccaccccaccaccccagaccccacccctgccccccctgccccccatcccagccctgccccagcagccccccctgccccccagccagcctgccttcagccaggtgcctgccagcagcaccagcaccctgccccccagcacccacagcaagaccagcgctgtgagcagccaggccaacagccagccccctgtgcaggtgtctgtgaagacccaggtgtctgtgacagctgccatcccccacctgaagaccagcaccctgccccccctgcccctgccccccctgctgcctggagatgatgacatggacagccccaaggagaccctgcccagcaagcctgtgaagaaggagaaggagcagaggaccaggcacctgctgacagacctgcccctgcccccagagctgcccggcggggacctgagccccccagacagccctgagcccaaggccatcaccccaccccagcagccctacaagaagaggcccaagatctgctgccccaggtatggagagcggcggcagacagaaagtgactggggcaagagatgtgtggacaagtttgacatcatcggcatcattggagagggcacctacggccaggtgtacaaggccaaggacaaggacacaggagagctggtggccctgaagaaggtgcggctggacaatgagaaggagggcttccccatcacagccatccgggagatcaagatcctgcggcagctgatccacaggtctgtggtgaacatgaaggagatcgtgacagacaagcaggatgccctggacttcaagaaggacaagggggccttctacctggtgtttgagtacatggaccatgacctgatgggcctgctggagagcggcctggtgcacttcagcgaggaccacatcaagagcttcatgaagcagctgatggagggcctggagtactgccacaagaagaacttcctgcaccgggacatcaagtgcagcaacatcctgctgaacaacagcggccagatcaagctggccgactttggcctggcccggctgtacaacagcgaggagagccggccctacaccaacaaggtgatcaccctgtggtacagacctcctgagctgctgctgggggaggagcgctacaccccagccattgatgtgtggagctgtggctgcatcctgggggagctgttcaccaagaagcccatcttccaggccaacctggagctggcccagctggagctgatcagccggctgtgtggcagcccctgcccagctgtgtggccagatgtgatcaagctgccctacttcaacaccatgaagcccaagaagcagtacagaagaaggctgcgggaggagttctccttcatccccagcgctgccctggacctgctggaccacatgctgaccctggaccccagcaagcgctgcacagctgagcagaccctgcagagcgacttcctgaaggatgtggagctgagcaagatggcccccccagacctgccccactggcaggactgccacgagctgtggagcaagaagagaagacggcagaggcagagcggcgtggtggtggaggagcccccacccagcaagaccagcaggaaggagaccaccagcggcaccagcacagagcctgtgaagaacagcagccctgccccaccccagcctgcccctgggaaggtggagagcggggctggagatgccatcggcctggccgacatcacccagcagctgaaccagagcgagctggccgtgctgctgaacctgctgcagagccagacagacctgagcatcccccagatggcccagctgctgaacatccacagcaaccctgagatgcagcagcagctggaggccctgaaccagagcatcagcgccctgacagaggccaccagccagcagcaggacagcgagaccatggcccctgaggagagcctgaaggaggcccccagcgcccctgtgatcctgcccagcgctgagcagaccaccctggaggccagcagcaccccagctgacatgcagaacatcctggccgtgctgctgagccagctgatgaagacccaggagcccgccggcagcctggaggagaacaacagcgacaagaacagcggcccccagggccccaggaggacccccaccatgccccaggaggaggccgccgcctgccccccccacatcctgcccccagagaagaggcctcctgagcccccaggccccccacctcctcctcctcctccacccctggtggagggggacctgagcagcgccccccaggagctgaacccagctgtgacagctgccctgctgcagctgctgagccagcctgaggccgagcccccaggccacctgccccatgagcaccaggccctgcggcccatggagtacagcacccggccccggcccaacagaacctacggcaacacagatggccctgagaccggcttcagcgccatcgacacagatgagaggaacagcggccctgccctgacagagagcctggtgcagaccctggtgaagaacagaaccttcagcggcagcctgagccacctgggggagagcagcagctaccagggcaccggctctgtgcagtttcctggggaccaggacctgcgctttgcccgggtgcccctggccctgcaccctgtggtgggccagcccttcctgaaggccgagggcagcagcaacagcgtggtgcatgctgagaccaagctgcagaactacggggagctgggccctggcaccaccggggccagcagcagtggagctggcctgcactggggcggccccacccagagcagcgcctacggcaagctgtaccggggccccaccagggtgcccccccggggcggccggggccggggcgtgccctactag

SEQ ID NO: 15297 - DNA, 4539 bp, Artificial Sequence
  Description of Artificial Sequence: Synthetic coding sequence
atgcccagcagcagtgacacagccctgggcggcggcggcggcctgtcctgggccgagaagaagctggaggagaggaggaagagaagacgcttcctgagcccccagcagccccccctgctgctgcccctgctgcagccccagctgctgcagcccccacctcctcctccacccctgctcttcctggccgcccctggaacagctgctgctgctgctgctgctgctgctgccagcagcagctgcttcagccctggcccccccctggaggtgaagaggctggcccggggcaagagaagagctgggggccggcagaagagaagaagaggccccagggctggccaggaggccgagaagagaagagtcttcagcctgccccagccccagcaggacggcggcggcggggccagcagcggcggcggcgtgacccccctggtggagtatgaagatgtgagcagccagagcgagcagggcctgctgctgggcggggccagcgctgccacagctgccacagctgctgggggcaccggcggcagcggcggcagccctgccagcagcagcggcacccagaggagaggagagggcagcgagcggcggccccggcgggaccggcgcagcagcagcggccgcagcaaggagcggcaccgggagcacagaagaagagatggccagaggggcggcagcgaggccagcaagagccgcagccgccacagccacagcggggaggagagagctgaggtggccaagagcggcagcagcagcagcagcggcggccgcaggaagagcgccagcgccaccagcagcagcagcagcagcaggaaggaccgggacagcaaggcccacaggagcaggaccaagagcagcaaggagcccccatctgcctacaaggagccccccaaggcctaccgggaggacaagacagagcccaaggcctacagaagaagaagaagcctgagccccctgggcggcagagatgacagccctgtgagccaccgggccagccagagcctgcggagcaggaagagccccagccctgctgggggcggcagcagcccctacagccggcggctgcccaggagccccagcccctacagcagaagaagaagccccagctacagccgccacagcagctatgaaagaggaggagatgtgagccccagcccctacagcagcagctcctggaggaggagccgcagcccctacagccctgtgctgcggcgcagcggcaagagccgcagccgcagcccctacagcagccgccacagccgcagccgcagccgccaccggctgagccgcagccgcagccgccacagcagcatcagccccagcaccctgaccctgaagagcagcctggccgctgagctgaacaagaacaagaaggcccgggctgctgaggccgcccgggctgctgaggccgccaaggctgctgaggccaccaaggctgctgaggccgccgccaaggccgccaaggccagcaacaccagcacccccaccaagggcaacacagagaccagcgccagcgccagccagaccaaccacgtgaaggatgtgaagaagatcaagattgagcacgcccccagccccagcagcggcggcaccctgaagaatgacaaggccaagaccaagccacccctgcaggtgaccaaggtggagaacaacctgattgtggacaaggccaccaagaaggctgtgattgtgggcaaggagagcaagtctgctgccaccaaggaggagagcgtgtccctgaaggagaagaccaagcccctgacccccagcattggagccaaggagaaggagcagcacgtggccctggtgaccagcaccctgccccccctgcccctgccccccatgctgcctgaggacaaggaggccgacagcctgcggggcaacatctctgtgaaggctgtgaagaaggaggtggagaagaagctgcgctgcctgctggccgacctgcccctgcccccagagctgcctggaggagatgacctgagcaagagccctgaggagaagaagacagccacccagctgcacagcaagaggcggcccaagatctgtggccccaggtatggagagaccaaggagaaggacatcgactggggcaagagatgtgtggacaagtttgacatcatcggcatcattggagagggcacctacggccaggtgtacaaggcccgggacaaggacacaggagagatggtggccctgaagaaggtgcggctggacaatgagaaggagggcttccccatcacagccatccgggagatcaagatcctgcggcagctgacccaccagagcatcatcaacatgaaggagatcgtgacagacaaggaggatgccctggacttcaagaaggacaagggggccttctacctggtgtttgagtacatggaccatgacctgatgggcctgctggagagcggcctggtgcacttcaatgaaaaccacatcaagagcttcatgaggcagctgatggagggcctggactactgccacaagaagaacttcctgcaccgggacatcaagtgcagcaacatcctgctgaacaacagaggccagatcaagctggccgactttggcctggcccggctgtacagcagcgaggagagccggccctacaccaacaaggtgatcaccctgtggtacagacctcctgagctgctgctgggggaggagcgctacaccccagccattgatgtgtggagctgtggctgcatcctgggggagctgttcaccaagaagcccatcttccaggccaaccaggagctggcccagctggagctgatcagccgcatctgtggcagcccctgcccagctgtgtggccagatgtgatcaagctgccctacttcaacaccatgaagcccaagaagcagtacagaaggaagctgcgggaggagtttgtgttcatcccagctgctgccctggacctgtttgactacatgctggccctggaccccagcaagcgctgcacagctgagcaggccctgcagtgtgagttcctgagagatgtggagcccagcaagatgcctcctccagacctgcccctgtggcaggactgccacgagctgtggagcaagaagagaagacggcagaagcagatgggcatgacagatgatgtgtccaccatcaaggcccccaggaaggacctgagcctgggcctggatgacagcaggaccaacaccccccagggcgtgctgcccagcagccagctgaagagccagggcagcagcaatgtggcccctgtgaagacaggccctggccagcacctgaaccacagcgagctggccatcctgctgaacctgctgcagagcaagacctctgtgaacatggctgactttgtgcaggtgctgaacatcaaggtgaacagcgagacccagcagcagctgaacaagatcaacctgcctgctggcatcctggccaccggggagaagcagacagaccccagcaccccccagcaggagagcagcaagcccctgggcggcatccagcccagcagccagaccatccagcccaaggtggagacagatgctgcccaggccgctgtgcagagcgcctttgctgtgctgctgacccagctgatcaaggcccagcagagcaagcagaaggatgtgctgctggaggagagagaaaatggcagcggccacgaggccagcctgcagctgcggcccccacctgagcccagcacccctgtgtctggccaggatgacctgatccagcaccaggacatgaggatcctggagctgaccccagagccagaccggccccgcatcctgcccccagaccagaggcctcctgagcccccagagcccccacctgtgacagaggaggacctggactacagaacagagaaccagcacgtgcccaccaccagcagcagcctgacagacccccacgccggcgtgaaggccgccctgctgcagctgctggcccagcaccagccccaggatgaccccaagcgggagggcggcatcgactaccaggccggggacacctacgtgtccaccagtgactacaaggacaactttggcagcagcagcttcagcagcgccccctacgtgtccaatgatggcctgggcagcagcagcgccccacccctggagaggaggagcttcatcggcaacagcgacatccagagcctggacaactacagcacagccagcagccacagcggcggccccccccagcccagcgccttcagcgagagcttccccagctctgtggccggctatggagacatctacctgaatgccggccccatgctgttcagcggggacaaggaccacagatttgagtacagccacggccccatcgctgtgctggccaacagcagtgaccccagcactggacctgagagcacccaccccctgcctgccaagatgcacaactacaactacggcggcaacctgcaggagaaccccagcggccccagcctgatgcacggccagacctggaccagccctgcccagggccctggctacagccagggctaccggggccacatcagcaccagcacaggccggggccggggccggggcctgccctactag

SEQ ID NO: 15298 - DNA, 4359 bp, Artificial Sequence
  Description of Artificial Sequence: Synthetic coding sequence
atgcccagcagcagtgacacagccctgggcggcggcggcggcctgtcctgggccgagaagaagctggaggagaggaggaagagaagacgcttcctgagcccccagcagccccccctgctgctgcccctgctgcagccccagctgctgcagcccccacctcctcctccacccctgctcttcctggccgcccctggaacagctgctgctgctgctgctgctgctgctgccagcagcagctgcttcagccctggcccccccctggaggtgaagaggctggcccggggcaagagaagagctgggggccggcagaagagaagaagaggccccagggctggccaggaggccgagaagagaagagtcttcagcctgccccagccccagcaggacggcggcggcggggccagcagcggcggcggcgtgacccccctggtggagtatgaagatgtgagcagccagagcgagcagggcctgctgctgggcggggccagcgctgccacagctgccacagctgctgggggcaccggcggcagcggcggcagccctgccagcagcagcggcacccagaggagaggagagggcagcgagcggcggccccggcgggaccggcgcagcagcagcggccgcagcaaggagcggcaccgggagcacagaagaagagatggccagaggggcggcagcgaggccagcaagagccgcagccgccacagccacagcggggaggagagagctgaggtggccaagagcggcagcagcagcagcagcggcggccgcaggaagagcgccagcgccaccagcagcagcagcagcagcaggaaggaccgggacagcaaggcccacaggagcaggaccaagagcagcaaggagcccccatctgcctacaaggagccccccaaggcctaccgggaggacaagacagagcccaaggcctacagaagaagaagaagcctgagccccctgggcggcagagatgacagccctgtgagccaccgggccagccagagcctgcggagcaggaagagccccagccctgctgggggcggcagcagcccctacagccggcggctgcccaggagccccagcccctacagcagaagaagaagccccagctacagccgccacagcagctatgaaagaggaggagatgtgagccccagcccctacagcagcagctcctggaggaggagccgcagcccctacagccctgtgctgcggcgcagcggcaagagccgcagccgcagcccctacagcagccgccacagccgcagccgcagccgccaccggctgagccgcagccgcagccgccacagcagcatcagccccagcaccctgaccctgaagagcagcctggccgctgagctgaacaagaacaagaaggcccgggctgctgaggccgcccgggctgctgaggccgccaaggctgctgaggccaccaaggctgctgaggccgccgccaaggccgccaaggccagcaacaccagcacccccaccaagggcaacacagagaccagcgccagcgccagccagaccaaccacgtgaaggatgtgaagaagatcaagattgagcacgcccccagccccagcagcggcggcaccctgaagaatgacaaggccaagaccaagccacccctgcaggtgaccaaggtggagaacaacctgattgtggacaaggccaccaagaaggctgtgattgtgggcaaggagagcaagtctgctgccaccaaggaggagagcgtgtccctgaaggagaagaccaagcccctgacccccagcattggagccaaggagaaggagcagcacgtggccctggtgaccagcaccctgccccccctgcccctgccccccatgctgcctgaggacaaggaggccgacagcctgcggggcaacatctctgtgaaggctgtgaagaaggaggtggagaagaagctgcgctgcctgctggccgacctgcccctgcccccagagctgcctggaggagatgacctgagcaagagccctgaggagaagaagacagccacccagctgcacagcaagaggcggcccaagatctgtggccccaggtatggagagaccaaggagaaggacatcgactggggcaagagatgtgtggacaagtttgacatcatcggcatcattggagagggcacctacggccaggtgtacaaggcccgggacaaggacacaggagagatggtggccctgaagaaggtgcggctggacaatgagaaggagggcttccccatcacagccatccgggagatcaagatcctgcggcagctgacccaccagagcatcatcaacatgaaggagatcgtgacagacaaggaggatgccctggacttcaagaaggacaagggggccttctacctggtgtttgagtacatggaccatgacctgatgggcctgctggagagcggcctggtgcacttcaatgaaaaccacatcaagagcttcatgaggcagctgatggagggcctggactactgccacaagaagaacttcctgcaccgggacatcaagtgcagcaacatcctgctgaacaacagaggccagatcaagctggccgactttggcctggcccggctgtacagcagcgaggagagccggccctacaccaacaaggtgatcaccctgtggtacagacctcctgagctgctgctgggggaggagcgctacaccccagccattgatgtgtggagctgtggctgcatcctgggggagctgttcaccaagaagcccatcttccaggccaaccaggagctggcccagctggagctgatcagccgcatctgtggcagcccctgcccagctgtgtggccagatgtgatcaagctgccctacttcaacaccatgaagcccaagaagcagtacagaaggaagctgcgggaggagtttgtgttcatcccagctgctgccctggacctgtttgactacatgctggccctggaccccagcaagcgctgcacagctgagcaggccctgcagtgtgagttcctgagagatgtggagcccagcaagatgcctcctccagacctgcccctgtggcaggactgccacgagctgtggagcaagaagagaagacggcagaagcagatgggcatgacagatgatgtgtccaccatcaaggcccccaggaaggacctgagcctgggcctggatgacagcaggaccaacaccccccagggcgtgctgcccagcagccagctgaagagccagggcagcagcaatgtggcccctggagagaagcagacagaccccagcaccccccagcaggagagcagcaagcccctgggcggcatccagcccagcagccagaccatccagcccaaggtggagacagatgctgcccaggccgctgtgcagagcgcctttgctgtgctgctgacccagctgatcaaggcccagcagagcaagcagaaggatgtgctgctggaggagagagaaaatggcagcggccacgaggccagcctgcagctgcggcccccacctgagcccagcacccctgtgtctggccaggatgacctgatccagcaccaggacatgaggatcctggagctgaccccagagccagaccggccccgcatcctgcccccagaccagaggcctcctgagcccccagagcccccacctgtgacagaggaggacctggactacagaacagagaaccagcacgtgcccaccaccagcagcagcctgacagacccccacgccggcgtgaaggccgccctgctgcagctgctggcccagcaccagccccaggatgaccccaagcgggagggcggcatcgactaccaggccggggacacctacgtgtccaccagtgactacaaggacaactttggcagcagcagcttcagcagcgccccctacgtgtccaatgatggcctgggcagcagcagcgccccacccctggagaggaggagcttcatcggcaacagcgacatccagagcctggacaactacagcacagccagcagccacagcggcggccccccccagcccagcgccttcagcgagagcttccccagctctgtggccggctatggagacatctacctgaatgccggccccatgctgttcagcggggacaaggaccacagatttgagtacagccacggccccatcgctgtgctggccaacagcagtgaccccagcactggacctgagagcacccaccccctgcctgccaagatgcacaactacaactacggcggcaacctgcaggagaaccccagcggccccagcctgatgcacggccagacctggaccagccctgcccagggccctggctacagccagggctaccggggccacatcagcaccagcacaggccggggccggggccggggcctgccctactag

SEQ ID NO: 15299 - DNA, 1770 bp, Artificial Sequence
  Description of Artificial Sequence: Synthetic coding sequence
atgacaggcctgctgaagaggaagtttgaccagctggatgaggacaacagctctgtgagcagcagcagcagcagcagcggctgccagagccgcagctgcagccccagcagctctgtgtcccgggcctgggacagcgaggaggagggcccctgggaccagatgcccctgcctgaccgggacttctgtggccccaggagcttcacccccctgagcatcctgaagagggcccggcgggagaggcctggccgggtggcctttgatggcatcaccgtcttctacttcccccgctgccagggcttcacctctgtgcccagcagaggaggctgcaccctgggcatggccctgcggcacagcgcctgccgccgcttcagcctggccgagtttgcccaggagcaggcccgggcccggcatgagaagctgcggcagaggctgaaggaggagaagctggagatgctgcagtggaagctgtctgctgctggggtgccccaggccgaggccggcctgccccctgtggtggatgccattgatgatgcctctgtggaggaggacctggccgtggccgtggccggcggccgcctggaggaggtgtccttcctgcagccctacccagccaggagaagaagagccctgctgcgggccagcggcgtgagaagaattgaccgggaggagaagcgggagctgcaggccctgcggcagagccgggaggactgtggctgccactgtgaccgcatctgtgaccctgagacctgcagctgcagcctggccggcatcaagtgccagatggaccacacagccttcccctgtggctgctgccgggagggctgtgagaaccccatgggccgggtggagttcaaccaggcccgggtgcagacccacttcatccacaccctgacccggctgcagctggagcaggaggccgagagcttccgggagctggaggccccagcccagggcagcccccccagccctggagaggaggccctggtgcccaccttccccctggccaagccacccatgaacaatgagctgggggacaacagctgcagcagtgacatgacagacagcagcacagccagcagcagcgccagcggcaccagcgaggccccagactgccccacccaccctggcctgcccggccctggcttccagcccggggtggatgatgacagcctggcccgcatcctgtccttcagtgacagcgactttggaggagaggaggaggaggaggaggagggctctgtgggcaacctggacaacctgagctgcttccaccctgctgacatcttcggcaccagtgaccccggcggcctggcctcctggacccacagctacagcggctgcagcttcaccagcggcgtgctggatgaaaatgccaacctggatgccagctgcttcctgaatggaggcctggagggcagccgggagggcagcctgcccggcacctctgtgccccccagcatggatgctggccgcagcagctctgtggacctgagcctgagcagctgtgacagctttgagctgctgcaggccctgcctgactacagcctgggcccccactacaccagccagaaggtgtctgacagcctggacaacatcgaggccccccacttccccctgcccggcctgagccccccaggagatgccagcagctgcttcctggagagcctgatgggcttcagcgagcctgctgctgaggccctggaccccttcatcgacagccagtttgaggacacagtgcctgccagcctgatggagcctgtgcctgtgtag

SEQ ID NO: 15300 - DNA, 744 bp, Artificial Sequence
  Description of Artificial Sequence: Synthetic coding sequence
agaagacgctgcaggacccggcgggcccggggcggctggacagatggctgcagagctgagaggacagagagcagaagaagaggccggccccggcccggccggggcagccgccgctgccccccccgggccagcggcctgcaggccgtgtgcccccagaccccagagcacgtgcgccaccaccacgactgggccgtggaggaggaggagggctctgtgggcaacctggacaacctgagctgcttccaccctgctgacatcttcggcaccagtgaccccggcggcctggcctcctggacccacagctacagcggctgcagcttcaccagcggcgtgctggatgaaaatgccaacctggatgccagctgcttcctgaatggaggcctggagggcagccgggagggcagcctgcccggcacctctgtgccccccagcatggatgctggccgcagcagctctgtggacctgagcctgagcagctgtgacagctttgagctgctgcaggccctgcctgactacagcctgggcccccactacaccagccagaaggtgtctgacagcctggacaacatcgaggccccccacttccccctgcccggcctgagccccccaggagatgccagcagctgcttcctggagagcctgatgggcttcagcgagcctgctgctgaggccctggaccccttcatcgacagccagtttgaggacacagtgcctgccagcctgatggagcctgtgcctgtgtag

SEQ ID NO: 15301 - DNA, 1770 bp, Artificial Sequence; identical to SEQ ID NO: 15299
  Description of Artificial Sequence: Synthetic coding sequence

SEQ ID NO: 15302 - DNA, 1191 bp, Artificial Sequence
  Description of Artificial Sequence: Synthetic coding sequence
atgctgtctgaggtgctgctggtgtctgcccctgggaaggtgatcctgcatggagagcacgctgtggtgcacggcaaggtggccctggccgtgtccctgaacctgcggaccttcctgcggctgcagccccacagcaatggcaaggtggacctgagcctgcccaacatcggcatcaagagggcctgggatgtggcccggctgcagagcctggacaccagcttcctggagcagggagatgtgaccacccccaccagcgagcaggtggagaagctgaaggaggtggccggcctgcctgatgactgtgctgtgacagagcggctggccgtgctggccttcctgtacctgtacctgagcatctgcaggaagcagagggccctgcccagcctggacatcgtggtgtggagcgagctgcccccaggagctggcctgggcagcagcgctgcctacagcgtgtgcctggccgccgccctgctgactgtgtgtgaggagatccccaaccccctgaaggatggagactgtgtgaaccgctggaccaaggaggacctggagctgatcaacaagtgggccttccagggcgagaggatgattcatggcaaccccagcggcgtggacaatgctgtgtccacctggggcggggccctgcgctaccaccagggcaagatcagcagcctgaagaggagccctgccctgcagatcctgctgaccaacaccaaggtgcccaggaacacccgggccctggtggccggcgtgaggaaccggctgctgaagtttcctgagatcgtggcccccctgctgaccagcattgatgccatcagcctggagtgtgagcgggtgctgggggagatgggagaggccccagcccctgagcagtacctggtgctggaggagctgattgacatgaaccagcaccacctgaatgccctgggcgtgggccacgccagcctggaccagctgtgccaggtgacccgggcccggggcctgcacagcaagctgaccggggccggcggcggcggctgcggcatcaccctgctgaagccaggcctggagcagcctgaggtggaggccaccaagcaggccctgaccagctgtggctttgactgcctggagaccagcatcggggcccctggggtgtccatccacagcgccaccagcctggacagccgggtgcagcaggccctggatggcctgtag

SEQ ID NO: 15303 - DNA, 177 bp, Artificial Sequence
  Description of Artificial Sequence: Synthetic coding sequence
atggatgccttcaccggcagcggcctgaagaggaagtttgatgatgtggatgtgggcagctctgtgagcaacagtgatgatgagatcagcagcagtgacagcgctgacagctgtgacagcctgaacccccccaccacagccagcttcacccccaccagcatcctgaagaggcagtag

SEQ ID NO: 15304 - DNA, 345 bp, Artificial Sequence
  Description of Artificial Sequence: Synthetic coding sequence
atggatgccttcaccggcagcggcctgaagaggaagtttgatgatgtggatgtgggcagctctgtgagcaacagtgatgatgagatcagcagcagtgacagcgctgacagctgtgacagcctgaacccccccaccacagccagcttcacccccaccagcatcctgaagaggcagaagcagctgcggaggaagaatgtgcgctttgaccaggtgacagtgtactactttgcccggcggcagggcttcacctctgtgcccagccagggcggcagcagcctgggcatggcccagaggcacaacagcgtgcgcagctacaccctgtgtgaatttgcccaggagcagtag

SEQ ID NO: 15305 - DNA, 261 bp, Artificial Sequence
  Description of Artificial Sequence: Synthetic coding sequence
atggatgccttcaccggcagcggcctgaagaggaagtttgatgatgtggatgtgggcagctctgtgagcaacagtgatgatgagatcagcagcagtgacagcgctgacagctgtgacagcctgaacccccccaccacagccagcttcacccccaccagcatcctgaagaggcagaagcagctgcggaggaagaatgtgcgctttgaccaggtgacagtgtactactttgcccggcggcagggcttcacctctgtgccctag

SEQ ID NO: 15306 - DNA, 1758 bp, Artificial Sequence
  Description of Artificial Sequence: Synthetic coding sequence
atgagcggcatcctgaagaggaagtttgaggaggtggatggcagcagcccctgcagctctgtgcgggagagtgatgatgaggtgagcagcagcgagagcgctgacagcggggacagcgtgaaccccagcaccagcagccacttcacccccagcagcatcctgaagcgggagaagaggctgcggaccaagaatgtgcacttcagctgtgtgacagtgtactacttcacccggcggcagggcttcacctctgtgcccagccagggcggcagcaccctgggcatgagcagccgccacaacagcgtgcggcagtacaccctgggggagtttgcccgggagcaggagcggctgcaccgggagatgctgcgggagcacctgcgggaggagaagctgaacagcctgaagctgaagatgaccaagaatggcaccgtggagagcgaggaggccagcaccctgaccctggatgacatcagtgatgatgacatcgacctggacaacacagaggtggatgagtacttcttcctgcagcccctgcccaccaagaagaggcgggccctgctgcgggccagcggcgtgaagaagattgatgtggaggagaagcatgagctgcgggccatccggctgagccgggaggactgtggctgtgactgcagggtcttctgtgaccctgacacctgcacctgcagcctggccggcatcaagtgccaggtggacaggatgtccttcccctgtggctgcaccaaggagggctgcagcaacacagctggaagaattgagttcaaccccatccgggtgaggacccacttcctgcacaccatcatgaagctggagctggagaagaaccgggagcagcagatccccaccctgaatggctgccacagcgagatcagcgcccacagcagctccatgggccctgtggcccacagcgtggagtacagcattgctgacagctttgaaattgaaacagagccccaggccgctgtgctgcacctgcagagcgctgaggagctggactgccagggcgaggaggaggaggaggaggaggatggcagcagcttctgcagcggcgtgacagacagcagcacccagagcctggcccccagcgagagtgatgaggaggaggaggaggaggaggaggaggaggaggaggaggatgatgatgatgacaagggagatggctttgtggagggcctgggcacccatgctgaggtggtgcccctgcccagcgtgctgtgctacagtgatggaacagctgtgcatgagagccacgccaagaatgccagcttctacgccaacagcagcaccctgtactaccagattgacagccacatccctggcacccccaaccagatcagcgagaactacagcgagcgggacacagtgaagaatggcaccctgagcctggtgccctacaccatgaccccagagcagtttgtggactatgcccggcaggccgaggaggcctacggggccagccactacccagctgccaaccccagcgtgattgtgtgctgcagcagcagtgaaaatgattctggagtgccctgcaacagcctgtacccagagcacaggagcaaccacccccaggtggagttccacagctacctgaagggccccagccaggagggctttgtgtctgccctgaatggagacagccacatcagcgagcaccctgctgagaacagcctgagcctggccgagaagagcatcctgcacgaggagtgcatcaagagccctgtggtggagaccgtgcctgtgtag

SEQ ID NO: 15307 - DNA, 1758 bp, Artificial Sequence; identical to SEQ ID NO: 15306
  Description of Artificial Sequence: Synthetic coding sequence

SEQ ID NO: 15308 - DNA, 1854 bp, Artificial Sequence
  Description of Artificial Sequence: Synthetic coding sequence
atgaagtgtgccctcttcctgcgggtgaagatcctgcagagggtgtgccgcagccgctacatcgtgcacgccggcacctgtgacagcacagctgccatgagcggcatcctgaagaggaagtttgaggaggtggatggcagcagcccctgcagctctgtgcgggagagtgatgatgaggtgagcagcagcgagagcgctgacagcggggacagcgtgaaccccagcaccagcagccacttcacccccagcagcatcctgaagcgggagaagaggctgcggaccaagaatgtgcacttcagctgtgtgacagtgtactacttcacccggcggcagggcttcacctctgtgcccagccagggcggcagcaccctgggcatgagcagccgccacaacagcgtgcggcagtacaccctgggggagtttgcccgggagcaggagcggctgcaccgggagatgctgcgggagcacctgcgggaggagaagctgaacagcctgaagctgaagatgaccaagaatggcaccgtggagagcgaggaggccagcaccctgaccctggatgacatcagtgatgatgacatcgacctggacaacacagaggtggatgagtacttcttcctgcagcccctgcccaccaagaagaggcgggccctgctgcgggccagcggcgtgaagaagattgatgtggaggagaagcatgagctgcgggccatccggctgagccgggaggactgtggctgtgactgcagggtcttctgtgaccctgacacctgcacctgcagcctggccggcatcaagtgccaggtggacaggatgtccttcccctgtggctgcaccaaggagggctgcagcaacacagctggaagaattgagttcaaccccatccgggtgaggacccacttcctgcacaccatcatgaagctggagctggagaagaaccgggagcagcagatccccaccctgaatggctgccacagcgagatcagcgcccacagcagctccatgggccctgtggcccacagcgtggagtacagcattgctgacagctttgaaattgaaacagagccccaggccgctgtgctgcacctgcagagcgctgaggagctggactgccagggcgaggaggaggaggaggaggaggatggcagcagcttctgcagcggcgtgacagacagcagcacccagagcctggcccccagcgagagtgatgaggaggaggaggaggaggaggaggaggaggaggaggaggatgatgatgatgacaagggagatggctttgtggagggcctgggcacccatgctgaggtggtgcccctgcccagcgtgctgtgctacagtgatggaacagctgtgcatgagagccacgccaagaatgccagcttctacgccaacagcagcaccctgtactaccagattgacagccacatccctggcacccccaaccagatcagcgagaactacagcgagcgggacacagtgaagaatggcaccctgagcctggtgccctacaccatgaccccagagcagtttgtggactatgcccggcaggccgaggaggcctacggggccagccactacccagctgccaaccccagcgtgattgtgtgctgcagcagcagtgaaaatgattctggagtgccctgcaacagcctgtacccagagcacaggagcaaccacccccaggtggagttccacagctacctgaagggccccagccaggagggctttgtgtctgccctgaatggagacagccacatcagcgagcaccctgctgagaacagcctgagcctggccgagaagagcatcctgcacgaggagtgcatcaagagccctgtggtggagaccgtgcctgtgtag

SEQ ID NO: 15309 - DNA, 417 bp, Artificial Sequence
  Description of Artificial Sequence: Synthetic coding sequence
atgagcggcatcctgaagaggaagtttgaggaggtggatggcagcagcccctgcagctctgtgcgggagagtgatgatgaggtgagcagcagcgagagcgctgacagcggggacagcgtgaaccccagcaccagcagccacttcacccccagcagcatcctgaagcgggagaagaggctgcggaccaagaatgtgcacttcagctgtgtgacagtgtactacttcacccggcggcagggcttcacctctgtgcccagccagggcggcagcaccctgggcatgagcagccgccacaacagcgtgcggcagtacaccctgggggagtttgcccgggagcaggagcggctgcaccgggagatgctgcgggagcacctgcgggaggagaagctgaacagcctgaagctgaagatgacctag

SEQ ID NO: 15310 - DNA, 1314 bp, Artificial Sequence
  Description of Artificial Sequence: Synthetic coding sequence
atgagcggcatcctgaagaggaagtttgaggaggtggatggcagcagcccctgcagctctgtgcgggagagtgatgatgaggtgagcagcagcgagagcgctgacagcggggacagcgtgaaccccagcaccagcagccacttcacccccagcagcatcctgaagcgggagaagaggctgcggaccaagaatgtgcacttcagctgtgtgacagtgtactacttcacccggcggcagggcttcacctctgtgcccagccagggcggcagcaccctgggcatgagcagccgccacaacagcgtgcggcagtacaccctgggggagtttgcccgggagcaggagcggctgcaccgggagatgctgcgggagcacctgcgggaggagaagctgaacagcctgaagctgaagatgaccaagaatggcaccgtggagagcgaggaggccagcaccctgaccctggatgacatcagtgatgatgacatcgacctggacaacacagaggtggatgagtacttcttcctgcagcccctgcccaccaagaagaggcgggccctgctgcgggccagcggcgtgaagaagattgatgtggaggagaagcatgagctgcgggccatccggctgagccgggaggactgtggctgtgactgcagggtcttctgtgaccctgacacctgcacctgcagcctggccggcatcaagtgccaggtggacaggatgtccttcccctgtggctgcaccaaggagggctgcagcaacacagctggaagaattgagttcaaccccatccgggtgaggacccacttcctgcacaccatcatgaagctggagctggagaagaaccgggagcagcagatccccaccctgaatggctgccacagcgagatcagcgcccacagcagctccatgggccctgtggcccacagcgtggagtacagcattgctgacagctttgaaattgaaacagagccccaggccgctgtgctgcacctgcagagcgctgaggagctggactgccagggcgaggaggaggaggaggaggaggatggcagcagcttctgcagcggcgtgacagacagcagcacccagagcctggcccccagcgagagtgatgaggaggaggaggaggaggaggaggaggaggaggaggaggatgatgatgatgacaagggagatggctttgtggagggcctgggcacccatgctgaggtggtgcccctgcccagcgtgctgtgctacagtgatggaacagctgtgcatgagagccacgccaagaatgccagcttctacgccaacagcagcaccctgtactactag

SEQ ID NO: 15311 - DNA, 1569 bp, Artificial Sequence
  Description of Artificial Sequence: Synthetic coding sequence
acctgtgacagcacagctgccatgagcggcatcctgaagaggaagtttgaggaggtggatggcagcagcccctgcagctctgtgcgggagagtgatgatgaggtgagcagcagcgagagcgctgacagcggggacagcgtgaaccccagcaccagcagccacttcacccccagcagcatcctgaagcgggagaagaggctgcggaccaagaatgtgcacttcagctgtgtgacagtgtactacttcacccggcggcagggcttcacctctgtgcccagccagggcggcagcaccctgggcatgagcagccgccacaacagcgtgcggcagtacaccctgggggagtttgcccgggagcaggagcggctgcaccgggagatgctgcgggagcacctgcgggaggagaagctgaacagcctgaagctgaagatgaccaagaatggaacagtggagagcgaggaggccagcaccctgaccctggatgacatcagtgatgatgacatcgacctggacaacacagaggtggatgagtacttcttcctgcagcccctgcccaccaagaagagaagagccctgctgcgggccagcggcgtgaagaagattgatgtggaggagaagcatgagctgcgggccatccggctgagccgggaggactgtggctgtgactgcagggtcttctgtgaccctgacacctgcacctgcagcctggccggcatcaagtgccaggtggacaggatgtccttcccctgtggctgcaccaaggagggctgcagcaacacagctggccgcatcgagttcaaccccatccgggtgaggacccacttcctgcacaccatcatgaagctggagctggagaagaaccgggagcagcagatccccaccctgaatggctgccacagcgagatcagcgcccacagcagctccatgggccctgtggcccacagcgtggagtacagcattgctgacagctttgaaattgaaacagagccccaggccgctgtgctgcacctgcagagcgctgaggagctggactgccagggcgaggaggaggaggaggaggaggatggcagcagcttctgcagcggcgtgacagacagcagcacccagagcctggcccccagcgagagtgatgaggaggaggaggaggaggaggaggaggaggaggaggaggatgatgatgatgacaagggagatggctttgtggagggcctgggcacccacgccgaggtggtgcccctgcccagcgtgctgtgctacagtgatggaacagctgtgcatgagagccacgccaagaatgccagcttctacgccaacagcagcaccctgtactaccagaatgacagcggcgtgccctgcaacagcctgtacccagagcacaggagcaaccacccccaggtggagttccacagctacctgaagggccccagccaggagggctttgtgtctgccctgaatggagacagccacatcagcgagcaccctgctgagaacagcctgagcctggccgagaagagcatcctgcacgaggagtgcatcaagagccctgtggtggagaccgtgcctgtgtag

SEQ ID NO: 15312 - DNA, 2127 bp, Artificial Sequence
  Description of Artificial Sequence: Synthetic coding sequence
atggctgtgcctgctgccctgatcccccccacccagctggtgcccccccagccccccatcagcaccagcgccagcagcagcggcaccaccaccagcaccagcagcgccaccagcagccctgcccccagcatcggccccccagccagcagcggccccaccctcttccggcctgagcccatcgccagcgctgctgctgctgctgccaccgtgaccagcactggaggcggcggcggcggcggcggcggcggcagcggcggcggcggcggcagcagtggaaatggaggcggcggcggcggcggcggcggcggcagcaactgcaaccccaacctggccgccgccagcaatggaagtggcggcggcggcggcggcatctctgctgggggcggcgtggccagcagcacccccatcaatgccagcacaggcagcagcagcagcagcagcagcagcagcagcagcagcagcagcagcagcagcagcagcagcagcagcagcagctgtggccccctgcccgggaagcctgtgtacagcacccccagccctgtggagaacaccccccagaacaatgaatgcaagatggtggacctgcggggggccaaggtggccagcttcaccgtggagggctgtgagctgatctgcctgccccaggcctttgacctcttcctgaagcacctggtgggcggcctgcacacagtgtacaccaagctgaagaggctggagatcacccctgtggtgtgcaatgtggagcaggtgcgcatcctgcggggcctgggcgccatccagcccggggtgaaccgctgcaagctgatcagcaggaaggactttgagaccctgtacaatgactgcaccaatgccagcagccggcccggccggccccccaagaggacccagagcgtgaccagccctgagaacagccacatcatgccccacagcgtgcccggcctgatgagccctggcatcatccccccaacaggcctgacagctgctgctgctgctgctgctgctgccaccaatgctgccatcgccgaggccatgaaggtgaagaagatcaagctggaggccatgagcaactaccacgccagcaacaaccagcacggggctgacagtgaaaatggagacatgaacagctctgtgggcctggagctgcccttcatgatgatgccccaccccctcatccctgtgtccctgcccccagcctctgtgaccatggccatgagccagatgaaccacctgagcaccatcgccaacatggctgctgctgcccaggtgcagagcccccccagccgggtggagaccagcgtcatcaaggagcgggtgcctgacagccccagccctgcccccagcctggaggagggccggcggcccggcagccaccccagcagccacaggagcagctctgtgagcagcagccctgccaggacagagagcagcagtgaccgcatccctgtgcaccagaatggcctgtccatgaaccagatgctgatgggcctgagccccaacgtgctgcccggccccaaggagggggacctggccggccatgacatgggccacgagagcaagaggatgcacatcgagaaggatgagacccccctgagcacccccacagcccgggacagcctggacaagctgagcctgactggacatggccagcccctgcccccaggcttccccagccccttcctgttcccagatggcctgagcagcattgagaccctgctgaccaacatccagggcctgctgaaggtggccatcgacaatgcccgggcccaggagaagcaggtgcagctggagaagacagagctgaagatggacttcctgcgggagcgggagctgcgggagaccctggagaagcagctggccatggagcagaagaacagagccatcgtgcagaagaggctgaagaaggagaagaaggccaagaggaagctgcaggaggccctggagtttgagaccaagaggcgggagcaggccgagcagaccctgaagcaggccgccagcacagacagcctgcgggtgctgaatgacagcctgaccccagaaattgaggccgacagaagtggcggccgcacagatgctgagaggaccatccaggacggccgcctgtacctgaagaccaccgtgatgtactag

SEQ ID NO: 15313 - DNA, 1683 bp, Artificial Sequence
  Description of Artificial Sequence: Synthetic coding sequence
atggctgtgcctgctgccctgatcccccccacccagctggtgcccccccagccccccatcagcaccagcgccagcagcagcggcaccaccaccagcaccagcagcgccaccagcagccctgcccccagcatcggccccccagccagcagcggccccaccctcttccggcctgagcccatcgccagcgctgctgctgctgctgccaccgtgaccagcactggaggcggcggcggcggcggcggcggcggcagcggcggcggcggcggcagcagtggaaatggaggcggcggcggcggcggcggcggcggcagcaactgcaaccccaacctggccgccgccagcaatggaagtggcggcggcggcggcggcatctctgctgggggcggcgtggccagcagcacccccatcaatgccagcacaggcagcagcagcagcagcagcagcagcagcagcagcagcagcagcagcagcagcagcagcagcagcagcagcagctgtggccccctgcccgggaagcctgtgtacagcacccccagccctgtggagaacaccccccagaacaatgaatgcaagatggtggacctgcggggggccaaggtggccagcttcaccgtggagggctgtgagctgatctgcctgccccaggcctttgacctcttcctgaagcacctggtgggcggcctgcacacagtgtacaccaagctgaagaggctggagatcacccctgtggtgtgcaatgtggagcaggtgcgcatcctgcggggcctgggcgccatccagcccggggtgaaccgctgcaagctgatcagcaggaaggactttgagaccctgtacaatgactgcaccaatgccagcagccggcccggccggccccccaagaggacccagagcgtgaccagccctgagaacagccacatcatgccccacagcgtgcccggcctgatgagccctggcatcatccccccaacaggcctgacagctgctgctgctgctgctgctgctgccaccaatgctgccatcgccgaggccatgaaggtgaagaagatcaagctggaggccatgagcaactaccacgccagcaacaaccagcacggggctgacagtgaaaatggagacatgaacagctctgtggatgagacccccctgagcacccccacagcccgggacagcctggacaagctgagcctgactggacatggccagcccctgcccccaggcttccccagccccttcctgttcccagatggcctgagcagcattgagaccctgctgaccaacatccagggcctgctgaaggtggccatcgacaatgcccgggcccaggagaagcaggtgcagctggagaagacagagctgaagatggacttcctgcgggagcgggagctgcgggagaccctggagaagcagctggccatggagcagaagaacagagccatcgtgcagaagaggctgaagaaggagaagaaggccaagaggaagctgcaggaggccctggagtttgagaccaagaggcgggagcaggccgagcagaccctgaagcaggccgccagcacagacagcctgcgggtgctgaatgacagcctgaccccagaaattgaggccgacagaagtggcggccgcacagatgctgagaggaccatccaggacggccgcctgtacctgaagaccaccgtgatgtactag

SEQ ID NO: 15314 - DNA, 1521 bp, Artificial Sequence
  Description of Artificial Sequence: Synthetic coding sequence
atggctgtgcctgctgccctgatcccccccacccagctggtgcccccccagccccccatcagcaccagcgccagcagcagcggcaccaccaccagcaccagcagcgccaccagcagccctgcccccagcatcggccccccagccagcagcggccccaccctcttccggcctgagcccatcgccagcgctgctgctgctgctgccaccgtgaccagcactggaggcggcggcggcggcggcggcggcggcagcggcggcggcggcggcagcagtggaaatggaggcggcggcggcggcggcggcggcggcagcaactgcaaccccaacctggccgccgccagcaatggaagtggcggcggcggcggcggcatctctgctgggggcggcgtggccagcagcacccccatcaatgccagcacaggcagcagcagcagcagcagcagcagcagcagcagcagcagcagcagcagcagcagcagcagcagcagcagcagctgtggccccctgcccgggaagcctgtgtacagcacccccagccctgtggagaacaccccccagaacaatgaatgcaagatggtggacctgcggggggccaaggtggccagcttcaccgtggagggctgtgagctgatctgcctgccccaggcctttgacctcttcctgaagcacctggtgggcggcctgcacacagtgtacaccaagctgaagaggctggagatcacccctgtggtgtgcaatgtggagcaggtgcgcatcctgcggggcctgggcgccatccagcccggggtgaaccgctgcaagctgatcagcaggaaggactttgagaccctgtacaatgactgcaccaatgccagcagccggcccggccggccccccaagaggacccagagcgtgaccagccctgagaacagccacatcatgccccacagcgtgcccggcctgatgagccctggcatcatccccccaacagatgagacccccctgagcacccccacagcccgggacagcctggacaagctgagcctgactggacatggccagcccctgcccccaggcttccccagccccttcctgttcccagatggcctgagcagcattgagaccctgctgaccaacatccagggcctgctgaaggtggccatcgacaatgcccgggcccaggagaagcaggtgcagctggagaagacagagctgaagatggacttcctgcgggagcgggagctgcgggagaccctggagaagcagctggccatggagcagaagaacagagccatcgtgcagaagaggctgaagaaggagaagaaggccaagaggaagctgcaggaggccctggagtttgagaccaagaggcgggagcaggccgagcagaccctgaagcaggccgccagcacagacagcctgcgggtgctgaatgacagcctgaccccagaaattgaggccgacagaagtggcggccgcacagatgctgagaggaccatccaggacggccgcctgtacctgaagaccaccgtgatgtactag

SEQ ID NO: 15315 - DNA, 2283 bp, Artificial Sequence
  Description of Artificial Sequence: Synthetic coding sequence
atggctgtgcctgctgccctgatcccccccacccagctggtgcccccccagccccccatcagcaccagcgccagcagcagcggcaccaccaccagcaccagcagcgccaccagcagccctgcccccagcatcggccccccagccagcagcggccccaccctcttccggcctgagcccatcgccagcgctgctgctgctgctgccaccgtgaccagcactggaggcggcggcggcggcggcggcggcggcagcggcggcggcggcggcagcagtggaaatggaggcggcggcggcggcggcggcggcggcagcaactgcaaccccaacctggccgccgccagcaatggaagtggcggcggcggcggcggcatctctgctgggggcggcgtggccagcagcacccccatcaatgccagcacaggcagcagcagcagcagcagcagcagcagcagcagcagcagcagcagcagcagcagcagcagcagcagcagcagctgtggccccctgcccgggaagcctgtgtacagcacccccagccctgtggagaacaccccccagaacaatgaatgcaagatggtggacctgcggggggccaaggtggccagcttcaccgtggagggctgtgagctgatctgcctgccccaggcctttgacctcttcctgaagcacctggtgggcggcctgcacacagtgtacaccaagctgaagaggctggagatcacccctgtggtgtgcaatgtggagcaggtgcgcatcctgcggggcctgggcgccatccagcccggggtgaaccgctgcaagctgatcagcaggaaggactttgagaccctgtacaatgactgcaccaatgccagcagccggcccggccggccccccaagaggacccagagcgtgaccagccctgagaacagccacatcatgccccacagcgtgcccggcctgatgagccctggcatcatccccccaacaggcctgacagctgctgctgctgctgctgctgctgccaccaatgctgccatcgccgaggccatgaaggtgaagaagatcaagctggaggccatgagcaactaccacgccagcaacaaccagcacggggctgacagtgaaaatggagacatgaacagctctgtgggcagcagtgatggctcctgggacaaggagaccctgcccagcagccccagccagggcccccaggccagcatcacccaccccaggatgcctggggcccggagcctgcccctgagccaccccctgaaccacctgcagcagagccacctgctgcccaacggcctggagctgcccttcatgatgatgccccaccccctcatccctgtgtccctgcccccagcctctgtgaccatggccatgagccagatgaaccacctgagcaccatcgccaacatggctgctgctgcccaggtgcagagcccccccagccgggtggagaccagcgtcatcaaggagcgggtgcctgacagccccagccctgcccccagcctggaggagggccggcggcccggcagccaccccagcagccacaggagcagctctgtgagcagcagccctgccaggacagagagcagcagtgaccgcatccctgtgcaccagaatggcctgtccatgaaccagatgctgatgggcctgagccccaacgtgctgcccggccccaaggagggggacctggccggccatgacatgggccacgagagcaagaggatgcacatcgagaaggatgagacccccctgagcacccccacagcccgggacagcctggacaagctgagcctgactggacatggccagcccctgcccccaggcttccccagccccttcctgttcccagatggcctgagcagcattgagaccctgctgaccaacatccagggcctgctgaaggtggccatcgacaatgcccgggcccaggagaagcaggtgcagctggagaagacagagctgaagatggacttcctgcgggagcgggagctgcgggagaccctggagaagcagctggccatggagcagaagaacagagccatcgtgcagaagaggctgaagaaggagaagaaggccaagaggaagctgcaggaggccctggagtttgagaccaagaggcgggagcaggccgagcagaccctgaagcaggccgccagcacagacagcctgcgggtgctgaatgacagcctgaccccagaaattgaggccgacagaagtggcggccgcacagatgctgagaggaccatccaggacggccgcctgtacctgaagaccaccgtgatgtactag

SEQ ID NO: 15316 - DNA, 2283 bp, Artificial Sequence
  Description of Artificial Sequence: Synthetic coding sequence
atggctgtgcctgctgccctgatcccccccacccagctggtgcccccccagccccccatcagcaccagcgccagcagcagcggcaccaccaccagcaccagcagcgccaccagcagccctgcccccagcatcggccccccagccagcagcggccccaccctcttccggcctgagcccatcgccagcgctgctgctgctgctgccaccgtgaccagcactggaggcggcggcggcggcggcggcggcggcagcggcggcggcggcggcagcagtggaaatggaggcggcggcggcggcggcggcggcggcagcaactgcaaccccaacctggccgccgccagcaatggaagtggcggcggcggcggcggcatctctgctgggggcggcgtggccagcagcacccccatcaatgccagcacaggcagcagcagcagcagcagcagcagcagcagcagcagcagcagcagcagcagcagcagcagcagcagcagcagctgtggccccctgcccgggaagcctgtgtacagcacccccagccctgtggagaacaccccccagaacaatgaatgcaagatggtggacctgcggggggccaaggtggccagcttcaccgtggagggctgtgagctgatctgcctgccccaggcctttgacctcttcctgaagcacctggtgggcggcctgcacacagtgtacaccaagctgaagaggctggagatcacccctgtggtgtgcaatgtggagcaggtgcgcatcctgcggggcctgggcgccatccagcccggggtgaaccgctgcaagctgatcagcaggaaggactttgagaccctgtacaatgactgcaccaatgccagcagccggcccggccggccccccaagaggacccagagcgtgaccagccctgagaacagccacatcatgccccacagcgtgcccggcctgatgagccctggcatcatccccccaacaggcctgacagctgctgctgctgctgctgctgctgccaccaatgctgccatcgccgaggccatgaaggtgaagaagatcaagctggaggccatgagcaactaccacgccagcaacaaccagcacggggctgacagtgaaaatggagacatgaacagctctgtgggcagcagtgatggctcctgggacaaggagaccctgcccagcagccccagccagggcccccaggccagcatcacccaccccaggatgcctggggcccggagcctgcccctgagccaccccctgaaccacctgcagcagagccacctgctgcccaacggcctggagctgcccttcatgatgatgccccaccccctcatccctgtgtccctgcccccagcctctgtgaccatggccatgagccagatgaaccacctgagcaccatcgccaacatggctgctgctgcccaggtgcagagcccccccagccgggtggagaccagcgtcatcaaggagcgggtgcctgacagccccagccctgcccccagcctggaggagggccggcggcccggcagccaccccagcagccacaggagcagctctgtgagcagcagccctgccaggacagagagcagcagtgaccgcatccctgtgcaccagaatggcctgtccatgaaccagatgctgatgggcctgagccccaacgtgctgcccggccccaaggagggggacctggccggccatgacatgggccacgagagcaagaggatgcacatcgagaaggatgagacccccctgagcacccccacagcccgggacagcctggacaagctgagcctgactggacatggccagcccctgcccccaggcttccccagccccttcctgttcccagatggcctgagcagcattgagaccctgctgaccaacatccagggcctgctgaaggtggccatcgacaatgcccgggcccaggagaagcaggtgcagctggagaagacagagctgaagatggacttcctgcgggagcgggagctgcgggagaccctggagaagcagctggccatggagcagaagaacagagccatcgtgcagaagaggctgaagaaggagaagaaggccaagaggaagctgcaggaggccctggagtttgagaccaagaggcgggagcaggccgagcagaccctgaagcaggccgccagcacagacagcctgcgggtgctgaatgacagcctgaccccagaaattgaggccgacagaagtggcggccgcacagatgctgagaggaccatccaggccgcccggctgtacatcaagacagtgtgcatgtactag

SEQ ID NO: 15317 - DNA, 1800 bp, Artificial Sequence
  Description of Artificial Sequence: Synthetic coding sequence
atggctgtgtctgccagccctgtgatcagcgccaccagcagcggggccggcgtgcctgggggcctcttccgggcagagcccctgtacagcaccccccgggagcccccccggctgacccccaacatgatcaacagctttgtggtgaacaaccacagcaacagcgctgggggcggcggccggggcaacaccaacaccaatgaatgtaggatggtggacatgcacggcatgaaggtggccagcttcctgatggatggccaggagctgatctgcctgccccaggtgtttgacctcttcctgaagcacctggtgggcggcctgcacacagtgtacaccaagctgaagaggctggacatcagccctgtggtgtgcaccgtggagcaggtgcgcatcctgcggggcctgggcgccatccagcccggggtgaaccgctgcaagctgatcaccaggaaggactttgagaccctcttcacagactgcaccaatgcccggaggaagaggcagatgaccaggaagcaggccgtgaacagcagcaggcctggccggccccccaagaggagcctgggcgtgctgcaggagaatgcccggctgctgacccatgctgtgcccggcctgctgagccctggcctcatcacccccaccggcatcacagctgctgccatggccgaggccatgaagctgcagaagatgaagctgatggccatgaacaccctgcagggcaatggcagccagaatggaacagagagcgagccagatgacctgaacagcaacacaggaggcagcgagagctcctgggacaaggacaagatgcagagcccctttgctgcccctggcccccagcacggcatcgcccatgctgccctggccggccagcccggcattggaggagcccccaccctgaaccccctgcagcagaaccacctgctgaccaaccggctggacctgcccttcatgatgatgccccaccccctgctgcctgtgtccctgcccccagcctctgtggccatggccatgaaccagatgaaccacctgaacaccatcgccaacatggctgctgctgcccagatccacagccccctgagccgggccggcaccagcgtcatcaaggagcgcatccctgagagccccagccctgcccccagcctggaggagaaccacaggcctggcagccagaccagcagccacaccagcagctctgtgagcagcagccccagccagatggaccaccacctggagaggatggaggaggtgcctgtgcagatccccatcatgaagagccccctggacaagatccagctgaccccaggccaggccctgcctgctggcttccctggccccttcatctttgctgacagcctgagctctgtggagaccctgctgaccaacatccagggcctgctgaaggtggccctggacaatgcccgcatccaggagaagcagatccagcaggagaagaaggagctgcggctggagctgtaccgggagcgggagatccgggagaacctggagcggcagctggccgtggagctgcagagcaggaccaccatgcagaagaggctgaagaaggagaagaagaccaagaggaagctgcaggaggccctggagtttgagagcaagagaagagagcaggtggagcaggccctgaagcaggccaccaccagtgacagcggcctgaggatgctgaaggacaccggcatcccagacatcgagattgaaaataatggcacccctcatgattctgctgccatgcagggcggcaactactactgcctggagatggcccagcagctgtacagcgcctag

SEQ ID NO: 15318 - DNA, 1800 bp, Artificial Sequence; identical to SEQ ID NO: 15317
  Description of Artificial Sequence: Synthetic coding sequence

SEQ ID NO: 15319 - DNA, 1716 bp, Artificial Sequence
  Description of Artificial Sequence: Synthetic coding sequence
atggctgtgtctgccagccctgtgatcagcgccaccagcagcggggccggcgtgcctgggggcctcttccgggcagagcccctgtacagcaccccccgggagcccccccggctgacccccaacatgatcaacagctttgtggtgaacaaccacagcaacagcgctgggggcggcggccggggcaacaccaacaccaatgaatgtaggatggtggacatgcacggcatgaaggtggccagcttcctgatggatggccaggagctgatctgcctgccccaggtgtttgacctcttcctgaagcacctggtgggcggcctgcacacagtgtacaccaagctgaagaggctggacatcagccctgtggtgtgcaccgtggagcaggtgcgcatcctgcggggcctgggcgccatccagcccggggtgaaccgctgcaagctgatcaccaggaaggactttgagaccctcttcacagactgcaccaatgccagcagccggcccggccggccccccaagaggagcctgggcgtgctgcaggagaatgcccggctgctgacccatgctgtgcccggcctgctgagccctggcctcatcacccccaccggcatcacagctgctgccatggccgaggccatgaagctgcagaagatgaagctgatggccatgaacaccctgcagggcaatggcagccagaatggaacagaaagtgagccagatgacctgaacagcaacacaggaggcagcgagagctcctgggacaaggacaagatgcagagcccctttgctgcccctggcccccagcacggcatcgcccacgccgccctggccggccagcccggcatcggcggggcccccaccctgaaccccctgcagcagaaccacctgctgaccaaccggctggacctgcccttcatgatgatgccccaccccctgctgcctgtgtccctgcccccagcctctgtggccatggccatgaaccagatgaaccacctgaacaccatcgccaacatggctgctgctgcccagatccacagccccctgagcagagctggcaccagcgtcatcaaggagcgcatccctgagagccccagccctgcccccagcctggaggagaaccaccggcccggcagccagaccagcagccacaccagcagctctgtgagcagcagccccagccagatggaccaccacctggagaggatggaggaggtgcctgtgcagatccccatcatgaagagccccctggacaagatccagctgaccccaggccaggccctgcctgctggcttccctggccccttcatctttgctgacagcctgagctctgtggagaccctgctgaccaacatccagggcctgctgaaggtggccctggacaatgcccgcatccaggagaagcagatccagcaggagaagaaggagctgcggctggagctgtaccgggagcgggagatccgggagaacctggagcggcagctggccgtggagctgcagagcaggaccaccatgcagaagaggctgaagaaggagaagaagaccaagaggaagctgcaggaggccctggagtttgagagcaagaggcgggagcaggtggagcaggccctgaagcaggccaccaccagtgacagcggcctgaggatgctgaaggacaccggcatcccagacattgaaattgagaacaacggcacccctcatgacagcgctgccatgcaggcctag

SEQ ID NO: 15320 - DNA, 1299 bp, Artificial Sequence
  Description of Artificial Sequence: Synthetic coding sequence
atggcccagaaccagttcttcaacagcagccggcccggccggccccccaagaggagcctgggcgtgctgcaggagaatgcccggctgctgacccatgctgtgcccggcctgctgagccctggcctcatcacccccaccggcatcacagctgctgccatggccgaggccatgaagctgcagaagatgaagctgatggccatgaacaccctgcagggcaatggcagccagaatggaacagaaagtgagccagatgacctgaacagcaacacaggaggcagcgagagctcctgggacaaggacaagatgcagagcccctttgctgcccctggcccccagcacggcatcgcccacgccgccctggccggccagcccggcatcggcggggcccccaccctgaaccccctgcagcagaaccacctgctgaccaaccggctggacctgcccttcatgatgatgccccaccccctgctgcctgtgtccctgcccccagcctctgtggccatggccatgaaccagatgaaccacctgaacaccatcgccaacatggctgctgctgcccagatccacagccccctgagcagagctggcaccagcgtcatcaaggagcgcatccctgagagccccagccctgcccccagcctggaggagaaccaccggcccggcagccagaccagcagccacaccagcagctctgtgagcagcagccccagccagatggaccaccacctggagaggatggaggaggtgcctgtgcagatccccatcatgaagagccccctggacaagatccagctgaccccaggccaggccctgcctgctggcttccctggccccttcatctttgctgacagcctgagctctgtggagaccctgctgaccaacatccagggcctgctgaaggtggccctggacaatgcccgcatccaggagaagcagatccagcaggagaagaaggagctgcggctggagctgtaccgggagcgggagatccgggagaacctggagcggcagctggccgtggagctgcagagcaggaccaccatgcagaagaggctgaagaaggagaagaagaccaagaggaagctgcaggaggccctggagtttgagagcaagaggcgggagcaggtggagcaggccctgaagcaggccaccaccagtgacagcggcctgaggatgctgaaggacaccggcatcccagacattgaaattgagaacaacggcacccctcatgacagcgctgccatgcagggcggcaactactactgcctggagatggcccagcagctgtacagcgcctag

SEQ ID NO: 15321 - DNA, 1299 bp, Artificial Sequence
  Description of Artificial Sequence: Synthetic coding sequence
atgaccaggaagcaggccgtgaacagcagccggcccggccggccccccaagaggagcctgggcgtgctgcaggagaatgcccggctgctgacccatgctgtgcccggcctgctgagccctggcctcatcacccccaccggcatcacagctgctgccatggccgaggccatgaagctgcagaagatgaagctgatggccatgaacaccctgcagggcaatggcagccagaatggaacagaaagtgagccagatgacctgaacagcaacacaggaggcagcgagagctcctgggacaaggacaagatgcagagcccctttgctgcccctggcccccagcacggcatcgcccacgccgccctggccggccagcccggcatcggcggggcccccaccctgaaccccctgcagcagaaccacctgctgaccaaccggctggacctgcccttcatgatgatgccccaccccctgctgcctgtgtccctgcccccagcctctgtggccatggccatgaaccagatgaaccacctgaacaccatcgccaacatggctgctgctgcccagatccacagccccctgagcagagctggcaccagcgtcatcaaggagcgcatccctgagagccccagccctgcccccagcctggaggagaaccaccggcccggcagccagaccagcagccacaccagcagctctgtgagcagcagccccagccagatggaccaccacctggagaggatggaggaggtgcctgtgcagatccccatcatgaagagccccctggacaagatccagctgaccccaggccaggccctgcctgctggcttccctggccccttcatctttgctgacagcctgagctctgtggagaccctgctgaccaacatccagggcctgctgaaggtggccctggacaatgcccgcatccaggagaagcagatccagcaggagaagaaggagctgcggctggagctgtaccgggagcgggagatccgggagaacctggagcggcagctggccgtggagctgcagagcaggaccaccatgcagaagaggctgaagaaggagaagaagaccaagaggaagctgcaggaggccctggagtttgagagcaagaggcgggagcaggtggagcaggccctgaagcaggccaccaccagtgacagcggcctgaggatgctgaaggacaccggcatcccagacattgaaattgagaacaacggcacccctcatgacagcgctgccatgcagggcggcaactactactgcctggagatggcccagcagctgtacagcgcctag

SEQ ID NO: 15322 - DNA, 1143 bp, Artificial Sequence
  Description of Artificial Sequence: Synthetic coding sequence
atggccgaggccatgaagctgcagaagatgaagctgatggccatgaacaccctgcagggcaatggcagccagaatggaacagaaagtgagccagatgacctgaacagcaacacaggaggcagcgagagctcctgggacaaggacaagatgcagagcccctttgctgcccctggcccccagcacggcatcgcccacgccgccctggccggccagcccggcatcggcggggcccccaccctgaaccccctgcagcagaaccacctgctgaccaaccggctggacctgcccttcatgatgatgccccaccccctgctgcctgtgtccctgcccccagcctctgtggccatggccatgaaccagatgaaccacctgaacaccatcgccaacatggctgctgctgcccagatccacagccccctgagcagagctggcaccagcgtcatcaaggagcgcatccctgagagccccagccctgcccccagcctggaggagaaccaccggcccggcagccagaccagcagccacaccagcagctctgtgagcagcagccccagccagatggaccaccacctggagaggatggaggaggtgcctgtgcagatccccatcatgaagagccccctggacaagatccagctgaccccaggccaggccctgcctgctggcttccctggccccttcatctttgctgacagcctgagctctgtggagaccctgctgaccaacatccagggcctgctgaaggtggccctggacaatgcccgcatccaggagaagcagatccagcaggagaagaaggagctgcggctggagctgtaccgggagcgggagatccgggagaacctggagcggcagctggccgtggagctgcagagcaggaccaccatgcagaagaggctgaagaaggagaagaagaccaagaggaagctgcaggaggccctggagtttgagagcaagaggcgggagcaggtggagcaggccctgaagcaggccaccaccagtgacagcggcctgaggatgctgaaggacaccggcatcccagacattgaaattgagaacaacggcacccctcatgacagcgctgccatgcagggcggcaactactactgcctggagatggcccagcagctgtacagcgcctag

SEQ ID NO: 15323 - DNA, 1794 bp, Artificial Sequence
  Description of Artificial Sequence: Synthetic coding sequence
atgcagtggcccccaccctggaggaggagccccctggtgtctgccaccccacctcctggccccacccggggcctgctgtgccccaggagagtgtctgaggccggggacagcagcacagaaggagccaggacaggccaccgccactacgtgaccccagctgagagcgccatggagggccgcagccagcccctgcccagcctgcggcctgccagccccaccaatgccccagcccacggccggggcagtgactgcacagccaaggagccccccctggccaacgtgtgccggcagaactatggagctgcccaggaccctgtggagcctgctggaagaagaagtgccagccacgtgacaggcagcagcctgggcaaggccgaggtggcctgtggccgccgctggcgctgggccgagctgctggccgacacctcctggagccctgctggccgggccacagagatgaaggtgaagatgctgagcaggaacccagacaactacgtgcgggagaccaagctggacctgcagagggtgcccaggaactatgaccctgccctgcacccctttgaggtgccccgggagtacatccgggccctgaatgccaccaagctggagcgggtgtttgccaagcccttcctggccagcctggatggccacagagatggagtgaactgcctggccaagcaccctgagaagctggccaccgtgctgagcggggcctgtgatggagaggtgcgcatctggaacctgacccagaggaactgcatccgcaccatccaggcccacgagggctttgtgcggggcatctgcacccgcttctgtggcaccagcttcttcaccgtgggagatgacaagacagtgaagcagtggaagatggatggccctggctatggagatgaggaggagcccctgcacaccatcctgggcaagacagtgtacacaggcatcgaccaccactggaaggaggccgtgtttgccacctgtggccagcaggtggacatctgggatgagcagaggaccaaccccatctgcagcatgacctggggctttgacagcatcagctctgtgaagttcaaccccatcgagaccttcctgctgggcagctgtgccagtgacagaaatattgtgctgtatgacatgaggcaggccacccccctgaagaaggtgatcctggacatgaggaccaacaccatctgctggaaccccatggaggccttcatcttcaccgctgccaatgaagactacaacctgtacacctttgacatgagggccctggacacccctgtgatggtgcacatggaccacgtgtctgctgtgctggatgtggactacagccccaccgggaaggagtttgtgtctgccagctttgacaagagcatccgcatcttccctgtggacaagagccgcagccgggaggtgtaccacaccaagaggatgcagcacgtgatctgtgtgaagtggaccagtgacagcaagtacatcatgtgtggcagtgatgagatgaacatccggctgtggaaggccaatgccagcgagaagctgggcgtgctgaccagccgggagaaggccgccaaggactacaaccagaagctgaaggagaagttccagcactacccccacatcaagagaattgcccggcaccgccacctgcccaagagcatctacagccagatccaggagcagaggatcatgaaggaggcccggcggaggaaggaggtgaaccgcatcaagcacagcaagccaggctctgtgcccctggtgtctgagaagaagaagcacgtggtggccgtggtgaagtag

SEQ ID NO: 15324 - DNA, 291 bp, Artificial Sequence
  Description of Artificial Sequence: Synthetic coding sequence
atgaaggtgaagatgctgagcaggaacccagacaactacgtgcgggagaccaagctggacctgcagagggtgcccaggaactatgaccctgccctgcacccctttgaggtgccccgggagtacatccgggccctgaatgccaccaagctggagcgggtgtttgccaagcccttcctggccagcctggatggccacagagatggagtgaactgcctggccaagcaccctgagaagctggccaccgtgctgagcggggcctgtgatggagagctgaacatgatcaagctgtag

SEQ ID NO: 15325 - DNA, 2583 bp, Artificial Sequence
  Description of Artificial Sequence: Synthetic coding sequence
atgagccggggcggcagctacccccacctgctgtgggatgtgaggaagaggagcctgggcctggaggaccccagccggctgcggagccgctacctgggccggcgggagttcatccagaggctgaagctggaggccaccctgaatgtgcatgatggctgtgtgaacaccatctgctggaatgacaccggggagtacatcctgagcggcagtgatgacaccaagctggtgatcagcaacccctacagcaggaaggtgctgaccaccatccgcagcggccaccgggccaacatcttcagcgccaagttcctgccctgcaccaatgacaagcagatcgtgtcctgcagcggagatggagtcatcttctacaccaacgtggagcaggatgctgagaccaaccggcagtgccagttcacctgccactacggcaccacctatgagatcatgacagtgcccaatgacccctacaccttcctgagctgtggggaggatggcaccgtgcgctggtttgacacccgcatcaagaccagctgcaccaaggaggactgcaaggatgacatcctgatcaactgcagaagagctgccacctctgtggccatctgcccccccatcccctactacctggccgtgggctgcagcgacagctctgtgcgcatctatgacaggaggatgctgggcacccgggccactggaaattatgccggccggggcaccaccggcatggtggcccgcttcatccccagccacctgaacaacaagagctgccgggtgaccagcctgtgctacagtgaagatggccaggagatcctggtgtcctacagcagtgactacatctacctgtttgaccccaaggatgacacagcccgggagctgaagacccccagcgctgaggagcggcgggaggagctgcggcagccccctgtgaagaggctgcggctgcggggggactggagcgacaccggcccccgggcccggcctgagagcgagcgggagagagatggagagcagagccccaacgtgtccctgatgcagaggatgtctgacatgctgagccgctggtttgaggaggccagcgaggtggcccagagcaacagaggccggggccgcagccggccccggggcggcaccagccagagcgacatcagcaccctgcccaccgtgcccagcagcccagacctggaggtgtctgaaacagccatggaggtggacaccccagctgagcagttcctgcagcccagcaccagcagcaccatgtctgcccaggcccacagcaccagcagccccacagagagcccccacagcacccccctgctgagcagcccagacagcgagcagaggcagagcgtggaggccagcggccaccacacccaccaccagagcgacaacaacaatgagaagctgagccccaagccaggcaccggggagcctgtgctgagcctgcactacagcacagagggcaccaccaccagcaccatcaagctgaacttcacagatgagtggagcagcatcgccagcagcagccggggcatcggcagccactgcaagtctgagggccaggaggagagctttgtgccccagagctctgtgcagcccccagagggggacagcgagaccaaggcccctgaggagagcagtgaagatgtgaccaagtaccaggagggcgtgtctgcagaaaatcctgtggagaaccacatcaacatcacccagagcgacaagttcaccgccaagcccctggacagcaacagcggggagagaaatgacctgaacctggacaggagctgtggggtgcctgaggagagcgccagcagcgagaaggccaaggagcctgagaccagtgaccagaccagcacagagagcgccaccaatgaaaacaacaccaaccctgagccccagttccagacagaggccaccggccccagcgcccacgaggagaccagcacccgggacagcgccctgcaggacacagatgacagtgatgatgatcctgtgctgatccctggggcccgctacagagctggccctggggaccggcgctctgctgtggcccgcatccaggagttcttcagaagaaggaaggagaggaaggagatggaggagctggacaccctgaacatcagaagacccctggtgaagatggtgtacaagggccacaggaacagcaggaccatgatcaaggaggccaacttctggggcgccaactttgtgatgagcggcagtgactgtggccacatcttcatctgggacagacacacagctgagcacctgatgctgctggaggccgacaaccacgtggtgaactgcctgcagccccacccctttgaccccatcctggccagcagcggcattgattatgacatcaagatctggagccccctggaggagagccgcatcttcaacaggaagctggctgatgaagtcatcaccagaaatgagctgatgctggaggagaccaggaacaccatcaccgtgcctgccagcttcatgctgaggatgctggccagcctgaaccacatccgggctgaccggctggagggggacagaagtgagggcagcggccaggagaatgaaaatgaagatgaggagtag

SEQ ID NO: 15326 - DNA, 2856 bp, Artificial Sequence
  Description of Artificial Sequence: Synthetic coding sequence
atgagccggggcggcagctacccccacctgctgtgggatgtgaggaagaggagcctgggcctggaggaccccagccggctgcggagccgctacctgggccggcgggagttcatccagaggctgaagctggaggccaccctgaatgtgcatgatggctgtgtgaacaccatctgctggaatgacaccggggagtacatcctgagcggcagtgatgacaccaagctggtgatcagcaacccctacagcaggaaggtgctgaccaccatccgcagcggccaccgggccaacatcttcagcgccaagttcctgccctgcaccaatgacaagcagatcgtgtcctgcagcggagatggagtcatcttctacaccaacgtggagcaggatgctgagaccaaccggcagtgccagttcacctgccactacggcaccacctatgagatcatgacagtgcccaatgacccctacaccttcctgagctgtggggaggatggcaccgtgcgctggtttgacacccgcatcaagaccagctgcaccaaggaggactgcaaggatgacatcctgatcaactgcagaagagctgccacctctgtggccatctgcccccccatcccctactacctggccgtgggctgcagcgacagctctgtgcgcatctatgacaggaggatgctgggcacccgggccactggaaattatgccggccggggcaccaccggcatggtggcccgcttcatccccagccacctgaacaacaagagctgccgggtgaccagcctgtgctacagtgaagatggccaggagatcctggtgtcctacagcagtgactacatctacctgtttgaccccaaggatgacacagcccgggagctgaagacccccagcgctgaggagcggcgggaggagctgcggcagccccctgtgaagaggctgcggctgcggggggactggagcgacaccggcccccgggcccggcctgagagcgagcgggagagagatggagagcagagccccaacgtgtccctgatgcagaggatgtctgacatgctgagccgctggtttgaggaggccagcgaggtggcccagagcaacagaggccggggccgcagccggccccggggcggcaccagccagagcgacatcagcaccctgcccaccgtgcccagcagcccagacctggaggtgtctgaaacagccatggaggtggacaccccagctgagcagttcctgcagcccagcaccagcagcaccatgtctgcccaggcccacagcaccagcagccccacagagagcccccacagcacccccctgctgagcagcccagacagcgagcagaggcagagcgtggaggccagcggccaccacacccaccaccagagcgagttcctgcggggccctgagatcgccctgctgaggaagaggctgcagcagctgcggctgaagaaggccgagcagcagaggcagcaggagctggccgcccacacccagcagcagcccagcaccagtgaccagagcagccatgagggcagcagccaggacccccacgccagtgacagccccagctctgtggtgaacaagcagctgggctccatgagcctggatgagcagcaggacaacaacaatgagaagctgagccccaagccaggcactggagagcctgtgctgagcctgcactacagcacagagggcaccaccaccagcaccatcaagctgaacttcacagatgagtggagcagcatcgccagcagcagccggggcatcggcagccactgcaagtctgagggccaggaggagagctttgtgccccagagctctgtgcagcccccagagggggacagcgagaccaaggcccctgaggagagcagtgaagatgtgaccaagtaccaggagggcgtgtctgctgagaaccctgtggagaaccacatcaacatcacccagagcgacaagttcaccgccaagcccctggacagcaacagcggggagagaaatgacctgaacctggacaggagctgtggggtgcctgaggagagcgccagcagcgagaaggccaaggagcctgagaccagtgaccagaccagcacagaaagtgccaccaatgaaaacaacaccaaccctgagccccagttccagacagaggccaccggccccagcgcccacgaggagaccagcacccgggacagcgccctgcaggacacagatgacagtgatgatgatcctgtgctgatccctggggcccgctaccgggccggccctggggaccgcttcaacatccggggcaccaccatcggggaccgcatcatgagaagatctgctgtggcccgcatccaggagttcttcagaagaaggaaggagaggaaggagatggaggagctggacaccctgaacatccggcggcccctggtgaagatggtgtacaagggccacaggaacagcaggaccatgatcaaggaggccaacttctggggcgccaactttgtgatgagcggcagtgactgtggccacatcttcatctgggacagacacacagctgagcacctgatgctgctggaggccgacaaccacgtggtgaactgcctgcagccccacccctttgaccccatcctggccagcagcggcatcgactatgacatcaagatctggagccccctggaggagagccgcatcttcaacaggaagctggctgatgaggtgatcaccagaaatgagctgatgctggaggagaccaggaacaccatcaccgtgcctgccagcttcatgctgaggatgctggccagcctgaaccacatccgggctgaccggctggagggggacagaagtgagggcagcggccaggagaatgaaaatgaagatgaggagtag

SEQ ID NO: 15327 - DNA, 2643 bp, Artificial Sequence
  Description of Artificial Sequence: Synthetic coding sequence
atgagccggggcggcagctacccccacctgctgtgggatgtgaggaagaggagcctgggcctggaggaccccagccggctgcggagccgctacctgggccggcgggagttcatccagaggctgaagctggaggccaccctgaatgtgcatgatggctgtgtgaacaccatctgctggaatgacaccggggagtacatcctgagcggcagtgatgacaccaagctggtgatcagcaacccctacagcaggaaggtgctgaccaccatccgcagcggccaccgggccaacatcttcagcgccaagttcctgccctgcaccaatgacaagcagatcgtgtcctgcagcggagatggagtcatcttctacaccaacgtggagcaggatgctgagaccaaccggcagtgccagttcacctgccactacggcaccacctatgagatcatgacagtgcccaatgacccctacaccttcctgagctgtggggaggatggcaccgtgcgctggtttgacacccgcatcaagaccagctgcaccaaggaggactgcaaggatgacatcctgatcaactgcagaagagctgccacctctgtggccatctgcccccccatcccctactacctggccgtgggctgcagcgacagctctgtgcgcatctatgacaggaggatgctgggcacccgggccactggaaattatgccggccggggcaccaccggcatggtggcccgcttcatccccagccacctgaacaacaagagctgccgggtgaccagcctgtgctacagtgaagatggccaggagatcctggtgtcctacagcagtgactacatctacctgtttgaccccaaggatgacacagcccgggagctgaagacccccagcgctgaggagcggcgggaggagctgcggcagccccctgtgaagaggctgcggctgcggggggactggagcgacaccggcccccgggcccggcctgagagcgagcgggagagagatggagagcagagccccaacgtgtccctgatgcagaggatgtctgacatgctgagccgctggtttgaggaggccagcgaggtggcccagagcaacagaggccggggccgcagccggccccggggcggcaccagccagagcgacatcagcaccctgcccaccgtgcccagcagcccagacctggaggtgtctgaaacagccatggaggtggacaccccagctgagcagttcctgcagcccagcaccagcagcaccatgtctgcccaggcccacagcaccagcagccccacagagagcccccacagcacccccctgctgagcagcccagacagcgagcagaggcagagcgtggaggccagcggccaccacacccaccaccagagcgacagccccagctctgtggtgaacaagcagctgggctccatgagcctggatgagcagcaggacaacaacaatgagaagctgagccccaagccaggcaccggggagcctgtgctgagcctgcactacagcacagagggcaccaccaccagcaccatcaagctgaacttcacagatgagtggagcagcatcgccagcagcagccggggcatcggcagccactgcaagtctgagggccaggaggagagctttgtgccccagagctctgtgcagcccccagagggggacagcgagaccaaggcccctgaggagagcagtgaagatgtgaccaagtaccaggagggcgtgtctgcagaaaatcctgtggagaaccacatcaacatcacccagagcgacaagttcaccgccaagcccctggacagcaacagcggggagagaaatgacctgaacctggacaggagctgtggggtgcctgaggagagcgccagcagcgagaaggccaaggagcctgagaccagtgaccagaccagcacagagagcgccaccaatgaaaacaacaccaaccctgagccccagttccagacagaggccaccggccccagcgcccacgaggagaccagcacccgggacagcgccctgcaggacacagatgacagtgatgatgatcctgtgctgatccctggggcccgctacagagctggccctggggaccggcgctctgctgtggcccgcatccaggagttcttcagaagaaggaaggagaggaaggagatggaggagctggacaccctgaacatcagaagacccctggtgaagatggtgtacaagggccacaggaacagcaggaccatgatcaaggaggccaacttctggggcgccaactttgtgatgagcggcagtgactgtggccacatcttcatctgggacagacacacagctgagcacctgatgctgctggaggccgacaaccacgtggtgaactgcctgcagccccacccctttgaccccatcctggccagcagcggcattgattatgacatcaagatctggagccccctggaggagagccgcatcttcaacaggaagctggctgatgaagtcatcaccagaaatgagctgatgctggaggagaccaggaacaccatcaccgtgcctgccagcttcatgctgaggatgctggccagcctgaaccacatccgggctgaccggctggagggggacagaagtgagggcagcggccaggagaatgaaaatgaagatgaggagtag

SEQ ID NO: 15328 - DNA, 2763 bp, Artificial Sequence
  Description of Artificial Sequence: Synthetic coding sequence
atgagccggggcggcagctacccccacctgctgtgggatgtgaggaagaggagcctgggcctggaggaccccagccggctgcggagccgctacctgggccggcgggagttcatccagaggctgaagctggaggccaccctgaatgtgcatgatggctgtgtgctgaccaccatccgcagcggccaccgggccaacatcttcagcgccaagttcctgccctgcaccaatgacaagcagatcgtgtcctgcagcggagatggagtcatcttctacaccaacgtggagcaggatgctgagaccaaccggcagtgccagttcacctgccactacggcaccacctatgagatcatgacagtgcccaatgacccctacaccttcctgagctgtggagaagatggcaccgtgcgctggtttgacacccgcatcaagaccagctgcaccaaggaggactgcaaggatgacatcctgatcaactgccggcgggccgccacctctgtggccatctgcccccccatcccctactacctggccgtgggctgcagcgacagctctgtgcgcatctatgacaggaggatgctgggcacccgggccaccggcaactatgccggccggggcaccaccggcatggtggcccgcttcatccccagccacctgaacaacaagagctgccgggtgaccagcctgtgctacagtgaagatggccaggagatcctggtgtcctacagcagtgactacatctacctgtttgaccccaaggatgacacagcccgggagctgaagaccccatctgctgaggagcggcgggaggagctgcggcagccccctgtgaagaggctgcggctgcggggggactggagcgacaccggcccccgggcccggcctgagagcgagcgggagagagatggagagcagagccccaacgtgtccctgatgcagaggatgtctgacatgctgagccgctggtttgaggaggccagcgaggtggcccagagcaacagaggccggggccgcagccggccccggggcggcaccagccagagcgacatcagcaccctgcccaccgtgcccagcagcccagacctggaggtgtctgaaacagccatggaggtggacaccccagctgagcagttcctgcagcccagcaccagcagcaccatgtctgcccaggcccacagcaccagcagccccacagagagcccccacagcacccccctgctgagcagcccagattctgagcagaggcagagcgtggaggccagcggccaccacacccaccaccagagcgagttcctgcggggccctgagatcgccctgctgaggaagaggctgcagcagctgcggctgaagaaggccgagcagcagaggcagcaggagctggccgcccacacccagcagcagcccagcaccagtgaccagagcagccatgagggcagcagccaggacccccacgccagtgacagccccagctctgtggtgaacaagcagctgggctccatgagcctggatgagcagcaggacaacaacaatgagaagctgagccccaagccaggcaccggggagcctgtgctgagcctgcactacagcacagagggcaccaccaccagcaccatcaagctgaacttcacagatgagtggagcagcatcgccagcagcagccggggcatcggcagccactgcaagtctgagggccaggaggagagctttgtgccccagagctctgtgcagcccccagagggggacagcgagaccaaggcccctgaggagagcagtgaagatgtgaccaagtaccaggagggcgtgtctgcagaaaatcctgtggagaaccacatcaacatcacccagagcgacaagttcaccgccaagcccctggacagcaacagcggggagagaaatgacctgaacctggacaggagctgtggggtgcctgaggagagcgccagcagcgagaaggccaaggagcctgagaccagtgaccagaccagcacagagagcgccaccaatgaaaacaacaccaaccctgagccccagttccagacagaggccaccggccccagcgcccacgaggagaccagcacccgggacagcgccctgcaggacacagatgacagtgatgatgatcctgtgctgatccctggggcccgctacagagctggccctggggaccgcttcaacatccggggcaccaccatcggggaccgcatcatgagaagatctgctgtggcccgcatccaggagttcttcagaagaaggaaggagaggaaggagatggaggagctggacaccctgaacatcagaagacccctggtgaagatggtgtacaagggccacaggaacagcaggaccatgatcaaggaggccaacttctggggcgccaactttgtgatgagcggcagtgactgtggccacatcttcatctgggacagacacacagctgagcacctgatgctgctggaggccgacaaccacgtggtgaactgcctgcagccccacccctttgaccccatcctggccagcagcggcattgattatgacatcaagatctggagccccctggaggagagccgcatcttcaacaggaagctggctgatgaagtcatcaccagaaatgagctgatgctggaggagaccaggaacaccatcaccgtgcctgccagcttcatgctgaggatgctggccagcctgaaccacatccgggctgaccggctggagggggacagaagtgagggcagcggccaggagaatgaaaatgaagatgaggagtag

SEQ ID NO: 15329 - DNA, 1524 bp, Artificial Sequence
  Description of Artificial Sequence: Synthetic coding sequence
atggaggacagcgaggccctgggctttgagcacatgggcctggacccccggctgctgcaggccgtgacagacctgggctggagccggcccaccctcatccaggagaaggccatccccctggccctggagggcaaggacctgctggcccgggccaggactggaagtggcaagacagctgcctatgccatccccatgctgcagctgctgctgcacaggaaggccactggacctgtggtggagcaggccgtgcggggcctggtgctggtgcccaccaaggagctggcccggcaggcccagagcatgatccagcagctggccacctactgtgccagagatgtgcgggtggccaacgtgtctgctgctgaggacagcgtgtcccagagagctgtgctgatggagaagccagatgtggtggtgggcacccccagccgcatcctgagccacctgcagcaggacagcctgaagctgcgggacagcctggagctgctggtggtggatgaggccgacctgctcttctcctttggatttgaggaggagctgaagagcctgctgtgccacctgccccgcatctaccaggccttcctgatgtctgccaccttcaatgaagatgtgcaggccctgaaggagctgatcctgcacaaccctgtgaccctgaagctgcaggagagccagctgcccggccctgaccagctgcagcagttccaggtggtgtgtgaaacagaggaggacaagttcctgctgctgtatgccctgctgaagctgagcctcatccggggcaagagcctgctgtttgtgaacaccctggagaggagctaccgcctgcggctcttcctggagcagttcagcatccccacctgtgtgctgaatggagagctgcccctgcggagccgggccagtgaccctgaggccggcgtggcccggggcatcgacttccaccacgtgtctgctgtgctgaactttgacctgccccccaccccagaggcctacatccacagagctggccgcacagcccgggccaacaaccctggcatcgtgctgacctttgtgctgcccacagagcagttccacctgggcaagattgaggagctgctgtctggagaaaatagaggccccatcctgctgccctaccagttcaggatggaggagattgagggcttccgctaccgctgcagagatgccatgaggtctgtgaccaagcaggccatccgggaggcccggctgaaggagatcaaggaggagctgctgcacagcgagaagctgaagacctactttgaggacaacccccgggacctgcagctgctgcggcatgacctgcccctgcaccctgctgtggtgaagccccacctgggccacgtgcctgactacctggtgcccccagccctgcggggcctggtgcggccccacaagaagaggaagaagctgagcagcagctgcaggaaggccaagagggccaagagccagaaccccctgcggagcttcaagcacaagggcaagaagttccggcccacagccaagcccagctag

SEQ ID NO: 15330 - DNA, 2391 bp, Artificial Sequence
  Description of Artificial Sequence: Synthetic coding sequence
atggtgctggcccagaggagaagaggaggctgtgagaagctgcgggccggcccccaggccgtgctggccagcggcagcggcttctgtgacaacatgctggccgacctgggcctgattggcaccatcggggaggatgatgaggtgcctgtggagcctgagagtgacagcggagatgaggaggaggagggccccatcgtgctgggccggcggcagaaggccctgggcaagaacagatctgctgacttcaacccagactttgtgttcacagagaaggagggcacctatgatggctcctgggccctggctgatgtgatgagccagctgaagaagaagagagctgccaccaccctggatgagaagattgagaaggtgaggaagaagaggaagacagaggacaaggaggccaagagcggcaagctggagaaggagaaggaggccaaggagggcagcgagcccaaggagcaggaggacctgcaggagaatgatgaggagggctctgaagatgaggccagcgagacagactacagcagcgcagatgagaacatcctgaccaaggctgacaccctgaaggtgaaggacaggaagaagaagaagaagaagggccaggaggccggcggcttctttgaagatgccagccagtatgatgagaacctgtccttccaggacatgaacctgagccggcccctgctgaaggccatcacagccatgggcttcaagcagcccacccccatccagaaggcctgcatccctgtgggcctgctgggcaaggacatctgtgcctgtgccgccaccggcaccgggaagacagctgcctttgccctgcctgtgctggagcggctcatctacaagccccggcaggcccctgtgaccagggtgctggtgctggtgcccacccgggagctgggcatccaggtgcacagcgtgacccggcagctggcccagttctgcaacatcaccacctgcctggccgtgggcggcctggatgtgaagagccaggaggccgccctgcgggccgccccagacatcctgattgccaccccaggccgcctgattgaccacctgcacaactgccccagcttccacctgagcagcattgaggtgctgatcctggatgaagctgacaggatgctggatgagtactttgaggagcagatgaaggagatcatccgcatgtgcagccaccaccggcagaccatgctgttcagcgccaccatgacagatgaggtgaaggacctggcctctgtgtccctgaagaaccctgtgcgcatctttgtgaacagcaacacagatgtggcccccttcctgcggcaggagttcatccgcatccggcccaaccgggagggggaccgggaggccatcgtggccgccctgctgaccaggaccttcacagaccacgtgatgctgttcacccagaccaagaagcaggcccacaggatgcacatcctgctgggcctgatgggcctgcaggtgggggagctgcacggcaacctgagccagacccagaggctggaggccctgcggcgcttcaaggatgagcagattgacatcctggtggccacagatgtggccgcccggggcctggacattgaaggagtgaagacagtcatcaacttcaccatgcccaacaccatcaagcactacgtgcaccgggtgggccgcacagcccgggccggccgggccggccgctctgtgtccctggtgggagaagatgagaggaagatgctgaaggagatcgtgaaggccgccaaggcccctgtgaaggcccgcatcctgccccaggacgtcatcctgaagttccgggacaagattgagaagatggagaaggatgtgtatgctgtgctgcagctggaggccgaggagaaggagatgcagcagagcgaggcccagatcaacacagccaagaggctgctggagaagggcaaggaggccgtggtgcaggagcctgagaggtcctggttccagaccaaggaggagaggaagaaggagaagatcgccaaggccctgcaggagtttgacctggccctgcggggcaagaagaagaggaagaagttcatgaaggatgccaagaagaagggggagatgacagctgaggagaggagccagtttgagatcctgaaggcccagatgtttgctgagcggctggccaagaggaacagaagagccaagagggcccgggccatgcctgaggaggagcctgtgcggggccctgccaagaagcagaagcagggcaagaagtctgtgtttgatgaggagctgaccaacaccagcaagaaggccctgaagcagtacagagctggccccagctttgaggagaggaagcagctgggcctgccccaccagaggagaggaggcaacttcaagagcaagagccgctacaagaggaggaagtag

SEQ ID NO: 15331 - DNA, 411 bp, Artificial Sequence
  Description of Artificial Sequence: Synthetic coding sequence
atggtgctggcccagaggagaagaggaggctgtgagaagctgcgggccggcccccaggccgtgctggccagcggcagcggcttctgtgacaacatgctggccgacctgggcctgattggcaccatcggggaggatgatgaggtgcctgtggagcctgagagtgacagcggagatgaggaggaggagggccccatcgtgctgggccggcggcagaaggccctgggcaagaacagatctgctgacttcaacccagactttgtgttcacagagaaggagggcacctatgatggctcctgggccctggctgatgtgatgagccagctgaagaagaagagagctgccaccaccctggatgagaagattgagaaggtgaggaagaagaggaagaagaagaagaagaagaagaagtag

SEQ ID NO: 15332 - DNA, 1758 bp, Artificial Sequence
  Description of Artificial Sequence: Synthetic coding sequence
atggccccagacctggccagccagaggcacagcgagagcttccccagcgtgaacagccggcccaacgtcatcctgcccggccgggagggcagaagagagggcctgcccccaggcggcggcacccggggcagcctggtgcccaccaggcctgtgccccccagccctgcccccctgggcaccagcccctacagctggagccgcagcggccctggccggggcggcggggccggcagcagccgggtgccccggggcgtgcccggccctgctgtgtgtgcccctggcagcctgctgcaccacgccagccccacccagaccatggctgctgctgatggcagcctgtttgacaaccccaggaccttcagccggcggcccccagcccaggccagccggcaggccaaggccaccaagaggaagtaccaggccagcagcgaggcccccccagccaagagaagaaatgagaccagcttcctgcctgccaagaagacctctgtgaaggagacccagaggaccttcaagggaaatgcccagaagatgttcagccccaagaagcacagcgtgtccaccagtgacaggaaccaggaggagcggcagtgcatcaagaccagcagcctcttcaagaacaacccagacatccctgagctgcacaggcctgtggtgaagcaggtgcaggagaaggtgttcaccagcgctgccttccacgagctgggcctgcacccccacctgatcagcaccatcaacacagtgctgaagatgagctccatgacctctgtgcagaagcagagcatccctgtgctgctggagggcagagatgccctggtgcgcagccagacaggcagcggcaagaccctggcctactgcatccctgtggtgcagagcctgcaggccatggagagcaagatccagaggagtgatggcccctatgccctggtgctggtgcccacccgggagctggccctgcagagctttgacacagtgcagaagctgctgaagcccttcacctggatcgtgcctggggtgctgatgggcggggagaagaggaagtctgagaaggcccggctgaggaagggcatcaacatcctgatcagcaccccaggccgcctggtggaccacatcaagagcaccaagaacatccacttcagccggctgcgctggctggtgtttgatgaggccgaccgcatcctggacctgggctttgagaaggacatcaccgtcatcctgaatgctgtgaatgctgagtgccagaagaggcagaatgtgctgctgagcgccaccctgacagagggcgtgacccggctggccgacatcagcctgcatgaccctgtgtccatctctgtgctggacaagagccatgaccagctgaaccccaaggacaaggctgtgcaggaggtgtgccccccacctgctggggacaagctggacagctttgccatccctgagagcctgaagcagcacgtgacagtggtgcccagcaagctgcggctggtgtgcctggccgccttcatcctgcagaagtgcaagtttgaggaggaccagaagatggtggtgttcttcagcagctgtgagctggtggagttccactacagcctcttcctgcagaccctgctgagcagcagcggggccccagccagcggccagctgcccagcgcctccatgaggctgaagttcctgcggctgcatggaggcatggagcaggaggagaggacagctgtgttccaggagttcagccacagccggcggggcgtgctgctgtgcacctag

SEQ ID NO: 15333 - DNA, 2337 bp, Artificial Sequence
  Description of Artificial Sequence: Synthetic coding sequence
atggccccagacctggccagccagaggcacagcgagagcttccccagcgtgaacagccggcccaacgtcatcctgcccggccgggagggcagaagagagggcctgcccccaggcggcggcacccggggcagcctggtgcccaccaggcctgtgccccccagccctgcccccctgggcaccagcccctacagctggagccgcagcggccctggccggggcggcggggccggcagcagccgggtgccccggggcgtgcccggccctgctgtgtgtgcccctggcagcctgctgcaccacgccagccccacccagaccatggctgctgctgatggcagcctgtttgacaaccccaggaccttcagccggcggcccccagcccaggccagccggcaggccaaggccaccaagaggaagtaccaggccagcagcgaggcccccccagccaagagaagaaatgagaccagcttcctgcctgccaagaagacctctgtgaaggagacccagaggaccttcaagggaaatgcccagaagatgttcagccccaagaagcacagcgtgtccaccagtgacaggaaccaggaggagcggcagtgcatcaagaccagcagcctcttcaagaacaacccagacatccctgagctgcacaggcctgtggtgaagcaggtgcaggagaaggtgttcaccagcgctgccttccacgagctgggcctgcacccccacctgatcagcaccatcaacacagtgctgaagatgagctccatgacctctgtgcagaagcagagcatccctgtgctgctggagggcagagatgccctggtgcgcagccagacaggcagcggcaagaccctggcctactgcatccctgtggtgcagagcctgcaggccatggagagcaagatccagaggagtgatggcccctatgccctggtgctggtgcccacccgggagctggccctgcagagctttgacacagtgcagaagctgctgaagcccttcacctggatcgtgcctggggtgctgatgggcggggagaagaggaagtctgagaaggcccggctgaggaagggcatcaacatcctgatcagcaccccaggccgcctggtggaccacatcaagagcaccaagaacatccacttcagccggctgcgctggctggtgtttgatgaggccgaccgcatcctggacctgggctttgagaaggacatcaccgtcatcctgaatgctgtgaatgctgagtgccagaagaggcagaatgtgctgctgagcgccaccctgacagagggcgtgacccggctggccgacatcagcctgcatgaccctgtgtccatctctgtgctggacaagagccatgaccagctgaaccccaaggacaaggctgtgcaggaggtgtgccccccacctgctggggacaagctggacagctttgccatccctgagagcctgaagcagcacgtgacagtggtgcccagcaagctgcggctggtgtgcctggccgccttcatcctgcagaagtgcaagtttgaggaggaccagaagatggtggtgttcttcagcagctgtgagctggtggagttccactacagcctcttcctgcagaccctgctgagcagcagcggggccccagccagcggccagctgcccagcgcctccatgaggctgaagttcctgcggctgcatggaggcatggagcaggaggagaggacagctgtgttccaggagttcagccacagccggcggggcgtgctgctgtgcacagatgtggccgcccggggcctggacctgccccaggtgacctggatcgtgcagaacaccagcacaggcctggaggagcccccaggcctggccgccatgggcgccgcctgcagcttctggctgctgcggcggcagaacatgagcacccgctggctgctgaccaagagcaccctgcagagcttcatccaggcctatgccacctacccccgggagctgaagcacatcttccacgtgcgcagcctgcacctgggccacgtggccaagagctttggcctgagagatgcccccaggaacctgagcgccctgaccaggaagaagaggaaggcccacgtgaagaggccagacctgcacaagaagacccagagcaagcacagcctggccgagatcctgcggtctgagtacagcagcggcatggaggccgacatcgccaaggtgaagaagcagaatgcccctggagagcccggcggccggcccctgcagcacagcctgcagcccaccccctgcttcggccggggcaagaccctgaagtggaggaagacccagaagggcgtgcagagggacagcaagaccagccagaaggtgtag

SEQ ID NO: 15334 - DNA, 2328 bp, Artificial Sequence
  Description of Artificial Sequence: Synthetic coding sequence
atggccccagacctggccagccagaggcacagcgagagcttccccagcgtgaacagccggcccaacgtcatcctgcccggccgggagggcagaagagagggcctgcccccaggcggcggcacccggggcagcctggtgcccaccaggcctgtgccccccagccctgcccccctgggcaccagcccctacagctggagccgcagcggccctggccggggcggcggggccggcagcagccgggtgccccggggcgtgcccggccctgctgtgtgtgcccctggcagcctgctgcaccacgccagccccacccagaccatggctgctgctgatggcagcctgtttgacaaccccaggaccttcagccggcggcccccagcccaggccagccggcaggccaaggccaccaagaggaagtaccaggccagcagcgaggcccccccagccaagagaagaaatgagaccagcttcctgcctgccaagaagacctctgtgaaggagacccagaggaccttcaagggaaatgcccagaagatgttcagccccaagaagcacagcgtgtccaccagtgacaggaaccaggaggagcggcagtgcatcaagaccagcagcctcttcaagaacaacccagacatccctgagctgcacaggcctgtggtgaagcaggtgcaggagaaggtgttcaccagcgctgccttccacgagctgggcctgcacccccacctgatcagcaccatcaacacagtgctgaagatgagctccatgacctctgtgcagaagcagagcatccctgtgctgctggagggcagagatgccctggtgcgcagccagacaggcagcggcaagaccctggcctactgcatccctgtggtgcagagcctgcaggccatggagagcaagatccagaggagtgatggcccctatgccctggtgctggtgcccacccgggagctggccctgcagagctttgacacagtgcagaagctgctgaagcccttcacctggatcgtgcctggggtgctgatgggcggggagaagaggaagtctgagaaggcccggctgaggaagggcatcaacatcctgatcagcaccccaggccgcctggtggaccacatcaagagcaccaagaacatccacttcagccggctgcgctggctggtgtttgatgaggccgaccgcatcctggacctgggctttgagaaggacatcaccgtcatcctgaatgctgtgaatgctgagtgccagaagaggcagaatgtgctgctgagcgccaccctgacagagggcgtgacccggctggccgacatcagcctgcatgaccctgtgtccatctctgtgctggacaagagccatgaccagctgaaccccaaggacaaggctgtgcaggaggtgtgccccccacctgctggggacaagctggacagctttgccatccctgagagcctgaagcagcacgtgacagtggtgcccagcaagctgcggctggtgtgcctggccgccttcatcctgcagaagtgcaagtttgaggaggaccagaagatggtggtgttcttcagcagctgtgagctggtggagttccactacagcctcttcctgcagaccctgctgagcagcagcggggccccagccagcggccagctgcccagcgcctccatgaggctgaagttcctgcggctgcatggaggcatggagcaggaggagaggacagctgtgttccaggagttcagccacagccggcggggcgtgctgctgtgcacagatgtggccgcccggggcctggacctgccccaggtgacctggatcgtgcagtacaatgcccccagcagccctgctgagtacatccaccgcatcggccgcacagcccgcatcggctgccacggcagcagcctgctgatcctggcccccagcgaggccgagtatgtgaacagcctggccagccacaagatcaacgtgtctgagatcaagatggaggacatcctgtgtgtgctgaccagagatgactgcttcaagggcaagcgctggggcgcccagaagagccatgctgtgggcccccaggagatccgggagcgggccaccgtgctgcagacagtgtttgaggactatgtgcacagcagcgagcggcgggtgtcctgggccaagaaggtgtggagcctggagacccctgtgctgacagccagcctgcctgccctcttctccttcagcagcgctgtgctgcaccccagcctgcggcacctgccccagggcgctgaggcccacctgccccggcccatccccccaccctgggcctgtggggaggagctgcggaccaagcgctgcccccaggagagctag

SEQ ID NO: 15335 - DNA, 2556 bp, Artificial Sequence
  Description of Artificial Sequence: Synthetic coding sequence
atggccccagacctggccagccagaggcacagcgagagcttccccagcgtgaacagccggcccaacgtcatcctgcccggccgggagggcagaagagagggcctgcccccaggcggcggcacccggggcagcctggtgcccaccaggcctgtgccccccagccctgcccccctgggcaccagcccctacagctggagccgcagcggccctggccggggcggcggggccggcagcagccgggtgccccggggcgtgcccggccctgctgtgtgtgcccctggcagcctgctgcaccacgccagccccacccagaccatggctgctgctgatggcagcctgtttgacaaccccaggaccttcagccggcggcccccagcccaggccagccggcaggccaaggccaccaagaggaagtaccaggccagcagcgaggcccccccagccaagagaagaaatgagaccagcttcctgcctgccaagaagacctctgtgaaggagacccagaggaccttcaagggaaatgcccagaagatgttcagccccaagaagcacagcgtgtccaccagtgacaggaaccaggaggagcggcagtgcatcaagaccagcagcctcttcaagaacaacccagacatccctgagctgcacaggcctgtggtgaagcaggtgcaggagaaggtgttcaccagcgctgccttccacgagctgggcctgcacccccacctgatcagcaccatcaacacagtgctgaagatgagctccatgacctctgtgcagaagcagagcatccctgtgctgctggagggcagagatgccctggtgcgcagccagacaggcagcggcaagaccctggcctactgcatccctgtggtgcagagcctgcaggccatggagagcaagatccagaggagtgatggcccctatgccctggtgctggtgcccacccgggagctggccctgcagagctttgacacagtgcagaagctgctgaagcccttcacctggatcgtgcctggggtgctgatgggcggggagaagaggaagtctgagaaggcccggctgaggaagggcatcaacatcctgatcagcaccccaggccgcctggtggaccacatcaagagcaccaagaacatccacttcagccggctgcgctggctggtgtttgatgaggccgaccgcatcctggacctgggctttgagaaggacatcaccgtcatcctgaatgctgtgaatgctgagtgccagaagaggcagaatgtgctgctgagcgccaccctgacagagggcgtgacccggctggccgacatcagcctgcatgaccctgtgtccatctctgtgctggacaagagccatgaccagctgaaccccaaggacaaggctgtgcaggaggtgtgccccccacctgctggggacaagctggacagctttgccatccctgagagcctgaagcagcacgtgacagtggtgcccagcaagctgcggctggtgtgcctggccgccttcatcctgcagaagtgcaagtttgaggaggaccagaagatggtggtgttcttcagcagctgtgagctggtggagttccactacagcctcttcctgcagaccctgctgagcagcagcggggccccagccagcggccagctgcccagcgcctccatgaggctgaagttcctgcggctgcatggaggcatggagcaggaggagaggacagctgtgttccaggagttcagccacagccggcggggcgtgctgctgtgcacagatgtggccgcccggggcctggacctgccccaggtgacctggatcgtgcagtacaatgcccccagcagccctgctgagtacatccaccgcatcggccgcacagcccgcatcggctgccacggcagcagcctgctgatcctggcccccagcgaggccgagtatgtgaacagcctggccagccacaagatcaacgtgtctgagatcaagatggaggacatcctgtgtgtgctgaccagagatgactgcttcaagggcaagcgctggggcgcccagaagagccatgctgtgggcccccaggagatccgggagcgggccaccgtgctgcagacagtgtttgaggactatgtgcacagcagcgagcggcgggtgtcctgggccaagaaggccctgcagagcttcatccaggcctatgccacctacccccgggagctgaagcacatcttccacgtgcgcagcctgcacctgggccacgtggccaagagctttggcctgagagatgcccccaggaacctgagcgccctgaccaggaagaagaggaaggcccacgtgaagaggccagacctgcacaagaagacccagagcaagcacagcctggccgagatcctgcggtctgagtacagcagcggcatggaggccgacatcgccaaggtgaagaagcagaatgcccctggagagcccggcggccggcccctgcagcacagcctgcagcccaccccctgcttcggccggggcaagaccctgaagtggaggaagacccagaagggcgtgcagagggacagcaagaccagccagaaggtgtag

SEQ ID NO: 15336 - DNA, 2169 bp, Artificial Sequence
  Description of Artificial Sequence: Synthetic coding sequence
atgcaggccaaggccaccaagaggaagtaccaggccagcagcgaggcccccccagccaagagaagaaatgagaccagcttcctgcctgccaagaagacctctgtgaaggagacccagaggaccttcaagggaaatgcccagaagatgttcagccccaagaagcacagcgtgtccaccagtgacaggaaccaggaggagcggcagtgcatcaagaccagcagcctcttcaagaacaacccagacatccctgagctgcacaggcctgtggtgaagcaggtgcaggagaaggtgttcaccagcgctgccttccacgagctgggcctgcacccccacctgatcagcaccatcaacacagtgctgaagatgagctccatgacctctgtgcagaagcagagcatccctgtgctgctggagggcagagatgccctggtgcgcagccagacaggcagcggcaagaccctggcctactgcatccctgtggtgcagagcctgcaggccatggagagcaagatccagaggagtgatggcccctatgccctggtgctggtgcccacccgggagctggccctgcagagctttgacacagtgcagaagctgctgaagcccttcacctggatcgtgcctggggtgctgatgggcggggagaagaggaagtctgagaaggcccggctgaggaagggcatcaacatcctgatcagcaccccaggccgcctggtggaccacatcaagagcaccaagaacatccacttcagccggctgcgctggctggtgtttgatgaagctgaccgcatcctggacctgggctttgagaaggacatcaccgtcatcctgaatgctgtgaatgctgagtgccagaagaggcagaatgtgctgctgagcgccaccctgacagaaggagtgacccggctggccgacatcagcctgcatgaccctgtgtccatctctgtgctggacaagagccatgaccagctgaaccccaaggacaaggctgtgcaggaggtgtgccccccacctgctggggacaagctggacagctttgccatccctgagagcctgaagcagcacgtgacagtggtgcccagcaagctgcggctggtgtgcctggccgccttcatcctgcagaagtgcaagtttgaggaggaccagaagatggtggtgttcttcagcagctgtgagctggtggagttccactacagcctcttcctgcagaccctgctgagcagcagcggggccccagccagcggccagctgcccagcgcctccatgaggctgaagttcctgcggctgcacggcggcatggagcaggaggagaggacagctgtgttccaggagttcagccacagcagaagaggagtgctgctgtgcacagatgtggccgcccggggcctggacctgccccaggtgacctggatcgtgcagtacaatgcccccagcagccctgctgagtacatccacagaattggaagaacagccagaattggctgccacggcagcagcctgctgatcctggcccccagcgaggccgagtatgtgaacagcctggccagccacaagatcaacgtgtctgagatcaagatggaggacatcctgtgtgtgctgaccagagatgactgcttcaagggcaagcgctggggcgcccagaagagccatgctgtgggcccccaggagatccgggagcgggccaccgtgctgcagacagtgtttgaagattatgtgcacagcagcgagaggagagtgtcctgggccaagaaggccctgcagagcttcatccaggcctatgccacctacccccgggagctgaagcacatcttccacgtgcgcagcctgcacctgggccacgtggccaagagctttggcctgagagatgcccccaggaacctgagcgccctgaccaggaagaagaggaaggcccacgtgaagaggccagacctgcacaagaagacccagagcaagcacagcctggccgagatcctgcggtctgagtacagcagcggcatggaggccgacatcgccaaggtgaagaagcagaatgcccctggagagcccggcggccggcccctgcagcacagcctgcagcccaccccctgcttcggccggggcaagaccctgaagtggaggaagacccagaagggcgtgcagagggacagcaagaccagccagaaggtgtag

SEQ ID NO: 15337 - DNA, 483 bp, Artificial Sequence
  Description of Artificial Sequence: Synthetic coding sequence
atgaggctggaggccggcagcggggctgtgtggaggggcggggagctggccccagcccccaggaaggtgaaggagggcatccggggctgcttcccctggaagcaggccaaggccaccaagaggaagtaccaggccagcagcgaggcccccccagccaagagaagaaatgagaccagcttcctgcctgccaagaagacctctgtgaaggagacccagaggaccttcaagggaaatgcccagaagatgttcagccccaagaagcacagcgtgtccaccagtgacaggaaccaggaggagcggcagtgcatcaagaccagcagcctcttcaagaacaacccagacatccctgagctgcacaggcctgtggtgaagcaggtgcaggagaaggtgttcaccagcgctgccttccacgagctgggcctgcacccccacctgatcagcaccatcaacacagtgctgaagatgagctccatgaccaggtag

SEQ ID NO: 15338 - DNA, 1284 bp, Artificial Sequence
  Description of Artificial Sequence: Synthetic coding sequence
atggccgagcaggatgtggagaatgacctgctggactatgatgaggaggaggagccccaggccccccaggagagcaccccagccccacccaagaaggacatcaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagatcgagcctgtgaatggccaggtgacagtgctggtgatgtgccacacccgggagctggccttccagatcagcaaggagtatgagcgcttcagcaagtacatgcccagcgtgaaggtgtctgtgttcttcggcggcctgagcatcaagaaggatgaggaggtgctgaagaagaactgcccccacgtggtggtgggcaccccaggccgcatcctggccctggtgaggaacagaagcttcagcctgaagaatgtgaagcactttgtgctggatgaatgtgacaagatgctggagcagctggacatgagaagagatgtgcaggagatcttccggctgacccctcatgagaagcagtgcatgatgttttctgccaccctgagcaaggacatccggcctgtgtgcaggaagttcatgcaggaccccatggaggtgtttgtggatgatgagaccaagctgaccctgcacggcctgcagcagtactacgtgaagctgaaggacagcgagaagaacaggaagctgtttgacctgctggatgtgctggagttcaaccaggtgatcatctttgtgaagtctgtgcagcgctgcatggccctggcccagctgctggtggagcagaacttccctgccatcgccatccaccggggcatggcccaggaggagcggctgagccgctaccagcagttcaaggacttccagaggcgcatcctggtggccaccaacctgtttggccggggcatggacatcgagcgggtgaacatcgtgttcaactatgacatgccagaagattctgacacctacctgcaccgggtggcccgggccggccgcttcggcaccaagggcctggccatcacctttgtgtctgatgaaaatgatgccaagatcctgaatgatgtgcaggacagatttgaggtgaatgtggccgagctgcctgaggagattgacatcagcacctacatcgagcagagcaggtag

SEQ ID NO: 15339 - DNA, 969 bp, Artificial Sequence
  Description of Artificial Sequence: Synthetic coding sequence
atggccgagcaggatgtggagaatgacctgctggactatgatgaggaggaggagccccaggccccccaggagagcaccccagccccacccaagaaggacatcaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagatcgagcctgtgaatggccaggtgacagtgctggtgatgtgccacacccgggagctggccttccagatcagcaaggagtatgagcgcttcagcaagtacatgcccagcgtgaaggtgtctgtgttcttcggcggcctgagcatcaagaaggatgaggaggtgctgaagaagaactgcccccacgtggtggtgggcaccccaggccgcatcctggccctggtgaggaacagaagcttcagcctgaagaatgtgaagcactttgtgctggatgaatgtgacaagatgctggagcagctggacatgagaagagatgtgcaggagatcttccggctgacccctcatgagaagcagtgcatgatgttttctgccaccctgagcaaggacatccggcctgtgtgcaggaagttcatgcaggaccccatggaggtgtttgtggatgatgagaccaagctgaccctgcacggcctgcagcagtactacgtgaagctgaaggacagcgagaagaacaggaagctgtttgacctgctggatgtgctggagttcaaccagcctgtgaccctgtctgctgtgcagggcttccctgctgctgaccccggcggccaccagagcgtgtggccaggagatggccaccgggccagccagcaccggctgtag

SEQ ID NO: 15340 - DNA, 1413 bp, Artificial Sequence
  Description of Artificial Sequence: Synthetic coding sequence
atggcctatggagcccccagccccacctggagcctgtctgtgcggcccaaccggccccggggcggcctgggcccctttggagaggtgcaggtgatcctgctgccccccagctcctgggactacagcatcatggccgagcaggatgtggagaatgacctgctggactatgatgaggaggaggagccccaggccccccaggagagcaccccagccccacccaagaaggacatcaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagatcgagcctgtgaatggccaggtgacagtgctggtgatgtgccacacccgggagctggccttccagatcagcaaggagtatgagcgcttcagcaagtacatgcccagcgtgaaggtgtctgtgttctttggaggcctgagcatcaagaaggatgaggaggtgctgaagaagaactgcccccacgtggtggtgggcaccccaggccgcatcctggccctggtgaggaacagaagcttcagcctgaagaatgtgaagcactttgtgctggatgaatgtgacaagatgctggagcagctggacatgagaagagatgtgcaggagatcttccggctgacccctcatgagaagcagtgcatgatgttcagcgccaccctgagcaaggacatccggcctgtgtgcaggaagttcatgcaggaccccatggaggtgtttgtggatgatgagaccaagctgaccctgcacggcctgcagcagtactacgtgaagctgaaggacagcgagaagaacaggaagctgtttgacctgctggatgtgctggagttcaaccaggtgatcatctttgtgaagtctgtgcagcgctgcatggccctggcccagctgctggtggagcagaacttccctgccatcgccatccaccggggcatggcccaggaggagcggctgagccgctaccagcagttcaaggacttccagaggcgcatcctggtggccaccaacctgtttggccggggcatggacatcgagcgggtgaacatcgtgttcaactatgacatgcctgaggacagcgacacctacctgcaccgggtggcccgggccggccgcttcggcaccaagggcctggccatcacctttgtgtctgatgaaaatgatgccaagatcctgaatgatgtgcaggacagatttgaggtgaatgtggccgagctgcctgaggagattgacatcagcacctacatcgagcagagcaggtag

SEQ ID NO: 15341 - DNA, 804 bp, Artificial Sequence
  Description of Artificial Sequence: Synthetic coding sequence
atggccgagcaggatgtggagaatgacctgctggactatgatgaggaggaggagccccaggccccccaggagagcaccccagccccacccaagaaggacatcaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagatcgagcctgtgaatggccaggtgacagtgctggtgatgtgccacacccgggagctggccttccagatcagcaaggagtatgagcgcttcagcaagtacatgcccagcgtgaaggtgtctgtgttcttcggcggcctgagcatcaagaaggatgaggaggtgctgaagaagaactgcccccacgtggtggtgggcaccccaggccgcatcctggccctggtgaggaacagaagcttcagcctgaagaatgtgaagcactttgtgctggatgaatgtgacaagatgctggagcagctggacatgagaagagatgtgcaggagatcttccggctgacccctcatgagaagcagtgcatgatgttttctgccaccctgagcaaggacatccggcctgtgtgcaggaagttcatgcaggatgtgctgtgggaggtgagccacaagggcgtggcccactggaaggtgctgggcagaagagatgcccagaggtag

SEQ ID NO: 15342 - DNA, 3096 bp, Artificial Sequence
  Description of Artificial Sequence: Synthetic coding sequence
atgggccgggagagccgccactacaggaagaggtctgccagccggggccgcagcggcagccgcagccgcagccgcagccccagcgacaagaggagcaagagaggagatgaccggcgcagccgcagccgggaccgggacagaagaagagagaggagccgcagccgggacaagaggaggagccgcagccgggacaggaagaggctgcggcgcagccgcagccgggagcgggacaggagccgggagaggagaagaagccgcagccgggacagaagaagaagccgcagccgcagccggggccgccgcagccgcagcagcagccctggcaacaagagcaagaagacagaaaatagaagccgcagcaaggagaagacagatggaggagagagcagcaaggagaagaagaaggacaaggatgacaaggaggatgagaaggagaaggatgctggcaactttgaccagaacaagctggaggaggagatgaggaagaggaaggagcgggtggagaagtggagggaggagcagaggaagaaggccatggagaacatcggggagctgaagaaggagattgaggagatgaagcagggcaagaagtggagcctggaggatgatgatgatgatgaagatgatcctgctgaggccgagaaggagggcaatgagatggagggggaggagctggaccccctggatgcctacatggaggaggtgaaggaggaggtgaagaagttcaacatgaggtctgtgaagggcggcggcggcaatgagaagaagagcggccccaccgtgaccaaggtggtgacagtggtgaccaccaagaaggctgtggtggacagcgacaagaagaagggggagctgatggagaatgaccaggatgccatggagtacagcagcgaggaggaggaggtggacctgcagacagccctgaccggctaccagaccaagcagaggaagctgctggagcctgtggaccacggcaagattgaatatgagcccttcaggaagaacttctacgtggaggtgcctgagctggccaagatgagccaggaggaggtgaatgtgttccggctggagatggagggcatcaccgtgaagggcaagggctgccccaagcccatcaagtcctgggtgcagtgtggcatctccatgaagatcctgaacagcctgaagaagcacggctatgagaagcccacccccatccagacccaggccatcccagccatcatgagcggccgggacctgattggaattgccaagacaggcagcggcaagaccatcgccttcctgctgcccatgttccgccacatcatggaccagaggagcctggaggagggggagggccccatcgccgtcatcatgacccccacccgggagctggccctgcagatcaccaaggagtgcaagaagttcagcaagaccctgggcctgcgggtggtgtgtgtgtatggaggcaccggcatcagcgagcagattgctgagctgaagagaggagctgagatcatcgtgtgcaccccaggccgcatgattgacatgctggccgccaacagcggccgggtgaccaacctgcggcgggtgacctacgtggtgctggatgaagctgacaggatgtttgacatgggctttgagccccaggtgatgagaattgtggacaacgtgcggccagaccggcagacagtgatgttcagcgccaccttcccccgggccatggaggccctggcccggcgcatcctgagcaagcccatcgaggtgcaggtgggcggccgctctgtggtgtgcagtgatgtggagcagcaggtgattgtcatcgaggaggagaagaagttcctgaagctgctggagctgctgggccactaccaggagagcggcagcgtcatcatctttgtggacaagcaggagcacgcagatggcctgctgaaggacctgatgagggccagctacccctgcatgagcctgcacggcggcatcgaccagtatgaccgggacagcatcatcaatgacttcaagaatggcacctgcaagctgctggtggccacctctgtggccgcccggggcctggatgtgaagcacctgatcctggtggtgaactacagctgccccaaccactatgaagattatgtgcacagagctggccgcacaggccgggccggcaacaagggctacgcctacaccttcatcacagaggaccaggcccgctatgctggggacatcatcaaggccctggagctgtctggaacagctgtgcccccagacctggagaagctgtggagcgacttcaaggaccagcagaaggccgagggcaagatcatcaagaagagcagcggcttcagcggcaagggcttcaagtttgatgaaacagagcaggccctggccaatgaaaggaagaagctgcagaaggccgccctgggcctgcaggacagtgatgatgaagatgctgctgtggacattgatgagcagattgaatccatgttcaacagcaagaagagggtgaaggacatggccgcccctggcaccagctctgtgcctgcccccacagctggaaatgctgagaagctggagatcgccaagaggctggccctgcgcatcaatgcccagaagaacctgggcatcgagagccaggatgtgatgcagcaggccaccaatgccatcctgcggggcggcaccatcctggcccccaccgtgtctgccaagaccatcgccgagcagctggccgagaagatcaatgccaagctgaactacgtgcccctggagaagcaggaggaggagcggcaggacggcggccagaatgaaagcttcaagagatatgaggaggagctggagatcaatgacttcccccagacagcccgctggaaggtgaccagcaaggaggccctgcagaggatcagcgagtacagcgaggccgccatcaccatccggggcacctacttccccccaggcaaggagcccaaggagggggagaggaagatctacctggccatcgagagcgccaatgagctggccgtgcagaaggccaaggccgagatcaccaggctcatcaaggaggagctgatccggctgcagaacagctaccagcccaccaacaagggccgctacaaggtgctgtag

SEQ ID NO: 15343 - DNA, 3099 bp, Artificial Sequence
  Description of Artificial Sequence: Synthetic coding sequence
atgggccgggagagccgccactacaggaagaggtctgccagccggggccgcagcggcagccgcagccgcagccgcagccccagcgacaagaggagcaagagaggagatgaccggcgcagccgcagccgggaccgggacagaagaagagagaggagccgcagccgggacaagaggaggagccgcagccgggacaggaagaggctgcggcgcagccgcagccgggagcgggacaggagccgggagaggagaagaagccgcagccgggacagaagaagaagccgcagccgcagccggggccgccgcagccgcagcagcagccctggcaacaagagcaagaagacagaaaatagaagccgcagcaaggagaagacagatggaggagagagcagcaaggagaagaagaaggacaaggatgacaaggaggatgagaaggagaaggatgctggcaactttgaccagaacaagctggaggaggagatgaggaagaggaaggagcgggtggagaagtggagggaggagcagaggaagaaggccatggagaacatcggggagctgaagaaggagattgaggagatgaagcagggcaagaagtggagcctggaggatgatgatgatgatgaagatgatcctgctgaggccgagaaggagggcaatgagatggagggggaggagctggaccccctggatgcctacatggaggaggtgaaggaggaggtgaagaagttcaacatgaggtctgtgaagggcggcggcggcaatgagaagaagagcggccccaccgtgaccaaggtggtgacagtggtgaccaccaagaaggctgtggtggacagcgacaagaagaagggggagctgatggagaatgaccaggatgccatggagtacagcagcgaggaggaggaggtggacctgcagacagccctgaccggctaccagaccaagcagaggaagctgctggagcctgtggaccacggcaagattgaatatgagcccttcaggaagaacttctacgtggaggtgcctgagctggccaagatgagccaggaggaggtgaatgtgttccggctggagatggagggcatcaccgtgaagggcaagggctgccccaagcccatcaagtcctgggtgcagtgtggcatctccatgaagatcctgaacagcctgaagaagcacggctatgagaagcccacccccatccagacccaggccatcccagccatcatgagcggccgggacctgattggaattgccaagacaggcagcggcaagaccatcgccttcctgctgcccatgttccgccacatcatggaccagaggagcctggaggagggggagggccccatcgccgtcatcatgacccccacccgggagctggccctgcagatcaccaaggagtgcaagaagttcagcaagaccctgggcctgcgggtggtgtgtgtgtatggaggcaccggcatcagcgagcagattgctgagctgaagagaggagctgagatcatcgtgtgcaccccaggccgcatgattgacatgctggccgccaacagcggccgggtgaccaacctgcggcgggtgacctacgtggtgctggatgaagctgacaggatgtttgacatgggctttgagccccaggtgatgagaattgtggacaacgtgcggccagaccggcagacagtgatgttcagcgccaccttcccccgggccatggaggccctggcccggcgcatcctgagcaagcccatcgaggtgcaggtgggcggccgctctgtggtgtgcagtgatgtggagcagcaggtgattgtcatcgaggaggagaagaagttcctgaagctgctggagctgctgggccactaccaggagagcggcagcgtcatcatctttgtggacaagcaggagcacgcagatggcctgctgaaggacctgatgagggccagctacccctgcatgagcctgcacggcggcatcgaccagtatgaccgggacagcatcatcaatgacttcaagaatggcacctgcaagctgctggtggccacctctgtggccgcccggggcctggatgtgaagcacctgatcctggtggtgaactacagctgccccaaccactatgaagattatgtgcacagagctggccgcacaggccgggccggcaacaagggctacgcctacaccttcatcacagaggaccaggcccgctatgctggggacatcatcaaggccctggagctgtctggaacagctgtgcccccagacctggagaagctgtggagcgacttcaaggaccagcagaaggccgagggcaagatcatcaagaagagcagcggcttcagcggcaagggcttcaagtttgatgaaacagagcaggccctggccaatgaaaggaagaagctgcagaaggccgccctgggcctgcaggacagtgatgatgaagatgctgctgtggacattgatgagcagattgaatccatgttcaacagcaagaagagggtgaaggacatggccgcccctggcaccagctctgtgcctgcccccacagctggaaatgctgagaagctggagatcgccaagaggctggccctgcgcatcaatgcccagaagaacctgggcatcgagagccaggtggatgtgatgcagcaggccaccaatgccatcctgcggggcggcaccatcctggcccccaccgtgtctgccaagaccatcgccgagcagctggccgagaagatcaatgccaagctgaactacgtgcccctggagaagcaggaggaggagcggcaggacggcggccagaatgaaagcttcaagagatatgaggaggagctggagatcaatgacttcccccagacagcccgctggaaggtgaccagcaaggaggccctgcagaggatcagcgagtacagcgaggccgccatcaccatccggggcacctacttccccccaggcaaggagcccaaggagggggagaggaagatctacctggccattgaaagtgccaatgagctggccgtgcagaaggccaaggccgagatcaccaggctcatcaaggaggagctgatccggctgcagaacagctaccagcccaccaacaagggccgctacaaggtgctgtag

SEQ ID NO: 15344 - DNA, 780 bp, Artificial Sequence
  Description of Artificial Sequence: Synthetic coding sequence
atgggccgggagagccgccactacaggaagaggtctgccagccggggccgcagcggcagccgcagccgcagccgcagccccagcgacaagaggagcaagagaggagatgaccggcgcagccgcagccgggaccgggacagaagaagagagaggagccgcagccgggacaagaggaggagccgcagccgggacaggaagaggctgcggcgcagccgcagccgggagcgggacaggagccgggagaggagaagaagccgcagccgggacagaagaagaagccgcagccgcagccggggccgccgcagccgcagcagcagccctggcaacaagagcaagaagacagaaaatagaagccgcagcaaggagaagacagatggaggagagagcagcaaggagaagaagaaggacaaggatgacaaggaggatgagaaggagaaggatgctggcaactttgaccagaacaagctggaggaggagatgaggaagaggaaggagcgggtggagaagtggagggaggagcagaggaagaaggccatggagaacatcggggagctgaagaaggagattgaggagatgaagcagggcaagaagtggagcctggaggatgatgatgatgatgaagatgatcctgctgaggccgagaaggagggcaatgagatggagggggaggagctggaccccctggatgcctacatggaggaggtgaaggaggaggtgaagaagttcaacatgaggtctgtgaaggctgtgtccaagaagaagaagaagaagaagaagtag

SEQ ID NO: 15345 - DNA, 1221 bp, Artificial Sequence
  Description of Artificial Sequence: Synthetic coding sequence
atggccgcccctgaggagcatgacagccccacagaggccagccagcccatcgtggaggaggaggagaccaagaccttcaaggacctgggcgtgacagatgtgctgtgtgaggcctgtgaccagctgggctggaccaagcccaccaagatccagatcgaggccatccccctggccctgcagggccgggacatcatcggcctggccgagaccggcagcggcaagacaggagcctttgccctgcccatcctgaatgccctgctggagaccccccagaggctgtttgccctggtgctgacccccacccgggagctggccttccagatcagcgagcagtttgaggccctgggcagcagcattggagtgcagagcgctgtgattgtgggcggcatcgacagcatgagccagagcctggccctggccaagaagccccacatcatcatcgccaccccaggccgcctgattgaccacctggagaacaccaagggcttcaacctgcgggccctgaagtacctggtgatggatgaggccgaccgcatcctgaacatggactttgaaacagaggtggacaagatcctgaaggtgatcccccgggacaggaagaccttcctgttcagcgccaccatgaccaagaaggtgcagaagctgcagagagctgccctgaagaaccctgtgaagtgtgctgtgagcagcaagtaccagacagtggagaagctgcagcagtactacatcttcatccccagcaagttcaagagcaagaggctgggcagcctgaacaagttcaaggccaaggcccggagcatcctgctggccacagatgtggccagccggggcctggacatcccccacgtggatgtggtggtgaactttgacatccccacccacagcaaggactacatccaccgggtgggccgcacagcccgggccggccgcagcggcaaggccatcacctttgtgacccagtatgatgtggagctgttccagagaattgagcacctgattggcaagaagctgcccggcttccccacccaggatgatgaggtgatgatgctgacagagcgggtggccgaggcccagagatttgccaggatggagctgcgggagcacggggagaagaagaagaggagcagagaagatgctggggacaatgatgacacagaaggagccatcggcgtgaggaacaaggtggccggcggcaagatgaagaagaggaagggccgctag

SEQ ID NO: 15346 - DNA, 1368 bp, Artificial Sequence
  Description of Artificial Sequence: Synthetic coding sequence
atggccgcccctgaggagcatgacagccccacagaggccagccagcccatcgtggaggaggaggagaccaagaccttcaaggacctgggcgtgacagatgtgctgtgtgaggcctgtgaccagctgggctggaccaagcccaccaagatccagatcgaggccatccccctggccctgcagggccgggacatcatcggcctggccgagaccggcagcggcaagacaggagcctttgccctgcccatcctgaatgccctgctggagaccccccagaggctgtttgccctggtgctgacccccacccgggagctggccttccagatcagcgagcagtttgaggccctgggcagcagcattggagtgcagagcgctgtgattgtgggcggcatcgacagcatgagccagagcctggccctggccaagaagccccacatcatcatcgccaccccaggccgcctgattgaccacctggagaacaccaagggcttcaacctgcgggccctgaagtacctggtgatggatgaggccgaccgcatcctgaacatggactttgaaacagaggtggacaagatcctgaaggtgatcccccgggacaggaagaccttcctgttcagcgccaccatgaccaagaaggtgcagaagctgcagagagctgccctgaagaaccctgtgaagtgtgctgtgagcagcaagtaccagacagtggagaagctgcagcagtactacatcttcatccccagcaagttcaaggacacctacctggtgtacatcctgaatgagctggccggcaacagcttcatgatcttctgcagcacctgcaacaacacccagaggacagccctgctgctgaggaacctgggcttcaccgccatccccctgcacggccagatgagccagagcaagaggctgggcagcctgaacaagttcaaggccaaggcccggagcatcctgctggccacagatgtggccagccggggcctggacatcccccacgtggatgtggtggtgaactttgacatccccacccacagcaaggactacatccaccgggtgggccgcacagcccgggccggccgcagcggcaaggccatcacctttgtgacccagtatgatgtggagctgttccagagaattgagcacctgattggcaagaagctgcccggcttccccacccaggatgatgaggtgatgatgctgacagagcgggtggccgaggcccagagatttgccaggatggagctgcgggagcacggggagaagaagaagaggagccgggaggatgctggggacaatgatgacacagagggcgccatcggcgtgaggaacaaggtggccggcggcaagatgaagaagaggaaaggaagatag

SEQ ID NO: 15347 - DNA, 2214 bp, Artificial Sequence
  Description of Artificial Sequence: Synthetic coding sequence
atgcctgggaagctgctgtggggagacatcatggagctggaggcccccctggaggagagcgagagccagaagaaggagcggcagaagagtgacaggaggaagagccgccaccactatgacagtgatgagaagtctgagaccagagaaaatggagtgacagatgacctggatgcccccaaggccaagaagagcaagatgaaggagaagctgaatggagacacagaggagggcttcaaccggctgagtgatgagttcagcaagagccacaagagcaggaggaaggacctgcccaacggggacattgatgaatatgagaagaagagcaagagggtgagcagcctggacaccagcacccacaagagcagtgacaacaagctggaggagaccctgacccgggagcagaaggagggcgccttcagcaacttccccatcagcgaggagaccatcaagctgctgaagggccggggcgtgacctacctgttccccatccaggtgaagaccttcggccctgtgtatgagggcaaggacctgattgcccaggccaggactggaacaggcaagaccttctcctttgccatccccctcatcgagcggctgcagaggaaccaggagaccatcaagaagagccgcagccccaaggtgctggtgctggcccccacccgggagctggccaaccaggtggccaaggacttcaaggacatcaccaggaagctgtctgtggcctgcttctacggcggcaccagctaccagagccagatcaaccacatcagaaatggcatcgacatcctggtgggcaccccaggccgcatcaaggaccacctgcagagcggccgcctggacctgagcaagctgcggcacgtggtgctggatgaggtggaccagatgctggacctgggctttgctgagcaggtggaggacatcatccacgagagctacaagacagacagcgaggacaacccccagaccctgctcttcagcgccacctgcccccagtgggtgtacaaggtggccaagaagtacatgaagagccgctatgagcaggtggacctggtgggcaagatgacccagaaggccgccaccaccgtggagcacctggccatccagtgccactggagccagaggcctgctgtgattggagatgtgctgcaggtgtacagcggcagcgagggccgggccatcatcttctgtgagaccaagaagaatgtgacagagatggccatgaacccccacatcaagcagaatgcccagtgcctgcatggagacatcgcccagagccagcgggagatcaccctgaagggcttccgggagggcagcttcaaggtgctggtggccaccaacgtggccgcccggggcctggacatccctgaggtggacctggtgatccagagcagccccccccaggatgtggagagctacatccacaggagcggccgcacaggccgggccggccgcacaggcatctgcatctgcttctaccagccccgggagcggggccagctgcgctacgtggagcagaaggccggcatcaccttcaagagggtgggcgtgcccagcaccatggacctggtgaagagcaagtccatggatgccatccgcagcctggcctctgtgtcctatgctgctgtggacttcttccggcccagcgcccagaggctgattgaggagaagggagctgtggatgccctggccgccgccctggcccacatcagcggggccagcagctttgagcccaggagcctcatcaccagtgacaagggctttgtgaccatgaccctggagagcctggaggagatccaggatgtgtcctgtgcctggaaggagctgaacaggaagctgagcagcaatgctgtgtcccagatcaccaggatgtgcctgctgaagggcaacatgggcgtgtgctttgatgtgcccaccacagaaagtgagcggctgcaggccgagtggcatgacagcgactggatcctgtctgtgcctgccaagctgcctgagattgaggagtactatgatggcaacaccagcagcaacagccggcagaggagcggctggagcagcggccgcagcggccgcagcggccgcagcggcggccgcagcggcggccgcagcggccggcagagccggcagggcagccgcagcggcagccggcaggacggcagaagaagaagtggcaacagaaacagaagccgcagcggcggccacaagaggagctttgattag

SEQ ID NO: 15348 - DNA, 2136 bp, Artificial Sequence
  Description of Artificial Sequence: Synthetic coding sequence
atgcctgggaagctgctgtggggagacatcatggagctggaggcccccctggaggagagcgagagccagaagaaggagcggcagaagagtgacaggaggaagagccgccaccactatgacagtgatgagaagtctgagaccagagaaaatggagtgacagatgacctggatgcccccaaggccaagaagagcaagatgaaggagaagctgaatggagacacagaggagggcttcaaccggctgagtgatgagttcagcaagagccacaagagcaggaggaaggacctgcccaacggggacattgatgaatatgagaagaagagcaagagggtgagcagcctggacaccagcacccacaagagcagtgacaacaagctggaggagaccctgacccgggagcagaaggagggcgccttcagcaacttccccatcagcgaggagaccatcaagctgctgaagggccggggcgtgacctacctgttccccatccaggtgaagaccttcggccctgtgtatgagggcaaggacctgattgcccaggccaggactggaacaggcaagaccttctcctttgccatccccctcatcgagcggctgcagaggaaccaggagaccatcaagaagagccgcagccccaaggtgctggtgctggcccccacccgggagctggccaaccaggtggccaaggacttcaaggacatcaccaggaagctgtctgtggcctgcttctacggcggcaccagctaccagagccagatcaaccacatcagaaatggcatcgacatcctggtgggcaccccaggccgcatcaaggaccacctgcagagcggccgcctggacctgagcaagctgcggcacgtggtgctggatgaggtggaccagatgctggacctgggctttgctgagcaggtggaggacatcatccacgagagctacaagacagacagcgaggacaacccccagaccctgctcttcagcgccacctgcccccagtgggtgtacaaggtggccaagaagtacatgaagagccgctatgagcaggtggacctggtgggcaagatgacccagaaggccgccaccaccgtggagcacctggccatccagtgccactggagccagaggcctgctgtgattggagatgtgctgcaggtgtacagcggcagcgagggccgggccatcatcttctgtgagaccaagaagaatgtgacagagatggccatgaacccccacatcaagcagaatgcccagtgcctgcatggagacatcgcccagagccagcgggagatcaccctgaagggcttccgggagggcagcttcaaggtgctggtggccaccaacgtggccgcccggggcctggacatccctgaggtggacctggtgatccagagcagccccccccaggatgtggagagctacatccacaggagcggccgcacaggccgggccggccgcacaggcatctgcatctgcttctaccagccccgggagcggggccagctgcgctacgtggagcagaaggccggcatcaccttcaagagggtgggcgtgcccagcaccatggacctggtgaagagcaagtccatggatgccatccgcagcctggcctctgtgtcctatgctgctgtggacttcttccggcccagcgcccagaggctgattgaggagaagggagctgtggatgccctggccgccgccctggcccacatcagcggggccagcagctttgagcccaggagcctcatcaccagtgacaagggctttgtgaccatgaccctggagagcctggaggagatccaggatgtgtcctgtgcctggaaggagctgaacaggaagctgagcagcaatgctgtgtcccagatcaccaggatgtgcctgctgaagggcaacatgggcgtgtgctttgatgtgcccaccacagaaagtgagcggctgcaggccgagtggcatgacagcgactggatcctgtctgtgcctgccaagctgcctgagattgaggagtactatgatggcaacaccagcagcaacagccggcagagccggcagggcagccgcagcggcagccggcaggacggcagaagaagaagtggcaacagaaacagaagccgcagcggcggccacaagaggagctttgattag

SEQ ID NO: 15349 - DNA, 2001 bp, Artificial Sequence
  Description of Artificial Sequence: Synthetic coding sequence
atggccctcttctacgtggcccgctacccaggcccagatgctgctgctgctgctggccctgagggcgctgaggccggggcccacggccgggcccgggccctgctggagcggctgcagagccgggcccgggagcggcagcagcagcgggagcccgcccagacagaggccgccgccagcacagagcccgccaccaggagaagaagaagaccaagaagaagaagaagagtgaatgatgctgagcccggcagccctgaggccccccagggcaagaggaggaaggcagatggagaagatgctggagctgagagcaatgaggaggcccctggagagcccagcgctggcagcagcgaggaggcccctggagagcccagcgctggcagcagcgaggaggcccctggagagaggagcaccagcgccagcgctgaggccgccccagatggccctgccctggaggaggccgccggccccctggtgcccggcctggtgctgggcggctttgggaagaggaaggcccccaaggtgcagcccttcctgccccgctggctggccgagcccaactgtgtgagaagaaatgtgacagaggacctggtgcccatcgaggacatcccagatgtgcacccagacctgcagaagcagctgcgggcccacggcatcagcagctacttccctgtgcaggccgctgtgatcccagccctgctggagagcgctgcctgtggcttcctggtgggccggggcggctaccggcccagcgacctgtgtgtgtctgcccccaccggcagcggcaagaccctggccttcgtcatccctgtggtgcaggccctgctgagccgggtggtgtgccacatccgggccctggtggtgctgcccaccaaggagctggcccagcaggtgtccaaggtgttcaacatctacacagatgccacccccctgcgggtgtccctggtgacaggccagaagagcctggccaaggagcaggagagcctggtgcagaagacagcagatggctaccgctgcctggccgacatcgtggtggccaccccaggccgcctggtggaccacatcgaccagaccccaggcttcagcctgcagcagctgcgcttcctgatcattgatgaagctgacaggatgattgacagcatgcaccagagctggctgccccgggtggtggccgccgccttccagagcgaggaccctgctgacccctgtgccctgctgcagaggcggcaggcccaggccgtgacagctgccagcacctgctgcccccagatgcccctgcagaagctgctcttcagcgccaccctgacccagaaccctgagaagctgcagcagctgggcctgcaccagcccaggctcttcagcacaggcctggcccaccggggcctggaggacacagatggagatggagacagcggcaagtatgccttccctgtgggcctgacccaccactacgtgccctgcagcctgagcagcaagcccctggtggtgctgcacctggtgctggagatgggcttcagccgggtgctgtgcttcaccaacagccgggagaacagccacaggctcttcctgctggtgcaggcctttggaggagtggatgtggccgagttcagcagccgctatggccctggccagaggaggatgatcctgaagcagtttgagcagggcaagatccagctgctgatcagcacagatgccacagcccggggcattgatgtgcagggcgtggagctggtggtgaactatgatgccccccagtacctgcggacctacgtgcaccgggtgggccgcacagcccgggccggcaagacaggccaggccttcaccctgctgctgaaggtgcaggagcggcgcttcctgaggatgctgacagaggccggggcccctgagctgcagagacatgagctgagcagcaagctgctgcagcccctggtgcccaggtatgaggaggccctgagccagctggaggagagcgtgaaggaggagaggaagcagagagctgcctag

SEQ ID NO: 15350 - DNA, 1896 bp, Artificial Sequence
  Description of Artificial Sequence: Synthetic coding sequence
atgagccactgggcccctgagtggaagagagctgaggccaacccccgggacctgggcgcctcctgggatgtgcggggcagccggggcagcggctggagcggccccttcggccaccagggccccagggctgctggcagccgggagccccccctgtgcttcaagatcaagaacaacatggtgggcgtggtgattggctacagcggcagcaagatcaaggacctgcagcacagcaccaacaccaagatccagatcatcaacggggagagcgaggccaaggtgcgcatcttcggcaaccgggagatgaaggccaaggccaaggccgccatcgagaccctcatcaggaagcaggagagctacaacagcgagagctctgtggacaatgctgccagccagacccccatcggcaggaacctgggcagaaatgacatcgtgggggaggccgagcccctgagcaactgggaccgcatccgggctgctgtggtggagtgtgagaagaggaagtgggccgacctgccccctgtgaagaagaacttctacatcgagagcaaggccaccagctgcatgtctgagatgcaggtgatcaactggaggaaagaaaacttcaacatcacctgtgatgacctgaagagcggggagaagaggctcatccccaagcccacctgccgcttcaaggatgccttccagcagtacccagacctgctgaagagcatcatccgggtgggcatcgtgaagcccacccccatccagagccaggcctggcccatcatcctgcagggcatcgacctgattgtggtggcccagacaggcaccgggaagaccctgagctacctgatgcctggcttcatccacctggacagccagcccatcagccgggagcagagaaatggacctggcatgctggtgctgacccccacccgggagctggccctgcacgtggaggctgaatgttccaagtacagctacaagggcctgaagagcatctgcatctacggcggcaggaacagaaatggccagatcgaggacatcagcaagggcgtggacatcatcatcgccaccccaggccgcctgaatgacctgcagatgaacaacagcgtgaacctgcggagcatcacctacctggtgattgatgaggccgacaagatgctggacatggagtttgagccccagatcaggaagatcctgctggatgtgcggccagaccggcagacagtgatgaccagcgccacctggccagacacagtgcggcagctggccctgagctacctgaaggaccccatgattgtgtatgtgggcaacctgaacctggtggccgtgaacacagtgaagcagaacatcatcgtgaccacagagaaggagaagagggccctgacccaggagtttgtggagaacatgagccccaatgacaaggtgatcatgtttgtgtcccagaagcacatcgcagatgacctgagcagtgacttcaacatccagggcatctctgctgagagcctgcacggcaacagcgagcagagcgaccaggagagagctgtggaggacttcaagagcggcaacatcaagatcctgatcaccacagacatcgtgtcccggggcctggacctgaatgatgtgacccacgtgtacaactatgacttccccaggaacattgatgtgtatgtgcaccgggtgggctacatcggccgcacaggcaagacaggcacctctgtgaccctcatcacccagagggacagcaagatggccggggagctgatcaagatcctggaccgggccaaccagagcgtgcctgaggacctggtggtgatggccgagcagtacaagctgaaccagcagaagaggcaccgggagaccaggagcaggaagccaggccagaggaggaaggagttctacttcctgtcctag

SEQ ID NO: 15351 - DNA, 1644 bp, Artificial Sequence
  Description of Artificial Sequence: Synthetic coding sequence
atggaggacagcgaggccctgggctttgagcacatgggcctggacccccggctgctgcaggccgtgacagacctgggctggagccggcccaccctcatccaggagaaggccatccccctggccctggagggcaaggacctgctggcccgggccaggactggaagtggcaagacagctgcctatgccatccccatgctgcagctgctgctgcacaggaaggccactggacctgtggtggagcaggccgtgcggggcctggtgctggtgcccaccaaggagctggcccggcaggcccagagcatgatccagcagctggccacctactgtgccagagatgtgcgggtggccaacgtgtctgctgctgaggacagcgtgtcccagagagctgtgctgatggagaagccagatgtggtggtgggcacccccagccgcatcctgagccacctgcagcaggacagcctgaagctgcgggacagcctggagctgctggtggtggatgaggccgacctgctcttctcctttggatttgaggaggagctgaagagcctgctgtgccacctgccccgcatctaccaggccttcctgatgtctgccaccttcaatgaagatgtgcaggccctgaaggagctgatcctgcacaaccctgtgaccctgaagctgcaggagagccagctgcccggccctgaccagctgcagcagttccaggtggtgtgtgaaacagaggaggacaagttcctgctgctgtatgccctgctgaagctgagcctcatccggggcaagagcctgctgtttgtgaacaccctggagaggagctaccgcctgcggctcttcctggagcagttcagcatccccacctgtgtgctgaatggagagctgcccctgcggagccgctgccacatcatcagccagttcaaccagggcttctatgactgtgtgattgccacagatgctgaggtgctgggcgcccctgtgaagggcaagaggcggggccggggccccaagggggacaaggccagtgaccctgaggccggcgtggcccggggcatcgacttccaccacgtgtctgctgtgctgaactttgacctgccccccaccccagaggcctacatccacagagctggccgcacagcccgggccaacaaccctggcatcgtgctgacctttgtgctgcccacagagcagttccacctgggcaagattgaggagctgctgtctggagaaaatagaggccccatcctgctgccctaccagttcaggatggaggagattgagggcttccgctaccgctgcagagatgccatgaggtctgtgaccaagcaggccatccgggaggcccggctgaaggagatcaaggaggagctgctgcacagcgagaagctgaagacctactttgaggacaacccccgggacctgcagctgctgcggcatgacctgcccctgcaccctgctgtggtgaagccccacctgggccacgtgcctgactacctggtgcccccagccctgcggggcctggtgcggccccacaagaagaggaagaagctgagcagcagctgcaggaaggccaagagggccaagagccagaaccccctgcggagcttcaagcacaagggcaagaagttccggcccacagccaagcccagctag

SEQ ID NO: 15352 - DNA, 2112 bp, Artificial Sequence
  Description of Artificial Sequence: Synthetic coding sequence
atggccgcccctgtgggccctgtgaagttctggaggcctggaacagagggccctggggtgtccatcagcgaggagcggcagagcctggctgaaaattctggcaccaccgtggtgtacaacccctatgctgccctgagcattgagcagcagaggcagaagctgcctgtgttcaagctgaggaaccacatcctgtacctgattgagaactaccagacagtggtgattgtgggggagaccggctgcggcaagagcacccagatcccccagtacctggccgaggccggctggacagctgagggccgggtggtgggcgtgacccagcccaggagagtggccgctgtgacagtggccggccgggtggccgaggagagaggagctgtgctgggccacgaggtgggctactgcatccgctttgatgactgcacagaccagctggccacccgcatcaagttcctgacagatggcatgctggtgcgggagatgatggtggaccccctgctgaccaagtacagcgtcatcatgctggatgaggcccacgagaggaccctgtacacagacatcgccatcggcctgctgaagaagatccagaagaagagaggagacctgcggctgattgtggccagcgccaccctggatgctgacaagttccgggacttcttcaaccagaatgagaccagtgaccctgcccgggacacctgtgtgatcctgactgtggagggccgcaccttccctgtggacatcttctacctgcagagccctgtgcctgactacatcaagagcacagtggagaccgtggtgaagatccaccagacagaaggagatggagatgtgctggccttcctgaccggccaggaggaggtggagaccgtggtgtccatgctgattgagcaggcccgggccctggccaggacaggcatgaagaggcacctgcgggtgctgcccatgtatgccggcctgcccagctttgagcagatgaaggtgtttgagcgggtgagccgctctgtgaggaaggtgattgtggccaccaacgtggccgagaccagcatcaccatcagcggcatcgtgtatgtgattgactgtggctttgtgaagctgcgggcctacaaccccaggacagccattgaatgtctggtggtggtgcctgtgtcccaggccagcgccaaccagagagctggccggggcggccgcagccgcagcggcaagtgctaccgcctgtacacagaggaggcctttgacaagctgccccagagcacagtgcctgagatgcagaggagcaacctggcccctgtgatcctgcagctgaaggccctgggcatcgacaacgtgctgcgcttccacttcatgagccccccaccagcccagagcatggtgcaggccctggagctgctgtatgccctgggcggcctggacaaggactgccgcctgacagagcccctgggcatgagaattgctgagttccccctgaaccccatgtttgccaagatgctgctggagagcggcaactttggctgcagccaggagatcctgagcattgctgccatgatgcagatccagaacatctttgtggtgccccccaaccagaagagccacgccatccgggtgcacaggaagtttgctgtggaggagggggaccacctgaccatgctgaacatctatgaggccttcatcaagcacaacaaggacagcaagtggtgccaggagcacttcctgaactacaagggcctggtgcgggccgccaccgtgcgggagcagctgaagaagctgctggtgaagttccaggtgcccaggaagagcagcgagggggaccctgacctggtgctgcgctgcatcgtgtctggcttctttgccaatgctgcccgcttccacagcactggagcctaccgcaccatcagagatgaccacgagctgcacatccacccagcctctgtgctgtatgcagagaagcccccacgctgggtgatctacaatgaggtgatccagaccagcaagtactacatgagagatgtgacagccatcgagagcgcctggctgctggagctggccccccacttctaccagcagggcacccacctgagcctgaaggccaagagggccaaggtgcaggacccctag

SEQ ID NO: 15353 - DNA, 552 bp, Artificial Sequence
  Description of Artificial Sequence: Synthetic coding sequence
atgctgctggagagcggcaactttggctgcagccaggagatcctgagcattgctgccatgatgcagatccagaacatctttgtggtgccccccaaccagaagagccacgcccacaacaaggacagcaagtggtgccaggagcacttcctgaactacaagggcctggtgcgggccgccaccgtgcgggagcagctgaagaagctgctggtgaagttccaggtgcccaggaagagcagcgagggggaccctgacctggtgctgcgctgcatcgtgtctggcttctttgccaatgctgcccgcttccacagcactggagcctaccgcaccatcagagatgaccacgagctgcacatccacccagcctctgtgctgtatgcagagaagcccccacgctgggtgatctacaatgaggtgatccagaccagcaagtactacatgagagatgtgacagccatcgagagcgcctggctgctggagctggccccccacttctaccagcagggcacccacctgagcctgaaggccaagagggccaaggtgcaggacccctag

SEQ ID NO: 15354 - DNA, 2019 bp, Artificial Sequence
  Description of Artificial Sequence: Synthetic coding sequence
atggccgcccctgtgggccctgtgaagttctggaggcctggaacagagggccctggggtgtccatcagcgaggagcggcagagcctggctgaaaattctggcaccaccgtggtgtacaacccctatgctgccctgagcattgagcagcagaggcagaagctgcctgtgttcaagtacctggccgaggccggctggacagctgagggccgggtggtgggcgtgacccagccccggcgggtggccgctgtgacagtggccggccgggtggccgaggagagaggagctgtgctgggccacgaggtgggctactgcatccgctttgatgactgcacagaccagctggccacccgcatcaagttcctgacagatggcatgctggtgcgggagatgatggtggaccccctgctgaccaagtacagcgtcatcatgctggatgaggcccacgagaggaccctgtacacagacatcgccatcggcctgctgaagaagatccagaagaagagaggagacctgcggctcatcgtggccagcgccaccctggatgctgacaagttccgggacttcttcaaccagaatgagaccagtgaccctgcccgggacacctgtgtgatcctgactgtggagggccgcaccttccctgtggacatcttctacctgcagagccctgtgcctgactacatcaagagcacagtggagaccgtggtgaagatccaccagacagaaggagatggagatgtgctggccttcctgaccggccaggaggaggtggagaccgtggtgtccatgctgattgagcaggcccgggccctggccaggacaggcatgaagaggcacctgcgggtgctgcccatgtatgccggcctgcccagctttgagcagatgaaggtgtttgagcgggtgagccgctctgtgaggaaggtgattgtggccaccaacgtggccgagaccagcatcaccatctctggaattgtgtatgtgattgactgtggctttgtgaagctgcgggcctacaaccccaggacagccatcgagtgcctggtggtggtgcctgtgtcccaggccagcgccaaccagagagctggccggggcggccgcagccgcagcggcaagtgctaccgcctgtacacagaggaggcctttgacaagctgccccagagcacagtgcctgagatgcagaggagcaacctggcccctgtgatcctgcagctgaaggccctgggcatcgacaacgtgctgcgcttccacttcatgagccccccaccagcccagagcatggtgcaggccctggagctgctgtatgccctgggcggcctggacaaggactgccgcctgacagagcccctgggcatgagaattgctgagttccccctgaaccccatgtttgccaagatgctgctggagagcggcaactttggctgcagccaggagatcctgagcattgctgccatgatgcagatccagaacatctttgtggtgccccccaaccagaagagccacgccatccgggtgcacaggaagtttgctgtggaggagggggaccacctgaccatgctgaacatctatgaggccttcatcaagcacaacaaggacagcaagtggtgccaggagcacttcctgaactacaagggcctggtgcgggccgccaccgtgcgggagcagctgaagaagctgctggtgaagttccaggtgcccaggaagagcagcgagggggaccctgacctggtgctgcgctgcatcgtgtctggcttctttgccaatgctgcccgcttccacagcactggagcctaccgcaccatcagagatgaccacgagctgcacatccacccagcctctgtgctgtatgcagagaagccaccccgctgggtgatctacaatgaagtcatccagaccagcaagtactacatgagagatgtgacagccattgaaagtgcctggctgctggagctggccccccacttctaccagcagggcacccacctgagcctgaaggccaagagggccaaggtgcaggacccctag

SEQ ID NO: 15355 - DNA, 2154 bp, Artificial Sequence
  Description of Artificial Sequence: Synthetic coding sequence
atgaccagccagcccctgcggctggccgaggagtatggccccagccctggagagagcgagctggccgtgaacccctttgatggcctgcccttcagcagccgctactatgagctgctgaagcagaggcaggccctgcccatctgggccgcccgcttcaccttcctggagcagctggagagcaaccccactggagtggtgctggtgtctggagagcccggcagcggcaagagcacccagatcccccagtggtgtgccgagtttgccctggcccggggcttccagaagggccaggtgacagtgacccagccctaccccctggccgcccggagcctggccctgcgggtggctgatgagatggacctgaccctgggccacgaggtgggctacagcatcccccaggaggactgcaccggccccaacaccctgctgcgcttctgctgggaccggctgctgctgcaggaggtggccagcacccggggcactggagcctggggcgtgctggtgctggatgaggcccaggagaggtctgtggccagtgacagcctgcagggcctgctgcaggatgcccggctggagaagctgcccggggacctgcgggtggtggtggtgacagatcctgccctggagcccaagctgcgggccttctggggcaacccccccatcgtgcacatcccccgggagcccggggagcggcccagccccatctactgggacaccatccccccagacagagtggaggccgcctgccaggccgtgctggagctgtgcaggaaggagctgcctggagatgtgctggtgttcctgcccagcgaggaggagatcagcctgtgctgtgagagcctgagccgggaggtggagagcctgctgctgcagggcctgcccccccgggtgctgcccctgcacccagactgtggccgggctgtgcaggccgtgtatgaggacatggatgccaggaaggtggtggtgacccactggctggccgacttctccttcagcctgcccagcatccagcacgtgattgacagcggcctggagctgcggtctgtgtacaacccccgcatccgggcagagttccaggtgctgcggcccatcagcaagtgccaggccgaggcccggcggctgcgggcccggggcttccccccaggcagctgcctgtgcctgtaccccaagagcttcctggagctggaggccccacccctgccccagccccgggtgtgtgaggagaacctgagcagcctggtgctgctgctgaagaggcggcagattgctgagcctggagagtgccacttcctggaccagcctgcccctgaggccctgatgcaggccctggaggacctggactacctggccgccctggatgatgatggagacctgagtgacctgggcgtcatcctgtctgagttccccctggcccctgagctggccaaggccctgctggccagctgtgaatttgactgtgtggatgagatgctgaccctggccgccatgctgacagctgcccctggcttcacccggccccccctgtctgctgaggaggccgccctgcggcgggccctggagcacacagatggagaccacagcagcctcatccaggtgtatgaggccttcatccagagcggggctgatgaggcctggtgccaggcccggggcctgaactgggccgccctgtgccaggcccacaagctgcggggggagctgctggagctgatgcagagaattgagctgcccctgagcctgcctgccttcggcagcgagcagaacagaagagacctgcagaaggccctggtgtctggctacttcctgaaggtggcccgggacacagatggcaccggcaactacctgctgctgacccacaagcacgtggcccagctgagcagctactgctgctaccgcagcagaagagccccagcccggcccccaccctgggtgctgtaccacaacttcaccatcagcaaggacaactgcctgagcatcgtgtctgagatccagccccagatgctggtggagctggccccaccctacttcctgagcaacctgccccccagcgagagccgggacctgctgaaccagctgcgggagggcatggctgacagcacagctggcagcaagagcagcagcgcccaggagttccgggacccctgtgtgctgcagtag

SEQ ID NO: 15356 - DNA, 2154 bp, Artificial Sequence; identical to SEQ ID NO: 15355
  Description of Artificial Sequence: Synthetic coding sequence

SEQ ID NO: 15357 - DNA, 981 bp, Artificial Sequence
  Description of Artificial Sequence: Synthetic coding sequence
atggccctgagcggcagcaccccagccccctgctgggaggaggatgagtgcctggactactacggcatgctgagcctgcacaggatgtttgaggtggtgggcggccagctgacagaatgtgagctggagctgctggccttcctgctggatgaggcccctggagctgctgggggcctggcccgggcccggagcggcctggagctgctgctggagctggagcggcggggccagtgtgatgagagcaacctgcggctgctgggccagctgctgcgggtgctggcccggcatgacctgctgccccacctggccaggaagagaagaagacctgtgtccccagagcgctacagctatggcaccagcagcagcagcaagaggacagagggcagctgcagaagaagacggcagagcagcagcagcgccaacagccagcagggccagtgggagaccggcagcccccccaccaagaggcagaggaggagccggggccggcccagcggcggggccaggagaagaagaagaggagccccagctgccccccagcagcagagcgagcccgcccggcccagcagcgagggcaaggtgacctgtgacatccggctgcgggtgcgggcagagtactgtgaacatggccctgccctggagcagggcgtggccagccggcggccccaggccctggcccggcagctggatgtgtttggccaggccacagctgtgctgcggagccgggacctgggctctgtggtgtgtgacatcaagttcagcgagctgagctacctggatgccttctggggagactacctgagcggggccctgctgcaggccctgcggggcgtcttcctgacagaggccctgcgggaggccgtgggccgggaggccgtgcggctgctggtgtctgtggatgaggccgactatgaggccggcagaagaaggctgctgctgatggaggaggagggcggccggcggcccacagaggccagctag

SEQ ID NO: 15358 - DNA, 981 bp, Artificial Sequence; identical to SEQ ID NO: 15357
  Description of Artificial Sequence: Synthetic coding sequence

SEQ ID NO: 15359 - DNA, 1635 bp, Artificial Sequence
  Description of Artificial Sequence: Synthetic coding sequence
atgagggtggccgtggccggctgctgccacggggagctggacaagatctatgagaccctggccctggccgagcggcggggccctggccctgtggacctgctgctgtgctgcggggacttccaggccgtgagaaatgaagctgacctgcgctgcatggctgtgccccccaagtaccgccacatgcagaccttctaccgctactacagcggggagaagaaggcccctgtgctgaccctcttcatcggcggcaaccacgaggccagcaaccacctgcaggagctgccctacggcggctgggtggcccccaacatctactacctgggcctggccggcgtggtgaagtacagaggagtgcgcatcggcggcatcagcggcatcttcaagagccatgactacaggaagggccactttgagtgccccccctacaacagcagcaccatccgcagcatctaccacgtgaggaacatcgaggtgtacaagctgaagcagctgaagcagcccatcgacatcttcctgagccatgactggcccaggagcatctaccactacggcaacaagaagcagctgctgaagaccaagagcttcttccggcaggaggtggagaacaacaccctgggcagccctgctgccagcgagctgctggagcacctgaagcccacctactggttcagcgcccacctgcacgtgaagtttgctgccctgatgcagcaccaggccaaggacaagggccagacagcccgggccaccaagttcctggccctggacaagtgcctgccccaccgggacttcctgcagatcctggagattgaacatgaccccagcgccccagactacctggagtatgacatcgagtggctgaccatcctgcgggccacagatgacctgatcaacgtgacaggccgcctgtggaacatgccagaaaataatggcctgcacgcccgctgggactacagcgccacagaggagggcatgaaggaggtgctggagaagctgaaccacgacctgaaggtgccctgcaacttctctgtgacagctgcctgctatgaccccagcaagccccagacccagatgcagctgatccaccgcatcaacccccagaccacagagttctgtgcccagctgggcatcatcgacatcaacgtgcggctgcagaagagcaaggaggagcaccacgtgtgtggggagtatgaggagcaggatgatgtggagagcaatgattctggagaggaccagagcgagtacaacacagacaccagcgccctgagcagcatcaacccagatgagatcatgctggatgaggaggaggatgaagattccatcgtgtctgcccacagcggcatgaacaccccatctgtggagcccagcgaccaggccagcgagttcagcgccagcttcagtgatgtgcgcatcctgcccggctccatgattgtgtccagtgatgacacagtggacagcaccatcgaccgggagggcaagccaggcggcaccgtggagagcggaaatggagaggacctgaccaaggtgcccctgaagaggctgagtgatgaacatgagcctgagcagaggaagaagatcaagagaagaaaccaggccatctatgctgctgtggatgatgatgatgatgatgctgcctag

SEQ ID NO: 15360 - DNA, 933 bp, Artificial Sequence
  Description of Artificial Sequence: Synthetic coding sequence
atgcagcaccaggccaaggacaagggccagacagcccgggccaccaagttcctggccctggacaagtgcctgccccaccgggacttcctgcagatcctggagattgaacatgaccccagcgccccagactacctggagtatgacatcgagtggctgaccatcctgcgggccacagatgacctgatcaacgtgacaggccgcctgtggaacatgccagaaaataatggcctgcacgcccgctgggactacagcgccacagaggagggcatgaaggaggtgctggagaagctgaaccacgacctgaaggtgccctgcaacttctctgtgacagctgcctgctatgaccccagcaagccccagacccagatgcagctgatccaccgcatcaacccccagaccacagagttctgtgcccagctgggcatcatcgacatcaacgtgcggctgcagaagagcaaggaggagcaccacgtgtgtggggagtatgaggagcaggatgatgtggagagcaatgattctggagaggaccagagcgagtacaacacagacaccagcgccctgagcagcatcaacccagatgagatcatgctggatgaggaggaggatgaagattccatcgtgtctgcccacagcggcatgaacaccccatctgtggagcccagcgaccaggccagcgagttcagcgccagcttcagtgatgtgcgcatcctgcccggctccatgattgtgtccagtgatgacacagtggacagcaccatcgaccgggagggcaagccaggcggcaccgtggagagcggaaatggagaggacctgaccaaggtgcccctgaagaggctgagtgatgaacatgagcctgagcagaggaagaagatcaagagaagaaaccaggccatctatgctgctgtggatgatgatgatgatgatgctgcctag

SEQ ID NO: 15361 - DNA, 1653 bp, Artificial Sequence
  Description of Artificial Sequence: Synthetic coding sequence
atggaccaccacgtgtccaccatcaagccccggcgcatccagaaccagaatgtcatccaccggctggagcggcggcgcatcagcagcggcaaggccggcacccactggcaccaggtgcgggtcttccaccagaatgtgttccccaacttcaccgtggtgaatgtggagaagccaccctgcttcctgaggaagttctccccagatggccgctacttcatcgccttcagcagtgaccagaccagcctggagatctatgagtaccagggctgccaggccgctgaggacctgctgcagggctatgaaggagagatcctgagcaatggaaatgaccagaggtctgtgaacatccggggccgcctgtttgagcgcttctttgtgctgctgcacatcaccaacgtggccgccaacggggagcacctgaacagagaatgttccctcttcacagatgactgccgctgtgtgattgtgggcagcgctgcctacctgcctgatgagccccacccccccttctttgaggtgtacagaaattctgagagcgtgacccccaaccccaggagccccctggaggactacagcctgcacatcatcgacctgcacacaggccgcctgtgtgacaccaggaccttcaagtgtgacaaggtggtgctgagccacaaccagggcctgtacctgtacaagaacatcctggccatcctgtctgtgcagcagcagaccatccacgtgttccaggtgaccccagagggcaccttcattgatgtgaggaccatcggccgcttctgctatgaagatgacctgctgactgtgtctgctgtgtttcctgaggtgcagagggacagccagacaggcatggccaaccccttccgggaccccttcatcaacagcctgaagcaccggctgctggtgtacctgtggaggagagctgagcaggacggcagcgccatggccaagaggcgcttcttccagtactttgaccagctgcggcagctgaggatgtggaagatgcagctgctggatgagaaccacctgttcatcaagtacaccagtgaagatgtggtgaccctgcgggtgacagaccccagccaggccagcttctttgtggtgtacaacatggtgaccacagaggtgattgctgtgtttgagaacaccagtgatgagctgctggagctgtttgagaacttctgtgacctcttcagaaatgccaccctgcacagcgaggtgcagttcccctgcagcgccagcagcaacaactttgcccggcagatccagaggcgcttcaaggacaccatcatcaatgccaagtatggaggccacacagaggccgtgcggcggctgctgggccagctgcccatcagcgcccagagctacagcggcagcccctacctggacctgagcctcttctcctatgatgacaagtgggtgtctgtgatggagcggcccaagacctgtggggaccaccccatccgcttctacgcccgggacagcggcctgctgaagtttgagatccaggccggcctgctgggccggcccatcaaccacacagtgcggcggctggtggccttcaccttccacccctttgagccctttgccatctctgtgcagaggaccaatgcagaatatgtggtgaacttccacatgaggcactgctgcacctag

SEQ ID NO: 15362 - DNA, 1686 bp, Artificial Sequence
  Description of Artificial Sequence: Synthetic coding sequence
atggtgggccagatcctgaagagagatgtgatcatggaccaccacgtgtccaccatcaagccccggcgcatccagaaccagaatgtcatccaccggctggagcggcggcgcatcagcagcggcaaggccggcacccactggcaccaggtgcgggtcttccaccagaatgtgttccccaacttcaccgtggtgaatgtggagaagccaccctgcttcctgaggaagttctccccagatggccgctacttcatcgccttcagcagtgaccagaccagcctggagatctatgagtaccagggctgccaggccgctgaggacctgctgcagggctatgaaggagagatcctgagcaatggaaatgaccagaggtctgtgaacatccggggccgcctgtttgagcgcttctttgtgctgctgcacatcaccaacgtggccgccaatggagagcacctgaaccgggagtgcagcctcttcacagatgactgccgctgcgtcatcgtgggcagcgctgcctacctgcctgatgagccccacccccccttctttgaggtgtacagaaacagcgagagcgtgacccccaaccccaggagccccctggaggactacagcctgcacatcatcgacctgcacacaggccgcctgtgtgacaccaggaccttcaagtgtgacaaggtggtgctgagccacaaccagggcctgtacctgtacaagaacatcctggccatcctgtctgtgcagcagcagaccatccacgtgttccaggtgaccccagagggcaccttcattgatgtgaggaccatcggccgcttctgctatgaagatgacctgctgactgtgtctgctgtgtttcctgaggtgcagagggacagccagacaggcatggccaaccccttccgggaccccttcatcaacagcctgaagcaccggctgctggtgtacctgtggaggagagctgagcaggacggcagcgccatggccaagaggcgcttcttccagtactttgaccagctgcggcagctgaggatgtggaagatgcagctgctggatgagaaccacctgttcatcaagtacaccagtgaagatgtggtgaccctgcgggtgacagaccccagccaggccagcttctttgtggtgtacaacatggtgaccacagaggtgattgctgtgtttgagaacaccagtgatgagctgctggagctgtttgagaacttctgtgacctcttcagaaatgccaccctgcacagcgaggtgcagttcccctgcagcgccagcagcaacaactttgcccggcagatccagaggcgcttcaaggacaccatcatcaatgccaagtatggaggccacacagaagctgtgcggcggctgctgggccagctgcccatcagcgcccagagctacagcggcagcccctacctggacctgagcctcttctcctatgatgacaagtgggtgtctgtgatggagcggcccaagacctgtggggaccaccccatccgcttctacgcccgggacagcggcctgctgaagtttgagatccaggccggcctgctgggccggcccatcaaccacacagtgcggcggctggtggccttcaccttccacccctttgagccctttgccatctctgtgcagaggaccaatgcagaatatgtggtgaacttccacatgaggcactgctgcacctag

SEQ ID NO: 15363 - DNA, 1686 bp, Artificial Sequence; identical to SEQ ID NO: 15362
  Description of Artificial Sequence: Synthetic coding sequence

SEQ ID NO: 15364 - DNA, 5592 bp, Artificial Sequence
  Description of Artificial Sequence: Synthetic coding sequence
atgattgaagataaaggcccccgggtggccgactactttgtggtggccggcctgacagatgtgtccaagcccctggaggaggagatccacttcaatgatgcctgccacaaggtggccaagcccaaggagcccatcacagatgtgtctgtcatcatcaagagcctgggggaggaggtgccccaggactacatctgcattgatgtgacccccaccggcctgtctgctgacctgaacaacggcagcctggtgggcccccagatctacctgtgctaccgccggggccgggacaagccacccctgacagacctgggcgtgctgtatgactggaaggagcggctgaagcagggctgtgagatcatccagagcaccccctacggccggcctgccaacatcagcggcagcaccagcagccagaggatctacatcacctacagaagagccagcgagaacatgacccagaacaccctggccgtgacagacatctgcatcatcatccccagcaagggggagagccccccccacaccttctgcaaggtggacaagaacctgaacaacagcatgtggggcagcgctgtgtacctgtgctacaagaagtctgtggccaagaccaacacagtgtcctacaaggccggcctcatctgccgctacccccaggaggactatgagagcttcagcctgcctgagagcgtgcccctcttctgcctgcccatgggcgccaccatcgagtgctggcccagcaacagcaagtaccccctgcctgtgttcagcacctttgtgctgactggagccagcgctgagaaggtgtatggagctgccatccagttctatgagccctacagcgaggagaacctgacagagaagcagaggctgctgctgggcctgaccagcgcagatggcaagagtgacagcagcaagaccatccacaccaacaagtgcatctgcctgctgagccactggcccttctttgatgccttcaggaagttcctgaccttcctgtaccgctacagcatcagcggcccccacgtgctgcccatcgagaagcacatcagccacttcatgcacaaggtgcccttccccagcccccagaggccccgcatcctggtgcagctgagcccccatgacaacctgatcctgagccagcctgtgagcagccccctgcccctgagcggcggcaagttcagcaccctgctgcagaacctgggcccagaaaatgctgtgaccctgctggtgtttgctgtgacagagcacaagatcctgatccacagcctgcggcccagcgtgctgacctctgtgacagaggccctggtgtccatgatcttccccttccactggccctgcccctacgtgcccctgtgccccctggccctggctgatgtgctgagcgccccctgccccttcatcgtgggcatcgacagccgctactttgacctgtatgaccccccaccagatgtgtcctgtgtggatgtggacaccaacaccatcagccagattggagacaagaagaatgtggcctggaagatcctgcccaagaagccctgcaagaacctgatgaacaccctgaacaacctgcaccagcagctggccaagctgcagcagaggcccagagatgatggcctgatggacctggccatcaatgactatgacttcaacagcggcaagaggctgcacatgattgacctggagatccaggaggccttcctgttcttcatggccagcatcctgaagggctaccgcagctacctgcggcccatcacccaggcccccagcgagacagccacagatgctgccagcctgtttgccctgcaggccttcctgcggagccgggacaggagccaccagaagttctacaacatgatgaccaagacccagatgttcatccgcttcattgaagaatgttcctttgtgtctgacaaggatgccagcctggccttctttgatgactgtgtggacaaggtggacatggacaagtctggagaggtgcggctgattgagctggatgagagcttcaagtctgagcacacagtgtttgtgaccccacctgagatcccccacctgcccaatggagaggagccccccctgcagtacagctacaacggcttccctgtgctgaggaacaacctgtttgagaggcctgagggcttcctgcaggccaagaagaacaagctgcccagcaagagcagcagccccaacagccccctgcccatgttccggaggaccaagcaggagatcaagagcgcccacaagatcgccaagcgctacagcagcatcccccagatgtggagccgctgcctgctgcggcactgctacggcctgtggttcatctgcctgcctgcctacgtgaaggtgtgccacagcaaggtgcgggccctgaagacagcctatgatgtgctgaagaagatgcagagcaagaagatggaccccccagatgaggtgtgctaccgcatcctgatgcagctgtgtggccagtatgaccagcctgtgctggccgtgcgggtgctgtttgagatgcagaaggccggcatcgaccccaatgccatcacctacggctactacaacaaggctgtgctggagagcacctggcccagccgcagccgcagcggctacttcctgtggaccaaggtgagaaatgtggtgctgggcgtgacccagttcaagagggccctgaagaagcacgcccacctgagccagaccaccctgagcggcggccagagcgacctgggctacaacagcctgagcaaggatgaggtgagaagaggagacaccagcacagaggacatccaggaggagaaggacaagaagggcagtgactgcagcagcctgtctgagagcgagagcaccaagggcagcgctgactgcctgcccaagctgagctaccagaacagcagcagcatcgtgcggctgaccggcaccagcaacaacagcgctgggaagatctctggagagagcatggagagcaccccagagctgctgctgatcagcagcctggaggacaccaatgagaccaggaacatccagagccgctgcttcaggaagaggcacaagagtgacaatgagaccaacctgcagcagcaggtggtgtggggcaacagaaacagaaacctgtctggaggagtgctgatgggcttcatgctgaaccgcatcaaccaggaggccacccctggggacatcgtggagaagctgggcgcagatgccaagatcctgagcaatgtcatcagcaagagcacccggcccaacaccctggacatcggcaagccacccctgcggagcaagagggacagcctggagaaggagagcagtgatgatgacaccccatttgatggcagcaactacctggccgacaaggtggacagccctgtgatctttgacctggaggacctggacagcgagacagatgtgtccaaggccggctgtgtggccacccagaaccccaagaggatccagaggatgaacagcagcttctctgtgaagccctttgagaagacagatgtggccactggatttgaccccctgagcctgctggtggccgagacagagcagcagcagaaggaggaggaggaggaggatgaagatgacagcaagagcatcagcaccccatctgcccggcgggacctggccgaggagatcgtgatgtacatgaacaacatgagcagccccctgaccagcaggacccccagcattgacctgcagagggcctgtgatgacaagctgaacaagaagagcccccccctggtgaaggcctgccgccgcagcagcctgccccccaacagccccaagcctgtgcggctgaccaagagcaagagctacaccaagtctgaggagaagccccgggaccggctgtggagcagccctgccttcagccccacctgccccttccgggaggagagccaggacaccctgacccacagcagccccagcttcaacctggacaccctgctggtgcccaagctggatgtgctgaggaacagcatgttcaccgctgggaagggcgtggccgagaaggccagcaagtggtacagccgcttcaccatgtacaccaccagcagcaaggaccagagcagtgacaggaccagcctgagctctgtgggcgcccaggacagcgagagcaccagcctgacagatgaagatgtgtgccacgagctggagggccccatcagcagccaggagaccagcgccaccagcggcaccaagagaattgacctgagccgcatcagcctggagagcagcgccagcctggagggcagcctgagcaagtttgccctgcccgggaagtctgaggtgaccagcagcttcaatgccagcaacaccaacatcttccagaactatgccatggaggtgctgatcagcagctgcagccgctgcaggacctgtgactgcctggtgcatgatgaggagatcatggccggctggacagcagatgacagcaacctgaacaccacctgccccttctgtggcaacatcttcctgcccttcctgaacatcgagatccgggacctgcggcggcccggccgctacttcctgaagagcagccccagcacagagaacatgcacttccccagcagcatcagcagccagacccggcagagctgcatcagcaccagcgccagcggcctggacaccagcgccctgtctgtgcagggcaactttgacctgaacagcaagagcaagctgcaggagaacttctgcaccaggagcatccagatcccagccaacagaagcaagacagccatgagcaagtgccccatcttccccatggcccggagcatcagcaccagcggccccctggacaaggaggacaccggccggcagaagctgatcagcacaggcagcctgcctgccaccctgcagggcgccacagacagcctgggcctggagtggcacctgcccagcccagaccctgtgacagtgccctacctgagccccctggtggtgtggaaggagctggagagcctgctggagaatgaaggagaccacgccatcaccgtggccgactttgtggaccaccaccccatcgtgttctggaacctggtgtggtacttccggcggctggacctgcccagcaacctgcccggcctcatcctgagcagcgagcactgcaacaagtacagcaagatccccaggcactgcatgtctgaggacagcaaatatgtgctgatccagatgctgtgggacaacatgaagctgcaccaggaccccggccagcccctgtacatcctgtggaatgcccacacccagaagtaccccatggtgcacctgctgcagaagagtgacaacagcttcaaccaggagctgctgaagtccatggtgaagagcatcaagatgaatgatgtgtatggccccatgagccagatcctggagaccctgaacaagtgcccccacttcaagaggcagaggagcctgtaccgggagatcctcttcctgagcctggtggccctgggccgggagaacatcgacattgatgcctttgacaaggagtacaagatggcctatgaccggctgacccccagccaggtgaagagcacccacaactgtgaccggccccccagcactggagtgatggagtgcaggaagaccttcggggagccctacctgtag

SEQ ID NO: 15365 - DNA, 5721 bp, Artificial Sequence
  Description of Artificial Sequence: Synthetic coding sequence
atgattgaagataaaggcccccgggtggccgactactttgtggtggccggcctgacagatgtgtccaagcccctggaggaggagatccacttcaatgatgcctgccacaaggtggccaagcccaaggagcccatcacagatgtgtctgtcatcatcaagagcctgggggaggaggtgccccaggactacatctgcattgatgtgacccccaccggcctgtctgctgacctgaacaacggcagcctggtgggcccccagatctacctgtgctaccgccggggccgggacaagccacccctgacagacctgggcgtgctgtatgactggaaggagcggctgaagcagggctgtgagatcatccagagcaccccctacggccggcctgccaacatcagcggcagcaccagcagccagaggatctacatcacctacagaagagccagcgagaacatgacccagaacaccctggccgtgacagacatctgcatcatcatccccagcaagggggagagccccccccacaccttctgcaaggtggacaagaacctgaacaacagcatgtggggcagcgctgtgtacctgtgctacaagaagtctgtggccaagaccaacacagtgtcctacaaggccggcctcatctgccgctacccccaggaggactatgagagcttcagcctgcctgagagcgtgcccctcttctgcctgcccatgggcgccaccatcgagtgctggcccagcaacagcaagtaccccctgcctgtgttcagcacctttgtgctgactggagccagcgctgagaaggtgtatggagctgccatccagttctatgagccctacagcgaggagaacctgacagagaagcagaggctgctgctgggcctgaccagcgcagatggcaagagtgacagcagcaagaccatccacaccaacaagtgcatctgcctgctgagccactggcccttctttgatgccttcaggaagttcctgaccttcctgtaccgctacagcatcagcggcccccacgtgctgcccatcgagaagcacatcagccacttcatgcacaaggtgcccttccccagcccccagaggccccgcatcctggtgcagctgagcccccatgacaacctgatcctgagccagcctgtgagcagccccctgcccctgagcggcggcaagttcagcaccctgctgcagaacctgggcccagaaaatgctgtgaccctgctggtgtttgctgtgacagagcacaagatcctgatccacagcctgcggcccagcgtgctgacctctgtgacagaggccctggtgtccatgatcttccccttccactggccctgcccctacgtgcccctgtgccccctggccctggctgatgtgctgagcgccccctgccccttcatcgtgggcatcgacagccgctactttgacctgtatgaccccccaccagatgtgtcctgtgtggatgtggacaccaacaccatcagccagattggagacaagaagaatgtggcctggaagatcctgcccaagaagccctgcaagaacctgatgaacaccctgaacaacctgcaccagcagctggccaagctgcagcagaggcccagagatgatggcctgatggacctggccatcaatgactatgacttcaacagcggcaagaggctgcacatgattgacctggagatccaggaggccttcctgttcttcatggccagcatcctgaagggctaccgcagctacctgcggcccatcacccaggcccccagcgagacagccacagatgctgccagcctgtttgccctgcaggccttcctgcggagccgggacaggagccaccagaagttctacaacatgatgaccaagacccagatgttcatccgcttcattgaagaatgttcctttgtgtctgacaaggatgccagcctggccttctttgatgactgtgtggacaaggtggacatggacaagtctggagaggtgcggctgattgagctggatgagagcttcaagtctgagcacacagtgtttgtgaccccacctgagatcccccacctgcccaatggagaggagccccccctgcagtacagctacaacggcttccctgtgctgaggaacaacctgtttgagaggcctgagggcttcctgcaggccaagaagaacaagctgcccagcaagagcagcagccccaacagccccctgcccatgttccggaggaccaagcaggagatcaagagcgcccacaagatcgccaagcgctacagcagcatcccccagatgtggagccgctgcctgctgcggcactgctacggcctgtggttcatctgcctgcctgcctacgtgaaggtgtgccacagcaaggtgcgggccctgaagacagcctatgatgtgctgaagaagatgcagagcaagaagatggaccccccagatgaggtgtgctaccgcatcctgatgcagctgtgtggccagtatgaccagcctgtgctggccgtgcgggtgctgtttgagatgcagaaggccggcatcgaccccaatgccatcacctacggctactacaacaaggctgtgctggagagcacctggcccagccgcagccgcagcggctacttcctgtggaccaaggtgagaaatgtggtgctgggcgtgacccagttcaagagggccctgaagaagcacgcccacctgagccagaccaccctgagtgatggcagtgacctggatgctgtgagccacggctccatggattctggccacggcacccacacagtggagcaggcccccttcaacacaggcctcatcaaggtgtatgccacagatgacaggagcagcactggaggccagagcgacctgggctacaacagcctgagcaaggatgaggtgcggcggggggacaccagcacagaggacatccaggaggagaaggacaagaagggcagtgactgcagcagcctgtctgagagcgagagcaccaagggcagcgctgactgcctgcccaagctgagctaccagaacagcagcagcatcgtgcggctgaccggcaccagcaacaacagcgctgggaagatcagcggggagagcatggagagcaccccagagctgctgctgatcagcagcctggaggacaccaatgagaccaggaacatccagagccgctgcttcaggaagaggcacaagagtgacaatgagaccaacctgcagcagcaggtggtgtggggcaacagaaacagaaacctgagcggcggcgtgctgatgggcttcatgctgaaccgcatcaaccaggaggccacccctggggacatcgtggagaagctgggcgcagatgccaagatcctgagcaatgtcatcagcaagagcacccggcccaacaccctggacatcggcaagccacccctgcggagcaagagggacagcctggagaaggagagcagtgatgatgacaccccatttgatggcagcaactacctggccgacaaggtggacagccctgtgatctttgacctggaggacctggacagcgagacagatgtgtccaaggccggctgtgtggccacccagaaccccaagaggatccagaggatgaacagcagcttctctgtgaagccctttgagaagacagatgtggccaccggctttgaccccctgagcctgctggtggccgagacagagcagcagcagaaggaggaggaggaggaggatgaagatgacagcaagagcatcagcacccccagcgcccggcgggacctggccgaggagatcgtgatgtacatgaacaacatgagcagccccctgaccagcaggacccccagcattgacctgcagagggcctgtgatgacaagctgaacaagaagagcccccccctggtgaaggcctgcagaagaagcagcctgccccccaacagccccaagcctgtgcggctgaccaagagcaagagctacaccaagtctgaggagaagccccgggaccggctgtggagcagccctgccttcagccccacctgccccttccgggaggagagccaggacaccctgacccacagcagccccagcttcaacctggacaccctgctggtgcccaagctggatgtgctgagaaattccatgttcaccgctggaaaaggagtggccgagaaggccagcaagtggtacagccgcttcaccatgtacaccaccagcagcaaggaccagagcagtgacaggaccagcctgagctctgtgggcgcccaggacagcgagagcaccagcctgacagatgaagatgtgtgccacgagctggagggccccatcagcagccaggagaccagcgccaccagcggcaccaagagaattgacctgagccgcatcagcctggagagcagcgccagcctggagggcagcctgagcaagtttgccctgcccgggaagtctgaggtgaccagcagcttcaatgccagcaacaccaacatcttccagaactatgccatggaggtgctgatcagcagctgcagccgctgcaggacctgtgactgcctggtgcatgatgaggagatcatggccggctggacagcagatgacagcaacctgaacaccacctgccccttctgtggcaacatcttcctgcccttcctgaacatcgagatccgggacctgcggcggcccggccgctacttcctgaagagcagccccagcacagagaacatgcacttccccagcagcatcagcagccagacccggcagagctgcatcagcaccagcgccagcggcctggacaccagcgccctgtctgtgcagggcaactttgacctgaacagcaagagcaagctgcaggagaacttctgcaccaggagcatccagatcccagccaacagaagcaagacagccatgagcaaatgtcccatcttccccatggcccggagcatcagcaccagcggccccctggacaaggaggacaccggccggcagaagctgatcagcacaggcagcctgcctgccaccctgcagggcgccacagacagcctgggcctggagtggcacctgcccagcccagaccctgtgacagtgccctacctgagccccctggtggtgtggaaggagctggagagcctgctggagaatgaaggagaccacgccatcaccgtggccgactttgtggaccaccaccccatcgtgttctggaacctggtgtggtacttccggcggctggacctgcccagcaacctgcccggcctcatcctgagcagcgagcactgcaacaagtacagcaagatccccaggcactgcatgtctgaggacagcaaatatgtgctgatccagatgctgtgggacaacatgaagctgcaccaggaccccggccagcccctgtacatcctgtggaatgcccacacccagaagtaccccatggtgcacctgctgcagaagagtgacaacagcttcaaccaggagctgctgaagtccatggtgaagagcatcaagatgaatgatgtgtatggccccatgagccagatcctggagaccctgaacaagtgcccccacttcaagaggcagaggagcctgtaccgggagatcctcttcctgagcctggtggccctgggcagagaaaatattgatattgatgcctttgacaaggagtacaagatggcctatgaccggctgacccccagccaggtgaagagcacccacaactgtgacaggcctcccagcactggagtgatggagtgcaggaagacctttggagagccctacctgtag

SEQ ID NO: 15366 - DNA, 102 bp, Artificial Sequence
  Description of Artificial Sequence: Synthetic coding sequence
atcatcaagtacctgctgctgtacagcttcctgtgtgtgctgatcaagtgccaggacagcttcaagatctactgcttcccctgctaccccttctacaactag

SEQ ID NO: 15367 - DNA, 990 bp, Artificial Sequence
  Description of Artificial Sequence: Synthetic coding sequence
atgggcgccactggagatgctgagcagccccggggccccagcggggctgagcggggcggcctggagctgggagatgctggagctgctggccagctggtgctgaccaacccctggaacatcatgatcaagcaccggcaggtgcagaggcggggccgccgcagccagatgaccaccagcttcacagatcctgccatctccatggacctgctgcgggctgtgctgcagcccagcatcaatgaggagatccagaccgtcttcaacaagtacatgaagttcttccagaaggccgccctgaatgtgcgggacaacgtgggggaggaggtggatgctgagcagctgatccaggaggcctgccgcagctgcctggagcaggccaagctgctcttcagtgatggagagaaggtgatcccccggctgacccatgagctgcccggcatcaagaggggccggcaggccgaggaggagtgtgcccaccggggcagccccctgcccaagaagaggaagggccggcccccaggccacatcctgagcagtgacagagctgctgctggcatggtgtggaagcccaagagctgtgagcccatccggcgggagggccccaagtgggaccctgcccggctgaatgaaagcaccacctttgtgctgggcagccgggccaacaaggccctgggcatgggcggcacccggggccgcatctacatcaagcacccccacctgttcaagtatgctgctgacccccaggacaagcactggctggccgagcagcaccacatgagggccactggaggcaagatggcctacctgctgattgaggaggacatccgggacctggccgccagtgatgactaccggggctgcctggacctgaagctggaggagctgaagagctttgtgctgcccagctggatggtggagaagatgaggaagtacatggagaccctgaggacagaaaatgagcacagagctgtggaggccccaccccagacctag

SEQ ID NO: 15368 - DNA, 2271 bp, Artificial Sequence
  Description of Artificial Sequence: Synthetic coding sequence
atggtggtgaccaggtctgcccgggccaaggccagcatccaggccgccagcgctgagagcagcggccagaagagctttgctgccaacggcatccaggcccaccctgagagcagcactggaagtgatgcccggaccacagctgagagccagaccaccgggaagcagagcctcatccccaggacccccaaggccaggaagaggaagagcaggaccaccggcagcctgcccaagggcacagagcccagcacagatggagagaccagcgaggccgagagcaactacagcgtgtctgagcaccacgacaccatcctgcgggtgacccggcggcggcagatcctgattgcctgcagccctgtgtcctctgtgaggaagaagcccaaggtgacccccaccaaggagagctacacagaggagatcgtgtctgaggccgagagccacgtgtctggcatcagcagaattgtgctgcccacagagaagaccactggagcccggcgcagcaaggccaagagcctgacagaccccagccaggagagccacacagaggccatcagtgatgctgagaccagcagcagtgacatctccttcagcggcatcgccaccaggaggaccaggtccatgcagaggaagctgaaggcccagacagagaagaaggacagcaagatcgtgcctggaaatgagaagcagatcgtgggcacccctgtgaacagtgaagattctgacacccggcagaccagccacctgcaggcccggagcctgtctgagatcaacaagcccaacttctacaacaatgactttgatgatgacttcagccacaggagcagcgagaacatcctgactgtgcatgagcaggccaacgtggagagcctgaaggagaccaagcagaactgcaaggacctggatgaagatgccaacggcatcacagatgagggcaaggagatcaatgagaagagcagccagctgaagaacctgtctgagctgcaggacaccagcctgcagcagctggtgtcccagaggcacagcaccccccagaacaagaatgctgtgtctgtgcacagcaacctgaacagcgaggccgtgatgaagagcctgacccagacctttgccaccgtggaggtgggccgctggaacaacaacaagaagagccccatcaaggccagtgacctgaccaagtttggagactgtggcggcagtgatgatgaggaggagagcaccgtcatctctgtgtctgaggacatgaacagcgagggcaatgtggactttgaatgtgacaccaagctgtacaccagcgcccccaacaccagccagggcaaggacaacagcgtgctgctggtgctgagcagtgatgagagccagcagagcgagaacagtgaaaatgaggaggacaccctgtgctttgtggagaacagcggccagcgggagagcctgagcggggacaccggcagcctgagctgtgacaatgccctgtttgtgattgacaccaccccaggcatgtctgctgacaagaacttctacctggaggaggaggacaaggccagcgaggtggccatcgaggaggagaaggaggaggaggaggatgagaagtctgaggaggacagcagtgaccatgatgaaaatgaagatgagttcagtgatgaggaggacttcctgaacagcaccaaggccaagctgctgaagctgaccagcagcagcattgaccccggcctgagcatcaagcagctgggcggcctgtacatcaacttcaatgctgacaagctgcagagcaacaagaggaccctgacccagatcaaggagaagaagaagaatgagctgctgcagaaggctgtgatcaccccagactttgagaagaaccactgtgtgcccccctacagcgagagcaagtaccagctgcagaagaagaggaggaaggagcggcagaagacagctggagatggctggtttggcatgaaggcccctgagatgaccaatgagctgaagaatgacctgaaggccctgaagatgagggcctccatggaccccaagcgcttctacaagaagaatgacagagatggcttccccaagtacttccagatcggcaccatcgtggacaacccagctgacttctaccacagccgcatccccaagaagcagaggaagaggaccatcgtggaggagctgctggccgacagcgagttccgccgctacaacagaaggaagtacagcgagatcatggccgagaaggccgccaatgctgctgggaagaagttcaggaagaagaagaagttcagaaattag

SEQ ID NO: 15369 - DNA, 1020 bp, Artificial Sequence
  Description of Artificial Sequence: Synthetic coding sequence
atgctgcccagcgctgtggccgcccacgccggggcctactgggatgtggtggccagcagcgccctgctgaacctgcctgctgcccctggctttggaaacctgggcaagagcttcctgattgagaacctgctgcgggtgggcggggcccccaccccccggctgcagcccccagcccctcatgaccctgccacagccctggccacagctggggcccagctgcggcccctgcctgccagccctgtgcccctgaagctgtgcccagctgctgagcaggtgtccccagctggggccccctacggcacccgctgggccttccaggtgctgagccccagcgctgacagcgcccggctgcccggccgggcccctggggaccgggactgcaccttccagcccagcgccccagcccccagcaagcccttcctgctgagcaccccacccttctacagcgcctgctgcggcggcagctgcagaagacctgccagcagcacagccttcccccgggaggagagcatgctgcccctgctgacccaggacagcaacagcaaggcccggcggggcatcctgcggcgggctgtgttttctgaggaccagaggaaggccctggagaagatgttccagaagcagaagtacatcagcaagacagacaggaagaagctggccatcaacctgggcctgaaggagagccaggtgaagatctggttccagaacagaaggatgaagtggaggaacagcaaggagaaggaggtgctgagcaaccgctgcatccaggaggtgggcctgcaggaggaccccctgagccgcagcgccctgggcttccccagcccctgccccagcatctgggatgtgccccagcagcacagcagcccccgctggagggagaacagccctgagcccagcgagcggctcatccaggagagcagcggggcccctcctcctgaggccaacagcctgcagggcgccctgtacctgtgcagcgaggaggaggccggcagcaagggcgtgctgaccggggctgtgtag

SEQ ID NO: 15370 - DNA, 1134 bp, Artificial Sequence
  Description of Artificial Sequence: Synthetic coding sequence
atgcagcactacggcgtgaatggctacagcctgcacgccatgaacagcctgagcgccatgtacaacctgcaccagcaggccgcccagcaggcccagcacgccccagactaccggcccagcgtgcacgccctgaccctggccgagcggctggccgacatcatcctggaggcccgctatggcagccagcacaggaagcagaggaggagcaggacagccttcaccgcccagcagctggaggccctggagaagaccttccagaagacccactacccagatgtggtgatgagggagcggctggccatgtgcaccaacctgcctgaggcccgggtgcaggtgtggttcaagaacagaagagccaagttcaggaagaagcagaggagcctgcagaaggagcagctgcagaagcagaaggaggccgagggcagccatggagagggcaaggccgaggcccccaccccagacacccagctggacacagagcagcccccccggctgcccggcagtgaccccccagctgagctgcacctgagcctgtctgagcagagcgccagcgagagcgcccctgaggaccagcctgaccgggaggaggacccccgggccggggctgaggaccccaaggccgagaagagccctggagctgacagcaagggcctgggctgcaagaggggcagccccaaggctgacagccctggcagcctgaccatcacccctgtggcccctgggggcggcctgctgggccccagccacagctacagcagcagccccctgagcctcttccggctgcaggagcagttccggcagcacatggccgccaccaacaacctggtgcactacagcagctttgaggtgggcggccctgccccagctgctgctgctgctgctgctgctgtgccctacctgggcgtgaacatggcccccctgggcagcctgcactgccagagctactaccagagcctgtctgctgctgctgctgcccaccagggcgtgtggggcagccccctgctgcctgcccccccagctggcctggccccagccagcgccaccctgaacagcaagaccaccagcattgagaacctgcggctgcgggccaagcagcacgccgccagcctgggcctggacaccctgcccaactag

SEQ ID NO: 15371 - DNA, 1149 bp, Artificial Sequence
  Description of Artificial Sequence: Synthetic coding sequence
atgcagcactacggcgtgaatggctacagcctgcacgccatgaacagcctgagcgccatgtacaacctgcaccagcaggccgcccagcaggcccagcacgccccagactaccggcccagcgtgcacgccctgaccctggccgagcggctggccggctgcaccttccaggacatcatcctggaggcccgctatggcagccagcacaggaagcagaggaggagcaggacagccttcaccgcccagcagctggaggccctggagaagaccttccagaagacccactacccagatgtggtgatgagggagcggctggccatgtgcaccaacctgcctgaggcccgggtgcaggtgtggttcaagaacagaagagccaagttcaggaagaagcagaggagcctgcagaaggagcagctgcagaagcagaaggaggccgagggcagccacggggagggcaaggccgaggcccccaccccagacacccagctggacacagagcagcccccccggctgcccggcagtgaccccccagctgagctgcacctgagcctgtctgagcagagcgccagcgagagcgcccctgaggaccagcctgaccgggaggaggaccccagggctggagctgaggaccccaaggccgagaagagccctggagctgacagcaagggcctgggctgcaagaggggcagccccaaggctgacagccctggcagcctgaccatcacccctgtggcccctgggggcggcctgctgggccccagccacagctacagcagcagccccctgagcctcttccggctgcaggagcagttccggcagcacatggccgccaccaacaacctggtgcactacagcagctttgaggtgggcggccctgccccagctgctgctgctgctgctgctgctgtgccctacctgggcgtgaacatggcccccctgggcagcctgcactgccagagctactaccagagcctgtctgctgctgctgctgcccaccagggcgtgtggggcagccccctgctgcctgcccctcctgctggcctggccccagccagcgccaccctgaacagcaagaccaccagcattgagaacctgcggctgcgggccaagcagcacgccgccagcctgggcctggacaccctgcccaactag

SEQ ID NO: 15372 - DNA, 1431 bp, Artificial Sequence
  Description of Artificial Sequence: Synthetic coding sequence
atggagacccctggggccagcgccagcagcctgctgctgcctgctgccagcaggcctcccaggaagcgggaggccggggaggccggggccgccaccagcaagcagagggtgctggatgaggaggagtacatcgagggcctgcagaccgtcatccagagggacttcttcccagatgtggagaagctgcaggcccagaaggagtacctggaggccgaggagaatggagacctggagaggatgaggcagatcgccatcaagtttggaagtgccctgggcaagatgagccgggagcccccaccaccctacgtgaccccagccacctttgagaccccagaggtgcatgctggcactggagtggtgggcaacaagccccggccccggggccggggcctggaggatggagaggccggggaggaggaggagaaggagcccctgcccagcctggatgtgttcctgagccgctacaccagcgaggacaatgccagcttccaggagatcatggaggtggccaaggagaggagccgggcccggcatgcctggctgtaccaggccgaggaggagtttgagaagaggcagaaggacaacctggagctgcccagcgctgagcaccaggccatcgagagcagccaggcctctgtggagacctggaagtacaaggccaagaacagcctgatgtactacccagagggcgtgcctgatgaggagcagctgttcaagaagccccggcaggtggtgcacaagaacacccgcttcctgcgggaccccttcagccaggccctgagccgctgccagctgcagcaggccgccgccctgaatgcccagcacaagcagggcaaggtgggcccagatggcaaggagctgatcccccaggagagcccccgggtgggcggcttcggctttgtggccacccccagccctgcccctggggtgaatgaaagccccatgatgacctggggcgaggtggagaacacccccctgcgggtggagggcagcgagaccccctacgtggacaggaccccaggccctgccttcaagatcctggagcctggaagaagagagcggctgggcctgaagatggccaatgaagctgctgccaagaacagagccaagaagcaggaggccctgcggcgggtgacagagaacctggccagcctgacccccaagggcctgagccctgccatgagccctgccctgcagaggctggtgtccaggacagccagcaagtacacagaccgggccctgcgggccagctacacccccagccctgcccggagcacccacctgaagaccccagccagcggcctgcagacccccaccagcaccccagcccctggcagcgccaccaggacccccctgacccaggaccctgccagcatcacagacaacctgctgcagctgcctgcccggaggaaggccagtgacttcttctag

SEQ ID NO: 15373 - DNA, 747 bp, Artificial Sequence
  Description of Artificial Sequence: Synthetic coding sequence
tgatgcagcacctggagcttcctggcccccctgccccagcagttccacctgaagatcctcttcctgcccctgacccccctgcggctgctgctgctgagcgcccaggtgctgattgtggtgcccttccgggaggccgccctgcgggtggtgcagctgttcatcagcctgctggagggggacagcaagaagaagatcatcgtgagcaacaagaagcgcttccagggcgagtatggcagtgaccctgaggagaggcctcccaacctgaagaggcctgaggactatgaggccgtgtttgtgggcaacattgatgaccacttccgcatcggcgtggccatcctgcagaggagcatccggctgtatgcccccttctacagcagtgacatcctgattgccagccccctgggcctgcggaccatcatcggcggggagggggagaagaagagggactttgacttcctgagcagcattgagctgctgatcatcgaccaggccgacatctacctgatgcagaactgggagcacgtgctgcacctgatgaaccacatgaacctgctgcccctggacagccacggcgtggacttcagccgggtgaggatgtggagcctgaacaactggagcaagtactaccggcagaccctgctgtttggagccctgcaggatgcccagatcaacagcgtcttcaacaagtactgtgtgaacatgcagggccaggtgggcagccggctggtgtcctctgtgagcagctag

SEQ ID NO: 15374 - DNA, 2271 bp, Artificial Sequence
  Description of Artificial Sequence: Synthetic coding sequence
atgggcaagaggggcagccgcagccagagccagctgctgaacaccctgaccaagaagcagaagaagcacctgcgggactttggagaggagcaccccttctatgacagagtgtccaggaaggaggccaagccccagatctgccagctgtctgagagcagtgacagcagtgacagcgagagtgacagcgagagcgagccccagcaggtgtctggctaccaccggctgctggccaccctgaagaatgtgtctgaggaggaggaggaggatgaggaggaggaggaggaggaggacagcatcgtggatgatgctgagatgaatgatgaagatggcggcagtgatgtgtctgtggaggaggagatggctgctgagagcacagagagcccagaaaatgtggccctgtctgctgaccctgagggcaaggaggatggagaggagcccccaggcaccagccagaccagccctgaggagttcacagatgccaagcatgagagcctcttcagcctggagaccaacttcctggaggaggagagcggggacaacagcagcctgaaggccagccaggaccccttcctgcagcacgtgaacaaggagctgaaggagaaggccatccaggccgtggccaccaaccccaagaccacccatgagctgaagtggcccatcctgggccagctgttcttcagcagcaagttccagaagctggagaccttcaagccacccaaggacatcgacctgaagagcctgcacctgcagaagcccctggagagcacctggaccaagaccaacagccagttcctgagcggcccccagaagagcagcagccccttcacccccctgcagaaggagctgttcctgatcatgaacagctacagagacctcttctacccagagaggacagccctgaagaatggagaggagatccgccacgtgtactgcctgcacgtgatcaaccacatcctgaaggccaatgcccaggtgctgggcaacaacagcagaagaagaagccagaagtttggagtgggagatgatgatgacttccgggaccagggcctgacccggcccaaggtgctgattgtggtgcccttccgggaggccgccctgcgggtggtgcagctgttcatcagcctgctggagggggacagcaagaagaagatcatcgtgagcaacaagaagcgcttccagggcgagtatggcagtgaccctgaggagcggccccccaacctgaagaggccagaagattatgaagctgtgtttgtgggcaacattgatgaccacttcagaattggagtggccatcctgcagaggagcatccggctgtatgcccccttctacagcagtgacatcctgattgccagccccctgggcctgcggaccatcattggaggagagggggagaagaagagggactttgacttcctgagcagcattgagctgctgatcatcgaccaggccgacatctacctgatgcagaactgggagcacgtgctgcacctgatgaaccacatgaacctgctgcccctggacagccatggagtggacttcagccgggtgaggatgtggagcctgaacaactggagcaagtactaccggcagaccctgctgtttggagccctgcaggatgcccagatcaacagcgtcttcaacaagtactgtgtgaacatgcagggccaggtggccgtgagaaatgtgcccatgacaggcagcatcagccacgtgctggtgcagctgccccacgtgttccagaggatggaggccgagaacctggcctctgtgattgatgcccgcttcaacttctttgtgaacaagatcctgccccagtacagagatgctgtgatgagccacaccctcatctacatccccagctactttgattttgtgcggctgaggaactacttcaagaaggaggagctgaacttcacccacatctgtgagtacacccagaagagcggcgtgtcccgggcccggcacttcttcctgcagggcgagaagcagttcctgctcttcacagagcgcttccacttctacaagcgctacaccatcaagggcatccggaacctgatcttctatgagctgcccacctacccccacttctacagcgagatctgcaacatgctgcgggccaccaacagaggagaggaggccacctggacctgcaccgtgctgtacagcaaatatgatgcccagaggctggccgctgtggtgggcgtggagcgggccgcccagatgctgcagagcaacaagaatgtgcacctgttcatcactggagagaagtag

SEQ ID NO: 15375 - DNA, 942 bp, Artificial Sequence
  Description of Artificial Sequence: Synthetic coding sequence
atgcccaaggtgaagagcggggccatcggcagaagaagaggccggcaggagcagaggcgggagctgaagtctgctgggggcctgatgttcaacacaggcatcggccagcacatcctgaagaaccccctcatcatcaacagcatcatcgacaaggccgccctgcggcccacagatgtggtgctggaggtgggccctggcactggaaacatgacagtgaagctgctggagaaggccaagaaggtggtggcctgtgagctggacccccggctggtggccgagctgcacaagagggtgcagggcacccctgtggccagcaagctgcaggtgctggtgggagatgtgctgaagacagacctgcccttctttgacacctgtgtggccaacctgccctaccagatcagcagcccctttgtgttcaagctgctgctgcaccggcccttcttccgctgtgccatcctgatgttccagcgggagtttgccctgcggctggtggccaagccaggggacaagctgtactgccgcctgagcatcaacacccagctgctggcccgggtggaccacctgatgaaggtgggcaagaacaacttccggcccccacccaaggtggagagctctgtggtgagaattgagcccaagaaccccccaccacccatcaacttccaggagtgggatggcctggtgcgcatcacctttgtgaggaagaacaagaccctgtctgctgccttcaagagcagcgctgtgcagcagctgctggagaagaactaccgcatccactgcagcgtgcacaacatcatcatccctgaggacttcagcattgctgacaagatccagcagatcctgaccagcacaggcttcagtgacaagagggcccgctccatggacattgatgacttcatccggctgctgcacggcttcaatgctgagggcatccacttctcctag

SEQ ID NO: 15376 - DNA, 4719 bp, Artificial Sequence
  Description of Artificial Sequence: Synthetic coding sequence
atggctgaccggggctgccccctggaggccgcccccctgcctgctgaggtgcgggagagcctggccgagctggagctggagctgtctgagggggacatcacccagaagggctatgagaagaagagggccaagctgctggcccgctacatccccctcatccagggcatcgaccccagcctgcaggctgaaaatcgcatccctggccccagccagaccacagctgctgcccccaagcagcagaagagccggcccacagccagcagagatgagcgcttcagaagtgatgtgcacacagaggccgtgcaggccgccctggccaagtacaaggagaggaagatgcccatgcccagcaagagaagatctgtgctggtgcacagctctgtggagacctacaccccaccagacaccagcagcgcctctgaagatgagggcagcctgcggcggcccggccgcctgaccagcacccccctgcagagccacagctctgtggagccctggctggacagagtcatccagggcagcagcaccagcagcagcgccagcagcaccagcagccaccctgggggccggcccaccacagcccccagcgctgctgccaccccaggagctgctgccaccacagccctggccggcctggaggcccacacccacatcgctgacctgcacagcgcccccccagatgtgaccaccggcctggtggagcacagctactttgagcggccccaggtggcctctgtgcgctctgtgccccggggctgcagcggctccatgctggagacagcagatggagtgcctgtgaacagccgggtgagcagcaagatccagcagctgctgaacaccctgaagaggcccaagaggcctcccctgaaggagttctttgtggatgactttgaggagctgctggaggtgcagcagcctgaccccaaccagcccaagccagagggcagcgagacctctgtgctgcggggggagcccctgacagctggggtgcccaggcctcccagcctgctggccaccctgcagcgctggggcaccacccagcccaagagcccctgcctgacagccctggacaccaccgggaaggctgtgtacaccctgacctacggcaagctgtggagccgcagcctgaagctggcctacaccctgctgaacaagctgaccagcaagaatgagcccctgctgaagccaggggacagagtggccctggtgttccccaacagcgaccctgtgatgttcatggtggccttctacggctgcctgctggccgagctggtgcctgtgcccatcgaggtgcccctgaccaggaaggatgctggcagccagcaggtgggcttcctgctgggcagctgtggggtcttcctggccctgaccacagatgcctgccagaagggcctgcccaaggcccagacaggagaggtggccgccttcaagggctggccacccctgtcctggctggtgattgatggcaagcacctggccaagccacccaaggactggcaccccctggcccaggacaccggcaccggcacagcctacatcgagtacaagaccagcaaggagggcagcacagtgggcgtgacagtgagccacgccagcctgctggcccagtgccgggccctgacccaggcctgtggctacagcgaggccgagaccctgaccaacgtgctggacttcaagagagatgctggcctgtggcacggcgtgctgacctctgtgatgaacaggatgcacgtggtgtctgtgccctatgccctgatgaaggccaaccccctgtcctggatccagaaggtgtgcttctacaaggcccgggccgccctggtgaagagccgggacatgcactggagcctgctggcccagaggggccagagagatgtgtccctgagcagcctgaggatgctgattgtggctgatggagccaacccctggagcatcagcagctgtgatgccttcctgaatgtgttccagagccggggcctgcggcctgaggtgatctgcccctgtgccagcagccctgaggccctgactgtggccatcagaagacctccagacctgggcggccccccacccaggaaggctgtgctgtccatgaatggcctgtcctatggagtcatccgggtggacacagaggagaagctgtctgtgctgactgtgcaggatgtgggccaggtgatgcctggggccaacgtgtgtgtggtgaagctggagggcaccccctacctgtgcaagacagatgaggtgggggagatctgtgtgagcagcagcgccaccggcacagcctactacggcctgctgggcatcaccaagaatgtgtttgaagctgtgcctgtgaccaccggcggggcccccatctttgaccggcccttcaccaggacaggcctgctgggcttcatcggccctgacaacctggtgttcatcgtgggcaagctggatggcctgatggtgactggagtgcggcggcacaatgctgatgatgtggtggccacagccctggccgtggagcccatgaagtttgtgtaccggggcagaattgctgtgttttctgtgacagtgctgcatgatgaccgcatcgtgctggtggccgagcagaggccagatgcctctgaagaagattccttccagtggatgagccgggtgctgcaggccatcgacagcatccaccaggtgggcgtgtactgcctggccctggtgcctgccaacaccctgcccaaggcccccctgggcggcatccacatcagcgagaccaagcagcgcttcctggagggcaccctgcacccctgcaatgtgctgatgtgcccccacacctgtgtgaccaacctgcccaagccccggcagaagcagcctgaggtgggccctgcctccatgattgtgggcaacctggtggccggcaagagaattgcccaggccagcggccgggagctggcccacctggaggacagcgaccaggccaggaagttcctgttcctggctgatgtgctgcagtggagggcccacaccaccccagaccaccccctcttcctgctgctgaatgccaagggcaccgtgaccagcacagccacctgtgtgcagctgcacaagagagctgagcgggtggccgccgccctgatggagaagggccgcctgtctgtgggggaccacgtggccctggtgtacccacctggggtggacctgattgctgccttctacggctgcctgtactgcggctgtgtgcctgtgacagtgcggcccccccacccccagaacctgggcaccaccctgcccaccgtgaagatgattgtggaggtgtccaagagcgcctgtgtgctgaccacccaggccgtgacccggctgctgcggagcaaggaggccgctgctgctgtggacatccgcacctggcccaccatcctggacacagatgacatccccaagaagaagatcgccagcgtcttccggccccccagcccagatgtgctggcctacctggacttctctgtgtccaccaccggcatcctggccggcgtgaagatgagccatgctgccaccagcgccctgtgccgcagcatcaagctgcagtgtgagctgtaccccagccggcagatcgccatctgcctggacccctactgcggcctgggctttgccctgtggtgcctgtgcagcgtgtacagcggccaccagagcgtgctggtgccccccctggagctggagagcaatgtgtccctgtggctgtctgctgtgtcccagtacaaggcccgggtgaccttctgcagctacagcgtgatggagatgtgcaccaagggcctgggcgcccagacaggagtgctgaggatgaagggcgtgaacctgagctgtgtgaggacctgcatggtggtggccgaggagcggcccagaattgccctgacccagagcttcagcaagctgttcaaggacctgggcctgcctgcccgggctgtgtccaccaccttcggctgccgggtgaatgtggccatctgcctgcagggcacagctggccctgaccccaccaccgtgtatgtggacatgagggccctgcggcatgacagagtgcggctggtggagcggggcagcccccacagcctgcccctgatggagagcggcaagatcctgcccggggtgaaggtgatcatcgcccacacagagaccaagggccccctgggggacagccacctgggggagatctgggtgagcagcccccacaatgccaccggctactacacagtgtatggagaggaggccctgcacgccgaccacttcagcgcccggctgagctttggagacacccagaccatctgggccaggacaggctacctgggcttcctgcggaggacagagctgacagatgccagcggcggcagacatgatgccctgtatgtggtgggcagcctggatgagaccctggagctgcggggcatgagataccaccccattgatattgagaccagcgtcatccgggcccacaggagcattgctgaatgtgctgtgttcacctggaccaacctgctggtggtggtggtggagctggatggcctggagcaggatgccctggacctggtggccctggtgaccaacgtggtgctggaggagcactacctggtggtgggcgtggtggtgattgtggaccccggggtcatccccatcaacagcagaggagagaagcagaggatgcacctgagagatggcttcctggccgaccagctggaccccatctacgtggcctacaacatgtag

SEQ ID NO: 15377 - DNA, 2394 bp, Artificial Sequence
  Description of Artificial Sequence: Synthetic coding sequence
atggctgaccggggctgccccctggaggccgcccccctgcctgctgaggtgcgggagagcctggccgagctggagctggagctgtctgagggggacatcacccagaagggctatgagaagaagagggccaagctgctggcccgctacatccccctcatccagggcatcgaccccagcctgcaggctgaaaatcgcatccctggccccagccagaccacagctgctgcccccaagcagcagaagagccggcccacagccagcagagatgagcgcttcagaagtgatgtgcacacagaggccgtgcaggccgccctggccaagtacaaggagaggaagatgcccatgcccagcaagagaagatctgtgctggtgcacagctctgtggagacctacaccccaccagacaccagcagcgcctctgaagatgagggcagcctgcggcggcccggccgcctgaccagcacccccctgcagagccacagctctgtggagccctggctggacagagtcatccagggcagcagcaccagcagcagcgccagcagcaccagcagccaccctgggggccggcccaccacagcccccagcgctgctgccaccccaggagctgctgccaccacagccctggccggcctggaggcccacacccacatcggcgtgcctgtgaacagccgggtgagcagcaagatccagcagctgctgaacaccctgaagaggcccaagaggcctcccctgaaggagttctttgtggatgactttgaggagctgctggaggtgcagcagcctgaccccaaccagcccaagccagagggcagcgagacctctgtgctgcggggggagcccctgacagctggggtgcccaggcctcccagcctgctggccaccctgcagcgctggggcaccacccagcccaagagcccctgcctgacagccctggacaccaccgggaaggctgtgtacaccctgacctacggcaagctgtggagccgcagcctgaagctggcctacaccctgctgaacaagctgaccagcaagaatgagcccctgctgaagccaggggacagagtggccctggtgttccccaacagcgaccctgtgatgttcatggtggccttctacggctgcctgctggccgagctggtgcctgtgcccatcgaggtgcccctgaccaggaaggatgctggcagccagcaggtgggcttcctgctgggcagctgtggggtcttcctggccctgaccacagatgcctgccagaagggcctgcccaaggcccagacaggagaggtggccgccttcaagggctggccacccctgtcctggctggtgattgatggcaagcacctggccaagccacccaaggactggcaccccctggcccaggacaccggcaccggcacagcctacatcgagtacaagaccagcaaggagggcagcacagtgggcgtgacagtgagccacgccagcctgctggcccagtgccgggccctgacccaggcctgtggctacagcgaggccgagaccctgaccaacgtgctggacttcaagagagatgctggcctgtggcacggcgtgctgacctctgtgatgaacaggatgcacgtggtgtctgtgccctatgccctgatgaaggccaaccccctgtcctggatccagaaggtgtgcttctacaaggcccgggccgccctggtgaagagccgggacatgcactggagcctgctggcccagaggggccagagagatgtgtccctgagcagcctgaggatgctgattgtggctgatggagccaacccctggagcatcagcagctgtgatgccttcctgaatgtgttccagagccggggcctgcggcctgaggtgatctgcccctgtgccagcagccctgaggccctgactgtggccatcagaagacctccagacctgggcggccccccacccaggaaggctgtgctgtccatgaatggcctgtcctatggagtcatccgggtggacacagaggagaagctgtctgtgctgactgtgcaggatgtgggccaggtgatgcctggggccaacgtgtgtgtggtgaagctggagggcaccccctacctgtgcaagacagatgaggtgggggagatctgtgtgagcagcagcgccaccggcacagcctactacggcctgctgggcatcaccaagaatgtgtttgaagctgtgcctgtgaccaccggcggggcccccatctttgaccggcccttcaccaggacaggcctgctgggcttcatcggccctgacaacctggtgttcatcgtgggcaagctggatggcctgatggtgactggagtgcggcggcacaatgctgatgatgtggtggccacagccctggccgtggagcccatgaagtttgtgtaccggggctag

SEQ ID NO: 15378 - DNA, 4704 bp, Artificial Sequence
  Description of Artificial Sequence: Synthetic coding sequence
atggctgaccggggctgccccctggaggccgcccccctgcctgctgaggtgcgggagagcctggccgagctggagctggagctgtctgagggggacatcacccagaagggctatgagaagaagagggccaagctgctggcccgctacatccccctcatccagggcatcgaccccagcctgcaggctgaaaatcgcatccctggccccagccagaccacagctgctgcccccaagcagcagaagagccggcccacagccagcagagatgagcgcttcagaagtgatgtgcacacagaggccgtgcaggccgccctggccaagtacaaggagaggaagatgcccatgcccagcaagagaagatctgtgctggtgcacagctctgtggagacctacaccccaccagacaccagcagcgcctctgaagatgagggcagcctgcggcggcccggccgcctgaccagcacccccctgcagagccacagctctgtggagccctggctggacagagtcatccagggcagcagcaccagcagcagcgccagcagcaccagcagccaccctgggggccggcccaccacagcccccagcgctgctgccaccccaggagctgctgccaccacagccctggccggcctggaggcccacacccacatcgacctgcacagcgcccccccagatgtgaccaccggcctggtggagcacagctactttgagcggccccaggtggcctctgtgcgctctgtgccccggggctgcagcggctccatgctggagacagcagatggagtgcctgtgaacagccgggtgagcagcaagatccagcagctgctgaacaccctgaagaggcccaagaggcctcccctgaaggagttctttgtggatgactttgaggagctgctggaggaccccaaccagcccaagccagagggcagcgagacctctgtgctgcggggggagcccctgacagctggggtgccccggccccccagcctgctggccaccctgcagcgctggggcaccacccagcccaagagcccctgcctgacagccctggacaccaccgggaaggctgtgtacaccctgacctacggcaagctgtggagccgcagcctgaagctggcctacaccctgctgaacaagctgaccagcaagaatgagcccctgctgaagccaggggacagagtggccctggtgttccccaacagcgaccctgtgatgttcatggtggccttctacggctgcctgctggccgagctggtgcctgtgcccatcgaggtgcccctgaccaggaaggatgctggcagccagcaggtgggcttcctgctgggcagctgtggggtcttcctggccctgaccacagatgcctgccagaagggcctgcccaaggcccagacaggagaggtggccgccttcaagggctggccacccctgtcctggctggtgattgatggcaagcacctggccaagccacccaaggactggcaccccctggcccaggacacaggaactggaacagcctacatcgagtacaagaccagcaaggagggcagcacagtgggcgtgacagtgtcccatgccagcctgctggcccagtgccgggccctgacccaggcctgtggctacagcgaggccgagaccctgaccaacgtgctggacttcaagagagatgctggcctgtggcatggagtgctgacctctgtgatgaacaggatgcacgtggtgtctgtgccctatgccctgatgaaggccaaccccctgtcctggatccagaaggtgtgcttctacaaggcccgggccgccctggtgaagagccgggacatgcactggagcctgctggcccagaggggccagagagatgtgtccctgagcagcctgaggatgctgattgtggctgatggagccaacccctggagcatcagcagctgtgatgccttcctgaatgtgttccagagccggggcctgcggcctgaggtgatctgcccctgtgccagcagccctgaggccctgactgtggccatccggcggcccccagacctgggcggccccccacccaggaaggctgtgctgtccatgaatggcctgtcctatggagtcatccgggtggacacagaggagaagctgtctgtgctgactgtgcaggatgtgggccaggtgatgcctggggccaacgtgtgtgtggtgaagctggagggcaccccctacctgtgcaagacagatgaggtgggggagatctgtgtgagcagcagcgccactggaacagcctactacggcctgctgggcatcaccaagaatgtgtttgaggccgtgcctgtgaccactggaggagcccccatctttgaccggcccttcaccaggacaggcctgctgggcttcatcggccctgacaacctggtgttcatcgtgggcaagctggatggcctgatggtgactggagtgagaagacacaatgctgatgatgtggtggccacagccctggccgtggagcccatgaagtttgtgtaccggggcagaattgctgtgttttctgtgacagtgctgcatgatgacagaattgtgctggtggccgagcagaggccagatgccagcgaggaggacagcttccagtggatgagccgggtgctgcaggccatcgacagcatccaccaggtgggcgtgtactgcctggccctggtgcctgccaacaccctgcccaaggcccccctgggcggcatccacatcagcgagaccaagcagcgcttcctggagggcaccctgcacccctgcaatgtgctgatgtgcccccacacctgtgtgaccaacctgcccaagccccggcagaagcagcctgaggtgggccctgcctccatgattgtgggcaacctggtggccggcaagagaattgcccaggccagcggccgggagctggcccacctggaggacagcgaccaggccaggaagttcctgttcctggctgatgtgctgcagtggagggcccacaccaccccagaccaccccctcttcctgctgctgaatgccaagggcaccgtgaccagcacagccacctgtgtgcagctgcacaagagagctgagcgggtggccgccgccctgatggagaagggccgcctgtctgtgggggaccacgtggccctggtgtacccacctggggtggacctgattgctgccttctacggctgcctgtactgcggctgtgtgcctgtgacagtgcggcccccccacccccagaacctgggcaccaccctgcccaccgtgaagatgattgtggaggtgtccaagagcgcctgtgtgctgaccacccaggccgtgacccggctgctgcggagcaaggaggccgctgctgctgtggacatccgcacctggcccaccatcctggacacagatgacatccccaagaagaagatcgcctctgtgttccggccccccagcccagatgtgctggcctacctggacttctctgtgtccaccaccggcatcctggccggcgtgaagatgagccacgccgccaccagcgccctgtgccgcagcatcaagctgcagtgtgagctgtaccccagccggcagatcgccatctgcctggacccctactgcggcctgggctttgccctgtggtgcctgtgcagcgtgtacagcggccaccagagcgtgctggtgccccccctggagctggagagcaatgtgtccctgtggctgtctgctgtgtcccagtacaaggcccgggtgaccttctgcagctacagcgtgatggagatgtgcaccaagggcctgggcgcccagacaggagtgctgaggatgaagggcgtgaacctgagctgtgtgaggacctgcatggtggtggccgaggagcggccccgcatcgccctgacccagagcttcagcaagctgttcaaggacctgggcctgcctgcccgggctgtgtccaccaccttcggctgccgggtgaatgtggccatctgcctgcagggcacagctggccctgaccccaccaccgtgtatgtggacatgagggccctgcggcatgacagagtgcggctggtggagcggggcagcccccacagcctgcccctgatggagagcggcaagatcctgcccggggtgaaggtgatcatcgcccacacagagaccaagggccccctgggggacagccacctgggggagatctgggtgagcagcccccacaatgccaccggctactacacagtgtatggagaggaggccctgcatgctgaccacttcagcgcccggctgagctttggagacacccagaccatctgggccaggacaggctacctgggcttcctgcggaggacagagctgacagatgccagcggcggcagacatgatgccctgtatgtggtgggcagcctggatgagaccctggagctgcggggcatgagataccaccccatcgacatcgagaccagcgtcatccgggcccacaggagcattgctgaatgtgctgtgttcacctggaccaacctgctggtggtggtggtggagctggatggcctggagcaggatgccctggacctggtggccctggtgaccaacgtggtgctggaggagcactacctggtggtgggcgtggtggtgattgtggaccccggggtcatccccatcaacagcagaggagagaagcagaggatgcacctgagagatggcttcctggccgaccagctggaccccatctacgtggcctacaacatgtag

SEQ ID NO: 15379 - DNA, 4716 bp, Artificial Sequence
  Description of Artificial Sequence: Synthetic coding sequence
atggctgaccggggctgccccctggaggccgcccccctgcctgctgaggtgcgggagagcctggccgagctggagctggagctgtctgagggggacatcacccagaagggctatgagaagaagagggccaagctgctggcccgctacatccccctcatccagggcatcgaccccagcctgcaggctgaaaatcgcatccctggccccagccagaccacagctgctgcccccaagcagcagaagagccggcccacagccagcagagatgagcgcttcagaagtgatgtgcacacagaggccgtgcaggccgccctggccaagtacaaggagaggaagatgcccatgcccagcaagagaagatctgtgctggtgcacagctctgtggagacctacaccccaccagacaccagcagcgcctctgaagatgagggcagcctgcggcggcccggccgcctgaccagcacccccctgcagagccacagctctgtggagccctggctggacagagtcatccagggcagcagcaccagcagcagcgccagcagcaccagcagccaccctgggggccggcccaccacagcccccagcgctgctgccaccccaggagctgctgccaccacagccctggccggcctggaggcccacacccacatcgacctgcacagcgcccccccagatgtgaccaccggcctggtggagcacagctactttgagcggccccaggtggcctctgtgcgctctgtgccccggggctgcagcggctccatgctggagacagcagatggagtgcctgtgaacagccgggtgagcagcaagatccagcagctgctgaacaccctgaagaggcccaagaggcctcccctgaaggagttctttgtggatgactttgaggagctgctggaggtgcagcagcctgaccccaaccagcccaagccagagggcagcgagacctctgtgctgcggggggagcccctgacagctggggtgccccggccccccagcctgctggccaccctgcagcgctggggcaccacccagcccaagagcccctgcctgacagccctggacaccaccgggaaggctgtgtacaccctgacctacggcaagctgtggagccgcagcctgaagctggcctacaccctgctgaacaagctgaccagcaagaatgagcccctgctgaagccaggggacagagtggccctggtgttccccaacagcgaccctgtgatgttcatggtggccttctacggctgcctgctggccgagctggtgcctgtgcccatcgaggtgcccctgaccaggaaggatgctggcagccagcaggtgggcttcctgctgggcagctgtggggtcttcctggccctgaccacagatgcctgccagaagggcctgcccaaggcccagacaggagaggtggccgccttcaagggctggccacccctgtcctggctggtgattgatggcaagcacctggccaagccacccaaggactggcaccccctggcccaggacacaggaactggaacagcctacatcgagtacaagaccagcaaggagggcagcacagtgggcgtgacagtgtcccatgccagcctgctggcccagtgccgggccctgacccaggcctgtggctacagcgaggccgagaccctgaccaacgtgctggacttcaagagagatgctggcctgtggcatggagtgctgacctctgtgatgaacaggatgcacgtggtgtctgtgccctatgccctgatgaaggccaaccccctgtcctggatccagaaggtgtgcttctacaaggcccgggccgccctggtgaagagccgggacatgcactggagcctgctggcccagaggggccagagagatgtgtccctgagcagcctgaggatgctgattgtggctgatggagccaacccctggagcatcagcagctgtgatgccttcctgaatgtgttccagagccggggcctgcggcctgaggtgatctgcccctgtgccagcagccctgaggccctgactgtggccatccggcggcccccagacctgggcggccccccacccaggaaggctgtgctgtccatgaatggcctgtcctatggagtcatccgggtggacacagaggagaagctgtctgtgctgactgtgcaggatgtgggccaggtgatgcctggggccaacgtgtgtgtggtgaagctggagggcaccccctacctgtgcaagacagatgaggtgggggagatctgtgtgagcagcagcgccactggaacagcctactacggcctgctgggcatcaccaagaatgtgtttgaggccgtgcctgtgaccactggaggagcccccatctttgaccggcccttcaccaggacaggcctgctgggcttcatcggccctgacaacctggtgttcatcgtgggcaagctggatggcctgatggtgactggagtgagaagacacaatgctgatgatgtggtggccacagccctggccgtggagcccatgaagtttgtgtaccggggcagaattgctgtgttttctgtgacagtgctgcatgatgacagaattgtgctggtggccgagcagaggccagatgccagcgaggaggacagcttccagtggatgagccgggtgctgcaggccatcgacagcatccaccaggtgggcgtgtactgcctggccctggtgcctgccaacaccctgcccaaggcccccctgggcggcatccacatcagcgagaccaagcagcgcttcctggagggcaccctgcacccctgcaatgtgctgatgtgcccccacacctgtgtgaccaacctgcccaagccccggcagaagcagcctgaggtgggccctgcctccatgattgtgggcaacctggtggccggcaagagaattgcccaggccagcggccgggagctggcccacctggaggacagcgaccaggccaggaagttcctgttcctggctgatgtgctgcagtggagggcccacaccaccccagaccaccccctcttcctgctgctgaatgccaagggcaccgtgaccagcacagccacctgtgtgcagctgcacaagagagctgagcgggtggccgccgccctgatggagaagggccgcctgtctgtgggggaccacgtggccctggtgtacccacctggggtggacctgattgctgccttctacggctgcctgtactgcggctgtgtgcctgtgacagtgcggcccccccacccccagaacctgggcaccaccctgcccaccgtgaagatgattgtggaggtgtccaagagcgcctgtgtgctgaccacccaggccgtgacccggctgctgcggagcaaggaggccgctgctgctgtggacatccgcacctggcccaccatcctggacacagatgacatccccaagaagaagatcgcctctgtgttccggccccccagcccagatgtgctggcctacctggacttctctgtgtccaccaccggcatcctggccggcgtgaagatgagccacgccgccaccagcgccctgtgccgcagcatcaagctgcagtgtgagctgtaccccagccggcagatcgccatctgcctggacccctactgcggcctgggctttgccctgtggtgcctgtgcagcgtgtacagcggccaccagagcgtgctggtgccccccctggagctggagagcaatgtgtccctgtggctgtctgctgtgtcccagtacaaggcccgggtgaccttctgcagctacagcgtgatggagatgtgcaccaagggcctgggcgcccagacaggagtgctgaggatgaagggcgtgaacctgagctgtgtgaggacctgcatggtggtggccgaggagcggccccgcatcgccctgacccagagcttcagcaagctgttcaaggacctgggcctgcctgcccgggctgtgtccaccaccttcggctgccgggtgaatgtggccatctgcctgcagggcacagctggccctgaccccaccaccgtgtatgtggacatgagggccctgcggcatgacagagtgcggctggtggagcggggcagcccccacagcctgcccctgatggagagcggcaagatcctgcccggggtgaaggtgatcatcgcccacacagagaccaagggccccctgggggacagccacctgggggagatctgggtgagcagcccccacaatgccaccggctactacacagtgtatggagaggaggccctgcatgctgaccacttcagcgcccggctgagctttggagacacccagaccatctgggccaggacaggctacctgggcttcctgcggaggacagagctgacagatgccagcggcggcagacatgatgccctgtatgtggtgggcagcctggatgagaccctggagctgcggggcatgagataccaccccatcgacatcgagaccagcgtcatccgggcccacaggagcattgctgaatgtgctgtgttcacctggaccaacctgctggtggtggtggtggagctggatggcctggagcaggatgccctggacctggtggccctggtgaccaacgtggtgctggaggagcactacctggtggtgggcgtggtggtgattgtggaccccggggtcatccccatcaacagcagaggagagaagcagaggatgcacctgagagatggcttcctggccgaccagctggaccccatctacgtggcctacaacatgtag

SEQ ID NO: 15380 - DNA, 3333 bp, Artificial Sequence
  Description of Artificial Sequence: Synthetic coding sequence
atggctgaccggggctgccccctggaggccgcccccctgcctgctgaggtgcgggagagcctggccgagctggagctggagctgtctgaagatgtgcacacagaggccgtgcaggccgccctggccaagtacaaggagaggaagatgcccatgcccagcaagagaagatctgtgctggtgcacagctctgtggagacctacaccccaccagacaccagcagcgcctctgaagatgagggcagcctgcggcggcccggccgcctgaccagcacccccctgcagagccacagctctgtggagccctggctggacagagtcatccagggcagcagcaccagcagcagcgccagcagcaccagcagccaccctgggggccggcccaccacagcccccagcgctgctgccaccccaggagctgctgccaccacagccctggccggcctggaggcccacacccacatcgacctgcacagcgcccccccagatgtgaccaccggcctggtggagcacagctactttgagcggccccaggtggcctctgtgcgctctgtgccccggggctgcagcggctccatgctggagacagcagatggagtgcctgtgaacagccgggtgagcagcaagatccagcagctgctgaacaccctgaagaggcccaagaggcctcccctgaaggagttctttgtggatgactttgaggagctgctggaggtgcagcagcctgaccccaaccagcccaagccagagggcagcgagacctctgtgctgcggggggagcccctgacagctggggtgccccggccccccagcctgctggccaccctgcagcgctggggcaccacccagcccaagagcccctgcctgacagccctggacaccaccgggaaggctgtgtacaccctgacctacggcaagctgtggagccgcagcctgaagctggcctacaccctgctgaacaagctgaccagcaagaatgagcccctgctgaagccaggggacagagtggccctggtgttccccaacagcgaccctgtgatgttcatggtggccttctacggctgcctgctggccgagctggtgcctgtgcccatcgaggtgcccctgaccaggaaggatgctggcagccagcaggtgggcttcctgctgggcagctgtggggtcttcctggccctgaccacagatgcctgccagaagggcctgcccaaggcccagacaggagaggtggccgccttcaagggctggccacccctgtcctggctggtgattgatggcaagcacctggccaagccacccaaggactggcaccccctggcccaggacacaggaactggaacagcctacatcgagtacaagaccagcaaggagggcagcacagtgggcgtgacagtgtcccatgccagcctgctggcccagtgccgggccctgacccaggcctgtggctacagcgaggccgagaccctgaccaacgtgctggacttcaagagagatgctggcctgtggcatggagtgctgacctctgtgatgaacaggatgcacgtggtgtctgtgccctatgccctgatgaaggccaaccccctgtcctggatccagaaggtgtgcttctacaaggcccgggccgccctggtgaagagccgggacatgcactggagcctgctggcccagaggggccagagagatgtgtccctgagcagcctgaggatgctgattgtggctgatggagccaacccctggagcatcagcagctgtgatgccttcctgaatgtgttccagagccggggcctgcggcctgaggtgatctgcccctgtgccagcagccctgaggccctgactgtggccatccggcggcccccagacctgggcggccccccacccaggaaggctgtgctgtccatgaatggcctgtcctatggagtcatccgggtggacacagaggagaagctgtctgtgctgactgtgcaggatgtgggccaggtgatgcctggggccaacgtgtgtgtggtgaagctggagggcaccccctacctgtgcaagacagatgaggtgggggagatctgtgtgagcagcagcgccactggaacagcctactacggcctgctgggcatcaccaagaatgtgtttgaggccgtgcctgtgaccactggaggagcccccatctttgaccggcccttcaccaggacaggcctgctgggcttcatcggccctgacaacctggtgttcatcgtgggcaagctggatggcctgatggtgactggagtgagaagacacaatgctgatgatgtggtggccacagccctggccgtggagcccatgaagtttgtgtaccggggcagaattgctgtgttttctgtgacagtgctgcatgatgacagaattgtgctggtggccgagcagaggccagatgccagcgaggaggacagcttccagtggatgagccgggtgctgcaggccatcgacagcatccaccaggtgggcgtgtactgcctggccctggtgcctgccaacaccctgcccaaggcccccctgggcggcatccacatcagcgagaccaagcagcgcttcctggagggcaccctgcacccctgcaatgtgctgatgtgcccccacacctgtgtgaccaacctgcccaagccccggcagaagcagcctgaggtgggccctgcctccatgattgtgggcaacctggtggccggcaagagaattgcccaggccagcggccgggagctggcccacctggaggacagcgaccaggccaggaagttcctgttcctggctgatgtgctgcagtggagggcccacaccaccccagaccaccccctcttcctgctgctgaatgccaagggcaccgtgaccagcacagccacctgtgtgcagctgcacaagagagctgagcgggtggccgccgccctgatggagaagggccgcctgtctgtgggggaccacgtggccctggtgtacccacctggggtggacctgattgctgccttctacggctgcctgtactgcggctgtgtgcctgtgacagtgcggcccccccacccccagaacctgggcaccaccctgcccaccgtgaagatgattgtggaggtgtccaagagcgcctgtgtgctgaccacccaggccgtgacccggctgctgcggagcaaggaggccgctgctgctgtggacatccgcacctggcccaccatcctggacacagatgacatccccaagaagaagatcgcctctgtgttccggccccccagcccagatgtgctggcctacctggacttctctgtgtccaccaccggcatcctggccggcgtgaaggccggccggggcggcagccggctgtag

SEQ ID NO: 15381 - DNA, 2526 bp, Artificial Sequence
  Description of Artificial Sequence: Synthetic coding sequence
atggctgaccggggctgccccctggaggccgcccccctgcctgctgaggtgcgggagagcctggccgagctggagctggagctgtctgagggggacatcacccagaagggctatgagaagaagagggccaagctgctggcccgctacatccccctcatccagggcatcgaccccagcctgcaggctgaaaatcgcatccctggccccagccagaccacagctgctgcccccaagcagcagaagagccggcccacagccagcagagatgagcgcttcagaagtgatgtgcacacagaggccgtgcaggccgccctggccaagtacaaggagaggaagatgcccatgcccagcaagagaagatctgtgctggtgcacagctctgtggagacctacaccccaccagacaccagcagcgcctctgaagatgagggcagcctgcggcggcccggccgcctgaccagcacccccctgcagagccacagctctgtggagccctggctggacagagtcatccagggcagcagcaccagcagcagcgccagcagcaccagcagccaccctgggggccggcccaccacagcccccagcgctgctgccaccccaggagctgctgccaccacagccctggccggcctggaggcccacacccacatcgacctgcacagcgcccccccagatgtgaccaccggcctggtggagcacagctactttgagcggccccaggtggcctctgtgcgctctgtgccccggggctgcagcggctccatgctggagacagcagatggagtgcctgtgaacagccgggtgagcagcaagatccagcagctgctgaacaccctgaagaggcccaagaggcctcccctgaaggagttctttgtggatgactttgaggagctgctggaggtgcagcagcctgaccccaaccagcccaagccagagggcagcgagacctctgtgctgcggggggagcccctgacagctggggtgccccggccccccagcctgctggccaccctgcagcgctggggcaccacccagcccaagagcccctgcctgacagccctggacaccaccgggaaggctgtgtacaccctgacctacggcaagctgtggagccgcagcctgaagctggcctacaccctgctgaacaagctgaccagcaagaatgagcccctgctgaagccaggggacagagtggccctggtgttccccaacagcgaccctgtgatgttcatggtggccttctacggctgcctgctggccgagctggtgcctgtgcccatcgaggtgcccctgaccaggaaggatgctggcagccagcaggtgggcttcctgctgggcagctgtggggtcttcctggccctgaccacagatgcctgccagaagggcctgcccaaggcccagacaggagaggtggccgccttcaagggctggccacccctgtcctggctggtgattgatggcaagcacctggccaagccacccaaggactggcaccccctggcccaggacacaggaactggaacagcctacatcgagtacaagaccagcaaggagggcagcacagtgggcgtgacagtgtcccatgccagcctgctggcccagtgccgggccctgacccaggcctgtggctacagcgaggccgagaccctgaccaacgtgctggacttcaagagagatgctggcctgtggcatggagtgctgacctctgtgatgaacaggatgcacgtggtgtctgtgccctatgccctgatgaaggccaaccccctgtcctggatccagaaggtgtgcttctacaaggcccgggccgccctggtgaagagccgggacatgcactggagcctgctggcccagaggggccagagagatgtgtccctgagcagcctgaggatgctgattgtggctgatggagccaacccctggagcatcagcagctgtgatgccttcctgaatgtgttccagagccggggcctgcggcctgaggtgatctgcccctgtgccagcagccctgaggccctgactgtggccatccggcggcccccagacctgggcggccccccacccaggaaggctgtgctgtccatgaatggcctgtcctatggagtcatccgggtggacacagaggagaagctgtctgtgctgactgtgcaggatgtgggccaggtgatgcctggggccaacgtgtgtgtggtgaagctggagggcaccccctacctgtgcaagacagatgaggtgggggagatctgtgtgagcagcagcgccactggaacagcctactacggcctgctgggcatcaccaagaatgtgtttgaggccgtgcctgtgaccactggaggagcccccatctttgaccggcccttcaccaggacaggcctgctgggcttcatcggccctgacaacctggtgttcatcgtgggcaagctggatggcctgatggtgactggagtgagaagacacaatgctgatgatgtggtggccacagccctggccgtggagcccatgaagtttgtgtaccggggccgctag

SEQ ID NO: 15382 - DNA, 2670 bp, Artificial Sequence
  Description of Artificial Sequence: Synthetic coding sequence
atggctgaccggggctgccccctggaggccgcccccctgcctgctgaggtgcgggagagcctggccgagctggagctggagctgtctgagggggacatcacccagaagggctatgagaagaagagggccaagctgctggcccgctacatccccctcatccagggcatcgaccccagcctgcaggctgaaaatcgcatccctggccccagccagaccacagctgctgcccccaagcagcagaagagccggcccacagccagcagagatgagcgcttcagaagtgatgtgcacacagaggccgtgcaggccgccctggccaagtacaaggagaggaagatgcccatgcccagcaagagaagatctgtgctggtgcacagctctgtggagacctacaccccaccagacaccagcagcgcctctgaagatgagggcagcctgcggcggcccggccgcctgaccagcacccccctgcagagccacagctctgtggagccctggctggacagagtcatccagggcagcagcaccagcagcagcgccagcagcaccagcagccaccctgggggccggcccaccacagcccccagcgctgctgccaccccaggagctgctgccaccacagccctggccggcctggaggcccacacccacatcgacctgcacagcgcccccccagatgtgaccaccggcctggtggagcacagctactttgagcggccccaggtggcctctgtgcgctctgtgccccggggctgcagcggctccatgctggagacagcagatggagtgcctgtgaacagccgggtgagcagcaagatccagcagctgctgaacaccctgaagaggcccaagaggcctcccctgaaggagttctttgtggatgactttgaggagctgctggaggtgcagcagcctgaccccaaccagcccaagccagagggcagcgagacctctgtgctgcggggggagcccctgacagctggggtgccccggccccccagcctgctggccaccctgcagcgctggggcaccacccagcccaagagcccctgcctgacagccctggacaccaccgggaaggctgtgtacaccctgacctacggcaagctgtggagccgcagcctgaagctggcctacaccctgctgaacaagctgaccagcaagaatgagcccctgctgaagccaggggacagagtggccctggtgttccccaacagcgaccctgtgatgttcatggtggccttctacggctgcctgctggccgagctggtgcctgtgcccatcgaggtgcccctgaccaggaaggatgctggcagccagcaggtgggcttcctgctgggcagctgtggggtcttcctggccctgaccacagatgcctgccagaagggcctgcccaaggcccagacaggagaggtggccgccttcaagggctggccacccctgtcctggctggtgattgatggcaagcacctggccaagccacccaaggactggcaccccctggcccaggacacaggaactggaacagcctacatcgagtacaagaccagcaaggagggcagcacagtgggcgtgacagtgtcccatgccagcctgctggcccagtgccgggccctgacccaggcctgtggctacagcgaggccgagaccctgaccaacgtgctggacttcaagagagatgctggcctgtggcatggagtgctgacctctgtgatgaacaggatgcacgtggtgtctgtgccctatgccctgatgaaggccaaccccctgtcctggatccagaaggtgtgcttctacaaggcccgggccgccctggtgaagagccgggacatgcactggagcctgctggcccagaggggccagagagatgtgtccctgagcagcctgaggatgctgattgtggctgatggagccaacccctggagcatcagcagctgtgatgccttcctgaatgtgttccagagccggggcctgcggcctgaggtgatctgcccctgtgccagcagccctgaggccctgactgtggccatccggcggcccccagacctgggcggccccccacccaggaaggctgtgctgtccatgaatggcctgtcctatggagtcatccgggtggacacagaggagaagctgtctgtgctgactgtgcaggatgtgggccaggtgatgcctggggccaacgtgtgtgtggtgaagctggagggcaccccctacctgtgcaagacagatgaggtgggggagatctgtgtgagcagcagcgccactggaacagcctactacggcctgctgggcatcaccaagaatgtgtttgaggccgtgcctgtgaccactggaggagcccccatctttgaccggcccttcaccaggacaggcctgctgggcttcatcggccctgacaacctggtgttcatcgtgggcaagctggatggcctgatggtgactggagtgagaagacacaatgctgatgatgtggtggccacagccctggccgtggagcccatgaagtttgtgtaccggggcagaattgctgtgttttctgtgacagtgctgcatgatgacagaattgtgctggtggccgagcagaggccagatgccagcgaggaggacagcttccagtggatgagccgggtgctgcaggtgggcgccccagcccggcccatggtgaggtag

SEQ ID NO: 15383 - DNA, 2397 bp, Artificial Sequence
  Description of Artificial Sequence: Synthetic coding sequence
atggctgaccggggctgccccctggaggccgcccccctgcctgctgaggtgcgggagagcctggccgagctggagctggagctgtctgagggggacatcacccagaagggctatgagaagaagagggccaagctgctggcccgctacatccccctcatccagggcatcgaccccagcctgcaggctgaaaatcgcatccctggccccagccagaccacagctgctgcccccaagcagcagaagagccggcccacagccagcagagatgagcgcttcagaagtgatgtgcacacagaggccgtgcaggccgccctggccaagtacaaggagaggaagatgcccatgcccagcaagagaagatctgtgctggtgcacagctctgtggagacctacaccccaccagacaccagcagcgcctctgaagatgagggcagcctgcggcggcccggccgcctgaccagcacccccctgcagagccacagctctgtggagccctggctggacagagtcatccagggcagcagcaccagcagcagcgccagcagcaccagcagccaccctgggggccggcccaccacagcccccagcgctgctgccaccccaggagctgctgccaccacagccctggccggcctggaggcccacacccacatcggcgtgcctgtgaacagccgggtgagcagcaagatccagcagctgctgaacaccctgaagaggcccaagaggcctcccctgaaggagttctttgtggatgactttgaggagctgctggaggtgcagcagcctgaccccaaccagcccaagccagagggcagcgagacctctgtgctgcggggggagcccctgacagctggggtgcccaggcctcccagcctgctggccaccctgcagcgctggggcaccacccagcccaagagcccctgcctgacagccctggacaccaccgggaaggctgtgtacaccctgacctacggcaagctgtggagccgcagcctgaagctggcctacaccctgctgaacaagctgaccagcaagaatgagcccctgctgaagccaggggacagagtggccctggtgttccccaacagcgaccctgtgatgttcatggtggccttctacggctgcctgctggccgagctggtgcctgtgcccatcgaggtgcccctgaccaggaaggatgctggcagccagcaggtgggcttcctgctgggcagctgtggggtcttcctggccctgaccacagatgcctgccagaagggcctgcccaaggcccagacaggagaggtggccgccttcaagggctggccacccctgtcctggctggtgattgatggcaagcacctggccaagccacccaaggactggcaccccctggcccaggacaccggcaccggcacagcctacatcgagtacaagaccagcaaggagggcagcacagtgggcgtgacagtgagccacgccagcctgctggcccagtgccgggccctgacccaggcctgtggctacagcgaggccgagaccctgaccaacgtgctggacttcaagagagatgctggcctgtggcacggcgtgctgacctctgtgatgaacaggatgcacgtggtgtctgtgccctatgccctgatgaaggccaaccccctgtcctggatccagaaggtgtgcttctacaaggcccgggccgccctggtgaagagccgggacatgcactggagcctgctggcccagaggggccagagagatgtgtccctgagcagcctgaggatgctgattgtggctgatggagccaacccctggagcatcagcagctgtgatgccttcctgaatgtgttccagagccggggcctgcggcctgaggtgatctgcccctgtgccagcagccctgaggccctgactgtggccatcagaagacctccagacctgggcggccccccacccaggaaggctgtgctgtccatgaatggcctgtcctatggagtcatccgggtggacacagaggagaagctgtctgtgctgactgtgcaggatgtgggccaggtgatgcctggggccaacgtgtgtgtggtgaagctggagggcaccccctacctgtgcaagacagatgaggtgggggagatctgtgtgagcagcagcgccaccggcacagcctactacggcctgctgggcatcaccaagaatgtgtttgaagctgtgcctgtgaccaccggcggggcccccatctttgaccggcccttcaccaggacaggcctgctgggcttcatcggccctgacaacctggtgttcatcgtgggcaagctggatggcctgatggtgactggagtgcggcggcacaatgctgatgatgtggtggccacagccctggccgtggagcccatgaagtttgtgtaccggggccgctag

SEQ ID NO: 15384 - DNA, 1515 bp, Artificial Sequence
  Description of Artificial Sequence: Synthetic coding sequence
atggagaggagccagtgtggcagccgggaccggggcgtgtctggccggccccacctggcccctggcctggtggtggccgcccctcctccacccagccctgccctgcctgtgcccagcggcatgcaggtgcccccagccttcctgcggccccccagcctcttcctgcgggctgctgctgctgctgctgctgctgctgctgccaccagcggcagcggcggctgccccccagcccctggcctggagagcggcgtgggcgctgtgggctgcggctaccccaggacccccaagtgtgcccgctgcagaaatcatggagtggtgtctgccctgaagggccacaagcgcttctgccgctggagggactgtgcctgtgccaagtgcaccctgattgctgagcggcagagggtgatggccgcccaggtggccctgcggcggcagcaggcccaggaggagagcgaggcccggggcctgcagaggctgctgtgcagcggcctgtcctggcccccaggcggccgggccagcggcggcggcggccgggcagagaacccccagagcactggaggccctgctgctggggccgccctgggcctgggcgccctgcggcaggccagcggcagcgccaccccagcctttgaggtgttccagcaggactacccagaggagaagcaggagcagaaggagagcaaatgtgagagctgccagaatggccaggaggagctgatcagcaagagccaccagctgtacctgggcagcagcagccgcagcaatggagtcatcggcaagcagagcatcggcagcagcatcagcgagtacagcaacaagccagacagcatcctgagcccccaccctggagagcagagcggcggggaggagagccccaggagcctgagcagcagtgacctggagagcggaaatgaaagtgagtgggtgaaggacctgacagccaccaaggccagcctgcccaccgtgagcagccggccccgggaccccctggacatcctgaccaagatcttccccaactacagaagaagccggctggagggcatcctgcgcttctgcaagggagatgtggtgcaggccatcgagcaggtgctgaatggcaaggagcacaagccagacaacagaaacctggccaacagcgaggagctggagaacacagccttccagagggccagcagcttcagcctggccggcatcggcttcggcaccctgggcaacaagagcgccttcagccccctgcagaccaccagcgccagctatggaggagacagcagcctgtatggagtgaacccccgggtgggcatcagccccctgcggctggcctacagcagcgctggccggggcctgagcggcttcatgagcccctacctgaccccaggcctggtgcccaccctgcccttccggcctgccctggactatgccttcagcggcatgatccgggacagcagctacctgagcagcaaggacagcatcacctgtggccgcctgtacttccggcccaaccaggacaacccctag

SEQ ID NO: 15385 - DNA, 1629 bp, Artificial Sequence
  Description of Artificial Sequence: Synthetic coding sequence
atggagctgcggtctgagctgcccagcgtgcctggagctgccacagctgctgctgccacagccaccggcccccctgtggcctctgtggcctctgtggccgctgctgctgctgctgctgccagcctgcctgtgtctgtggccggcggcctgctgcggggcccccccctgctgctgcgggctgctgagaagtaccccaggacccccaagtgtgcccgctgcaggaaccacggcgtggtgtctgccctgaagggccacaagcgctactgccgctggaaggactgcctgtgtgccaagtgcaccctgattgctgagcggcagagggtgatggccgcccaggtggccctgcggcggcagcaggcccaggaggagaatgaggcccgggagctgcagctgctgtatggaacagctgagggcctggccctggccgccgccaacggcatcatcccccccaggcctgcctatgaggtgtttggatctgtgtgtgccgcagatggcggcggccctggggccggggccccagctggcaccggcggcggcgctgctggagctgggggcagcgaggccaagctgcagaagtttgacctcttccccaagaccctgctgcaggccggccggcccggcagccccctgcccccacctgtgaagcccctgagcccagatggagctgacagcggccctggcaccagcagccctgaggtgcggcccggcagcggctctgaaaatggagatggagagagcttcagcggcagccccctggcccgggccagcaaggaggccggcggcagctgccccggcagcgctggccctgggggcggcggggaggaggacagccctggcagcgccagccccctgggcagcgagagcggcagcgaggccgacaaggaggagggggaggccgccccagcccctggcctgggcggcggcagcggcccccggcagaggacccccctggacatcctgaccagggtcttccctggccaccggcggggcgtgctggagctggtgctgcagggctgtggaggagatgtggtgcaggccatcgagcaggtgctgaaccaccaccggggcggcctggccgccggcctgggccctgctgcccccccagacaaggctgctgtgggcgctgctgctgctgctgatgatgcctggcccagccgggtggatgctgctgctgctgctgctgctgctgctgggggccctggcctgcctgcccccctgcaggccggccctgctgccccaccccaccaccggcccctgctggccggggccatggcccctggggccctgggcagcctgagcagccgcagcgccttcagccccctgcagcccaatgccagccactttggagcagatgctggggcctaccccctgggcgcccccctgggcctgagccccctgcggctggcctacagcgctgctgctgcccacagccggggcctggccttcatggccccctacagcacagctggcctggtgcccaccctgggcttccggccccccatggactatgccttcagtgacctgatgagggacagatctgctgctgctgctgctgctgtgcacaaggagcccacctacggcggcggcctgtatggccccatggtgaatggagcccctgagaagcagtag

SEQ ID NO: 15386 - DNA, 1629 bp, Artificial Sequence; identical to SEQ ID NO: 15385
  Description of Artificial Sequence: Synthetic coding sequence

SEQ ID NO: 15387 - DNA, 1029 bp, Artificial Sequence
  Description of Artificial Sequence: Synthetic coding sequence
atggctgacaagatggtgaggacccccaagtgcagccgctgcagaaatcatggcttcctggtgcctgtgaagggccatgctggaaaatgtcgctggaagcagtgcctgtgtgagaagtgctacctgatcagcgagcggcagaagatcatggccgcccagaaggtgctgaagacccaggccgctgaggaggagcaggaggccgccctgtgtgcccagggccccaagcaggccagcggggctgctgctgctgccccagcccctgtgcctgtgcctgctgccagcctgcggcccctgagccctggcacccccagcggagatgctgaccccggccctgagggccgggccgccgcctgcttctttgagcagcccccccggggcagaaatcctggcccccgggccctgcagcctgtgctgggcggccgcagccacgtggagcccagcgagagagctgctgtggccatgcccagcctggccggccccccatttggagctgaggccgccggcagcggctacccaggccccctggacctgcggcggcccatgaggacagtgcccggccccctcttcacagactttgtgcggcccctgaacatcaacccagaccgggccctgggccctgagtacccaggcggcagctccatgcacccctactgccccttccccctgggctacctggatgcccctcctggggtgcccctgcagcagggcttcagacatgtgagccgcagccagtaccagggcggcggcctggtgtctgagcccggcggggacttccagcccagctactacctgcccccacctcctccacccctgccccccctgccccccctgcccccccagccccagttcctgcccccaggctacctgagcgccctgcacttcctgcccccacctcctcctcctcctccacccagcagcttcagcctgactgtgctgtttgacacagacaaggagaacacagatgaccaggatgctgaggtgctgtctggagagcccagccagcccagcagccaggagcagagcgactag

SEQ ID NO: 15388 - DNA, 432 bp, Artificial Sequence
  Description of Artificial Sequence: Synthetic coding sequence
atgcccagcctggccggccccccatttggagctgaggccgccggcagcggctacccaggccccctggacctgcggcggcccatgaggacagtgcccggccccctcttcacagactttgtgcggcccctgaacatcaacccagaccgggccctgggccctgagtacccaggcggcagctccatgcacccctactgccccttccccctgggctacctggatgcccctcctggggtgcccctgcagcagggcttccgccacgtgagccgcagccagtaccagggcggcggcctggtgtctgagcctggaggagacttccagcccagctactacctgcccccacctcctccacccctgccccccctgccccccctgcccccaccagccacagccaccaccaccagcatcatcttcctgacagacaggcctgtgtag

SEQ ID NO: 15389 - DNA, 1104 bp, Artificial Sequence
  Description of Artificial Sequence: Synthetic coding sequence
atggagcccagcgacatgcctgctggctaccactgccccctggacagcgccccctgggatgagacccgggacccccagagcacagagctgatcccccggcgggccatcagccgcagccccacctgtgcccgctgcaggaaccacggcgtgacagcccacctgaagggccacaagaggctgtgcctcttccaggcctgtgagtgccacaagtgtgtgctgatcctggagcggcggcgggtgatggccgcccaggtggccctgcggcggcagcaggaggcccagctgaagaagcacctgatgagaagaggagaggccagccccaaggcccccaaccacttcaggaagggcaccacccagccccaggtgcccagcggcaaggaaaatattgccccccagccccagacccctcatggagctgtgctgctggcccccaccccacctgggaagaacagctgtggccccctgctgctgagccaccccccagaggccagccccctgtcctggacccctgtgcccccaggcccctgggtgcccggccactggctgcccccaggcttctccatgcctcctcctgtggtgtgccgcctgctgtaccaggagcctgctgtgtccctgccccccttccctggctttgatcctggcaccagcctgcagctgcccacccacggccccttcaccacctgccccggcagccaccctgtgctgacagcccccctgagcggggagccccagggcccccccagccagcccaggacccacagcaccctcatcctgcagccctgtggcaccccagaccccctgcagctgcagccccaggccagcggggccagctgcctggcccggaccagcggccccagcgagtggcagctgcagcaggaggccgctgaggccctggtgggcctgaaggacagcagccaggccccccgggtgaccccatctgtgccccccaacccagcctggatcagcctgctgcacccctgtggccccccagccccagctgggggccggggcttccagcctgtgggcccctgcctgcggcccagccctgcccccagcgtggccctgcacatcggccgcctgggcagcatcagcctgctgtcctag

SEQ ID NO: 15390 - DNA, 1404 bp, Artificial Sequence
  Description of Artificial Sequence: Synthetic coding sequence
atggccactggagcagatgtgcgggacatcctggagctgggcggcccagaaggagatgctgccagcggcaccatcagcaagaaggacatcatcaacccagacaagaagaagagcaagaagagcagcgagaccctgaccttcaagaggcctgagggcatgcaccgggaggtgtatgccctgctgtacagcgacaagaaggatgccccacccctgctgcccagcgacaccggccagggctacagaacagtgaaggccaagctgggcagcaagaaggtgcggccctggaagtggatgcccttcaccaacccagccaggaaggatggagccatgttcttccactggaggagagctgctgaggagggcaaggactacccctttgcccgcttcaacaagacagtgcaggtgcctgtgtacagcgagcaggagtaccagctgtacctgcatgatgatgcctggaccaaggccgagacagaccacctgtttgacctgagcagaagatttgacctgcgctttgtggtgattcatgacagatatgaccaccagcagttcaagaagaggtctgtggaggacctgaaggagcgctactaccacatctgtgccaagctggccaacgtgcgggctgtgcctggaacagacctgaagatccctgtgtttgatgctggccacgagaggaggaggaaggagcagctggagcggctgtacaacagaacacctgagcaggtggccgaggaggagtacctgctgcaggagctgaggaagattgaggccaggaagaaggagcgggagaagaggagccaggacctgcagaagctgatcacagctgctgacaccacagctgagcagaggagaacagagaggaaggcccccaagaagaagctgccccagaagaaggaggccgagaagccagctgtgcctgagacagctggcatcaagttcccagacttcaagtctgctggggtgaccctgcggagccagaggatgaagctgcccagctctgtgggccagaagaagatcaaggccctggagcagatgctgctggagctgggcgtggagctgagccccacccccacagaggagctggtgcacatgtttaatgagctgcggagtgacctggtgctgctgtatgagctgaagcaggcctgtgccaactgtgaatatgagctgcagatgctgcggcacagacatgaggccctggcccgggccggcgtgctgggcggccctgccaccccagccagcggccctggccctgccagcgctgagcctgctgtgacagagcccggcctgggccctgaccccaaggacaccatcattgatgtggtgggcgcccccctgacccccaacagcaggaagagaagagagagcgccagcagcagcagctctgtgaagaaggccaagaagccctag

SEQ ID NO: 15391 - DNA, 1404 bp, Artificial Sequence; identical to SEQ ID NO: 15390
  Description of Artificial Sequence: Synthetic coding sequence

SEQ ID NO: 15392 - DNA, 858 bp, Artificial Sequence
  Description of Artificial Sequence: Synthetic coding sequence
atggccactggagcagatgtgcgggacatcctggagctgggcggcccagaaggagatgctgccagcggcaccatcagcaagaaggacatcatcaacccagacaagaagaagagcaagaagagcagcgagaccctgaccttcaagaggcctgagggcatgcaccgggaggtgtatgccctgctgtacagcgacaagaacaagggcagctgcctgctgagcaggatgcaggaggacctgaagagctttgcccctggccatgacttcctggccatcggagatgccccacccctgctgcccagcgacaccggccagggctacagaacagtgaaggccaagctgggcagcaagaaggtgcggccctggaagtggatgcccttcaccaacccagccaggaaggatggagccatgttcttccactggaggagagctgctgaggagggcaaggactacccctttgcccgcttcaacaagacagtgcaggtgcctgtgtacagcgagcaggagtaccagctgtacctgcatgatgatgcctggaccaaggccgagacagaccacctgtttgacctgagcagaagatttgacctgcgctttgtggtgattcatgacagatatgaccaccagcagttcaagaagaggtctgtggaggacctgaaggagcgctactaccacatctgtgccaagctggccaacgtgcgggctgtgcctggaacagacctgaagatccctgtgtttgatgctggccacgagaggaggaggaaggagcagctggagcggctgtacaacagaacacctgagcaggtggccgaggaggagtacctgctgcaggagctgaggaagattgaggccaggaagaagtag

SEQ ID NO: 15393 - DNA, 1404 bp, Artificial Sequence; identical to SEQ ID NO: 15390
  Description of Artificial Sequence: Synthetic coding sequence

SEQ ID NO: 15394 - DNA, 399 bp, Artificial Sequence
  Description of Artificial Sequence: Synthetic coding sequence
atcatcaacccagacaagaagaagagcaagaagagcagcgagaccctgaccttcaagaggcctgagggcatgcaccgggaggtgtatgccctgctgtacagcgacaagaaggatgccccacccctgctgcccagcgacaccggccagggctacagaacagtgaaggccaagctgggcagcaagaaggtgcggccctggaagtggatgcccttcaccaacccagccaggaaggatggagccatgttcttccactggaggagagctgctgaggagggcaaggactacccctttgcccgcttcaacaaggagtaccagctgtacctgcatgatgatgcctggaccaaggccgagacagaccacctgtttgacctgagccgccgctttgacctgcgcttctag

SEQ ID NO: 15395 - DNA, 456 bp, Artificial Sequence
  Description of Artificial Sequence: Synthetic coding sequence
atggccactggagcagatgtgcgggacatcctggagctgggcggcccagaaggagatgctgccagcggcaccatcagcaagaaggacatcatcaacccagacaagaagaagagcaagaagagcagcgagaccctgaccttcaagaggcctgagggcatgcaccgggaggtgtatgccctgctgtacagcgacaagaacaagggcagctgcctgctgagcaggatgcaggaggacctgaagagctttgcccctggccatgacttcctggccatcggagatgccccacccctgctgcccagcgacaccggccagggctacagaacagtgaaggccaagctgggcagcaagaaggtgcggccctggaagtggatgcccttcaccaacccagccaggaaggatggagccatgttcttccactggaggagagctgctgaggagggcaaggactacccctag

SEQ ID NO: 15396 - DNA, 858 bp, Artificial Sequence; identical to SEQ ID NO: 15392
  Description of Artificial Sequence: Synthetic coding sequence

SEQ ID NO: 15397 - DNA, 714 bp, Artificial Sequence
  Description of Artificial Sequence: Synthetic coding sequence
atggccactggagcagatgtgcgggacatcctggagctgggcggcccagaaggagatgctgccagcggcaccatcagcaagaaggacatcatcaacccagacaagaagaagagcaagaagagcagcgagaccctgaccttcaagaggcctgagggcatgcaccgggaggtgtatgccctgctgtacagcgacaagaaggatgccccacccctgctgcccagcgacaccggccagggctacagaacagtgaaggccaagctgggcagcaagaaggtgcggccctggaagtggatgcccttcaccaacccagccaggaaggatggagccatgttcttccactggaggagagctgctgaggagggcaaggactacccctttgcccgcttcaacaagacagtgcaggtgcctgtgtacagcgagcaggagtaccagctgtacctgcatgatgatgcctggaccaaggccgagacagaccacctgtttgacctgagcagaagatttgacctgcgctttgtggtgattcatgacagatatgaccaccagcagttcaagaagaggtctgtggaggacctgaaggagcgctactaccacatctgtgccaagctggccaacgtgcgggctgtgcctggaacagacctgaagatccctgtgtttgatgctggccacgagaggaggaggaaggagcagctggagcggctgtacaacagaacatag

SEQ ID NO: 15398 - DNA, 909 bp, Artificial Sequence
  Description of Artificial Sequence: Synthetic coding sequence
atggccactggagcagatgtgcgggacatcctggagctgggcggcccagaaggagatgctgccagcggcaccatcagcaagaaggacatcatcaacccagacaagaagaagagcaagaagagcagcgagaccctgaccttcaagaggcctgagggcatgcaccgggaggtgtatgccctgctgtacagcgacaagaaggatgccccacccctgctgcccagcgacaccggccagggctacagaacagtgaaggccaagctgggcagcaagaaggtgcggccctggaagtggatgcccttcaccaacccagccaggaaggatggagccatgttcttccactggaggagagctgctgaggagggcaaggactacccctttgcccgcttcaacaagacagtgcaggtgcctgtgtacagcgagcaggagtaccagctgtacctgcatgatgatgcctggaccaaggccgagacagaccacctgtttgacctgagcagaagatttgacctgcgctttgtggtgattcatgacagatatgaccaccagcagttcaagaagaggtctgtggaggacctgaaggagcgctactaccacatctgtgccaagctggccaacgtgcgggctgtgcctggaacagacctgaagatccctgtgtttgatgctggccacgagaggaggaggaaggagcagctggagcggctgtacaacagaacacctgagcaggtggccgaggaggagtacctgctgcaggagctgaggaagattgaggccaggaagaaggagcgggagaagaggagccaggacctgcagaagctgatcacagctgctgacaccacagctgagcagaggagaacagagaggaaggcccccaagaagaagctgccccagaagaaggaggccgagaagccctag

SEQ ID NO: 15399 - DNA, 762 bp, Artificial Sequence
  Description of Artificial Sequence: Synthetic coding sequence
atggccgccagcggggagagcggcaccagcggcggcggcggcagcacagaggaggccttcatgaccttctacagcgaggtgaagcagatcgagaagagggacagcgtgctgaccagcaagaaccagatcgagcggctgaccaggcctggcagcagctacttcaacctgaacccctttgaggtgctgcagattgatcctgaggtgacagatgaggagatcaagaagcgcttccggcagctgagcatcctggtgcacccagacaagaaccaggatgatgctgaccgggcccagaaggcctttgaggccgtggacaaggcctacaagctgctgctggaccaggagcagaagaagagggccctggatgtgatccaggccggcaaggagtatgtggagcacacagtgaaggagaggaagaagcagctgaagaaggagggcaagcccaccatcgtggaggaggatgatcctgagctgttcaagcaggccgtgtacaagcagaccatgaagctgtttgctgagctggagatcaagaggaaggagcgggaggccaaggagatgcatgagaggaagaggcagcgggaggaggagattgaggcccaggagaaggccaagcgggagcgggagtggcagaagaactttgaggagagcagagatggccgggtggacagctggaggaacttccaggccaacaccaagggcaagaaggagaagaagaacagaaccttcctgcggccccccaaggtgaagatggagcagcgggagtag

SEQ ID NO: 15400 - DNA, 1458 bp, Artificial Sequence
  Description of Artificial Sequence: Synthetic coding sequence
atgaagggctggagcctgcctgcctgtggccccctgcagggccgcctggccggctggctggccgtgcgggccggcctgctggccgccccagctgctgtgcacagccctgctgaggtgcacggcagccccccagccagcctgtgcccccggcccagcgtgaagttccggcccggcctgacagccatggccctgcccacccccagcgacagcaccctgcctgctgaggcccggggccggggcagaagaagaaggctggtgtggacccccagccagagcgaggccctgcgggcctgctttgaaagaaacccctacccaggcatcgccacccgggagcggctggcccaggccatcggcatccctgagccccgggtgcagatctggttccagaatgaaagaagccggcagctgcggcagcaccggcgggagagccggccctggccaggaagaagaggccccccagagggccgcaggaagaggacagctgtgacaggcagccagacagccctgctgctgcgggcctttgagaaggaccgcttccctggcattgctgcccgggaggagctggcccgggagaccggcctgcctgagagccgcatccagatctggttccagaacagaagagcccggcaccctggccagggcggccgggccccagcccaggccggcggcctgtgcagcgctgcccctgggggcggccacccagcccccagctgggtggcctttgcccacactggagcctggggcaccggcctgcctgcccctcatgtgccctgtgcccctggggccctgccccagggcgcctttgtgtcccaggccgcccgggccgccccagccctgcagcccagccaggccgccccagctgagggcgtgtcccagcctgccccagcccggggggactttgcctatgctgccccagcccccccagatggagccctgagccacccccaggccccccgctggccaccccaccctgggaagagcagagaagatcgggacccccagagagatggcctgcccggcccctgtgctgtggcccagcccggccctgcccaggccggcccccagggccagggcgtgctggccccacccaccagccagggcagcccctggtggggctggggccggggcccccaggtggccggggccgcctgggagccccaggccggggccgcccccccaccccagcctgcccccccagatgccagcgccagcgcccggcagggccagatgcagggcatcccagcccccagccaggccctgcaggagcccgccccctggagcgccctgccctgtggcctgctgctggatgagctgctggccagccctgagttcctgcagcaggcccagcccctgctggagacagaggcccctggagagctggaggccagcgaggaggccgccagcctggaggcccccctgtctgaggaggagtaccgggccctgctggaggagctgtag

SEQ ID NO: 15401 - DNA, 1275 bp, Artificial Sequence
  Description of Artificial Sequence: Synthetic coding sequence
atggccctgcccacccccagcgacagcaccctgcctgctgaggcccggggccggggcagaagaagaaggctggtgtggacccccagccagagcgaggccctgcgggcctgctttgagaggaacccctacccaggcatcgccacccgggagcggctggcccaggccatcggcatccctgagccccgggtgcagatctggttccagaatgaaagaagccggcagctgcggcagcacagaagagagagccggccctggccaggccggcggggccccccagagggccgcaggaagaggacagctgtgacaggcagccagacagccctgctgctgcgggcctttgagaaggaccgcttccctggcattgctgcccgggaggagctggcccgggagaccggcctgcctgagagccgcatccagatctggttccagaacagaagagcccggcaccctggccagggcggccgggccccagcccaggccggcggcctgtgcagcgctgcccctgggggcggccacccagcccccagctgggtggcctttgcccacactggagcctggggcaccggcctgcctgccccccacgtgccctgtgcccctggggccctgccccagggcgcctttgtgtcccaggccgcccgggccgccccagccctgcagcccagccaggccgccccagctgagggcgtgtcccagcctgccccagcccggggggactttgcctatgctgccccagcccccccagatggagccctgagccacccccaggccccccgctggccaccccaccctgggaagagccgggaggaccgggacccccagagagatggcctgcccggcccctgtgctgtggcccagcccggccctgcccaggccggcccccagggccagggcgtgctggccccacccaccagccagggcagcccctggtggggctggggccggggcccccaggtggccggggccgcctgggagccccaggccggggccgcccccccaccccagcctgcccccccagatgccagcgccagcgcccggcagggccagatgcagggcatcccagcccccagccaggccctgcaggagcccgccccctggagcgccctgccctgtggcctgctgctggatgagctgctggccagccctgagttcctgcagcaggcccagcccctgctggagacagaggcccctggagagctggaggccagcgaggaggccgccagcctggaggcccccctgtctgaggaggagtaccgggccctgctggaggagctgtag

SEQ ID NO: 15402 - DNA, 1458 bp, Artificial Sequence; identical to SEQ ID NO: 15400
  Description of Artificial Sequence: Synthetic coding sequence

SEQ ID NO: 15403 - DNA, 1275 bp, Artificial Sequence; identical to SEQ ID NO: 15401
  Description of Artificial Sequence: Synthetic coding sequence

SEQ ID NO: 15404 - DNA, 1452 bp, Artificial Sequence
  Description of Artificial Sequence: Synthetic coding sequence
atgaagggctggagcctgcctgcctgtggccccctgcagggccgcctggccggctggctggccgtgcgggccggcctgctggccgccccagctgctgtgcacagccctgctgaggtgcacggcagccccccagccagcctgtgcccccggcccagcgtgaagttccggcccggcctgacagccatggccctgcccacccccagcgacagcaccctgcctgctgaggcccggggccggggcagaagaagaaggctggtgtggacccccagccagagcgaggccctgcgggcctgctttgaaagaaacccctacccaggcatcgccacccgggagcggctggcccaggccatcggcatccctgagccccgggtgcagatctggttccagaatgaaagaagccggcagctgcggcagcaccggcgggagagccggccctggccaggaagaagaggccccccagagggccgcaggaagaggacagctgtgacaggcagccagacagccctgctgctgcgggcctttgagaaggaccgcttccctggcattgctgcccgggaggagctggcccgggagaccggcctgcctgagagccgcatccagatctggttccagaacagaagagcccggcaccctggccagggcggccgggccccagcccaggccggcggcctgtgcagcgctgcccctgggggcggccacccagcccccagctgggtggcctttgcccacactggagcctggggcaccggcctgcctgcccctcatgtgccctgtgcccctggggccctgccccagggcgcctttgtgtcccaggccgcccgggccgccccagccctgcagcccagccaggccgccccagctgagggcgtgtcccagcctgccccagcccggggggactttgcctatgctgccccagcccccccagatggagccctgagccacccccaggccccccgctggccaccccaccctgggaagagcagagaagatcgggacccccagagagatggcctgcccggcccctgtgctgtggcccagcccggccctgcccaggccggcccccagggccagggcgtgctggccccacccaccagccagggcagcccctggtggggctggggccggggcccccaggtggccggggccgcctgggagccccaggccggggaggcccccccaccccagcctgcccccccagatgccagcgcccggcagggccagatgcagggcatcccagcccccagccaggccctgcaggagcccgccccctggagcgccctgccctgtggcctgctgctggatgagctgctggccagccctgagttcctgcagcaggcccagcccctgctggagacagaggcccctggagagctggaggccagcgaggaggccgccagcctggaggcccccctgtctgaggaggagtaccgggccctgctggaggagctgtag

SEQ ID NO: 15405 - DNA, 1269 bp, Artificial Sequence
  Description of Artificial Sequence: Synthetic coding sequence
atggccctgcccacccccagcgacagcaccctgcctgctgaggcccggggccggggcagaagaagaaggctggtgtggacccccagccagagcgaggccctgcgggcctgctttgagaggaacccctacccaggcatcgccacccgggagcggctggcccaggccatcggcatccctgagccccgggtgcagatctggttccagaatgaaagaagccggcagctgcggcagcacagaagagagagccggccctggccaggccggcggggccccccagagggccgcaggaagaggacagctgtgacaggcagccagacagccctgctgctgcgggcctttgagaaggaccgcttccctggcattgctgcccgggaggagctggcccgggagaccggcctgcctgagagccgcatccagatctggttccagaacagaagagcccggcaccctggccagggcggccgggccccagcccaggccggcggcctgtgcagcgctgcccctgggggcggccacccagcccccagctgggtggcctttgcccacactggagcctggggcaccggcctgcctgccccccacgtgccctgtgcccctggggccctgccccagggcgcctttgtgtcccaggccgcccgggccgccccagccctgcagcccagccaggccgccccagctgagggcgtgtcccagcctgccccagcccggggggactttgcctatgctgccccagcccccccagatggagccctgagccacccccaggccccccgctggccaccccaccctgggaagagccgggaggaccgggacccccagagagatggcctgcccggcccctgtgctgtggcccagcccggccctgcccaggccggcccccagggccagggcgtgctggccccacccaccagccagggcagcccctggtggggctggggccggggcccccaggtggccggggccgcctgggagccccaggccggggaggcccccccaccccagcctgcccccccagatgccagcgcccggcagggccagatgcagggcatcccagcccccagccaggccctgcaggagcccgccccctggagcgccctgccctgtggcctgctgctggatgagctgctggccagccctgagttcctgcagcaggcccagcccctgctggagacagaggcccctggagagctggaggccagcgaggaggccgccagcctggaggcccccctgtctgaggaggagtaccgggccctgctggaggagctgtag

SEQ ID NO: 15406 - DNA, 1458 bp, Artificial Sequence; identical to SEQ ID NO: 15400
  Description of Artificial Sequence: Synthetic coding sequence

SEQ ID NO: 15407 - DNA, 1275 bp, Artificial Sequence; identical to SEQ ID NO: 15401
  Description of Artificial Sequence: Synthetic coding sequence

SEQ ID NO: 15408 - DNA, 1275 bp, Artificial Sequence; identical to SEQ ID NO: 15401
  Description of Artificial Sequence: Synthetic coding sequence

SEQ ID NO: 15409 - DNA, 1458 bp, Artificial Sequence; identical to SEQ ID NO: 15400
  Description of Artificial Sequence: Synthetic coding sequence

SEQ ID NO: 15410 - DNA, 1458 bp, Artificial Sequence; identical to SEQ ID NO: 15400
  Description of Artificial Sequence: Synthetic coding sequence

SEQ ID NO: 15411 - DNA, 1275 bp, Artificial Sequence; identical to SEQ ID NO: 15401
  Description of Artificial Sequence: Synthetic coding sequence

SEQ ID NO: 15412 - DNA, 1275 bp, Artificial Sequence; identical to SEQ ID NO: 15401
  Description of Artificial Sequence: Synthetic coding sequence

SEQ ID NO: 15413 - DNA, 1419 bp, Artificial Sequence
  Description of Artificial Sequence: Synthetic coding sequence
atgaatggctacggcagcccctacctgtacatgggcggccctgtgtcccagcccccccgggcccccctgcagaggacccccaagtgtgcccgctgcagaaatcatggagtgctgtcctggctgaagggccacaagcgctactgccgcttcaaggactgcacctgtgagaagtgcatcctgatcatcgagcggcagagggtgatggccgcccaggtggccctgcggcggcagcaggccaatgaaagcctggagagcctcatcccagacagcctgcgggccctgcccggccccccacctcctggagatgctgtggccgccccccagcccccaccagccagccagcccagccagccccagccccccaggcctgctgctgagctggccgctgctgctgccctgcgctggacagctgagccccagcccggggccctgcaggcccagctggccaagccagacctgacagaggagcggctgggagatggcaagtctgctgacaacacagaggtgttcagtgacaaggacacagaccagaggagcagcccagatgtggccaagagcaagggctgcttcaccccagagagccctgagatcgtgtctgtggaggagggcggctatgctgtgcagaagaatggaggcaaccctgagagcaggccagacagccccaagtgccacgccgagcagaaccacctgctgattgagggccccagcggcaccgtgtccctgcccttcagcctgaaggccaaccggccccccctggaggtgctgaagaagatcttccccaaccagaagcccaccgtgctggagctgatcctgaagggctgcggcggggacctggtgtctgctgtggaggtgctgctgagcagccgcagctctgtgactggagctgagaggaccagcgctgagcctgagagcctggccctgcccagcaatggccacatctttgagcacaccctgagcagctaccccatcagcagcagcaagtggagcgtgggcagcgccttccgggtgcctgacaccctgcgcttctctgctgacagcagcaatgtggtgcccagccccctggccggccccctgcagccccccttcccccagcccccacgctaccccctgatgctgaggaacaccctggcccggagccagagcagccccttcctgcccaatgatgtgaccctgtggaacaccatgaccctgcagcagcagtaccagctgcggagccagtatgtgagccccttccccagcaacagcacctctgtgttccgcagcagccctgtgctgcctgcccgggccacagaggacccccgcatcagcatcccagatgatggctgcccctttgtgtccaagcagagcatctacacagaagatgattatgatgagaggagtgacagcagtgacagcaggaccctgaacaccagcagctag

SEQ ID NO: 15414 - DNA, 339 bp, Artificial Sequence
  Description of Artificial Sequence: Synthetic coding sequence
atgcacaccaggaagaggctgacccagctgttctgcttcccagacctgacagaggagcggctgggagatggcaagtctgctgacaacacagaggtgttcagtgacaaggacacagaccagaggagcagcccagatgtggccaagagcaagggctgcttcaccccagagagccctgagatcgtgtctgtggaggagggcggctatgctgtgcagaagaatggaggcaaccctgagagcaggccagacagccccaagtgccacgccgagcagaaccacctgctgattgagggccccagcggcaccgtgtccctgcccttcagcctgaaggccaacagatag

SEQ ID NO: 15415 - DNA, 1701 bp, Artificial Sequence
  Description of Artificial Sequence: Synthetic coding sequence
atggccctgtctgtgcccggctacagccctggcttcaggaagcccccagaggtggtgcggctgcggaggaagagggcccggagcagaggagctgctgccagccccccccgggagctgacagagcctgctgccaggagagctgccctggtggccggcctgcccctgcggcccttccctgctgctgggggccggggcggcggcagcggcggcggccctgctgctgcccggaggaacccctttgcccggctggacaaccggccccgggtggccgctgagcccccagatggccctgcccgggagcagcctgaggcccctgtgcccttcctggacagcaaccaggagaatgacctgctgtgggaggagaagtttcctgagaggaccaccgtgacagagctgccccagaccagccacgtgtccttcagcgagccagacatccccagcagcaagagcacagagctgcctgtggactggagcatcaagacccggctgctcttcaccagcagccagcccttcacctgggccgaccacctgaaggcccaggaggaggcccagggcctggtgcagcactgccgggccacagaggtgaccctgcccaagagcatccaggaccccaagctgagcagcgagctgcgctgcaccttccagcagagcctcatctactggctgcacccagccctgtcctggctgcccctcttccccagaattggagctgacaggaagatggccggcaagaccagcccctggagcaatgatgccaccctgcagcacgtgctgatgtctgactggagcgtgtccttcaccagcctgtacaacctgctgaagaccaagctgtgcccctacttctacgtgtgcacctaccagttcaccgtgctcttccgggctgctggcctggccggcagtgacctgatcacagccctgatcagccccaccacccggggcctgcgggaggccatgagaaatgaaggaattgagttcagcctgcccctcatcaaggagagcggccacaagaaggagacagccagcggcaccagcctgggctatggagaggagcaggccatcagtgatgaagatgaggaggagagcttctcctggctggaggagatgggcgtgcaggacaagatcaagaagccagacatcctgagcatcaagctgaggaaggagaagcatgaggtgcagatggaccacaggcctgagagcgtggtgctggtgaagggcatcaacaccttcaccctgctgaacttcctgatcaacagcaagagcctggtggccaccagcggcccccaggccggcctgccccccaccctgctgagccctgtggccttccggggggccaccatgcagatgctgaaggcccggtctgtgaatgtgaagacccaggccctgagcggctacagagaccagttcagcctggagatcaccggccccatcatgccccacagcctgcacagcctgaccatgctgctgaagagcagccagagcggcagcttctctgctgtgctgtacccccatgagcccacagctgtgttcaacatctgcctgcagatggacaaggtgctggacatggaggtggtgcacaaggagctgaccaactgtggcctgcaccccaacaccctggagcagctgagccagatccccctgctgggcaagagcagcctgagaaatgtggtgctgcgggactacatctacaactggaggagctag

SEQ ID NO: 15416 - DNA, 618 bp, Artificial Sequence
  Description of Artificial Sequence: Synthetic coding sequence
atgcccagcaagaagaagaagtacaatgcccgcttccccccagcccgcatcaagaagatcatgcagacagatgaggagatcggcaaggtggccgctgctgtgcctgtgatcatcagccgggccctggagctgttcctggagagcctgctgaagaaggcctgccaggtgacccagagcagaaatgccaagaccatgaccaccagccacctgaagcagtgcatcgagctggagcagcagtttgacttcctgaaggacctggtggcctctgtgcctgacatgcagggagatggagaggacaaccacatggatggagacaagggggcccggcggggcaggaagccaggcagcggcggcaggaagaatggaggcatgggcaccaagagcaaggacaagaagctgagcggcacagacagcgagcaggaggatgaaagtgaggacacagacacagatggagaggaggagaccagccagcccccaccccaggccagccaccccagcgcccacttccagagcccccccacccccttcctgccctttgccagcaccctgcccctgcccccagcccctcctggccccagcgccccagatgaggaggatgaagaagattatgacagctag

SEQ ID NO: 15417 - DNA, 750 bp, Artificial Sequence
  Description of Artificial Sequence: Synthetic coding sequence
atgaaccccagccccagcaagatccgcatcaacctggaggacaacgtgcagtatgtgtccatgaggaaggccctgaaggtgaagaggcccaggtttgatgtgtccctggtgtacctgaccaggaagttcatggacctggtgcgcagcgcccctgggggcatcctggacctgaacaaggtggccaccaagctgggcgtgaggaagagaagagtgtatgacatcaccaacgtgctggatggcatcgacctggtggagaagaagagcaagaaccacatccgctggattggaagtgacctgagcaactttggagctgtgccccagcagaagaagctgcaggaggagctgagtgacctgagcgccatggaggatgccctggatgagctgatcaaggactgtgcccagcagctgtttgagctgacagatgacaaggaaaatgaaaggctggcctacgtgacctaccaggacatccacagcatccaggccttccacgagcagatcgtgattgctgtgaaggccccagctgagacccggctggatgtgcctgcccccagagaagattccatcaccgtgcacatccgcagcaccaacggccccattgatgtgtacctgtgtgaggtggagcagggccagaccagcaacaagaggtctgagggcgtgggcaccagcagcagcgagagcacccaccctgagggccctgaggaggaggagaacccccagcagagcgaggagctgctggaggtgagcaactag

SEQ ID NO: 15418 - DNA, 402 bp, Artificial Sequence
  Description of Artificial Sequence: Synthetic coding sequence
atgagccagcagaggcctgccaggaagctgcccagcctgctgctggaccccacagaggagaccgtgagaagacgctgccgggaccccatcaacgtggagggcctgctgcccagcaagatccgcatcaacctggaggacaacgtgcagtatgtgtccatgaggaaggccctgaaggtgaagaggcccaggtttgatgtgtccctggtgtacctgaccaggaagttcatggacctggtgcgcagcgcccctgggggcatcctggacctgaacaaggtggccaccaagctgggcgtgaggaagagaagagtgtatgacatcaccaacgtgctggatggcatcgacctggtggagaagaagagcaagaaccacatccgctggatgaccctgagccagtgcacctag

SEQ ID NO: 15419 - DNA, 846 bp, Artificial Sequence
  Description of Artificial Sequence: Synthetic coding sequence
atgagccagcagaggcctgccaggaagctgcccagcctgctgctggaccccacagaggagaccgtgagaagacgctgccgggaccccatcaacgtggagggcctgctgcccagcaagatccgcatcaacctggaggacaacgtgcagtatgtgtccatgaggaaggccctgaaggtgaagaggcccaggtttgatgtgtccctggtgtacctgaccaggaagttcatggacctggtgcgcagcgcccctgggggcatcctggacctgaacaaggtggccaccaagctgggcgtgaggaagagaagagtgtatgacatcaccaacgtgctggatggcatcgacctggtggagaagaagagcaagaaccacatccgctggattggaagtgacctgagcaactttggagctgtgccccagcagaagaagctgcaggaggagctgagtgacctgagcgccatggaggatgccctggatgagctgatcaaggactgtgcccagcagctgtttgagctgacagatgacaaggaaaatgaaaggctggcctacgtgacctaccaggacatccacagcatccaggccttccacgagcagatcgtgattgctgtgaaggccccagctgagacccggctggatgtgcctgcccccagagaagattccatcaccgtgcacatccgcagcaccaacggccccattgatgtgtacctgtgtgaggtggagcagggccagaccagcaacaagaggtctgagggcgtgggcaccagcagcagcgagagcacccaccctgagggccctgaggaggaggagaacccccagcagagcgaggagctgctggaggtgagcaactag

SEQ ID NO: 15420 - DNA, 621 bp, Artificial Sequence
  Description of Artificial Sequence: Synthetic coding sequence
atggacctggtgcgcagcgcccctgggggcatcctggacctgaacaaggtggccaccaagctgggcgtgaggaagagaagagtgtatgacatcaccaacgtgctggatggcatcgacctggtggagaagaagagcaagaaccacatccgctggattggaagtgacctgagcaactttggagctgtgccccagcagaagaagctgcaggaggagctgagtgacctgagcgccatggaggatgccctggatgagctgatcaaggactgtgcccagcagctgtttgagctgacagatgacaaggaaaatgaaaggctggcctacgtgacctaccaggacatccacagcatccaggccttccacgagcagatcgtgattgctgtgaaggccccagctgagacccggctggatgtgcctgccccccgggaggacagcatcaccgtgcacatccgcagcaccaacggccccattgatgtgtacctgtgtgaggtggagcagggccagaccagcaacaagagaagtgaaggagtgggcaccagcagcagcgagagcacccaccctgagggccctgaggaggaggagaacccccagcagagcgaggagctgctggaggtgagcaactag

SEQ ID NO: 15421 - DNA, 621 bp, Artificial Sequence; identical to SEQ ID NO: 15420
  Description of Artificial Sequence: Synthetic coding sequence

SEQ ID NO: 15422 - DNA, 1860 bp, Artificial Sequence
  Description of Artificial Sequence: Synthetic coding sequence
atggctgctgtggtgcagcagaatgacctggtgtttgaatttgccagcaatgtgatggaggatgagcggcagctgggggaccctgccatcttccctgctgtgattgtggagcacgtgcctggagctgacatcctgaacagctatgccggcctggcctgtgtggaggagcccaatgacatgatcacagagagcagcctggatgtggccgaggaggagatcattgatgatgatgatgatgacatcaccctgactgtggaggccagctgccatgatggagatgagaccatcgagaccattgaagctgctgaggccctgctgaacatggacagccctggccccatgctggatgagaagaggatcaacaacaacatcttcagcagcccagaagatgacatggtggtggcccctgtgacccacgtgtctgtgaccctggatggcatccctgaggtgatggagacccagcaggtgcaggagaagtatgctgacagccctggggccagcagccctgagcagcccaagaggaagaagggcaggaagaccaagccacccaggccagacagccctgccaccacccccaacatctctgtgaagaagaagaacaaggatggcaagggcaacaccatctacctgtgggagttcctgctggccctgctgcaggacaaggccacctgccccaagtacatcaagtggacccagcgggagaagggcatcttcaagctggtggacagcaaggctgtgtcccggctgtggggcaagcacaagaacaagccagacatgaactatgagaccatgggccgggccctgcgctactactaccagaggggcatcctggccaaggtggagggccagaggctggtgtaccagttcaaggagatgcccaaggacctgatctacatcaatgatgaggaccccagcagcagcattgagagcagtgaccccagcctgagcagcagcgccaccagcaacagaaaccagaccagccgcagccgggtgagcagcagccctggggtgaagggcggggccaccaccgtgctgaagccaggcaacagcaaggccgccaagcccaaggaccctgtggaggtggcccagcccagcgaggtgctgaggacagtgcagcccacccagagcccctaccccacccagctgttcagaacagtgcacgtggtgcagcctgtgcaggccgtgcctgagggggaggccgcccggaccagcaccatgcaggatgagaccctgaacagctctgtgcagagcatccgcaccatccaggcccccacccaggtgcctgtggtggtgagccccaggaaccagcagctgcacacagtgaccctgcagacagtgcccctgaccaccgtcatcgccagcacagaccccagcgctggcaccggcagccagaagttcatcctgcaggccatccccagcagccagcccatgacagtgctgaaggaaaatgtgatgctgcagagccagaaggccggcagcccccccagcatcgtgctgggccctgcccaggtgcagcaggtgctgaccagcaatgtgcagaccatctgcaatggaacagtgtctgtggccagcagccccagcttcagcgccacagcccctgtggtgaccttcagccccaggagcagccagctggtggcccaccccccaggcaccgtcatcaccagcgtcatcaagacccaggagaccaagaccctgacccaggaggtggagaagaaggagagcgaggaccacctgaaggagaacacagagaagacagagcagcagccccagccctacgtgatggtggtgagcagcagcaatggcttcaccagccaggtggccatgaagcagaatgagctgctggagcccaacagcttctag

SEQ ID NO: 15423 - DNA, 1086 bp, Artificial Sequence
  Description of Artificial Sequence: Synthetic coding sequence
atgaactatgagaccatgggccgggccctgcgctactactaccagaggggcatcctggccaaggtggagggccagaggctggtgtaccagttcaaggagatgcccaaggacctgatctacatcaatgatgaggaccccagcagcagcattgagagcagtgaccccagcctgagcagcagcgccaccagcaacagaaaccagaccagccgcagccgggtgagcagcagccctggggtgaagggcggggccaccaccgtgctgaagccaggcaacagcaaggccgccaagcccaaggaccctgtggaggtggcccagcccagcgaggtgctgaggacagtgcagcccacccagagcccctaccccacccagctgttcagaacagtgcacgtggtgcagcctgtgcaggccgtgcctgagggggaggccgcccggaccagcaccatgcaggatgagaccctgaacagctctgtgcagagcatccgcaccatccaggcccccacccaggtgcctgtggtggtgagccccaggaaccagcagctgcacacagtgaccctgcagacagtgcccctgaccaccgtcatcgccagcacagaccccagcgctggcaccggcagccagaagttcatcctgcaggccatccccagcagccagcccatgacagtgctgaaggaaaatgtgatgctgcagagccagaaggccggcagcccccccagcatcgtgctgggccctgcccaggtgcagcaggtgctgaccagcaatgtgcagaccatctgcaatggaacagtgtctgtggccagcagccccagcttcagcgccacagcccctgtggtgaccttcagccccaggagcagccagctggtggcccaccccccaggcaccgtcatcaccagcgtcatcaagacccaggagaccaagaccctgacccaggaggtggagaagaaggagagcgaggaccacctgaaggagaacacagagaagacagagcagcagccccagccctacgtgatggtggtgagcagcagcaatggcttcaccagccaggtggccatgaagcagaatgagctgctggagcccaacagcttctag

SEQ ID NO: 15424 - DNA, 75 bp, Artificial Sequence
  Description of Artificial Sequence: Synthetic coding sequence
atggctgctgtggtgcagcagaatgacctggtgtttgaatttgccagcaatgtgatggaggatgagcggcagtag

SEQ ID NO: 15425 - DNA, 1788 bp, Artificial Sequence
  Description of Artificial Sequence: Synthetic coding sequence
atggctgctgtggtgcagcagaatgacctggtgtttgaatttgccagcaatgtgatggaggatgagcggcagctgggggaccctgccatcttccctgctgtgattgtggagcacgtgcctggagctgacatcctgaacagctatgccggcctggcctgtgtggaggagcccaatgacatgatcacagagagcagcctggatgtggccgaggaggagatcattgatgatgatgatgatgacatcaccctgactgtggaggccagctgccatgatggagatgagaccatcgagaccattgaagctgctgaggccctgctgaacatggacagccctggccccatgctggatgagaagaggatcaatggcatccctgaggtgatggagacccagcaggtgcaggagaagtatgctgacagccctggggccagcagccctgagcagcccaagaggaagaagggcaggaagaccaagccacccaggccagacagccctgccaccacccccaacatctctgtgaagaagaagaacaaggatggcaagggcaacaccatctacctgtgggagttcctgctggccctgctgcaggacaaggccacctgccccaagtacatcaagtggacccagcgggagaagggcatcttcaagctggtggacagcaaggctgtgtcccggctgtggggcaagcacaagaacaagccagacatgaactatgagaccatgggccgggccctgcgctactactaccagaggggcatcctggccaaggtggagggccagaggctggtgtaccagttcaaggagatgcccaaggacctgatctacatcaatgatgaggaccccagcagcagcattgagagcagtgaccccagcctgagcagcagcgccaccagcaacagaaaccagaccagccgcagccgggtgagcagcagccctggggtgaagggcggggccaccaccgtgctgaagccaggcaacagcaaggccgccaagcccaaggaccctgtggaggtggcccagcccagcgaggtgctgaggacagtgcagcccacccagagcccctaccccacccagctgttcagaacagtgcacgtggtgcagcctgtgcaggccgtgcctgagggggaggccgcccggaccagcaccatgcaggatgagaccctgaacagctctgtgcagagcatccgcaccatccaggcccccacccaggtgcctgtggtggtgagccccaggaaccagcagctgcacacagtgaccctgcagacagtgcccctgaccaccgtcatcgccagcacagaccccagcgctggcaccggcagccagaagttcatcctgcaggccatccccagcagccagcccatgacagtgctgaaggaaaatgtgatgctgcagagccagaaggccggcagcccccccagcatcgtgctgggccctgcccaggtgcagcaggtgctgaccagcaatgtgcagaccatctgcaatggaacagtgtctgtggccagcagccccagcttcagcgccacagcccctgtggtgaccttcagccccaggagcagccagctggtggcccaccccccaggcaccgtcatcaccagcgtcatcaagacccaggagaccaagaccctgacccaggaggtggagaagaaggagagcgaggaccacctgaaggagaacacagagaagacagagcagcagccccagccctacgtgatggtggtgagcagcagcaatggcttcaccagccaggtggccatgaagcagaatgagctgctggagcccaacagcttctag

SEQ ID NO: 15426 - DNA, 1776 bp, Artificial Sequence
  Description of Artificial Sequence: Synthetic coding sequence
atgtttggcatccaggagagcatccagaggagcggcagctccatgaaggaggagcccctgggcagcggcatgaatgctgtgaggacctggatgcagggcgctggggtgctggatgccaacacagctgcccagagcggcgtgggcctggcccgggcccactttgagaagcagccccccagcaacctgaggaagagcaacttcttccactttgtgctggccctgtatgaccggcagggccagcctgtggagattgaaagaacagcctttgtgggctttgtggagaaggagaaggaggccaacagcgagaagaccaacaacggcatccactaccgcctgcagctgctgtacagcaatggcatcagaacagagcaggacttctacgtgcggctgattgacagcatgaccaagcaggccatcgtgtatgagggccaggacaagaaccctgagatgtgccgggtgctgctgacccatgagatcatgtgcagccgctgctgtgacaagaagagctgtggcaacagaaatgagacccccagcgaccccgtcatcatcgaccgcttcttcctgaagttcttcctgaagtgcaaccagaactgcctgaagaatgccggcaacccccgggacatgaggcgcttccaggtggtggtgtccaccaccgtgaatgtggatggccacgtgctggccgtgtctgacaacatgtttgtgcacaacaacagcaagcacggccggcgggcccggcggctggaccccagcgagggcacccccagctacctggagcacgccaccccctgcatcaaggccatcagccccagcgagggctggaccactggaggagccaccgtcatcatcattggagacaacttctttgatggcctgcaggtgatcttcggcaccatgctggtgtggagcgagctgatcaccccccacgccatccgggtgcagaccccacccaggcacatccctggggtggtggaggtgaccctgagctacaagagcaagcagttctgcaagggcaccccaggccgcttcatctacacagccctgaatgagcccaccatcgactatggcttccagaggctgcagaaggtgatccccaggcaccctggggaccctgagcggctgcccaaggaggtgatcctgaagagagctgctgacctggtggaggccctgtatggcatgccccacaacaaccaggagatcatcctgaagagagctgctgacattgctgaggccctgtacagcgtgcccaggaaccacaaccagctgcctgccctggccaacacctctgtgcatgctggcatgatgggcgtgaacagcttcagcggccagctggccgtgaatgtgtctgaggccagccaggccaccaaccagggcttcaccaggaacagcagctctgtgagcccccacggctacgtgcccagcaccaccccccagcagaccaactacaacagcgtgaccacctccatgaatggctacggcagcgctgccatgagcaacctgggcggcagccccaccttcctgaatggatctgctgccaacagcccctatgccatcgtgcccagcagccccaccatggccagcagcaccagcctgcccagcaactgcagcagcagcagcggcatcttctccttctccccagccaacatggtgtctgctgtgaagcagaagagcgcctttgcccctgtggtgcggccccagaccagccccccacccacctgcaccagcaccaacggcaacagcctgcaggccatcagcggcatgattgtgccccccatgtag

SEQ ID NO: 15427 - DNA, 1776 bp, Artificial Sequence; identical to SEQ ID NO: 15426
  Description of Artificial Sequence: Synthetic coding sequence

SEQ ID NO: 15428 - DNA, 1683 bp, Artificial Sequence
  Description of Artificial Sequence: Synthetic coding sequence
atgtttggcatccaggagagcatccagaggagcggcagctccatgaaggaggagcccctgggcagcggcatgaatgctgtgaggacctggatgcagggcgctggggtgctggatgccaacacagctgcccagagcggcgtgggcctggcccgggcccactttgagaagcagccccccagcaacctgaggaagagcaacttcttccactttgtgctggccctgtatgaccggcagggccagcctgtggagattgaaagaacagcctttgtgggctttgtggagaaggagaaggaggccaacagcgagaagaccaacaacggcatccactaccgcctgcagctgctgtacagcaatggcatcagaacagagcaggacttctacgtgcggctgattgacagcatgaccaagcaggccatcgtgtatgagggccaggacaagaaccctgagatgtgccgggtgctgctgacccatgagatcatgtgccgcttcttcctgaagttcttcctgaagtgcaaccagaactgcctgaagaatgccggcaacccccgggacatgaggcgcttccaggtggtggtgtccaccaccgtgaatgtggatggccacgtgctggccgtgtctgacaacatgtttgtgcacaacaacagcaagcatggaagaagagcccggcggctggaccccagcgaggccaccccctgcatcaaggccatcagccccagcgagggctggaccaccggcggggccaccgtcatcatcatcggggacaacttctttgatggcctgcaggtgatcttcggcaccatgctggtgtggagcgagctgatcacccctcatgccatccgggtgcagaccccacccaggcacatccctggggtggtggaggtgaccctgagctacaagagcaagcagttctgcaagggcaccccaggccgcttcatctacacagccctgaatgagcccaccattgattatggcttccagaggctgcagaaggtgatccccaggcaccctggggaccctgagcggctgcccaaggaggtgatcctgaagagagctgctgacctggtggaggccctgtatggcatgccccacaacaaccaggagatcatcctgaagagagctgctgacattgctgaggccctgtacagcgtgcccaggaaccacaaccagctgcctgccctggccaacacctctgtgcacgccggcatgatgggcgtgaacagcttcagcggccagctggccgtgaatgtgtctgaggccagccaggccaccaaccagggcttcaccaggaacagcagctctgtgagcccccacggctacgtgcccagcaccaccccccagcagaccaactacaacagcgtgaccacctccatgaatggctacggcagcgctgccatgagcaacctgggcggcagccccaccttcctgaatggcagcgctgccaacagcccctatgccatcgtgcccagcagccccaccatggccagcagcaccagcctgcccagcaactgcagcagcagcagcggcatcttctccttcagccctgccaacatggtgtctgctgtgaagcagaagagcgcctttgcccctgtggtgcggccccagaccagccccccacccacctgcaccagcaccaatggaaacagcctgcaggccatcagcggcatgattgtgccccccatgtag

SEQ ID NO: 15429 - DNA, 4506 bp, Artificial Sequence
  Description of Artificial Sequence: Synthetic coding sequence
atgtgcaagatggccatcatcccagactggctgcggagccacccccacaccaggaagttcacccacagccggccccacagcagcccctgccgggtgtacagcagaaatggcagccccaacaagttccgcagcagcagcaccacagctgtggccaaccccaccctgagcagcctggatgtgaagaggatcctcttccagaagatcacagacagaggagatgagctgcagaaggccttccagctgctggacaccggccagaacctgactgtgtccaagtctgagctgcggcgcatcatcacagacttcctgatgcccctgacccgggagcagttccaggatgtgctggcccagatccccctgagcaccagcggcaccgtgccctacctggccttcctgagcagatttggaggcatcgacctgtacatcaatggcatcaagaggggcggcggcaatgagatgaactgctgcaggaccctgcgggagctggagatccaggtgggggagaaggtgttcaagaacatcaagacagtgatgaaggcctttgagctgattgatgtgaacaagacaggcctggtgcggccccaggagctgcggcgggtgctggagaccttctgcatgaagctgagagatgaggagtatgagaagttcagcaagcactacaacatccacaaggacacagctgtggactacaacgtgttcctgaagaacctgagcatcaacaatgacctgaacctgcgctactgcatgggcaaccaggaggtgtccctggagaaccagcaggccaagaacagcaagaaggagcggctgctgggcagcgccagcagcgaggacatctggaggaactacagcctggatgaaattgaaagaaacttctgcctgcagctgagcaagagctatgagaaggtggagaaggccctgtctgctggggacccctgcaagggcggctacgtgtccttcaactacctgaagatcgtgctggacacctttgtgtaccagatcccccggcgcatcttcatccagctgatgaagagatttggcctgaaggccaccaccaagatcaactggaagcagttcctgaccagcttccacgagccccagggcctgcaggtgagcagcaagggccccctgaccaagagaaattccatcaacagcagaaatgaaagccacaaggagaacatcatcaccaagctgttccgccacacagaggaccacagcgccagcctgaagaaggccctgctgatcatcaacaccaagccagatggccccatcacccgggaggagttccgctacatcctgaactgcatggctgtgaagctgagtgacagcgagttcaaggagctgatgcagatgctggaccccggggacaccggggtggtgaacacctccatgtttattgacctgattgaggagaactgcaggatgaggaagaccagcccctgcacagatgccaagacccccttcctgctggcctgggacagcgtggaggagatcgtgcatgacaccatcaccaggaacctgcaggccttctacaacatgctgcggagctatgacctgggggacaccggccgcatcggcaggaacaacttcaagaagatcatgcacgtgttctgccccttcctgaccaatgcccacttcatcaagctgtgcagcaagatccaggacatcggcagcggccgcatcctgtacaagaagctgctggcctgcattggaattgatggcccccccaccgtgtcccctgtgctggtgcccaaggaccagctgctgtctgagcacctgcagaaggatgagcagcagcagcctgacctgtctgagaggaccaagctgacagaggacaagaccaccctgaccaagaagatgaccacagaggaggtgattgagaagttcaagaagtgcatccagcagcaggaccctgccttcaagaagcgcttcctggacttcagcaaggagcccaacgggaagatcaacgtgcatgacttcaagaaggtgctggaggacaccggcatgcccatggatgatgaccagtatgccctgctgaccaccaagattggatttgagaaggagggcatgagctacctggactttgctgctggctttgaagatcctcccatgaggggccctgagaccaccccaccccagccccccacccccagcaagagctatgtgaacagccacttcatcacagctgaggagtgcctgaagctgttcccccggcggctgaaggagagcttccgggacccctacagcgccttcttcaagacagatgctgacagagatggcatcatcaacatgcatgacctgcaccggctgctgctgcacctgctgctgaacctgaaggatgatgaatttgagcgcttcctgggcctgctgggcctgcggctgtctgtgaccctgaacttccgggagttccagaacctgtgtgagaagaggccctggaggacagatgaggccccccagaggctcatccggcccaagcagaaggtggccgacagcgagctggcctgtgagcaggcccaccagtacctggtgaccaaggccaagaaccgctggagcgacctgagcaagaacttcctggagacagacaatgaaggaaatggcatcctgcggcggcgggacatcaagaatgccctgtatggctttgacatccccctgaccccccgggagtttgagaagctgtgggcccgctatgacacagagggcaagggccacatcacctaccaggagttcctgcagaagctgggcatcaactacagccctgctgtgcaccggccctgtgccgaggactacttcaacttcatgggccacttcaccaagccccagcagctgcaggaggagatgaaggagctgcagcagagcacagagaaggctgtggccgcccgggacaagctgatggacagacaccaggacatcagcaaggccttcaccaagacagaccagagcaagaccaactacatcagcatctgcaagatgcaggaggtgctggaggagtgtggctgcagcctgacagaaggagagctgacccacctgctgaacagctggggcgtgtccagacatgacaatgccatcaactacctggacttcctgcgggctgtggagaacagcaagagcactggagcccagcccaaggagaaggaggagagcatgcccatcaactttgccaccctgaacccccaggaggccgtgaggaagatccaggaggtggtggagagcagccagctggccctgagcacagccttcagcgccctggacaaggaggacaccggctttgtgaaggccacagaatttggccaggtgctgaaggacttctgctacaagctgacagacaaccagtaccactacttcctgaggaagctgcgcatccacctgaccccctacatcaactggaagtacttcctgcagaacttcagctgcttcctggaggagacagcagatgagtgggccgagaagatgcccaagggccccccacccaccagccccaaggccacagctgaccgggacatcctggcccggctgcacaaggctgtgaccagccactaccacgccatcacccaggagtttgagaactttgacaccatgaagaccaacaccatcagccgggaggagttccgggccatctgcaacagaagagtgcagatcctgacagatgagcagtttgaccggctgtggaatgagatgcctgtgaatgccaagggccgcctgaagtacccagacttcctgagccgcttcagcagcgagacagctgccacccccatggccaccggggacagcgctgtggcccagaggggcagctctgtgcctgatgtgtctgagggcaccaggtctgccctgagcctgcccacccaggagctgcggcccggcagcaagagccagagccacccctgcaccccagccagcaccaccgtcatccctggcaccccacccctgcagaactgtgaccccatcgagagccggctgaggaagaggatccagggctgctggaggcagctgctgaaggagtgcaaggagaaggatgtggcccggcagggcgacatcaatgccagtgacttcctggccctggtggagaagttcaacctggacatcagcaaggaggagtgccagcagctgatcatcaagtatgacctgaagagcaatggcaagtttgcctactgtgacttcatccagagctgtgtgctgctgctgaaggccaaggagagcagcctgatgcacaggatgaagatccagaatgcccacaagatgaaggaggccggggctgagacccccagcttctacagcgccctgctgcgcatccagcccaagatcgtgcactgctggaggcccatgaggaggaccttcaagagctatgatgaagctggcaccggcctgctgtctgtggccgacttcagaacagtgctgcggcagtacagcatcaacctgtctgaggaggagttcttccacatcctggagtactatgacaagaccctgagcagcaagatctcctacaatgacttcctgcgggccttcctgcagtag

SEQ ID NO: 15430 - DNA, 732 bp, Artificial Sequence
  Description of Artificial Sequence: Synthetic coding sequence
atggtgccccagatcagcagtgacctgctgcagatccccctgagcaccagcggcaccgtgccctacctggccttcctgagcagatttggaggcatcgacctgtacatcaatggcatcaagaggggcggcggcaatgagatgaactgctgcaggaccctgcgggagctggagatccaggtgggggagaaggtgttcaagaacatcaagacagtgatgaaggcctttgagctgattgatgtgaacaagacaggcctggtgcggccccaggagctgcggcgggtgctggagaccttctgcatgaagctgagagatgaggagtatgagaagttcagcaagcactacaacatccacaaggacacagctgtggactacaacgtgttcctgaagaacctgagcatcaacaatgacctgaacctgcgctactgcatgggcaaccaggaggtgtccctggagaaccagcaggccaagaacagcaagaaggagcggctgctgggcagcgccagcagcgaggacatctggaggaactacagcctggatgaaattgaaagaaacttctgcctgcagctgagcaagagctatgagaaggtggagaaggccctgtctgctggggacccctgcaagggcggctacgtgtccttcaactacctgaagatcgtgctggacacctttgtgtaccagatcccccggcgcatcttcatccagctgatgaagaggaaccccatggacagatag

SEQ ID NO: 15431 - DNA, 4050 bp, Artificial Sequence
  Description of Artificial Sequence: Synthetic coding sequence
atgaactgctgcaggaccctgcgggagctggagatccaggtgggggagaaggtgttcaagaacatcaagacagtgatgaaggcctttgagctgattgatgtgaacaagacaggcctggtgcggccccaggagctgcggcgggtgctggagaccttctgcatgaagctgagagatgaggagtatgagaagttcagcaagcactacaacatccacaaggacacagctgtggactacaacgtgttcctgaagaacctgagcatcaacaatgacctgaacctgcgctactgcatgggcaaccaggaggtgtccctggagaaccagcaggccaagaacagcaagaaggagcggctgctgggcagcgccagcagcgaggacatctggaggaactacagcctggatgaaattgaaagaaacttctgcctgcagctgagcaagagctatgagaaggtggagaaggccctgtctgctggggacccctgcaagggcggctacgtgtccttcaactacctgaagatcgtgctggacacctttgtgtaccagatcccccggcgcatcttcatccagctgatgaagagatttggcctgaaggccaccaccaagatcaactggaagcagttcctgaccagcttccacgagccccagggcctgcaggtgagcagcaagggccccctgaccaagagaaattccatcaacagcagaaatgaaagccacaaggagaacatcatcaccaagctgttccgccacacagaggaccacagcgccagcctgaagaaggccctgctgatcatcaacaccaagccagatggccccatcacccgggaggagttccgctacatcctgaactgcatggctgtgaagctgagtgacagcgagttcaaggagctgatgcagatgctggaccccggggacaccggggtggtgaacacctccatgtttattgacctgattgaggagaactgcaggatgaggaagaccagcccctgcacagatgccaagacccccttcctgctggcctgggacagcgtggaggagatcgtgcatgacaccatcaccaggaacctgcaggccttctacaacatgctgcggagctatgacctgggggacaccggccgcatcggcaggaacaacttcaagaagatcatgcacgtgttctgccccttcctgaccaatgcccacttcatcaagctgtgcagcaagatccaggacatcggcagcggccgcatcctgtacaagaagctgctggcctgcattggaattgatggcccccccaccgtgtcccctgtgctggtgcccaaggaccagctgctgtctgagcacctgcagaaggatgagcagcagcagcctgacctgtctgagaggaccaagctgacagaggacaagaccaccctgaccaagaagatgaccacagaggaggtgattgagaagttcaagaagtgcatccagcagcaggaccctgccttcaagaagcgcttcctggacttcagcaaggagcccaacgggaagatcaacgtgcatgacttcaagaaggtgctggaggacaccggcatgcccatggatgatgaccagtatgccctgctgaccaccaagattggatttgagaaggagggcatgagctacctggactttgctgctggctttgaagatcctcccatgaggggccctgagaccaccccaccccagccccccacccccagcaagagctatgtgaacagccacttcatcacagctgaggagtgcctgaagctgttcccccggcggctgaaggagagcttccgggacccctacagcgccttcttcaagacagatgctgacagagatggcatcatcaacatgcatgacctgcaccggctgctgctgcacctgctgctgaacctgaaggatgatgaatttgagcgcttcctgggcctgctgggcctgcggctgtctgtgaccctgaacttccgggagttccagaacctgtgtgagaagaggccctggaggacagatgaggccccccagaggctcatccggcccaagcagaaggtggccgacagcgagctggcctgtgagcaggcccaccagtacctggtgaccaaggccaagaaccgctggagcgacctgagcaagaacttcctggagacagacaatgaaggaaatggcatcctgcggcggcgggacatcaagaatgccctgtatggctttgacatccccctgaccccccgggagtttgagaagctgtgggcccgctatgacacagagggcaagggccacatcacctaccaggagttcctgcagaagctgggcatcaactacagccctgctgtgcaccggccctgtgccgaggactacttcaacttcatgggccacttcaccaagccccagcagctgcaggaggagatgaaggagctgcagcagagcacagagaaggctgtggccgcccgggacaagctgatggacagacaccaggacatcagcaaggccttcaccaagacagaccagagcaagaccaactacatcagcatctgcaagatgcaggaggtgctggaggagtgtggctgcagcctgacagaaggagagctgacccacctgctgaacagctggggcgtgtccagacatgacaatgccatcaactacctggacttcctgcgggctgtggagaacagcaagagcactggagcccagcccaaggagaaggaggagagcatgcccatcaactttgccaccctgaacccccaggaggccgtgaggaagatccaggaggtggtggagagcagccagctggccctgagcacagccttcagcgccctggacaaggaggacaccggctttgtgaaggccacagaatttggccaggtgctgaaggacttctgctacaagctgacagacaaccagtaccactacttcctgaggaagctgcgcatccacctgaccccctacatcaactggaagtacttcctgcagaacttcagctgcttcctggaggagacagcagatgagtgggccgagaagatgcccaagggccccccacccaccagccccaaggccacagctgaccgggacatcctggcccggctgcacaaggctgtgaccagccactaccacgccatcacccaggagtttgagaactttgacaccatgaagaccaacaccatcagccgggaggagttccgggccatctgcaacagaagagtgcagatcctgacagatgagcagtttgaccggctgtggaatgagatgcctgtgaatgccaagggccgcctgaagtacccagacttcctgagccgcttcagcagcgagacagctgccacccccatggccaccggggacagcgctgtggcccagaggggcagctctgtgcctgatgtgtctgagggcaccaggtctgccctgagcctgcccacccaggagctgcggcccggcagcaagagccagagccacccctgcaccccagccagcaccaccgtcatccctggcaccccacccctgcagaactgtgaccccatcgagagccggctgaggaagaggatccagggctgctggaggcagctgctgaaggagtgcaaggagaaggatgtggcccggcagggcgacatcaatgccagtgacttcctggccctggtggagaagttcaacctggacatcagcaaggaggagtgccagcagctgatcatcaagtatgacctgaagagcaatggcaagtttgcctactgtgacttcatccagagctgtgtgctgctgctgaaggccaaggagagcagcctgatgcacaggatgaagatccagaatgcccacaagatgaaggaggccggggctgagacccccagcttctacagcgccctgctgcgcatccagcccaagatcgtgcactgctggaggcccatgaggaggaccttcaagagctatgatgaagctggcaccggcctgctgtctgtggccgacttcagaacagtgctgcggcagtacagcatcaacctgtctgaggaggagttcttccacatcctggagtactatgacaagaccctgagcagcaagatctcctacaatgacttcctgcgggccttcctgcagtag

SEQ ID NO: 15432 - DNA, 783 bp, Artificial Sequence
  Description of Artificial Sequence: Synthetic coding sequence
atgaacagcgctgctggcttcagccacctggaccggcgggagcgggtgctgaagctgggggagagctttgagaagcagccccgctgtgccttccacacagtgcgctatgacttcaagccagccagcattgacaccagcagcgagggctacctggaggtgggggagggggagcaggtgaccatcaccctgcccaacatcgagggcagcaccccacctgtgaccgtcttcaagggcagcaagaagccctacctgaaggagtgcatcctgatcatcaaccacgacacaggagaatgtcggctggagaagctgagcagcaacatcaccgtgaagaagaccagggtggagggcagcagcaagatccagtacaggaaggagcagcagcagcagcagatgtggaacagcgcccggacccccaacctggtgaagcacagccccagcgaggacaagatgagccctgccagccccattgatgacatcgagcgggagctgaaggccgaggccagcctgatggaccagatgagcagctgtgacagcagcagtgacagcaagagcagcagcagcagcagcagcgaggacagcagcagtgacagtgaagatgaggactgcaagagcagcaccagtgacaccggcaactgtgtgtctggccaccccaccatgacccagtaccgcatcccagacattgatgccagccacaaccgcttccgggacaacagcggcctgctgatgaacaccctgagaaatgacctgcagctgtctgagagcggcagtgacagtgatgactag

SEQ ID NO: 15433 - DNA, 792 bp, Artificial Sequence
  Description of Artificial Sequence: Synthetic coding sequence
atgaacagcgctgctggcttcagccacctggaccggcgggagcgggtgctgaagctgggggagagctttgagaagcagccccgctgtgccttccacacagtgcgctatgacttcaagccagccagcattgacaccagcagcgagggctacctggaggtgggggagggggagcaggtgaccatcaccctgcccaacatcgagggcagcaccccacctgtgaccgtcttcaagggcagcaagaagccctacctgaaggagtgcatcctgatcatcaaccacgacacaggagaatgtcggctggagaagctgagcagcaacatcaccgtgaagaagaccagggtggagggcagcagcaagatccagtacaggaaggagcagcagcagcagcagatgtggaacagcgcccggacccccaacctggtgaagcacagccccagcgaggacaagatgagccctgccagccccattgatgacatcgagcgggagctgaaggccgaggccagcctgatggaccagatgagcagctgtgacagcagcagtgacagcaagagcagcagcagcagcagcagcgaggacagcagcagtgacagtgaagatgaggactgcaagagcagcaccagtgacaccggcaactgtgtgtctggccaccccaccatgacccagtaccgcatcccagacattgatgccagccacaaccgcttccgggacaacagcggcctgctgatgaacaccctgaacaacctgagcagccacagcttcagcagcctgtatgaccccctgctgagccactag

SEQ ID NO: 15434 - DNA, 252 bp, Artificial Sequence
  Description of Artificial Sequence: Synthetic coding sequence
atgggccgcaggaagagcaagaggaagcccccacccaagaagaagatgacaggcaccctggagacccagttcacctgccccttctgcaaccacgagaagagctgtgatgtgaagatggaccgggccagaaatactggagtcatcagctgcaccgtgtgcctggaggagttccagacccccatcacctacctgtctgagcctgtggatgtgtacagcgactggattgatgcctgtgaggccgccaaccagtag

SEQ ID NO: 15435 - DNA, 306 bp, Artificial Sequence
  Description of Artificial Sequence: Synthetic coding sequence
atggtggtgtccaagatgaacaaggatgcccagatgagagctgccatcaaccagaagctgattgaaacaggagagcgggagcggctgaaggagctgctgcgggccaagctgattgaatgtggctggaaggaccagctgaaggcccactgcaaggaggtgatcaaggagaagggcctggagcacgtgacagtggatgacctggtggccgagatcacccccaagggccgggccctggtgcctgacagcgtgaagaaggagctgctgcagaggatccgcaccttcctggcccagcacgccagcctgtag

SEQ ID NO: 15436 - DNA, 291 bp, Artificial Sequence
  Description of Artificial Sequence: Synthetic coding sequence
atgaacaaggatgcccagatgagagctgccatcaaccagaagctgattgagaccggggagcgggagcggctgaaggagctgctgcgggccaagctgattgaatgtggctggaaggaccagctgaaggcccactgcaaggaggtgatcaaggagaagggcctggagcacgtgacagtggatgacctggtggccgagatcacccccaagggccgggccctggtgcctgattctgtgaagaaggagctgctgcagaggatccgcaccttcctggcccagcacgccagcctgtag

SEQ ID NO: 15437 - DNA, 486 bp, Artificial Sequence
  Description of Artificial Sequence: Synthetic coding sequence
atggccgagcccaccggcctgctggagatgtctgagctgcccggggacagctctgtgccccaggtgggcacagccagcggcgtgtctgatgtgctgcggggagctgtgggcggcggcgtgcgggtgcaggaggcccgggagggccctgtggccgaggccgcccgctccatggccaggatgcctggccctgtgcccggccccatccccagctctgtgcccggcctggccagcgccccagacccccaccagcagctggccttcctggagatcaaccggcagctgctcttccgggagtacctggatggcagctccatgatccctgtgcggctgctgcgggactttgaggagcggcggcggctgtttgtggagggctgcaaggcccgggaggccgcctttgatgctgaccccccccagatggactttgctgctgtggccttcaccgtggccctgacagccagcgaggccctgagccccctggccgactag

SEQ ID NO: 15438 - DNA, 2556 bp, Artificial Sequence
  Description of Artificial Sequence: Synthetic coding sequence
atgagcagcaagcaggagatcatgtctgaccagcgcttccggcgggtggccaaggacccccgcttctgggagatgcctgagaaggacaggaaggtgaagattgacaagcgcttccgggccatgtttcatgacaagaagttcaagctgaactatgctgtggacaagaggggccggcccatcagccacagcaccacagaggacctgaagcgcttctatgacctgagtgacagcgacagcaacctgagcggggaggacagcaaggccctgagccagaagaagatcaagaagaagaagacccagaccaagaaggagattgacagcaagaacctggtggagaagaagaaggagaccaagaaggccaaccacaagggcagcgagaacaagacagacctggacaacagcatcggcatcaagaagatgaagaccagctgcaagttcaagattgacagcaacatcagccccaagaaggacagcaaggagttcacccagaagaacaagaaggagaagaagaacatcgtgcagcacaccacagacagcagcctggaggagaagcagaggaccctggacagcggcaccagcgagatcgtgaagagccccagaattgagtgcagcaagacccggcgggagatgcagagcgtggtgcagctgatcatgacccgggacagtgatggctatgagaacagcacagatggagagatgtgtgacaaggatgccctggaggaggacagcgagagcgtgtctgaaattggaagtgatgaggagagtgaaaatgagatcacctctgtgggccgggccagcggagatgatgatggctctgaagatgatgaggaggaggatgaagatgaggaggaggatgaagatgaggacagtgaagatgatgacaagagtgacagcggccctgacctggcccggggcaagggcaacatcgagaccagcagtgaagatgaagatgacacagctgacctcttccctgaggagagcggctttgaacatgcctggagggagctggacaaggatgcccccagggcagatgagatcacccggcggctggccgtgtgcaacatggactgggaccggctgaaggccaaggacctgctggccctcttcaacagcttcaagcccaagggcggcgtcatcttctctgtgaagatctaccccagcgagtttgggaaggagaggatgaaggaggagcaggtgcagggccctgtggagctgctgagcatcccagaagatgcccctgagaaggactggaccagccgggagaagctgcgggactaccagttcaagaggctgaagtactactatgctgtggtggactgtgacagccctgagacagccagcaagatctatgaggactgtgatggcctggagtttgagagcagctgcagcttcatcgacctgcgcttcatcccagatgacatcacctttgatgatgagcccaaggatgtggccagcgaggtgaacctgacagcctacaagcccaagtacttcaccagcgctgccatgggcaccagcacagtggagatcacctgggatgaaacagaccacgagcgcatcaccatgctgaacaggaagttcaagaaggaggagctgctggacatggacttccaggcctacctggccagcagcagtgaagatgaggaggagattgaggaggagctgcagggagatgatggagtgaatgtggaggaggatggcaagaccaagaagagccagaaggatgatgaggagcagatcgccaagtaccggcagctgctgcaggtgatccaggagaaggagaagaagggcaaggaaaatgacatggagatggagatcaagtgggtgcccggcctgaaggagagcgctgaggagatggtgaagaacaagctggagggcaaggacaagctgaccccctgggagcagttcctggagaagaagaaggagaagaagaggctgaagaggaagcagaaggccctggccgaggaggccagcgaggaggagctgcccagtgatgtggacctgaatgacccctactttgctgaggaggtgaagcagatcggcatcaacaagaagtctgtgaagagcgccaaggatggcaccagccctgaggaggagattgaaattgagcggcagaaggccgagatggccctgctgatgatggatgaagatgaggacagcaagaagcacttcaactacaacaagatcgtggagcaccagaacctgagcaagaagaagaagaagcagctgatgaagaagaaggagctgattgaagatgactttgaggtgaatgtgaatgatgcccgcttccaggccatgtacaccagccacctgttcaacctggaccccagcgaccccaacttcaagaagaccaaggccatggagaagatcctggaggagaaggcccggcagcgggagaggaaggagcaggagctgacccaggccatcaagaagaaggagagcgagattgagaaggagagccagaggaagagcattgatcctgccctgtccatgctgatcaagagcatcaagaccaagacagagcagttccaggccaggaagaagcagaaggtgaagtag

SEQ ID NO: 15439 - DNA, 333 bp, Artificial Sequence
  Description of Artificial Sequence: Synthetic coding sequence
atgagcagcaagcaggagatcatgtctgaccagcgcttccggcgggtggccaaggacccccgcttctgggagatgcctgagaaggacaggaaggtgaagattgacaagcgcttccgggccatgtttcatgacaagaagttcaagctgaactatgctgtggacaagaggggccggcccatcagccacagcaccacagaggacctgaagcgcttctatgacctgagtgacagcgacagcaacctgagcggggaggacagcaaggccctgagccagaagaagatcaagaagaagaagacccagaccaagaagaagaagaagaagaagaagaagtag

SEQ ID NO: 15440 - DNA, 1086 bp, Artificial Sequence
  Description of Artificial Sequence: Synthetic coding sequence
atgcactgcagctgcctggccgagggcatcccagccaaccctggcaactggatcagcggcctggccttcccagactgggcctacaaggccgagagcagccctggcagccggcagatccagctgtggcacttcatcctggagctgctgcagaaggaggagttccgccacgtgattgcctggcagcagggcgagtatggagaatttgtgatcaaggaccctgatgaggtggcccggctgtggggccgcaggaagtgcaagccccagatgaactatgacaagctgagccgggccctgcgctactactacaacaagaggatcctgcacaagaccaagggcaagcgcttcacctacaagttcaacttcagcaagctgattgtggtgaactaccccctgtgggaggtgcgggccccacccagcccccacctgctgctgggcgccccagccctgtgcaggcctgccctggtgcctgtgggcgtgcagagcgagctgctgcacagcatgctgtttgcccaccaggccatggtggagcagctgaccggccagcagaccccccggggccccccagagaccagcggggacaagaagggcagcagcagctctgtgtaccgcctgggcagcgcccctggcccctgccgcctgggcctgtgctgccacctgggctctgtgcagggcgagctgcccggggtggccagcttcaccccacccctgcccccacccctgcccagcaactggacctgcctgagcggccccttcctgccccccctgcccagcgagcagcagctgcccggggccttcaagccagacatcctgctgcccggccccaggagcctgcccggggcctggcacttccctggcctgcccctgctggccggcctgggccagggcgctggggagcggctgtggctgctgagcctgcggcctgagggcctggaggtgaagccagcccccatgatggaggccaagggcggcctggacccccgggaggtgttctgcccagagacccggcggctgaagacaggagaggagagcctgaccagccccaacctggagaacctgaaggctgtgtggcccctggaccccccatag

SEQ ID NO: 15441 - DNA, 498 bp, Artificial Sequence
  Description of Artificial Sequence: Synthetic coding sequence
atgagccaggccaccaagaggaagcacgtggtgaaggaggtgctgggggagcacatcgtgcccagcgaccagcagcagatcgtgcgggtgctgcggaccccaggcaacaacctgcacgaggtggagacagcccagggccagcgcttcctggtgtccatgcccagcaagtacaggaagaacatctggatcaagagaggagacttcctgattgtggaccccatcgaggagggggagaaggtgaaggccgagatcagctttgtgctgtgcaaggaccacgtgcgcagcctgcagaaggagggcttctggccagaggccttcagcgaggtggccgagaagcacaacaacagaaaccggcagacccagcctgagctgcctgctgagccccagctgtctggagaggagagcagcagtgaagatgacagcgacctgtttgtgaacaccaacagacggcagtaccatgaaagtgaggaggagagcgaggaggaggaggccgcctag

SEQ ID NO: 15442 - DNA, 498 bp, Artificial Sequence; identical to SEQ ID NO: 15441
  Description of Artificial Sequence: Synthetic coding sequence

SEQ ID NO: 15443 - DNA, 237 bp, Artificial Sequence
  Description of Artificial Sequence: Synthetic coding sequence
atgagccaggccaccaagaggaagcacgtggtgaaggaggtgctgggggagcacatcgtgcccagcgaccagcagcagatcgtgcgggtgctgcggaccccaggcaacaacctgcacgaggtggagacagcccagggccagcgcttcctggtgtccatgcccagcaagtacaggaagaacatctggatcaagagaggagacttcctgattgtggaccccatcgaggagggggagtag

SEQ ID NO: 15444 - DNA, 498 bp, Artificial Sequence; identical to SEQ ID NO: 15441
  Description of Artificial Sequence: Synthetic coding sequence

SEQ ID NO: 15445 - DNA, 441 bp, Artificial Sequence
  Description of Artificial Sequence: Synthetic coding sequence
atgagccaggccaccaagaggaagcacgtggtgaaggaggtgctgggggagcacatcgtgcccagcgaccagcagcagatcgtgcgggtgctgcggaccccaggcaacaacctgcacgaggtggagacagcccagggccagcgcttcctggtgtccatgcccagcaagtacaggaagaacatctggatcaagagaggagacttcctgattgtggaccccatcgaggagggggagaaggtgaaggccgagatcagctttgtgctgtgcaaggaccacgtgcgcagcctgcagaaggagggcttctggccagaggccttcagcgaggtggccgagaagcacaacaacagaaaccggcagacccagcctgagctgcctgctgagccccagctgtctggagaggagagcagcagtgaagatgacagcgacctgtttgtgaactag

SEQ ID NO: 15446 - DNA, 345 bp, Artificial Sequence
  Description of Artificial Sequence: Synthetic coding sequence
atgagccaggccaccaagaggaagcacgtggtgaaggaggtgctgggggagcacatcgtgcccagcgaccagcagcagatcgtgcgggtgctgcggaccccaggcaacaacctgcacgaggtggagacagcccagggccagcgcttcctggtgtccatgcccagcaagtacaggaagaacatctggatcaagagaggagacttcctgattgtggaccccatcgaggagggggagaaggtgaaggccgagatcagctttgtgctgtgcaaggaccacgtgcgcagcctgcagaaggagggcttctggccagaggccttcagcgaggtggccgagaagcacaactag

SEQ ID NO: 15447 - DNA, 342 bp, Artificial Sequence
  Description of Artificial Sequence: Synthetic coding sequence
atgagccaggccaccaagaggaagcacgtggtgaaggaggtgctgggggagcacatcgtgcccagcgaccagcagcagatcgtgcgggtgctgcggaccccaggcaacaacctgcacgaggtggagacagcccagggccagcgcttcctggtgtccatgcccagcaagtacaggaagaacatctggatcaagagaggagacttcctgattgtggaccccatcgaggagggggagaaggtgaaggccgagatcagctttgtgctgtgcaaggaccacgtgcgcagcctgcagaaggagggcttctggccagaggccttcagcgaggtggccgagaagcactag

SEQ ID NO: 15448 - DNA, 498 bp, Artificial Sequence; identical to SEQ ID NO: 15441
  Description of Artificial Sequence: Synthetic coding sequence

SEQ ID NO: 15449 - DNA, 1230 bp, Artificial Sequence
  Description of Artificial Sequence: Synthetic coding sequence
atggagggggagagcaccagcgctgtgctgagcggctttgtgctgggcgccctggccttccagcacctgaacacagacagcgacacagagggcttcctgctgggggaggtgaagggggaggccaagaacagcatcacagacagccagatggatgatgtggaggtggtgtacaccatcgacatccagaagtacatcccctgctaccagctgttctccttctacaacagcagtggagaggtgaatgagcaggccctgaagaagatcctgagcaatgtgaagaagaatgtggtgggctggtacaagttcagaagacacagcgaccagatcatgaccttccgggagcggctgctgcacaagaacctgcaggagcacttcagcaaccaggacctggtgttcctgctgctgacccccagcatcatcacagagagctgcagcacccaccggctggagcacagcctgtacaagccccagaagggcctcttccaccgggtgcccctggtggtggccaacctgggcatgtctgagcagctgggctacaagacagtgtctggcagctgcatgagcacaggcttcagcagagctgtgcagacccacagcagcaagttctttgaagaagatggcagcctgaaggaggtgcacaagatcaatgagatgtatgccagcctgcaggaggagctgaagagcatctgcaagaaggtggaggacagcgagcaggccgtggacaagctggtgaaggatgtgaaccggctgaagcgggagattgagaagagaagaggagcccagatccaggccgcccgggagaagaacatccagaaggacccccaggagaacatcttcctgtgccaggccctgcggaccttcttccccaacagcgagttcctgcacagctgtgtgatgagcctgaagaacagacatgtgtccaagagcagctgcaactacaaccaccacctggatgtggtggacaacctgaccctgatggtggagcacacagacatccctgaggccagccctgccagcaccccccagatcatcaagcacaaggccctggacctggatgaccgctggcagttcaagaggagccggctgctggacacccaggacaagaggagcaaggctgacaccggcagcagcaaccaggacaaggccagcaagatgagcagccctgagacagatgaggagattgagaagatgaagggctttggagagtacagccgcagccccaccttctag

SEQ ID NO: 15450 - DNA, 1083 bp, Artificial Sequence
  Description of Artificial Sequence: Synthetic coding sequence
atggatgatgtggaggtggtgtacaccatcgacatccagaagtacatcccctgctaccagctgttctccttctacaacagcagcggggaggtgaatgagcaggccctgaagaagatcctgagcaatgtgaagaagaatgtggtgggctggtacaagttccgccgccacagcgaccagatcatgaccttccgggagcggctgctgcacaagaacctgcaggagcacttcagcaaccaggacctggtgttcctgctgctgacccccagcatcatcacagagagctgcagcacccaccggctggagcacagcctgtacaagccccagaagggcctcttccaccgggtgcccctggtggtggccaacctgggcatgtctgagcagctgggctacaagacagtgtctggcagctgcatgagcacaggcttcagcagagctgtgcagacccacagcagcaagttctttgaggaggatggcagcctgaaggaggtgcacaagatcaatgagatgtatgccagcctgcaggaggagctgaagagcatctgcaagaaggtggaggacagcgagcaggccgtggacaagctggtgaaggatgtgaaccggctgaagcgggagattgagaagagaagaggagcccagatccaggccgcccgggagaagaacatccagaaggacccccaggagaacatcttcctgtgccaggccctgcggaccttcttccccaacagcgagttcctgcacagctgtgtgatgagcctgaagaacagacatgtgtccaagagcagctgcaactacaaccaccacctggatgtggtggacaacctgaccctgatggtggagcacacagacatccctgaggccagccctgccagcaccccccagatcatcaagcacaaggccctggacctggatgaccgctggcagttcaagaggagccggctgctggacacccaggacaagaggagcaaggctgacaccggcagcagcaaccaggacaaggccagcaagatgagcagccctgagacagatgaggagattgagaagatgaagggctttggagagtacagccgcagccccaccttctag

SEQ ID NO: 15451 - DNA, 333 bp, Artificial Sequence
  Description of Artificial Sequence: Synthetic coding sequence
atggatgatgtggaggtggtgtacaccatcgacatccagaagtacatcccctgctaccagctgttctccttctacaacagcagcggggaggtgaatgagcaggccctgaagaagatcctgagcaatgtgaagaagaatgtggtgggctggtacaagttccgccgccacagcgaccagatcatgaccttccgggagcggctgctgcacaagaacctgcaggagcacttcagcaaccaggacctggtgttcctgctgctgacccccagcatcatcacagagagctgcagcacccaccggctggagcacagcctgtacaagccccagaagggctag

SEQ ID NO: 15452 - DNA, 1338 bp, Artificial Sequence
  Description of Artificial Sequence: Synthetic coding sequence
atgtctgagctgaccaaggagctgatggagctggtgtggggcaccaagagcagccctggcctgagtgacaccatcttctgccgctggacccagggctttgtgttcagcgagagcgagggcagcgccctggagcagtttgagggcggcccctgtgccgtcatcgcccctgtgcaggccttcctgctgaagaagctgctcttcagcagcgagaagagctcctggagggactgcagcgaggaggagcagaaggagctgctgtgccacaccctgtgtgacatcctggagagcgcctgctgtgaccacagcggcagctactgcctggtgtcctggctgcggggcaagaccacagaggagacagccagcatcagcggcagccctgctgagagcagctgccaggtggagcacagcagcgccctggccgtggaggagctgggctttgagcgcttccacgccctgatccagaagaggagcttccgcagcctgcctgagctgaaggatgctgtgctggaccagtacagcatgtggggcaacaagtttggagtgctgctcttcctgtacagcgtgctgctgaccaagggcatcgagaacatcaagaatgaaattgaagatgccagcgagcccctgattgatcctgtgtatggccacggcagccagagcctcatcaacctgctgctgaccggccatgctgtgtccaatgtgtgggatggagacagagaatgttctggcatgaagctgctgggcatccacgagcaggccgctgtgggcttcctgaccctgatggaggccctgcgctactgcaaggtgggcagctacctgaagagccccaagttccccatctggatcgtgggcagcgagacccacctgactgtgttctttgccaaggacatggccctggtggcccctgaggcccccagcgagcaggcccggcgggtcttccagacctatgaccctgaggacaatggcttcatcccagacagcctgctggaggatgtgatgaaggccctggacctggtgtctgaccctgagtacatcaacctgatgaagaacaagctggaccctgagggcctgggcatcatcctgctgggccccttcctgcaggagttcttcccagaccagggcagcagcggccctgagagcttcaccgtgtaccactacaacggcctgaagcagagcaactacaatgagaaggtgatgtatgtggagggcacagctgtggtgatgggctttgaggaccccatgctgcagacagatgacacccccatcaagcgctgcctgcagaccaagtggccctacatcgagctgctgtggaccacagacaggagccccagcctgaactag

SEQ ID NO: 15453 - DNA, 453 bp, Artificial Sequence
  Description of Artificial Sequence: Synthetic coding sequence
atggccctggtggcccctgaggcccccagcgagcaggcccggcgggtcttccagacctatgaccctgaagataatggcttcatcccagacagcctgctggaggatgtgatgaaggccctggacctggtgtctgaccctgagtacatcaacctgatgaagaacaagctggaccctgagggcctgggcatcatcctgctgggccccttcctgcaggagttcttcccagaccagggcagcagcggccctgagagcttcaccgtgtaccactacaacggcctgaagcagagcaactacaatgagaaggtgatgtatgtggagggcacagctgtggtgatgggctttgaggaccccatgctgcagacagatgacacccccatcaagcgctgcctgcagaccaagtggccctacatcgagctgctgtggaccacagacaggagccccagcctgaactag

SEQ ID NO: 15454 - DNA, 453 bp, Artificial Sequence; identical to SEQ ID NO: 15453
  Description of Artificial Sequence: Synthetic coding sequence

SEQ ID NO: 15455 - DNA, 549 bp, Artificial Sequence
  Description of Artificial Sequence: Synthetic coding sequence
ctgcctgagctgaaggatgctgtgctggaccagtacagcatgtggggcaacaagtttggagtgctgctcttcctgtacagcgtgctgctgaccaagggcatcgagaacatcaagaatgaaattgaagatgccagcgagcccctgattgatcctgtgtatggccacggcagccagagcctcatcaacctgctgctgaccggccatgctgtgtccaatgtgtgggatggagacagagaatgttctggcatgaagctgctgggcatccacgagcaggccgctgtgggcttcctgaccctgatggaggccctgcgctactgcaaggtgggcagctacctgaagagccccaagttccccatctggatcgtgggcagcgagacccacctgactgtgttctttgccaaggacatggccctggtggcccctgaggcccccagcgagcaggcccggcgggtcttccagacctatgaccctgaggacaatggcttcatcccagacagcctgctggaggatgtgatgaaggccctggacctggtgtctgaccctgagtag

SEQ ID NO: 15456 - DNA, 495 bp, Artificial Sequence
  Description of Artificial Sequence: Synthetic coding sequence
atgaagcgcttccctgccaagaagaggagcttccgcagcctgcctgagctgaaggatgctgtgctggaccagtacagcatgtggggcaacaagtttggagtgctgctcttcctgtacagcgtgctgctgaccaagggcatcgagaacatcaagaatgaaattgaagatgccagcgagcccctgattgatcctgtgtatggccacggcagccagagcctcatcaacctgctgctgactggacatgctgtgtccaatgtgtgggatggagaccgggagtgcagcggcatgaagctgctgggcatccacgagcaggccgctgtgggcttcctgaccctgatggaggccctgcgctactgcaaggtgggcagctacctgaagagccccaagttccccatctggatcgtgggcagcgagacccacctgaccgtcttctttgccaaggacatggccctggtggcccctgaggcccccagcgagcaggcccggcgggtgtag

SEQ ID NO: 15457 - DNA, 765 bp, Artificial Sequence
  Description of Artificial Sequence: Synthetic coding sequence
atggatggaggagatgatggcaacctgatcatcaagaagagatttgtgtctgaggccgagctggatgagaggaggaagaggcggcaggaggagtgggagaaggtgaggaagccagaagatcctgaagaatgtcctgaggaggtgtatgaccccaggagcctgtatgagcggctgcaggagcagaaggacaggaagcagcaggagtatgaggagcagttcaagttcaagaacatggtgcggggcctggatgaagatgagaccaacttcctggatgaggtgtcccggcagcaggagctgattgagaagcagaggcgggaggaggagctgaaggagctgaaggagtacagaaacaacctgaagaaggtgggcatcagccaggagaacaagaaggaggtggagaagaagctgactgtgaagcccatcgagaccaagaacaagttcagccaggccaagctgctggccggggctgtgaagcacaagagcagcgagagcggcaacagcgtgaagaggctgaagccagaccctgagccagatgacaagaaccaggagcccagcagctgcaagagcctgggcaacaccagcctgagcggccccagcatccactgccccagcgctgctgtgtgcatcggcatcctgcccggcctgggcgcctacagcggcagcagtgacagcgagagcagcagtgacagcgagggcaccatcaatgccaccgggaagatcgtgagcagcatcttccgcaccaacaccttcctggaggccccctag

SEQ ID NO: 15458 - DNA, 765 bp, Artificial Sequence; identical to SEQ ID NO: 15457
  Description of Artificial Sequence: Synthetic coding sequence

SEQ ID NO: 15459 - DNA, 246 bp, Artificial Sequence
  Description of Artificial Sequence: Synthetic coding sequence
atggatggaggagatgatggcaacctgatcatcaagaagagatttgtgtctgaggccgagctggatgagaggaggaagaggcggcaggaggagtgggagaaggtgaggaagccagaagatcctgaagaatgtcctgaggaggtgtatgaccccaggagcctgtatgagcggctgcaggagcagaaggacaggaagcagcaggagtatgaggagcagttcaagttcagcaagcagtttgacccctag

SEQ ID NO: 15460 - DNA, 1617 bp, Artificial Sequence
  Description of Artificial Sequence: Synthetic coding sequence
atgagacatgtgcaggccgagcccagccccagcagcgagcctgaggccggccccagccagccccctgtgcggcagggcgccctgcagggcggcctgctgatgggctacagccctgctggaggagccaccagccctggggtgtaccaggtgtccatcttcagccccccagctggcaccagcgagccccaccgggccctgaagaggcaggcccccagcacagagggcccccgggagctgaagaggggccctggcctgggcgcccgggagggcctgcccccagaggagcccagcacagtgggcctgctgggccctgagggccctggcctgggcctgggcgtggccagccagcacttcagccaccggggcctgtgtgtggtggagcagaggagctctgtgaccagctcctggaccagcggggcctggagccccccctgcccccccagcaatgccagctgcaacaccctgcacacccgggactgggccagcccagaccccggcggccagggcagcctgggggagagccctggccctgcccctcctggccagctgcacaccctggacacagacctgcacagcctggcccagatcggcggcaagagccctgtggccggcgtgggcaatggaggcagcctgtggccccgggagagccctggaacagccaacggccacagccctgagcacaccccacctggccctggccccccaggcccctgccccaccaagaggcggctgctgcctgctggggaggccccagatgtgtcctctgaggaggagggccctgcccccaggagaagaagaggcagcctgggccaccccacagctgccaacagcagtgatgccaaggccacccccttctggagccacctgctgcccggccccaaggagcctgtgctggaccccacagactgtggccccatgggccggcggctgaagggggcccggcggctgaagctgagccccctgcggagcctgaggaagggccctggcctgctgagccccccatctgccagccctgtgcccaccccagctgtgtccaggaccctgctgggcaactttgaggagagcctgctgcggggccgctttgcccccagcggccacatcgagggcttcaccgctgagatcggggccagcggcagctactgcccccagcacgtgaccctgcctgtgacagtgaccttctttgatgtgtctgagcagaatgccccagcccccttcctgggcatcgtggacctgaaccccctgggcaggaagggctacagcgtgcccaaggtgggcaccgtgcaggtgaccctcttcaaccccaaccagacagtggtgaagatgttcctggtgacctttgacttcagtgacatgcctgctgcccacatgaccttcctgcggcacaggctcttcctggtgcctgtgggggaggagggcaatgccaaccccacccaccggctgctgtgctacctgctgcacctgcgcttccgcagcagccgcagcggccgcctgagcctgcacggggacatccggctgctcttcagcagaagaagcctggagctggacaccggcctgccctatgagctgcaggccgtgacagaggccccccacaacccccgctacagccccctgccctag

SEQ ID NO: 15461 - DNA, 1329 bp, Artificial Sequence
  Description of Artificial Sequence: Synthetic coding sequence
atgagacatgtgcaggccgagcccagccccagcagcgagcctgaggccggccccagccagccccctgtgcggcagggcgccctgcagggcggcctgctgatgggctacagccctgctggaggagccaccagccctggggtgtaccaggtgtccatcttcagccccccagctggcaccagcgagccccaccgggccctgaagaggcaggcccccagcacagagggcccccgggagctgaagaggggccctggcctgggcgcccgggagggcctgcccccagaggagcccagcacagtgggcctgctgggccctgagggccctggcctgggcctgggcgtggccagccagcacttcagccaccggggcctgtgtgtggtggagcagaggagctctgtgaccagctcctggaccagcggggcctggagccccccctgcccccccagcaatgccagctgcaacaccctgcacacccgggactgggccagcccagaccccggcggccagggcagcctgggggagagccctggccctgcccctcctggccagctgcacaccctggacacagacctgcacagcctggcccagatcggcggcaagagccctgtggccggcgtgggcaatggaggcagcctgtggccccgggagagccctggaacagccaacggccacagccctgagcacaccccacctggccctggccccccaggcccctgccccaccaagaggcggctgctgcctgctggggaggccccagatgtgtcctctgaggaggagggccctgcccccaggagaagaagaggcagcctgggccaccccacagctgccaacagcagtgatgccaaggccacccccttctggagccacctgctgcccggccccaaggagcctgtgctggaccccacagactgtggccccatgggccggcggctgaagggggcccggcggctgaagctgagccccctgcggagcctgaggaagggccctggcctgctgagccccccatctgccagccctgtgcccaccccagctgtgtccaggaccctgctgggcaactttgaggagagcctgctgcggggccgctttgcccccagcggccacatcgagggcttcaccgctgagatcggggccagcggcagctactgcccccagcacgtgaccctgcctgtgacagtgaccttctttgatgtgtctgagcagaatgccccagcccccttcctgggcatcgtggacctgaaccccctgggcaggaagggctacagcgtgcccaaggtgggcaccgtgcaggtgaccctcttcaaccccaaccccttcaccagccccaccctgtag

SEQ ID NO: 15462 - DNA, 1617 bp, Artificial Sequence; identical to SEQ ID NO: 15460
  Description of Artificial Sequence: Synthetic coding sequence

SEQ ID NO: 15463 - DNA, 1617 bp, Artificial Sequence; identical to SEQ ID NO: 15460
  Description of Artificial Sequence: Synthetic coding sequence

SEQ ID NO: 15464 - DNA, 702 bp, Artificial Sequence
  Description of Artificial Sequence: Synthetic coding sequence
atgggccgccgcctgaagggggcccggcggctgaagctgagccccctgcggagcctgaggaaaggacctggcctgctgagcccccccagcgccagccctgtgcccaccccagctgtgtccaggaccctgctgggcaactttgaggagagcctgctgcggggccgctttgcccccagcggccacatcgagggcttcaccgctgagattggagccagcggcagctactgcccccagcacgtgaccctgcctgtgacagtgaccttctttgatgtgtctgagcagaatgccccagcccccttcctgggcatcgtggacctgaaccccctgggcaggaagggctacagcgtgcccaaggtgggcaccgtgcaggtgaccctcttcaaccccaaccagacagtggtgaagatgttcctggtgacctttgacttcagtgacatgcctgctgcccacatgaccttcctgcggcacaggctcttcctggtgcctgtgggggaggagggcaatgccaaccccacccaccggctgctgtgctacctgctgcacctgcgcttccgcagcagccgcagcggccgcctgagcctgcatggagacatccggctgctcttcagccgccgcagcctggagctggacaccggcctgccctatgagctgcaggccgtgacagaggccccccacaacccccgctacagccccctgccctag

SEQ ID NO: 15465 - DNA, 339 bp, Artificial Sequence
  Description of Artificial Sequence: Synthetic coding sequence
atggaggcctatgagcaggtgcagaagggccccctgaagctgaagggcgtggccgagctgggcgtgaccaagaggaagaagaagaagaaggacaaggacaaggccaagctgctggaggccatgggcaccagcaagaagaatgaggaggagaagaggcggggcctggacaagaggaccccagcccaggccgcctttgagaagatgcaggagaagaggcagatggagcgcatcctgaagaaggccagcaagacccacaagcagagggtggaggacttcaacagacacctggacaccctgacagagcactatgacatccccaaggtgtcctggaccaagtag

SEQ ID NO: 15466 - DNA, 639 bp, Artificial Sequence
  Description of Artificial Sequence: Synthetic coding sequence
atggagcctgctgtgggcggccctggccccctcatcgtgaacaacaagcagccccagcccccacctcctcctcctcctgctgctgcccagcccccacctggggcccccagggctgctgctggcctgctgcccggcggcaaggcccgggagttcaacagaaaccagaggaaggacagcgagggctacagcgagagcccagacctggagtttgaatatgctgacacagacaagtgggccgctgagctgtctgagctgtacagctacacagagggccctgagttcctgatgaacagaaaatgttttgaggaggacttccgcatccacgtgacagacaagaagtggacagagctggacaccaaccagcacaggacccacgccatgaggctgctggatggcctggaggtgacagcccgggagaagaggctgaaggtggcccgggccatcctgtatgtggcccagggcaccttcggggagtgcagcagcgaggccgaggtgcagagctggatgagatacaacatcttcctgctgctggaggtgggcaccttcaatgccctggtggagctgctgaacatggagattgagcactgctgcgtgcggcctgctgtgtctgccctggccggcggccaggcccaggactag

SEQ ID NO: 15467 - DNA, 2514 bp, Artificial Sequence
  Description of Artificial Sequence: Synthetic coding sequence
atggagcctgctgtgggcggccctggccccctcatcgtgaacaacaagcagccccagcccccacctcctcctcctcctgctgctgcccagcccccacctggggcccccagggctgctgctggcctgctgcccggcggcaaggcccgggagttcaacagaaaccagaggaaggacagcgagggctacagcgagagcccagacctggagtttgaatatgctgacacagacaagtgggccgctgagctgtctgagctgtacagctacacagagggccctgagttcctgatgaacagaaaatgttttgaggaggacttccgcatccacgtgacagacaagaagtggacagagctggacaccaaccagcacaggacccacgccatgaggctgctggatggcctggaggtgacagcccgggagaagaggctgaaggtggcccgggccatcctgtatgtggcccagggcaccttcggggagtgcagcagcgaggccgaggtgcagagctggatgagatacaacatcttcctgctgctggaggtgggcaccttcaatgccctggtggagctgctgaacatggagattgacaacagcgctgcctgcagcagcgctgtgaggaagccagccatcagcctggccgacagcacagacctgcgggtgctgctgaacatcatgtacctgattgtggagaccgtgcaccaggagtgtgagggggacaaggccgagtggaggaccatgaggcagaccttccgggcagagctgggcagccccctgtacaacaatgagccctttgccatcatgctgtttggcatggtgaccaagttctgcagcggccacgccccccacttccccatgaagaaggtgctgctgctgctgtggaagacagtgctgtgcaccctgggcggctttgaggagctgcagagcatgaaggccgagaagaggagcatcctgggcctgccccccctgcctgaggacagcatcaaggtgatccggaacatgagagctgccagccccccagccagcgccagtgacctgattgagcagcagcagaagaggggccggcgggagcacaaggccctgatcaagcaggacaacctggatgccttcaatgaaagagacccctacaaggcagatgacagccgggaggaggaggaggagaatgatgatgacaacagcctggagggggagaccttccccctggagagagatgaggtgatgcccccacccctgcagcacccccagacagaccggctgacctgccccaagggcctgccctgggcccccaaggtgcgggagaaggacatcgagatgttcctggagagcagccgcagcaagttcatcggctacaccctgggcagtgacaccaacacagtggtgggcctgccccggcccatccacgagagcatcaagaccctgaagcagcacaagtacaccagcattgctgaggtgcaggcccagatggaggaggagtacctgcggagccccctgtctggaggagaggaggaggtggagcaggtgcctgctgagaccctgtaccagggcctgctgcccagcctgccccagtacatgattgccctgctgaagatcctgctggccgccgcccccaccagcaaggccaagacagacagcatcaacatcctggctgatgtgctgcctgaggagatgcccaccaccgtgctgcagagcatgaagctgggcgtggatgtgaacagacacaaggaggtgattgtgaaggccatctctgctgtgctgctgctgctgctgaagcacttcaagctgaaccacgtgtaccagtttgagtacatggcccagcacctggtgtttgccaactgcatccccctcatcctgaagttcttcaaccagaacatcatgagctacatcacagccaagaacagcatctctgtgctggactacccccactgtgtggtgcatgagctgcctgagctgacagctgagagcctggaggccggggacagcaaccagttctgctggaggaacctcttcagctgcatcaacctgctgcgcatcctgaacaagctgaccaagtggaagcacagcaggaccatgatgctggtggtgttcaagagcgcccccatcctgaagagggccctgaaggtgaagcaggccatgatgcagctgtatgtgctgaagctgctgaaggtgcagaccaagtacctgggccggcagtggaggaagagcaacatgaagaccatgtctgccatctaccagaaggtgcgccaccggctgaatgatgactgggcctatggaaatgacctggatgcccggccctgggacttccaggccgaggagtgtgccctgcgggccaacatcgagcgcttcaatgccaggagatatgaccgggcccacagcaacccagacttcctgcctgtggacaactgcctgcagagcgtgctgggccagagggtggacctgcctgaggacttccagatgaactatgacctgtggctggagcgggaggtgttcagcaagcccatctcctgggaggagctgctgcagtag

SEQ ID NO: 15468 - DNA, 2229 bp, Artificial Sequence
  Description of Artificial Sequence: Synthetic coding sequence
atgaacaggaagtgctttgaggaggacttccgcatccacgtgacagacaagaagtggacagagctggacaccaaccagcacaggacccacgccatgaggctgctggatggcctggaggtgacagcccgggagaagaggctgaaggtggcccgggccatcctgtatgtggcccagggcacctttggagaatgtagcagcgaggccgaggtgcagagctggatgagatacaacatcttcctgctgctggaggtgggcaccttcaatgccctggtggagctgctgaacatggagattgacaacagcgctgcctgcagcagcgctgtgaggaagccagccatcagcctggccgacagcacagacctgcgggtgctgctgaacatcatgtacctgattgtggagaccgtgcaccaggagtgtgagggggacaaggccgagtggaggaccatgaggcagaccttccgggcagagctgggcagccccctgtacaacaatgagccctttgccatcatgctgtttggcatggtgaccaagttctgcagcggccacgccccccacttccccatgaagaaggtgctgctgctgctgtggaagacagtgctgtgcaccctgggcggctttgaggagctgcagagcatgaaggccgagaagaggagcatcctgggcctgccccccctgcctgaagattccatcaaggtgatccggaacatgagagctgccagccccccagccagcgccagtgacctgattgagcagcagcagaagagaggaagaagagagcacaaggccctgatcaagcaggacaacctggatgccttcaatgaaagagacccctacaaggcagatgacagccgggaggaggaggaggagaatgatgatgacaacagcctggagggggagaccttccccctggagagagatgaggtgatgcccccacccctgcagcacccccagacagaccggctgacctgccccaagggcctgccctgggcccccaaggtgcgggagaaggacatcgagatgttcctggagagcagccgcagcaagttcatcggctacaccctgggcagtgacaccaacacagtggtgggcctgccccggcccatccacgagagcatcaagaccctgaagcagcacaagtacaccagcattgctgaggtgcaggcccagatggaggaggagtacctgcggagccccctgagcggcggggaggaggaggtggagcaggtgcctgctgagaccctgtaccagggcctgctgcccagcctgccccagtacatgattgccctgctgaagatcctgctggccgccgcccccaccagcaaggccaagacagacagcatcaacatcctggctgatgtgctgcctgaggagatgcccaccaccgtgctgcagagcatgaagctgggcgtggatgtgaacagacacaaggaggtgattgtgaaggccatctctgctgtgctgctgctgctgctgaagcacttcaagctgaaccacgtgtaccagtttgagtacatggcccagcacctggtgtttgccaactgcatccccctcatcctgaagttcttcaaccagaacatcatgagctacatcacagccaagaacagcatctctgtgctggactacccccactgtgtggtgcatgagctgcctgagctgacagctgagagcctggaggccggggacagcaaccagttctgctggaggaacctcttcagctgcatcaacctgctgcgcatcctgaacaagctgaccaagtggaagcacagcaggaccatgatgctggtggtgttcaagagcgcccccatcctgaagagggccctgaaggtgaagcaggccatgatgcagctgtatgtgctgaagctgctgaaggtgcagaccaagtacctgggccggcagtggaggaagagcaacatgaagaccatgtctgccatctaccagaaggtgcgccaccggctgaatgatgactgggcctatggaaatgacctggatgcccggccctgggacttccaggccgaggagtgtgccctgcgggccaacatcgagcgcttcaatgcccggcgctatgaccgggcccacagcaacccagacttcctgcctgtggacaactgcctgcagagcgtgctgggccagagggtggacctgcctgaggacttccagatgaactatgacctgtggctggagcgggaggtgttcagcaagcccatctcctgggaggagctgctgcagtag

SEQ ID NO: 15469 - DNA, 783 bp, Artificial Sequence
  Description of Artificial Sequence: Synthetic coding sequence
atgaagagcaacatcgacaagaagttcagcgcccactatgatgctgtggaggccgagctgaagagcagcacagtgggcctggtgaccctgaatgacatgaaggccaagcaggaggccctggtgaaggagcgggagaagcagctggccaagaaggagcagagcaaggagctgcagatgaagctggagaagctgcgggagaaggagaggaagaaggaggccaagaggaagatcagcagcctgtccttcaccctggaggaggaggaggagggcggggaggaggaggaggaggccgccatgtatgaggaggagatggagcgggaggagatcaccaccaagaagaggaagctgggcaagaacccagatgtggacaccagcttcctgcctgaccgggaccgggaggaggaggagaaccggctgcgggaggagctgcggcaggagtgggaggccaagcaggagaagatcaagtctgaggagattgagatcaccttctcctactgggatggcagcggccacagaagaacagtgaagatgaggaaaggaaacaccatgcagcagttcctgcagaaggccctggagatcctgaggaaggacttcagcgagctgcggtctgctggggtggagcagctgatgtacatcaaggaggacctgatcatcccccaccaccacagcttctatgacttcatcgtgaccaaggcccggggcaagagcggccccctcttcaactttgatgtgcatgatgatgtgcggctgctgagtgatgccaccgtggagaaggatgaatag

SEQ ID NO: 15470 - DNA, 1020 bp, Artificial Sequence
  Description of Artificial Sequence: Synthetic coding sequence
atggcccagtacaagggagctgccagcgaggccggccgggccatgcacctgatgaagaagcgggagaagcagcgggagcagatggagcagatgaagcagagaattgctgaggagaacatcatgaagagcaacatcgacaagaagttcagcgcccactatgatgctgtggaggccgagctgaagagcagcacagtgggcctggtgaccctgaatgacatgaaggccaagcaggaggccctggtgaaggagcgggagaagcagctggccaagaaggagcagagcaaggagctgcagatgaagctggagaagctgcgggagaaggagaggaagaaggaggccaagaggaagatcagcagcctgtccttcaccctggaggaggaggaggagggcggggaggaggaggaggaggccgccatgtatgaggaggagatggagcgggaggagatcaccaccaagaagaggaagctgggcaagaacccagatgtggacaccagcttcctgcctgaccgggaccgggaggaggaggagaaccggctgcgggaggagctgcggcaggagtgggaggccaagcaggagaagatcaagtctgaggagattgagatcaccttctcctactgggatggcagcggccacagaagaacagtgaagatgaggaaaggaaacaccatgcagcagttcctgcagaaggccctggagatcctgaggaaggacttcagcgagctgcggtctgctggggtggagcagctgatgtacatcaaggaggacctgatcatcccccaccaccacagcttctatgacttcatcgtgaccaaggcccggggcaagagcggccccctcttcaactttgatgtgcatgatgatgtgcggctgctgagtgatgccaccgtggagaaggatgagagccatgctgggaaggtggtgctgcgctcctggtatgagaagaacaagcacatcttccctgccagccgctgggagccctatgaccctgagaagaagtgggacaagtacaccatcagatag

SEQ ID NO: 15471 - DNA, 1197 bp, Artificial Sequence
  Description of Artificial Sequence: Synthetic coding sequence
atggtgaccctcatcacagagaagctgcagagccagagcctggatgacctgacctgcaaggccgaggccggccccctgcagtacagcgctgagaccctgaacaagagcggccgcctcttccccctggagctgaatgaccagagcccctggaaggtgttcagcggcggcccccctgtgcgcagccaggccgccactggaccagacttctccttcctgcccggcctgtctgctgctgcccacaccatgggcctgcagtggcagccccagagccccaggcctggagctggcctgggcgccgccagcacagtggaccccagcgagagcacaggcagcagcacagccccacccaccaagaggcactgccgcagcctgtctgagcctgaggagctggtgcgctgccgcagcccctggaggcctggcagcagcaaggtgtggacccctgtgtccaagagaagatgtgacagcggcggcagcgccacccggcagggcagccctggagctgtgctgcccaggtctgctgtgtggagcacaggccccaccagccctgccaccccccggcccagcagcgccagcggcggctttgtggacagcagcgagggcagcgctggcagcggccccctgtggtgcagcgctgagagctgcctgcccagcacccggcggcggcccagcctgagccaggagcggctggccggggccggcacccccctgccctgggccagcagcagccccaccagcaccccagccctgggcggccggcggggcctgctgcgctgccgcagccagccctgtgtgctgagcggcaagaggagcaggaggaagagaagaagagaggaggatgcccgctggacccggcccagcctggacttcctgaagatgacccagaccctgaagaacagcaagagcctgtgcagcctgaactatgaagatgatgatgaagatgacacccctgtgaagacagtgctgagcagcccctgtgacagccggggcctgcccggcatcaccatgcctggctgcagccagaggggcctgcggaccagccctgtgcaccccaacctgtgggccagccgggagagcgtgaccagtgatggcagcagaagaagcagcggggaccccagagatggagacagcgtgggggaggagggcgtcttcccccgggcccgctgggagctggacctggagcagatcgagaacaactag

SEQ ID NO: 15472 - DNA, 1197 bp, Artificial Sequence; identical to SEQ ID NO: 15471
  Description of Artificial Sequence: Synthetic coding sequence

SEQ ID NO: 15473 - DNA, 327 bp, Artificial Sequence
  Description of Artificial Sequence: Synthetic coding sequence
atggtgaccctcatcacagagaagctgcagagccagagcctggatgacctgacctgcaaggccgaggccggccccctgcagtacagcgctgagaccctgaacaagagcggccgcctcttccccctggagctgaatgaccagagcccctggaaggtgttcagcggcggcccccctgtgcgcagccaggccgccactggaccagacttctccttcctgcccggcctgtctgctgctgcccacaccatgggcctgcagtggcagccccagagccccaggcctggagctggcctgggcgccgccagcacagtggaccccagcgagagctag

SEQ ID NO: 15474 - DNA, 1197 bp, Artificial Sequence; identical to SEQ ID NO: 15471
  Description of Artificial Sequence: Synthetic coding sequence

SEQ ID NO: 15475 - DNA, 717 bp, Artificial Sequence
  Description of Artificial Sequence: Synthetic coding sequence
atggccagccgctggcagaacatgggcacctctgtgagaagaagaagcctgcagcaccaggagcagctggaggacagcaaggagctgcagcctgtggtgagccaccaggagacctctgtgggcgccctgggcagcctgtgccggcagttccagaggcggctgcccctgcgggctgtgaacctgaacctgcgggccggccccagctggaagaggctggagaccccagagcccggccagcagggcctgcaggccgccgcccggagcgccaagagcgccctgggcgctgtgtcccagaggatccaggagagctgccagagcggcaccaagtggctggtggagacccaggtgaaggcccggcggaggaagagaggagcccagaagggcagcggcagccccacccacagcctgagccagaagagcacccggctgagcggggccgccccagcccacagcgctgctgacccctgggagaaggagcaccaccggctgtctgtgaggatgggcagccacgcccaccccctgcggcgcagccggcgggaggccgccttccgcagcccctacagcagcacagagcccctgtgcagccccagcgagagtgacagcgacctggagcctgtgggcgccggcatccagcacctgcagaagctgagccaggagctggatgaggccatcatggccgaggagagcggggacatcgtgtccctcatccatgactag

SEQ ID NO: 15476 - DNA, 747 bp, Artificial Sequence
  Description of Artificial Sequence: Synthetic coding sequence
atggccagccgctggcagaacatgggcacctctgtgagaagaagaagcctgcagcaccaggagcagctggaggacagcaaggagctgcagcctgtggtgagccaccaggagacctctgtgggcgccctgggcagcctgtgccggcagttccagaggcggctgcccctgcgggctgtgaacctgaacctgcgggccggccccagctggaagaggctggagaccccagagcccggccagcagggcctgcaggccgccgcccggagcgccaagagcgccctgggcgctgtgtcccagaggatccaggagagctgccagagcggcaccaagtggctggtggagacccaggtgaaggcccggcggaggaagagaggagcccagaagggcagcggcagccccacccacagcctgagccagaagagcacccggctgagcggggccgccccagcccacagcgctgctgacccctgggagaaggagcaccaccggctgtctgtgaggatgggcagccacgcccaccccctgcggcgcagccggcgggaggccgccttccgcagcccctacagcagcacagagcccctgtgcagccccagcgagagtgacagcgacctggagcctgtgggcgccggcatccagcacctgcagaagctgagccaggagctggatgaggccatcatggccgaggagaggaagcaggccctgagtgaccggcagggcttcatcctgaaggatgtgtatgccagcccctag

SEQ ID NO: 15477 - DNA, 717 bp, Artificial Sequence; identical to SEQ ID NO: 15475
  Description of Artificial Sequence: Synthetic coding sequence

SEQ ID NO: 15478 - DNA, 1818 bp, Artificial Sequence
  Description of Artificial Sequence: Synthetic coding sequence
atgagcaatgaaagctgcctgccctactacacagcccacagctacagctccatgtctgccttcaagacctccatgggagacctgcagaggcagctgtacaacagaggagagtacaacatcttcaagtatgcccccatgtttgagagcaacttcatccagatcaacaagaagggggaggtgattgatgtgcacaacagagtgaggatggtgacagtgggcatcgtgtgcaccagccccatcctgcccctgcctgatgtgatggtgctggcccagcccaccaagatctgtgagcagcacgtgcgctggggccgctttgccaagggccggggcagaagacctgtgaagaccctggagctgacccggctgctgcccctgaagtttgtgaagatcagcatccatgaccacgagaagcagcagctgcggctgaagctggccaccggccgcaccttctacctgcagctgtgccccagcagtgacacccgggaggacctcttctgctactgggagaagctggtgtacctgctgcggccccctgtggagagctactgcagcacccccaccctgctgtctggagatgcccctcctgaggacaacaagagcctggtggccgctgagctgcaccgggagggggaccagagcgagaccggcctgtacaagccctgtgatgtgtctgctgccaccagcagcgcctatgctggaggagagggcatccagcacgccagccacggcacagccagcgctgccagccccagcaccagcaccccaggagctgctgagggcggggccgccaggacagctgggggcatggctgtggccggcacagccaccggccccaggacagatgtggccatcgccggggccgccatgagccctgccactggagccatgagcatcgccaccaccaagtctgctggccctggccaggtgaccacagccctggccggggccgccatcaagaaccctggagaaaatgaaagcagcaagtccatggccggggccgccaacatcagcagcgagggcatcagcctggccctggtgggcgccgccagcaccagcctggagggcaccagcacctccatggccggggccgccagcctgagccaggacagcagcctgtctgctgcctttgctggcagcatcaccaccagcaaatgtgccgctgagaggacagagggccctgctgtgggccccctcatcagcaccctgcagagcgagggctacatgtctgaaagagatggcagccagaaggtgtcccagcccagcgctgaggtgtggaatgaaaacaaggagcggcgggagaagaaggacagacaccccagcaggaagagcagccaccacaggaaggccggggagagccacagaagaagagctggggacaagaaccagaaggccagcagccacaggtctgccagcggccacaagaacaccagagatgacaagaaggagaagggctacagcaatgtgcggggcaagagacatggcagcagcaggaagagcagcacccacagcagcaccaagaaggagagcaggaccacccaggagctgggcaagaaccagagcgccagcagcactggagccctgcagaagaaggccagcaagatcagcagcttcctgcggagcctgcgggccaccccaggcagcaagaccagggtgaccagccatgaccgggaggtggacatcgtggccaagatggtggagaagcagaacatcgaggccaaggtggagaaggcccagggcggccaggagctggagatgatcagcggcaccatgaccagcgagaagacagagatgattgtgtttgagaccaagagcatctag

SEQ ID NO: 15479 - DNA, 3054 bp, Artificial Sequence
  Description of Artificial Sequence: Synthetic coding sequence
atgatgtctgagggcaagcccccagacaagaagaggccccggcgcagcctgagcatcagcaagaacaagaagaaggccagcaacagcatcatcagctgcttcaacaatgcccccccagccaagctggcctgccctgtgtgcagcaagatggtgcccaggtatgacctgaacagacacctggatgagatgtgtgccaacaatgactttgtgcaggtggaccccggccaggtgggcctcatcaacagcaatgtgtccatggtggacctgacctctgtgaccctggaggatgtgacccccaagaagagccccccacccaagaccaacctgaccccaggccagagcgacagcgccaagcgggaggtgaagcagaagatcagcccctacttcaagagcaatgatgtggtgtgcaagaaccaggatgagctgaggaacagatctgtgaaggtgatctgcctgggcagcctggccagcaagctgagcaggaaatatgtgaaggccaagaagagcattgacaaggatgaggagtttgctggcagcagcccccagagcagcaagagcacagtggtgaagagcctgattgacaacagcagcgagattgaagatgaggaccagatcctggagaacagcagccagaaggaaaatgtgttcaagtgtgacagcctgaaggaggagtgcatccctgagcacatggtgcggggcagcaagatcatggaggccgagagccagaaggccaccagagaatgtgagaagagcgccctgaccccaggcttcagtgacaatgccatcatgctgttctccccagacttcaccctgaggaacaccctgaagagcaccagcgaggacagcctggtgaagcaggagtgcatcaaggaggtggtggagaagcgggaggcctgccactgtgaggaggtgaagatgacagtggccagcgaggccaagatccagctgagtgacagcgaggccaagagccacagcagcgcagatgatgccagcgcctggagcaacatccaggaggcccccctgcaggatgacagctgcctgaacaatgacatcccccacagcatccccctggagcagggcagcagctgcaatggacctggccagaccaccggccacccctactacctgcggagcttcctggtggtgctgaagacagtgctggagaatgaagatgacatgctgctgtttgatgagcaggagaagggcatcgtgaccaagttctaccagctgagcgccaccggccagaagctgtatgtgcggctcttccagaggaagctgtcctggatcaagatgaccaagctggagtatgaggagatcgccctggacctgacccctgtgattgaggagctgaccaatgccggcttcctgcagacagagagcgagctgcaggagctgtctgaggtgctggagctgctgagcgcccctgagctgaagagcctggccaagaccttccacctggtgaaccccaacggccagaagcagcagctggtggatgccttcctgaagctggccaagcagaggtctgtgtgcacctggggcaagaacaagccaggcattggagctgtgatcctgaagagggccaaggccctggccggccagagcgtgcgcatctgcaagggccccagggctgtgttcagccgcatcctgctgctcttcagcctgacagacagcatggaggatgaagatgctgcctgtggcggccagggccagctgagcacagtgctgctggtgaacctgggccgcatggagttccccagctacaccatcaacaggaagacccacatcttccaggacagagatgacctgatccgctatgctgctgccacccacatgctgagtgacatcagcagcgccatggccaatggaaactgggaggaggccaaggagctggcccagtgtgccaagagggactggaaccggctgaagaaccaccccagcctgcgctgccacgaggacctgcccctcttcctgcgctgcttcaccgtgggctggatctacacccgcatcctgagcagatttgtggagatcctgcagaggctgcacatgtatgaggaggccgtgcgggagctggagagcctgctgagccagaggatctactgcccagacagccggggccgctggtgggaccggctggccctgaacctgcaccagcacctgaagaggctggagcccaccatcaagtgcatcacagagggcctggccgaccctgaggtgaggacaggccaccggctgagcctgtaccagagagctgtgcggctgcgggagagccccagctgcaagaagttcaagcacctgttccagcagctgcctgagatggctgtgcaggatgtgaagcacgtgaccatcaccggccgcctgtgcccccagaggggcatgtgcaagtctgtgtttgtgatggaggccggggaggccgctgaccccaccaccgtgctgtgcagcgtggaggagctggccctggcccactacagaagaagtggctttgaccagggcatccacggggagggcagcaccttcagcaccctgtatggcctgctgctgtgggacatcatcttcatggatggcatcccagatgtgttcagaaatgcctgccaggccttccccctggacctgtgcacagacagcttcttcaccagcagaagacctgccctggaggcccggctgcagctgattcatgatgcccctgaggagagcctgcgggcctgggtggccgccacctggcatgagcaggagggccgggtggccagcctggtgtcctgggaccgcttcaccagcctgcagcaggcccaggacctggtgtcctgcctgggcggccctgtgctgtctggagtgtgccgccacctggccgctgacttccgccactgccggggcggcctgcctgacctggtggtgtggaacagccagagccgccacttcaagctggtggaggtgaagggccccaatgaccggctgagccacaagcagatgatctggctggccgagctgcagaagctgggcgctgaggtggaggtgtgccacgtggtggccgtgggcgccaagagccagagcctgtcctag

SEQ ID NO: 15480 - DNA, 1602 bp, Artificial Sequence
  Description of Artificial Sequence: Synthetic coding sequence
atgatgtctgagggcaagcccccagacaagaagaggccccggcgcagcctgagcatcagcaagaacaagaagaaggccagcaacagcatcatcagctgcttcaacaatgcccccccagccaagctggcctgccctgtgtgcagcaagatggtgcccaggtatgacctgaacagacacctggatgagatgtgtgccaacaatgactttgtgcaggtggaccccggccaggtgggcctcatcaacagcaatgtgtccatggtggacctgacctctgtgaccctggaggatgtgacccccaagaagagccccccacccaagaccaacctgaccccaggccagagcgacagcgccaagcgggaggtgaagcagaagatcagcccctacttcaagagcaatgatgtggtgtgcaagaaccaggatgagctgaggaacagatctgtgaaggtgatctgcctgggcagcctggccagcaagctgagcaggaaatatgtgaaggccaagaagagcattgacaaggatgaggagtttgctggcagcagcccccagagcagcaagagcacagtggtgaagagcctgattgacaacagcagcgagattgaagatgaggaccagatcctggagaacagcagccagaaggaaaatgtgttcaagtgtgacagcctgaaggaggagtgcatccctgagcacatggtgcggggcagcaagatcatggaggccgagagccagaaggccaccagagaatgtgagaagagcgccctgaccccaggcttcagtgacaatgccatcatgctgttctccccagacttcaccctgaggaacaccctgaagagcaccagcgaggacagcctggtgaagcaggagtgcatcaaggaggtggtggagaagcgggaggcctgccactgtgaggaggtgaagatgacagtggccagcgaggccaagatccagctgagtgacagcgaggccaagagccacagcagcgcagatgatgccagcgcctggagcaacatccaggaggcccccctgcaggatgacagctgcctgaacaatgacatcccccacagcatccccctggagcagggcagcagctgcaatggacctggccagaccaccggccacccctactacctgcggagcttcctggtggtgctgaagacagtgctggagaatgaagatgacatgctgctgtttgatgagcaggagaagggcatcgtgaccaagttctaccagctgagcgccaccggccagaagctgtatgtgcggctcttccagaggaagctgtcctggatcaagatgaccaagctggagtatgaggagatcgccctggacctgacccctgtgattgaggagctgaccaatgccggcttcctgcagacagagagcgagctgcaggagctgtctgaggtgctggagctgctgagcgcccctgagctgaagagcctggccaagaccttccacctggtgaaccccaacggccagaagcagcagctggtggatgccttcctgaagctggccaagcagaggtctgtgtgcacctggggcaagaacaagccaggcattggagctgtgatcctgaagcgcttctgctggctgctgctgcagtag

SEQ ID NO: 15481 - DNA, 1719 bp, Artificial Sequence
  Description of Artificial Sequence: Synthetic coding sequence
atggccgagctggtgcagggccagagcgcccctgtgggcatgaaggccgagggctttgtggatgccctgcaccgggtgcggcagattgctgccaagattgacagcatcccccacctgaacaacagcacccccctggtggaccccagcgtgtatggctatggagtgcagaagaggcccctggatgatggagtgggcaaccagctgggcgccctggtgcaccagaggacagtcatcacagaggagttcaaggtgcctgacaagatggtgggcttcatcatcggccggggcggggagcagatcagccgcatccaggccgagagcggctgcaagatccagatcgccagcgagagcagcggcatccctgagcggccctgtgtgctgaccggcaccccagagagcattgagcaggccaagaggctgctgggccagatcgtggaccgctgcagaaatggacctggcttccacaatgacatcgacagcaacagcaccatccaggagatcctgatcccagccagcaaggtgggcctggtgattggccggggcggggagaccatcaagcagctgcaggagaggactggagtgaagatggtgatgatccaggacggccccctgcccaccggggctgacaagcccctgcgcatcactggagatgccttcaaggtgcagcaggcccgggagatggtgctggagatcatccgggagaaggaccaggccgacttccggggcgtgcggggggacttcaacagcaggatgggcggcggcagcattgaggtgtctgtgcccaggtttgctgtgggcatcgtgattggaagaaatggagagatgatcaagaagatccagaatgatgctggggtgcgcatccagttcaagccagatgatggcatcagccctgagcgggccgcccaggtgatgggccccccagaccgctgccagcacgccgcccacatcatcagcgagctgatcctgacagcccaggagagagatggctttggaggcctggccgccgcccggggccggggccggggccgcggggactggagcgtgggcgcccctggaggagtgcaggagatcacctacacagtgcctgctgacaagtgtggcctggtgattggaaaaggaggagagaacatcaagagcatcaaccagcagagcggggcccacgtggagctgcagaggaaccccccacccaacagcgaccccaacctgcggcgcttcaccatccggggcgtgccccagcagatcgaggtggcccggcagctgattgatgagaaggtgggcggcaccaacctgggcgcccctggggccttcggccagagccccttcagccagcccccagccccaccccaccagaacaccttcccccccaggagcagcggctgcttccccaacatggccgccaaggtgaatggaaacccccacagcacccctgtgtctggccccccagccttcctgacccagggctggggcagcacctaccaggcctggcagcagcccacccagcaggtgcccagccagcagagccagccccagagcagccagcccaactacagcaaggcctgggaggactactacaagaagcagagccacgccgccagcgctgccccccaggccagcagccccccagactacaccatggcctgggccgagtactaccggcagcaggtggccttctacggccagaccctgggccaggcccaggcccacagccaggagcagtag

SEQ ID NO: 15482 - DNA, 927 bp, Artificial Sequence
  Description of Artificial Sequence: Synthetic coding sequence
atgaaggccgagggctttgtggatgccctgcaccgggtgcggcagattgctgccaagattgacagcatcccccacctgaacaacagcacccccctggtggaccccagcgtgtatggctacggcgtgcagaagaggcccctggatgatggagtgggcaaccagctgggcgccctggtgcaccagaggacagtcatcacagaggagttcaaggtgcctgacaagatggtgggcttcatcatcggccggggcggggagcagatcagccgcatccaggccgagagcggctgcaagatccagatcgccagcgagagcagcggcatccctgagcggccctgtgtgctgaccggcaccccagagagcattgagcaggccaagaggctgctgggccagatcgtggaccgctgcagaaatggacctggcttccacaatgacatcgacagcaacagcaccatccaggagatcctgatcccagccagcaaggtgggcctggtgattggccggggcggggagaccatcaagcagctgcaggagaggactggagtgaagatggtgatgatccaggacggccccctgcccactggagctgacaagcccctgcgcatcactggagatgccttcaaggtgcagcaggcccgggagatggtgctggagatcatccgggagaaggaccaggccgacttccggggcgtgcggggggacttcaacagcaggatgggcggcggcagcattgaggtgtctgtgcccaggtttgctgtgggcatcgtcatcggcagaaatggagagatgatcaagaagatccagaatgatgctggggtgcgcatccagttcaagccagatgatggcatcagccctgagtactaccggcagcaggtggccttctacggccagaccctgggccaggcccaggcccacagccaggatgaatag

SEQ ID NO: 15483 - DNA, 786 bp, Artificial Sequence
  Description of Artificial Sequence: Synthetic coding sequence
atgccacccatcggcaaccagctgggcgccctggtgcaccagaggacagtcatcacagaggagttcaaggtgcctgacaagatggtgggcttcatcatcggccggggcggggagcagatcagccgcatccaggccgagagcggctgcaagatccagatcgccagcgagagcagcggcatccctgagcggccctgtgtgctgaccggcaccccagagagcattgagcaggccaagaggctgctgggccagatcgtggaccgctgcagaaatggacctggcttccacaatgacatcgacagcaacagcaccatccaggagatcctgatcccagccagcaaggtgggcctggtgattggccggggcggggagaccatcaagcagctgcaggagaggactggagtgaagatggtgatgatccaggacggccccctgcccaccggggctgacaagcccctgcgcatcactggagatgccttcaaggtgcagcaggcccgggagatggtgctggagatcatccgggagaaggaccaggccgacttccggggcgtgcggggggacttcaacagcaggatgggcggcggcagcattgaggtgtctgtgcccaggtttgctgtgggcatcgtgattggaagaaatggagagatgatcaagaagatccagaatgatgctggggtgcgcatccagttcaagccagatgatggcatcagccctgagtactaccggcagcaggtggccttctacggccagaccctgggccaggcccaggcccacagccaggagcagtag

SEQ ID NO: 15484 - DNA, 597 bp, Artificial Sequence
  Description of Artificial Sequence: Synthetic coding sequence
atgggcaagcagaagaagaccaggaaatatgccaccatgaagaggatgctgagcctgcgggaccagaggctgaaggagaaggaccggctgaagcccaagaagaaggagaagaaggaccccagcgccctgaaggagcgggaggtgccccagcaccccagctgcctcttcttccagtacaacacccagctgggccccccctaccacatcctggtggacaccaacttcatcaacttcagcatcaaggccaagctggacctggtgcagagcatgatggactgcctgtatgccaagtgcatcccctgcatcacagactgtgtgatggccgagattgagaagctgggccagaagtacagagtggccctgagaattgccaaggaccccaggtttgagcggctgccctgcacccacaagggcacctatgcagatgactgcctggtgcagagggtgacccagcacaagtgctacatcgtggccaccgtggaccgggacctgaagaggcgcatcaggaagatccctggggtgcccatcatgtacatcagcaaccaccgctacaacatcgagaggatgccagatgattatggagccccccgcttctag

SEQ ID NO: 15485 - DNA, 501 bp, Artificial Sequence
  Description of Artificial Sequence: Synthetic coding sequence
atggccgcctacccagagagctgtgtggacaccaccgtgctggactttgtggccgacctgagcctggccagcccccggcggcccctgctgtgtgactttgcccctggggtgtccctgggggaccctgccctggccctgcgggagggccggcccaggaggatggccaggtttgaggagggggaccctgaggaggaggagtgtgaggtggaccagggagatggagaggaggaggaggaggaggagcggggccggggcgtgtccctgctgggccggcccaagaggaagagggtcatcacctacgcccagaggcaggccgccaacatccgggagaggaagaggatgttcaacctgaatgaggcctttgaccagctgcggaggaaggtgcccacctttgcctatgagaagaggctgagccgcatcgagaccctgcggctggccatcgtgtacatctccttcatgacagagctgctggagagctgtgagaagaaggagagcggctag

SEQ ID NO: 15486 - DNA, 2280 bp, Artificial Sequence
  Description of Artificial Sequence: Synthetic coding sequence
atgatcagcagcacctctgtgtatggcctgaagatgcagtggaccccagagcacgcccagtggccagagcagcactttgacatcaccagcaccaccaggagccctgcccacaaggtggaggcctaccggggccacctgcagaggacctaccagtatgcctgggccaatgatgacatcagcgccctgacagccagcaacctgctgaagaagtatgcagagaagtacagcggcatcctggagggccctgtggacaggcctgtgctgagcaactacagcgacacccccagcggcctggtgaatggaaggaagaatgaaagtgagccctggcagcccagcctgaacagcgaggccgtgtaccccatgaactgtgtgcctgatgtgatcacagccagcaaggccggcgtgtcctctgccctgcccccagcagatgtgtctgccagcatcggcagcagccctggggtggccagcaacctgacagagcccagctacagcagcagcacctgtggcagccacacagtgcccagcctgcacgccggcctgcccagccaggagtatgcccctggctacaacggcagctacctgcacagcacctacagcagccagcctgccccagccctgcccagcccccaccccagccccctgcacagcagcggcctgctgcagcccccacctcctcctcctcctcctccagccctggtgcccggctacaacggcaccagcaacctgagcagctacagctaccccagcgccagctacccaccccagacagctgtgggcagcggctacagccctgggggcgcccctcctccacccagcgcctacctgcccagcggcatcccagcccccacccccctgccccccaccaccgtgcccggctacacctaccagggccacggcctgacccccatcgcccccagcgccctgaccaacagcagcgccagcagcctgaagaggaaggccttctacatggccggccagggcgacatggacagcagctatggcaactacagctatggccagcagaggagcacccagagccccatgtacaggatgccagacaacagcatcagcaacaccaacagaggaaatggatttgacagatctgctgagaccagcagcctggccttcaagcccaccaagcagctgatgagcagcgagcagcagaggaagttcagcagccagagcagccgggccctgaccccacccagctacagcacagccaagaacagcctgggcagccgcagcagcgagagctttgggaagtacaccagccctgtgatgtctgagcacggagatgagcaccggcagctgctgagccaccccatgcagggccctggcctgcgggccgccaccagcagcaaccacagcgtggatgagcagctgaagaacacagacacccacctgattgacctggtgaccaatgagatcatcacccagggcccccctgtggactggaatgacattgctggcctggacctggtgaaggccgtcatcaaggaggaggtgctgtggcctgtgctgcggagtgatgccttcagcggcctgacagccctgcccaggagcatcctgctgtttggcccccggggcaccgggaagaccctgctgggccgctgcatcgccagccagctgggcgccaccttcttcaagattgctggcagcggcctggtggccaagtggctgggggaggccgagaagatcatccacgccagcttcctggtggcccgctgccggcagcccagcgtcatctttgtgtctgacatcgacatgctgctgagcagccaggtgaatgaggagcacagccctgtgtccaggatgaggacagagttcctgatgcagctggacacagtgctgaccagcgctgaggaccagatcgtggtgatctgtgccaccagcaagccagaggagattgatgagagcctgcggcgctacttcatgaagaggctgctgatccccctgcctgacagcacagcccggcaccagatcatcgtgcagctgctgagccagcacaactactgcctgaatgacaaggagtttgccctgctggtgcagaggacagagggcttcagcggcctggatgtggcccacctgtgccaggaggccgtggtgggccccctgcacgccatgcctgccacagacctgagcgccatcatgcccagccagctgcggcctgtgacctaccaggactttgaaaatgccttctgcaagatccagcccagcatcagccagaaggagctggacatgtatgtggagtggaacaagatgtttggctgcagccagtag

SEQ ID NO: 15487 - DNA, 1050 bp, Artificial Sequence
  Description of Artificial Sequence: Synthetic coding sequence
atggagaccccacctgtgaacaccatcggggagaaggacaccagccagccccagcaggagtgggagaagaacctgcgggagaacctggacagcgtcatccagatccggcagcagccccgggaccccccaacagagaccctggagctggaggtgtccccagaccctgccagccagatcctggagcacacccagggcgctgagaagctggtggccgagctggagggggacagccacaagagccacggcagcaccagccagatgcctgaggccctgcaggccagtgacctgtggtactgcccagatggcagctttgtgaagaagatcgtcatccggggccacggcctggacaagcccaagctgggcagctgctgccgggtgctggccctgggcttcccctttggaagtggccccccagagggctggacagagctgaccatgggcgtgggcccctggagggaggagacctggggcgagctgattgagaagtgcctggagagcatgtgccagggcgaggaggccgagctgcagctgcccggccacagcggcccccctgtgcggctgaccctggccagcttcacccagggccgggacagctgggagctggagaccagcgagaaggaggccctggcccgggaggagcgggcccggggcacagagctgttccgggccggcaaccctgagggcgccgcccgctgctacggccgggccctgcggctgctgctgaccctgcccccacctggccccccagagaggacagtgctgcacgccaacctggccgcctgccagctgctgctgggccagccccagctggccgcccagagctgtgacagagtgctggagcgggagcccggccacctgaaggccctgtacagaagaggagtggcccaggccgccctgggcaacctggagaaggccacagctgacctgaagaaggtgctggccatcgaccccaagaacagagctgcccaggaggagctgggcaaggtggtgatccagggcaagaaccaggatgctggcctggcccagggcctgaggaagatgtttggatag

SEQ ID NO: 15488 - DNA, 1050 bp, Artificial Sequence; identical to SEQ ID NO: 15487
  Description of Artificial Sequence: Synthetic coding sequence

SEQ ID NO: 15489 - DNA, 1050 bp, Artificial Sequence; identical to SEQ ID NO: 15487
  Description of Artificial Sequence: Synthetic coding sequence

SEQ ID NO: 15490 - DNA, 2151 bp, Artificial Sequence
  Description of Artificial Sequence: Synthetic coding sequence
atgcccctgcctgagcccagcgagcaggagggggagagcgtgaaggccggccaggagcccagccccaagccaggcacagatgtgatcccagctgcccccaggaagccccgggagttcagcaagctggtgctgctgacagccagtgaccaggatgaagatggagtgggcagcaagccccaggaggtgcactgtgtgctgagcctggagatggccggccctgccaccctggccagcaccctgcagatcctgcctgtggaggagcagggcggcgtggtgcagcctgccctggagatgcctgagcagaagtgcagcaagctggatgctgctgccccccagagcctggagttcctgcggaccccatttggaggccgcctgctggtgctggagagcttcctgtacaagcaggagaaggctgtgggggacaaggtgtactggaagtgccggcagcacgccgagctgggctgccggggccgggccatcacccggggcctgcgggccaccgtgatgaggggccactgccacgccccagatgagcagggcctggaggcccggcggcagcgggagaagctgcccagcctggccctgcctgagggcctgggggagccccagggccctgagggccctgggggccgggtggaggagcccctggagggcgtgggcccctggcagtgcccagaggagcctgagcccaccccaggcctggtgctgagcaagccagccctggaggaggaggaggccccccgggccctgagcctgctgagcctgccccccaagaagaggagcatcctgggcctgggccaggcccggcccctggagttcctgcggacctgctacggcggcagcttcctggtgcatgagagcttcctgtacaagcgggagaaggctgtgggggacaaggtgtactggacctgccgggaccacgccctgcacggctgccgcagccgggccatcacccagggccagagggtgacagtgatgaggggccactgccaccagcctgacatggagggcctggaggcccggcggcagcaggagaaggctgtggagaccctgcaggccggccaggacggccctggcagccaggtggacaccctgctgcggggcgtggacagcctgctgtacagaagaggccctggccccctgaccctgacccggccccggcccaggaagagggccaaggtggaggaccaggagctgcccacccagcctgaggccccagatgagcaccaggacatggatgctgaccccggcggccctgagttcctgaagacccccctgggcggcagcttcctggtgtatgagagcttcctgtacagaagagagaaggccgccggggagaaggtgtactggacctgccgggaccaggccaggatgggctgccgcagccgggccatcacccagggcagaagagtgacagtgatgaggggccactgccaccccccagacctgggcggcctggaggccctgcggcagcgggagaagaggcccaacacagcccagaggggcagccctgggggccctgagttcctgaagacccccctgggcggcagcttcctggtgtatgagagcttcctgtacagaagagagaaggccgccggggagaaggtgtactggacctgccgggaccaggccaggatgggctgccgcagccgggccatcacccagggcagaagagtgatggtgatgagaagacactgccaccccccagacctgggcggcctggaggccctgcggcagcgggagcacttccccaacctggcccagtgggacagcccagaccccctgcggcccctggagttcctgcggaccagcctgggcggccgcttcctggtgcatgagagcttcctgtacaggaaggagaaggctgctggggagaaggtgtactggatgtgccgggaccaggcccggctgggctgccgcagccgggccatcacccagggccaccgcatcatggtgatgaggagccactgccaccagcctgacctggccggcctggaggccctgcggcagcgggagcggctgcccaccacagcccagcaggaggaccctgagaagatccaggtgcagctgtgcttcaagacctgcagccctgagagccagcagatctatggagacatcaaggatgtgcggctggatggagagagccagtag

SEQ ID NO: 15491 - DNA, 987 bp, Artificial Sequence
  Description of Artificial Sequence: Synthetic coding sequence
atgccccaggccaccagcccccccctgtggcccctgagcctgcatggaggcaagggcatcctgtgggcccggcacagccaccccccaggcccccccagccaccacatccaggacagcggccgctgcagcctgcccctgccccagagccctggggtgacccccctgcctgcccggctgagcggggccacccccctgagccccatccggctgctgagcagctttgtgccccggggccccagggtcatccccctgaccaaccaggcccggaggaccctgcacgccagcctgggcggctgctggggccgcaccagtgatgctgctgacacagccagcctgaaggcctggcagggcggccctgagttcctgaagacccccctgggcggcagcttcctggtgtatgagagcttcctgtacagaagagagaaggccgccggggagaaggtgtactggacctgccgggaccaggccaggatgggctgccgcagccgggccatcacccagggcagaagagtgatggtgatgagaagacactgccaccccccagacctgggcggcctggaggccctgcggcagcgggagcacttccccaacctggcccagtgggacagcccagaccccctgcggcccctggagttcctgcggaccagcctgggcggccgcttcctggtgcatgagagcttcctgtacaggaaggagaaggctgctggggagaaggtgtactggatgtgccgggaccaggcccggctgggctgccgcagccgggccatcacccagggccaccgcatcatggtgatgaggagccactgccaccagcctgacctggccggcctggaggccctgcggcagcgggagcggctgcccaccacagcccagcaggaggaccctgagaagatccaggtgcagctgtgcttcaagacctgcagccctgagagccagcagatctatggagacatcaaggatgtgcggctggatggagagagccagtag

SEQ ID NO: 15492 - DNA, 2298 bp, Artificial Sequence
  Description of Artificial Sequence: Synthetic coding sequence
atgcccctgcctgagcccagcgagcaggagggggagagcgtgaaggccggccaggagcccagccccaagccaggcacagatgtgatcccagctgcccccaggaagccccgggagttcagcaagctggtgctgctgacagccagtgaccaggatgaagatggagtgggcagcaagccccaggaggtgcactgtgtgctgagcctggagatggccggccctgccaccctggccagcaccctgcagatcctgcctgtggaggagcagggcggcgtggtgcagcctgccctggagatgcctgagcagaagtgcagcaagctggatgctgctgccccccagagcctggagttcctgcggaccccatttggaggccgcctgctggtgctggagagcttcctgtacaagcaggagaaggctgtgggggacaaggtgtactggaagtgccggcagcacgccgagctgggctgccggggccgggccatcacccggggcctgcgggccaccgtgatgaggggccactgccacgccccagatgagcagggcctggaggcccggcggcagcgggagaagctgcccagcctggccctgcctgagggcctgggggagccccagggccctgagggccctgggggccgggtggaggagcccctggagggcgtgggcccctggcagtgcccagaggagcctgagcccaccccaggcctggtgctgagcaagccagccctggaggaggaggaggccccccgggccctgagcctgctgagcctgccccccaagaagaggagcatcctgggcctgggccaggcccggcccctggagttcctgcggacctgctacggcggcagcttcctggtgcatgagagcttcctgtacaagcgggagaaggctgtgggggacaaggtgtactggacctgccgggaccacgccctgcacggctgccgcagccgggccatcacccagggccagagggtgacagtgatgaggggccactgccaccagcctgacatggagggcctggaggcccggcggcagcaggagaaggctgtggagaccctgcaggccggccaggacggccctggcagccaggtggacaccctgctgcggggcgtggacagcctgctgtacagaagaggccctggccccctgaccctgacccggccccggcccaggaagagggccaaggtggaggaccaggagctgcccacccagcctgaggccccagatgagcaccaggacatggatgctgaccccggcggccctgagttcctgaagacccccctgggcggcagcttcctggtgtatgagagcttcctgtacagaagagagaaggccgccggggagaaggtgtactggacctgccgggaccaggccaggatgggctgccgcagccgggccatcacccagggcagaagagtgacagtgatgaggggccactgccaccccccagacctgggcggcctggaggccctgcggcagcgggagaagaggcccaacacagcccagaggggcagccctggggccggcctgtccttccagtggctgttccgcatcctgcagctgctgggccacgcccctgtgctgctgtgccccagcggcagcagctgcctgcccagcctgcctgccccccacggcccctgcccagccctgagcatccccctggagggcggccctgagttcctgaagacccccctgggcggcagcttcctggtgtatgagagcttcctgtaccgccgggagaaggctgctggggagaaggtgtactggacctgccgggaccaggccaggatgggctgccgcagccgggccatcacccagggccggcgggtgatggtgatgaggaggcactgccaccccccagacctgggcggcctggaggccctgcggcagcgggagcacttccccaacctggcccagtgggacagcccagaccccctgcggcccctggagttcctgcggaccagcctgggcggccgcttcctggtgcatgagagcttcctgtacaggaaggagaaggccgccggggagaaggtgtactggatgtgccgggaccaggcccggctgggctgccgcagccgggccatcacccagggccaccgcatcatggtgatgaggagccactgccaccagcctgacctggccggcctggaggccctgcggcagcgggagcggctgcccaccacagcccagcaggaggaccctgagaagatccaggtgcagctgtgcttcaagacctgcagccctgagagccagcagatctacggggacatcaaggatgtgcggctggatggagagagccagtag

SEQ ID NO: 15493 - DNA, 2148 bp, Artificial Sequence
  Description of Artificial Sequence: Synthetic coding sequence
atgcccctgcctgagcccagcgagcaggagggggagagcgtgaaggccggccaggagcccagccccaagccaggcacagatgtgatcccagctgcccccaggaagccccgggagttcagcaagctggtgctgctgacagccagtgaccaggatgaagatggagtgggcagcaagccccaggaggtgcactgtgtgctgagcctggagatggccggccctgccaccctggccagcaccctgcagatcctgcctgtggaggagcagggcggcgtggtgcagcctgccctggagatgcctgagcagaagtgcagcaagctggatgctgccccccagagcctggagttcctgcggaccccatttggaggccgcctgctggtgctggagagcttcctgtacaagcaggagaaggctgtgggggacaaggtgtactggaagtgccggcagcacgccgagctgggctgccggggccgggccatcacccggggcctgcgggccaccgtgatgaggggccactgccacgccccagatgagcagggcctggaggcccggcggcagcgggagaagctgcccagcctggccctgcctgagggcctgggggagccccagggccctgagggccctgggggccgggtggaggagcccctggagggcgtgggcccctggcagtgcccagaggagcctgagcccaccccaggcctggtgctgagcaagccagccctggaggaggaggaggccccccgggccctgagcctgctgagcctgccccccaagaagaggagcatcctgggcctgggccaggcccggcccctggagttcctgcggacctgctatggaggcagcttcctggtgcatgagagcttcctgtacaagcgggagaaggctgtgggggacaaggtgtactggacctgccgggaccacgccctgcacggctgccgcagccgggccatcacccagggccagagggtgacagtgatgaggggccactgccaccagcctgacatggagggcctggaggcccggcggcagcaggagaaggctgtggagaccctgcaggccggccaggacggccctggcagccaggtggacaccctgctgcggggcgtggacagcctgctgtaccgccggggccctggccccctgaccctgacccggccccggcccaggaagagggccaaggtggaggaccaggagctgcccacccagcctgaggccccagatgagcaccaggacatggatgctgaccccggcggccctgagttcctgaagacccccctgggcggcagcttcctggtgtatgagagcttcctgtaccgccgggagaaggctgctggggagaaggtgtactggacctgccgggaccaggccaggatgggctgccgcagccgggccatcacccagggccggcgggtgacagtgatgaggggccactgccaccccccagacctgggcggcctggaggccctgcggcagcgggagaagaggcccaacacagcccagaggggcagccctgggggccctgagttcctgaagacccccctgggcggcagcttcctggtgtatgagagcttcctgtaccgccgggagaaggctgctggggagaaggtgtactggacctgccgggaccaggccaggatgggctgccgcagccgggccatcacccagggccggcgggtgatggtgatgaggaggcactgccaccccccagacctgggcggcctggaggccctgcggcagcgggagcacttccccaacctggcccagtgggacagcccagaccccctgcggcccctggagttcctgcggaccagcctgggcggccgcttcctggtgcatgagagcttcctgtacaggaaggagaaggccgccggggagaaggtgtactggatgtgccgggaccaggcccggctgggctgccgcagccgggccatcacccagggccaccgcatcatggtgatgaggagccactgccaccagcctgacctggccggcctggaggccctgcggcagcgggagcggctgcccaccacagcccagcaggaggaccctgagaagatccaggtgcagctgtgcttcaagacctgcagccctgagagccagcagatctacggggacatcaaggatgtgcggctggatggagagagccagtag

SEQ ID NO: 15494 - DNA, 978 bp, Artificial Sequence
  Description of Artificial Sequence: Synthetic coding sequence
atgccccggcccggcaggaacacctacagcgaccagaagccaccctacagctacatcagcctgacagccatggccatccagagcagccctgagaagatgctgcccctgtctgagatctacaagttcatcatggaccgcttcccctactaccgggagaacacccagcgctggcagaacagcctgcggcacaacctgtccttcaatgactgcttcatcaagatcccccggcggccagaccagcccgggaagggcagcttctgggccctgcaccccagctgtggggacatgtttgaaaatggcagcttcctgcggcggaggaagcgcttcaaggtgctgaagagtgaccacctggcccccagcaagccagcagatgctgcccagtacctgcagcagcaggccaagctgcggctgagcgccctggccgccagcggcacccacctgccccagatgcctgctgctgcctacaacctgggcggcgtggcccagcccagcggcttcaagcacccctttgccatcgagaacatcatcgcccgggagtacaagatgcctgggggcctggccttcagcgccatgcagcctgtgcctgctgcctaccccctgcccaaccagctgaccaccatgggcagcagcctgggcaccggctggccccacgtgtatggcagcgctggcatgattgattctgccacccccatctccatggccagcggggactacagcgcctatggagtgcccctgaagcccctgtgccacgccgccggccagaccctgcctgccatccctgtgcccatcaagcccaccccagctgctgtgcctgccctgcctgccctgcctgcccccatccccaccctgctgagcaacagcccccccagcctgagccccaccagcagccagacagccaccagccagagcagccctgccaccccatctgagaccctgaccagccctgccagcgccctgcacagcgtggccgtgcactag

SEQ ID NO: 15495 - DNA, 1299 bp, Artificial Sequence
  Description of Artificial Sequence: Synthetic coding sequence
atgcccaggcctgggaagagcagctacagcgaccagaagccaccctacagctacatcagcctgacagccatggccatccagcacagcgctgagaagatgctgcccctgagtgacatctacaagttcatcatggagcgcttcccctactaccgggagcacacccagcgctggcagaacagcctgcggcacaacctgtccttcaatgactgcttcatcaagatcccccggcggccagaccagcccgggaagggcagcttctgggccctgcacccagactgtggggacatgtttgaaaatggcagcttcctgcggcggaggaagcgcttcaaggtgctgcgggctgaccacacccacctgcatgctggcagcaccaagagcgcccctggggccggccctgggggccacctgcacccccaccaccaccaccacccccaccaccaccaccaccaccacgccgccgcccaccaccaccaccaccaccaccccccccagcccccacctcctcctcctcctcctccaccccacatggtgcactacttccaccagcagcccccaacagccccccagcccccaccccacctgcccagccagcccccccagcagcccccccagcagagccagccccagcagcccagccaccctgggaagatgcaggaggccgctgctgtggccgctgctgctgctgctgctgctgctgctgctgtgggctctgtgggccgcctgagccagtttcctccctacggcctgggcagcgctgctgctgctgctgctgctgctgctgccagcaccagcggcttcaagcacccctttgccatcgagaacatcatcggccgggactacaagggcgtgctgcaggccggcggcctgcccctggcctctgtgatgcaccacctgggctaccctgtgcccggccagctgggcaatgtggtgtcctctgtgtggccccacgtgggcgtgatggacagcgtggccgctgctgctgctgctgctgctgctgctggggtgcctgtgggcccagaatatggagccttcggcgtgcctgtgaagagcctgtgccacagcgccagccagagcctgcctgccatgcctgtgcccatcaagcccaccccagccctgccccctgtgtctgccctgcagcccggcctgactgtgcctgctgccagccagcagcccccagcccccagcacagtgtgcagcgctgctgctgccagccctgtggccagcctgctggagcccacagcccccaccagcgctgagagcaaaggaggcagcctgcacagcgtgctggtgcacagctag

SEQ ID NO: 15496 - DNA, 1251 bp, Artificial Sequence
  Description of Artificial Sequence: Synthetic coding sequence
atgaacctgcccagggctgagcggcccaggagcaccccccagaggagcctgcgggacagtgatggagaagatggcaagattgatgtgctgggggaggaggaggatgaagatgaggtggaggatgaggaggaggaggcccggcagcagttcctggagcagagcctgcagcccggcctgcaggtggcccgctggggcggcgtggccctgccccgggagcacatcgagggcggcggcggccccagcgaccccagcgagtttggcaccaagttccgggccccacccaggtctgctgctgcctctgaagatgcccggcagcctgccaagccaccctacagctacatcgccctgatcaccatggccatcctgcagaacccccacaagaggctgaccctgagcggcatctgtgccttcatcagcggccgcttcccctactacagaaggaagtttcctgcctggcagaacagcatccgccacaacctgagcctgaatgactgctttgtgaagatcccccgggagcccggccaccctgggaagggcaactactggagcctggaccctgccagccaggacatgtttgacaatggcagcttcctgcggcggaggaagcgcttcaagaggcaccagctgacccctggggcccacctgccccaccccttccccctgcctgctgcccacgccgccctgcacaacccccaccctggccccctgctgggcgccccagccccaccccagcctgtgcctggggcctaccccaacacagcccctggaagaagaccctatgccctgctgcacccccaccccctgcgctacctgctgctgagcgcccgggtgtatgctggggcccccaagaaggccgagggcgctgacctggccaccccagcccccttcccctgctgcagcccccacctggtgctgagcctgggcagaagagcccgggtgtggaggaggcaccgggaggctgatgccagcctgagcgccctgcgggtgctgtgcaagggcagcggggagcgggtgcagggcctgcggcgggtgtgcccccggcccaggggggccacagccacctgcagcagtgaccaccaggcctgctgcatccccaagcccctgcccctgtgctgcaagtgccccccacccctgctgctgggccagttctgcagcaacagcagcagcatcagaagaacagcccccacagctgccctgcccccccgggcccgctgctgggccggcacctgccggccccggcggcgctgctag

SEQ ID NO: 15497 - DNA, 1251 bp, Artificial Sequence
  Description of Artificial Sequence: Synthetic coding sequence
atgaacctgcccagggctgagcggcccaggagcaccccccagaggagcctgcgggacagtgatggagaagatggcaagattgatgtgctgggggaggaggaggatgaagatgaggtggaggatgaggaggaggaggcccggcagcagttcctggagcagagcctgcagcccggcctgcaggtggcccgctggggcggcgtggccctgccccgggagcacatcgagggcggcggcggccccagcgaccccagcgagtttggcaccaagttccgggccccacccaggtctgctgctgcctctgaagatgcccggcagcctgccaagccaccctacagctacatcgccctgatcaccatggccatcctgcagaacccccacaagaggctgaccctgagcggcatctgtgccttcatcagcggccgcttcccctactacagaaggaagtttcctgcctggcagaacagcatccgccacaacctgagcctgaatgactgctttgtgaagatcccccgggagcccggccaccctgggaagggcaactactggagcctggaccctgccagccaggacatgtttgacaatggcagcttcctgcggcggaggaagcgcttcaagaggcaccagctgacccctggggcccacctgccccaccccttccccctgcctgctgcccacgccgccctgcacaacccccaccctggccccctgctgggcgccccagccccaccccagcctgtgcctggggcctaccccaacacagcccctggccgctgcccctatgccctgctgcacccccaccccctgcgctacctgctgctgagcgcccctgtgtatgctggggcccccaagaaggccgagggcgctgacctggccaccccagcccccttcccctgctgcagcccccacctggtgctgagcctgggcagaagagcccgggtgtggaggaggcaccgggaggctgatgccagcctgagcgccctgcgggtgctgtgcaagggcagcggggagcgggtgcagggcctgcggcgggtgtgcccccggcccaggggggccacagccacctgcagcagtgaccaccaggcctgctgcatccccaagcccctgcccctgtgctgcaagtgccccccacccctgctgctgggccagttctgcagcaacagcagcagcatcagaagaacagcccccacagctgccctgcccccccgggcccgctgctgggccggcacctgccggccccggcggcgctgctag

SEQ ID NO: 15498 - DNA, 1254 bp, Artificial Sequence
  Description of Artificial Sequence: Synthetic coding sequence
atgaacctgcccagggctgagcggctgcggagcaccccccagaggagcctgcgggacagtgatggagaagatggcaagattgatgtgctgggggaggaggaggatgaagatgaggtggaggatgaggaggaggccgccagccagcagttcctggagcagagcctgcagcccggcctgcaggtggcccgctggggcggcgtggccctgccccgggagcacatcgagggcggcggcggccccagcgaccccagcgagtttggcaccaagttccgggccccacccaggtctgctgctgcctctgaagatgcccggcagcctgccaagccaccctacagctacatcgccctgatcaccatggccatcctgcagaacccccacaagaggctgaccctgagcggcatctgtgccttcatcagcggccgcttcccctactacagaaggaagtttcctgcctggcagaacagcatccgccacaacctgagcctgaatgactgctttgtgaagatcccccgggagcccggccaccctgggaagggcaactactggagcctggaccctgccagccaggacatgtttgacaatggcagcttcctgcggcggaggaagcgcttcaagaggcaccagctgacccctggggcccacctgccccaccccttccccctgcctgctgcccacgccgccctgcacaacccccaccctggccccctgctgggcgccccagccccaccccagcctgtgcctggggcctaccccaacacagcccctggaagaagaccctatgccctgctgcacccccaccccctgcgctacctgctgctgagcgcccctgtgtatgctggggcccccaagaaggccgagggcgccgccctggccaccccagcccccttcccctgctgcagcccccacctggtgctgagcctgggcagaagagcccgggtgtggaggaggcaccgggaggctgatgccagcctgagcgccctgcgggtgctgtgcaagggcagcggggagcgggtgcagggcctgcggcgggtgtgcccccggcccaggggggccacagccacctgcagcagtgaccaccaggcctgctgcatcccccggcccctgcccctgtgctgcaagtgccccccaccacccctgctgggccagttctgcagcaacagcagcagcatcagaagaagaacagcccccacagctgccctgcccccccgggcccgctgctgggccggcacctgccggccccggcggccctgctag

SEQ ID NO: 15499 - DNA, 1140 bp, Artificial Sequence
  Description of Artificial Sequence: Synthetic coding sequence
atgagcagcgcccctgagaagcagcagcccccccacggcggcggcggcggcggcggcggcggcggcggggccgccatggaccctgccagcagcggccccagcaaggccaagaagaccaatgccggcatccggcggcctgagaagccaccctacagctacatcgccctgattgtgatggccatccagagcagccccaccaagaggctgaccctgtctgagatctaccagttcctgcagagccgcttccccttcttccggggcagctaccagggctggaagaacagcgtgcgccacaacctgagcctgaatgaatgcttcatcaagctgcccaagggcctgggccggcctgggaagggccactactggaccatcgaccctgccagcgagttcatgtttgaggagggcagcttcagaagaagaccccggggcttccggaggaagtgccaggccctgaagcccatgtacagcatgatgaatggcctgggcttcaaccacctgcctgacacctacggcttccagggcagcgctgggggcctgagctgcccccccaacagcctggccctggagggcggcctgggcatgatgaatggccacctgcctggaaatgtggatggcatggccctgcccagccacagcgtgccccacctgcccagcaatggaggccacagctacatgggcggctgcggcggcgctgctgctggggagtacccccaccacgacagctctgtgcctgccagccccctgctgcccactggagctggaggagtgatggagccccatgctgtgtacagcggcagcgctgctgcctggcccccatctgccagcgctgccctgaacagcggggccagctacatcaagcagcagcccctgagcccctgcaacccagctgccaaccccctgagcggcagcctgagcacccacagcctggagcagccctacctgcaccagaacagccacaatgccccagctgagctgcagggcatcccccgctaccacagccagagccccagcatgtgtgacaggaaggagtttgtgttctccttcaatgccatggccagcagctccatgcacagcgctgggggcggcagctactaccaccagcaggtgacctaccaggacatcaagccctgtgtgatgtag

SEQ ID NO: 15500 - DNA, 765 bp, Artificial Sequence
  Description of Artificial Sequence: Synthetic coding sequence
ccagccctgcccagcaccctgccccacaggcctgcccccagcaccaggcctggcccctgcccccgctgcctgcccagcaggatgggcccctgcagcggcagccggctgggccccccagaggccgagagccccagccagccccccaagaggaggaagaagcgctacctgcggcatgacaagccaccctacacctacctggccatgattgccctggtgatccaggccgcccccagccggcggctgaagctggcccagatcatccggcaggtgcaggccgtgttccccttcttcagagaagattatgagggctggaaggacagcatccgccacaacctgagcagcaaccgctgcttcaggaaggtgcccaaggaccctgccaagccccaggccaagggcaacttctgggccgtggatgtgtccctcatcccagctgaggccctgcggctgcagaacacagccctgtgccgccgctggcagaatggaggagcccggggggcctttgccaaggacctgggcccctacgtgctgcacggccggccctacagaccacccagccccccacctcctccttctgagggcttcagcatcaagagcctgctgggcggcagcggggagggcgccccctggccaggcctggccccccagagcagccctgtgcctgctggcactggaaacagcggggaggaggccgtgcccaccccacctccacccagcggcggcagctgccccccacccacctgcctgagcaccctgcccatgtggtag

SEQ ID NO: 15501 - DNA, 1098 bp, Artificial Sequence
  Description of Artificial Sequence: Synthetic coding sequence
atgggcccctgcagcggcagccggctgggccccccagaggccgagagccccagccagccccccaagaggaggaagaagcgctacctgcggcatgacaagccaccctacacctacctggccatgattgccctggtgatccaggccgcccccagccggcggctgaagctggcccagatcatccggcaggtgcaggccgtgttccccttcttccgggaggactatgagggctggaaggacagcatccgccacaacctgagcagcaaccgctgcttcaggaaggtgcccaaggaccctgccaagccccaggccaagggcaacttctgggccgtggatgtgtccctcatcccagctgaggccctgcggctgcagaacacagccctgtgccgccgctggcagaatggaggagcccggggggcctttgccaaggacctgggcccctacgtgctgcacggccggccctaccggccccccagccccccacctccacccagcgagggcttcagcatcaagagcctgctgggcggcagcggggagggcgccccctggccaggcctggccccccagagcagccctgtgcctgctggcaccggcaacagcggggaggaggccgtgcccaccccacccctgcccagcagcgagcggcccctgtggcccctgtgccccctgcccggccccaccagggtggagggggagaccgtgcagggcggggccatcggccccagcaccctgagccctgagccccgggcctggcccctgcacctgctgcagggcacagctgtgcctgggggccgcagcagcggcggccaccgggccagcctgtggggccagctgcccaccagctacctgcccatctacacccccaacgtggtgatgcccctggcccccccacccaccagctgcccccagtgccccagcaccagccctgcctactggggcgtggcccctgagacccggggccccccaggcctgctgtgtgacctggatgccctcttccagggcgtgccccccaacaagagcatctatgatgtgtgggtgagccacccccgggacctggccgcccctggccctggctggctgctgtcctggtgcagcctgtag

SEQ ID NO: 15502 - DNA, 957 bp, Artificial Sequence
  Description of Artificial Sequence: Synthetic coding sequence
atggccacctactgtgatgacctgggccccagcagcgcccctcctggccaggcccaggccacagcccaccccccaggctatgagcccggggacctgggcgctgtgggcggcggccccctgctgtgggtgaatgccccagccctgagccccaagagctatgccagcggccctggccctgccccaccctatgctgcccccagctatggagcccctggccccctgctgggcgcccctgggggcctggccggggctgacctggcctggctgagcctgagcggccagcaggagctgctgcggctggtgcggcccccctacagctacagcgccctgattgccatggccatccagagcgcccccctgaggaagctgaccctgagccagatctaccagtatgtggccggcaacttccccttctacaagaggagcaaggccggctggcagaacagcatccgccacaacctgagcctgaatgactgcttcaagaaggtgcccagagatgaagatgaccccgggaagggcaactactggaccctggaccccaactgtgagaagatgtttgacaatggaaacttccggaggaagaggaagagaagagctgaggccagcgctgctgtgcgcagcggggcccggtctgtgggcggcgctgaggccccagccctggagccccccagcgctgcctgcctggacctgcaggccagccccagccccagcgcccctgaggccgccacctgcttcagcggctttgccagcgccatgtctgccctggccggcggcctgggcaccttccctgggggcctggccggggacttctcctttggccggcggccccccaccgtggccacccacgccccccagaccctgaaccccagccctggctttgcccctggccaccagacagctgctgctggcttccggctgagccacctgctgtacagccgggagggcacagaggtgtag

SEQ ID NO: 15503 - DNA, 1725 bp, Artificial Sequence
  Description of Artificial Sequence: Synthetic coding sequence
atggccagtgacctggagagcagcctgaccagcattgactggctgccccagctgaccctgcgggccaccatcgagaagctgggcagcgccagccaggccggccccccaggcagcagcaggaagtgcagccctggcagccccacagaccccaatgccaccctgagcaaggatgaagctgctgtgcaccaggacggcaagccccgctacagctatgccaccctcatcacctacgccatcaacagcagccctgccaagaagatgaccctgtctgagatctaccgctggatctgtgacaacttcccctactacaagaatgccggcatcggctggaagaacagcatccgccacaacctgagcctgaacaagtgcttcaggaaggtgccccggcccagagatgaccccgggaagggcagctactggaccatcgacacctgcccagacatcagcaggaagaggaggcaccccccagatgatgacctgagccaggacagccctgagcaggaggccagcaagagcccccggggcggcgtggccggcagcggggaggccagcctgcccccagagggcaacccccagatgagcctgcagagccccaccagcatcgccagctacagccagggcaccggctctgtggatggcggcgctgtggccgccggggccagcggccgggagagcgctgagggccccccacccctgtacaacaccaaccacgacttcaagttctcctacagcgagatcaacttccaggacctgtcctggagcttcaggaacctgtacaagtccatgctggagaagagcagcagcagcagccagcacggcttcagcagcctgctgggggacatcccccccagcaacaactactacatgtaccagcagcagcagcccccaccaccccagcagcagcagcagcagcagcagcccccccagcccccaccccagcagagccagccccagcagcagcaggccccagcccagggccccagcgctgtgggcggggccccacccctgcacacccccagcacagatggctgcaccccacctgggggcaagcaggccggggctgagggctacggccccccacctgtgatggccatgcaccccccacccctgcagcacggcggctaccacccccaccagcaccacccccacagccacccagcccagcagcccccaccaccccagccccaggcccagggccaggcccccatcaacaacacaggctttgccttccccagcgactggtgcagcaacatcgacagcctgaaggagagcttcaagatggtgaaccggctgaactggagcagcattgagcagagccagttcagcgagctgatggagagcctgcggcaggccgagcagaagaactggaccctggaccagcaccacatcgccaacctgtgtgacagcctgaaccacttcctgacccagacaggccacgtgcccccccagggcggcacccaccggcccccagccccagccagaattgctgacagctgtgccctgaccagcggcaagcaggagagcgccatgagccaggtgaacagctatggccacccccaggccccccacctgtacccaggccccagccccatgtaccccatccccacccaggacagcgctggctacaacagacctgcccaccacatggtgccccggcccagcgtgcccccacctggggccaatgaggagatcccagatgactttgactgggacctgatcacctag

SEQ ID NO: 15504 - DNA, 1581 bp, Artificial Sequence
  Description of Artificial Sequence: Synthetic coding sequence
atggccagtgacctggagagcagcctgaccagcattgactggctgccccagctgaccctgcgggccaccatcgagaagctgggcagcgccagccaggccggccccccaggcagcagcaggaagtgcagccctggcagccccacagaccccaatgccaccctgagcaaggatgaagctgctgtgcaccaggacggcaagccccgctacagctatgccaccctcatcacctacgccatcaacagcagccctgccaagaagatgaccctgtctgagatctaccgctggatctgtgacaacttcccctactacaagaatgccggcatcggctggaagaacagcatccgccacaacctgagcctgaacaagtgcttcaggaaggtgccccggcccagagatgaccccgggaagggcagctactggaccatcgacacctgcccagacatcagcaggaagaggaggcaccccccagatgatgacctgagccaggacagccctgagcaggaggccagcaagagcccccggggcggcgtggccggcagcggggaggccagcctgcccccagagggcaacccccagatgagcctgcagagccccaccagcatcgccagctacagccagggcaccggctctgtggatggcggcgctgtggccgccggggccagcggccgggagagcgctgagggccccccacccctgtacaacaccaaccacgacttcaagttctcctacagcgagatcaacttccaggacctgtcctggagcttcaggaacctgtacaagtccatgctggagaagagcagcagcagcagccagcacggcttcagcagcctgctgggggacatcccccccagcaacaactactacatgtaccagcagcagcagcccccaccaccccagcagcagcagcagcagcagcagcccccccagcccccaccccagcagagccagccccagcagcagcaggccccagcccagggccccagcgctgtgggcggggccccacccctgcacacccccagcacagatggctgcaccccacctgggggcaagcaggccggggctgagggctacggccccccacctgtgatggccatgcaccccccacccctgcagcacggcggctaccacccccaccagcaccacccccacagccacccagcccagcagcccccaccaccccagccccaggcccagggccaggcccccatcaacaacacaggctttgccttccccagcgactggtgcagcaacatcgacagcctgaaggagagcttcaagatggtgaaccggctgaactggagcagcattgagcagagccagttcagcgagctgatggagagcctgcggcaggccgagcagaagaactggaccctggaccagcaccacatcgccaacctgtgtgacagcctgaaccacttcctgacccagacaggccacgtgcccccccagggcggcacccaccggcccccagccccagccagaattgctgacagctgtgccctgaccagcggcaagcaggagagcgccatgagccagggcacagcccccagccagctgccctggcgctggaggctgtgctag

SEQ ID NO: 15505 - DNA, 1869 bp, Artificial Sequence
  Description of Artificial Sequence: Synthetic coding sequence
atgggcctgtatggccaggcctgccccagcgtgaccagcctgaggatgaccagcgagctggagagcagcctgacctccatggactggctgccccagctgaccatgagagctgccatccagaagagtgatgccacccagaatgcccatggaacaggcatcagcaagaagaatgccctgctggaccccaacaccaccctggaccaggaggaggtgcagcagcacaaggatggcaagccaccctacagctatgccagcctcatcacctttgccatcaacagcagccccaagaagaagatgaccctgtctgagatctaccagtggatctgtgacaacttcccctactaccgggaggccggcagcggctggaagaacagcatccgccacaacctgagcctgaacaagtgcttcctgaaggtgcccaggagcaaggatgaccccgggaagggcagctactgggccatcgacaccaaccccaaggaggatgtgctgcccacccggcccaagaagagggcccggtctgtggagcgggccagcaccccctacagcattgacagcgacagcctgggcatggagtgcatcatcagcggcagcgccagccccaccctggccatcaacacagtgaccaacaaggtgaccctgtacaacacagaccaggacggcagtgacagccccaggagcagcctgaacaacagcctgagtgaccagagcctggcctctgtgaacctgaacagcgtgggctctgtgcacagctacacccctgtgaccagccaccctgagagcgtgtcccagagcctgaccccccagcagcagccccagtacaacctgcctgagcgggacaagcagctgctcttcagcgagtacaactttgaggacctgagcgccagcttccgcagcctgtacaagtctgtgtttgagcagagcctgagccagcagggcctgatgaacatccccagcgagagcagccagcagagccacaccagctgcacctaccagcacagccccagcagcacagtgtccacccacccccacagcaaccagagcagcctgagcaacagccacggcagcggcctgaacaccaccggcagcaacagcgtggcccaggtgtccctgagccacccccagatgcacacccagcccagcccccaccccccccaccggccccacggcctgccccagcacccccagaggagcccccacccagccccccacccccagcagcacagccagctgcagagcccccacccccagcaccccagcccccaccagcacatccagcaccaccccaaccaccagcaccagaccctgacccaccaggcccctcctccaccccagcaggtgtcctgcaacagcggcgtgtccaatgactggtacgccaccctggacatgctgaaggagagctgcagaattgccagctctgtgaactggagcgatgtggacctgagccagttccagggcctgatggagagcatgaggcaggccgacctgaagaactggagcctggaccaggtgcagtttgctgacctgtgcagcagcctgaaccagttcttcacccagacaggcctcatccacagccagagcaatgtgcagcagaatgtgtgccacggggccatgcaccccaccaagcccagccagcacatcggcaccggcaacctgtacatcgacagccggcagaacctgccccccagcgtgatgcctcctcctggctacccccacatcccccaggccctgagcaccccaggcaccaccatggccggccaccaccgggccatgaaccagcagcacatgatgcccagccaggccttccagatgaggaggagcctgcccccagatgacatccaggatgactttgactgggacagcatcgtgtag

SEQ ID NO: 15506 - DNA, 1767 bp, Artificial Sequence
  Description of Artificial Sequence: Synthetic coding sequence
atgggcctgtatggccaggcctgccccagcgtgaccagcctgaggatgaccagcgagctggagagcagcctgacctccatggactggctgccccagctgaccatgagagctgccatccagaagagtgatgccacccagaatgcccatggaacaggcatcagcaagaagaatgccctgctggaccccaacaccaccctggaccaggaggaggtgcagcagcacaaggatggcaagccaccctacagctatgccagcctcatcacctttgccatcaacagcagccccaagaagaagatgaccctgtctgagatctaccagtggatctgtgacaacttcccctactaccgggaggccggcagcggctggaagaacagcatccgccacaacctgagcctgaacaagtgcttcctgaaggtgcccaggagcaaggatgaccccgggaagggcagctactgggccatcgacaccaaccccaaggaggatgtgctgcccacccggcccaagaagagggcccggtctgtggagcgggtgaccctgtacaacacagaccaggacggcagtgacagccccaggagcagcctgaacaacagcctgagtgaccagagcctggcctctgtgaacctgaacagcgtgggctctgtgcacagctacacccctgtgaccagccaccctgagagcgtgtcccagagcctgaccccccagcagcagccccagtacaacctgcctgagcgggacaagcagctgctcttcagcgagtacaactttgaggacctgagcgccagcttccgcagcctgtacaagtctgtgtttgagcagagcctgagccagcagggcctgatgaacatccccagcgagagcagccagcagagccacaccagctgcacctaccagcacagccccagcagcacagtgtccacccacccccacagcaaccagagcagcctgagcaacagccacggcagcggcctgaacaccaccggcagcaacagcgtggcccaggtgtccctgagccacccccagatgcacacccagcccagcccccaccccccccaccggccccacggcctgccccagcacccccagaggagcccccacccagccccccacccccagcagcacagccagctgcagagcccccacccccagcaccccagcccccaccagcacatccagcaccaccccaaccaccagcaccagaccctgacccaccaggcccctcctccaccccagcaggtgtcctgcaacagcggcgtgtccaatgactggtacgccaccctggacatgctgaaggagagctgcagaattgccagctctgtgaactggagcgatgtggacctgagccagttccagggcctgatggagagcatgaggcaggccgacctgaagaactggagcctggaccaggtgcagtttgctgacctgtgcagcagcctgaaccagttcttcacccagacaggcctcatccacagccagagcaatgtgcagcagaatgtgtgccacggggccatgcaccccaccaagcccagccagcacatcggcaccggcaacctgtacatcgacagccggcagaacctgccccccagcgtgatgcctcctcctggctacccccacatcccccaggccctgagcaccccaggcaccaccatggccggccaccaccgggccatgaaccagcagcacatgatgcccagccaggccttccagatgaggaggagcctgcccccagatgacatccaggatgactttgactgggacagcatcgtgtag

SEQ ID NO: 15507 - DNA, 411 bp, Artificial Sequence
  Description of Artificial Sequence: Synthetic coding sequence
atggagagcatgaggcaggccgacctgaagaactggagcctggaccaggtgcagtttgctgacctgtgcagcagcctgaaccagttcttcacccagacaggcctcatccacagccagagcaatgtgcagcagaatgtgtgccacggggccatgcaccccaccaagcccagccagcacatcggcaccggcaacctgtacatcgacagccggcagaacctgccccccagcgtgatgcctcctcctggctacccccacatcccccaggccctgagcaccccaggcaccaccatggccggccaccaccgggccatgaaccagcagcacatgatgcccagccaggccttccagatgaggaggagcctgcccccagatgacatccaggatgactttgactgggacagcatcgtgtag

SEQ ID NO: 15508 - DNA, 1869 bp, Artificial Sequence; identical to SEQ ID NO: 15505
  Description of Artificial Sequence: Synthetic coding sequence

SEQ ID NO: 15509 - DNA, 1869 bp, Artificial Sequence; identical to SEQ ID NO: 15505
  Description of Artificial Sequence: Synthetic coding sequence

SEQ ID NO: 15510 - DNA, 264 bp, Artificial Sequence
  Description of Artificial Sequence: Synthetic coding sequence
atggagtgcatcatcagcggcagcgccagccccaccctggccatcaacacagtgaccaacaaggtgaccctgtacaacacagaccaggacggcagtgacagccccaggagcagcctgaacaacagcctgagtgaccagagcctggcctctgtgaacctgaacagcgtgggctctgtgcacagctacacccctgtgaccagccaccctgagagcgtgtcccagagcctgaccccccagcagcagccccagtacaacctgccctag

SEQ ID NO: 15511 - DNA, 1149 bp, Artificial Sequence
  Description of Artificial Sequence: Synthetic coding sequence
atgggcctgtatggccaggcctgccccagcgtgaccagcctgaggatgaccagcgagctggagagcagcctgacctccatggactggctgccccagctgaccatgagagctgccatccagaagagtgatgccacccagaatgcccatggaacaggcatcagcaagaagaatgccctgctggaccccaacaccaccctggaccaggaggaggtgcagcagcacaaggatggcaagccaccctacagctatgccagcctcatcacctttgccatcaacagcagccccaagaagaagatgaccctgtctgagatctaccagtggatctgtgacaacttcccctactaccgggaggccggcagcggctggaagaacagcatccgccacaacctgagcctgaacaagtgcttcctgaaggtgcccaggagcaaggatgaccccgggaagggcagctactgggccatcgacaccaaccccaaggaggatgtgctgcccacccggcccaagaagagggcccggtctgtggagcgggtgaccctgtacaacacagaccaggacggcagtgacagccccaggagcagcctgaacaacagcctgagtgaccagagcctggcctctgtgaacctgaacagcgtgggctctgtgcacagctacacccctgtgaccagccaccctgagagcgtgtcccagagcctgaccccccagcagcagccccagtacaacctgcctgagcgggacaagcagctgctcttcagcgagtacaactttgaggacctgagcgccagcttccgcagcctgtacaagtctgtgtttgagcagagcctgagccagcagggcctgatgaacatccccagcgagagcagccagcagagccacaccagctgcacctaccagcacagccccagcagcacagtgtccacccacccccacagcaaccagagcagcctgagcaacagccacggcagcggcctgaacaccaccggcagcaacagcgtggcccaggtgtccctgagccacccccagatgcacacccagcccagcccccaccccccccaccggccccacggcctgccccagcacccccagaggagcccccacccagccccccacccccagcagcacagccagctgcagagcccccacccccagtag

SEQ ID NO: 15512 - DNA, 378 bp, Artificial Sequence
  Description of Artificial Sequence: Synthetic coding sequence
gccacccagaatgcccacggcaccggcatcagcaagaagaatgccctgctggaccccaacaccaccctggaccaggaggaggtgcagcagcacaaggatggcaagccaccctacagctatgccagcctcatcacctttgccatcaacagcagccccaagaagaagatgaccctgtctgagatctaccagtggatctgtgacaacttcccctactaccgggaggccggcagcggctggaagaacagcatccgccacaacctgagcctgaacaagtgcttcctgaaggtgcccaggagcaaggatgatcctgggaaggtgggcttcatcttcctgaagcagctgaacagctctgtgtgccacctgagctgcctgaactag

SEQ ID NO: 15513 - DNA, 1869 bp, Artificial Sequence; identical to SEQ ID NO: 15505
  Description of Artificial Sequence: Synthetic coding sequence

SEQ ID NO: 15514 - DNA, 1023 bp, Artificial Sequence
  Description of Artificial Sequence: Synthetic coding sequence
atgatgtgccaccccctggaccagctggccaccaggacccagaagaagagcgccaccagcaagccaccctacagcttcagcctgctgatctacatggccatcgagcacagccccaacaagtgcctgcctgtgaaggagatctacagctggatcctggaccacttcccctactttgccacagcccccaccggctggaagaacagcgtgcgccacaacctgagcctgaacaagtgcttccagaaggtggagaggagccacggcaaggtgaatggcaagggcagcctgtggtgtgtggaccctgagtacaagcccaacctgatccaggccctgaagaagcagcccttcagcagcgccagcagccagaatggcagcctgagcccccactacctgagcagcgtcatcaagcagaaccaggtgaggaacctgaaggagagtgacattgatgctgctgctgccatgatgctgctgaacaccagcattgagcagggcatcctggagtgtgagaagcccctgcccctgaagacagccctgcagaagaagaggagctatggaaatgccttccaccaccccagcgctgtgcggctgcaggagagtgacagcctggccaccagcattgaccccaaggaggaccacaactacagcgccagctccatggccgcccagagatgtgccagccgcagctctgtgagcagcctgagctctgtggatgaggtgtatgagttcatccccaagaacagccacgtgggcagtgatggcagcgagggcttccacagcgaggaggacacagatgtggactatgaagatgaccccctgggggacagcggctacgccagccagccctgtgccaagatcagcgagaagggccagagcggcaagaagatgaggaagcagacctgccaggagattgatgaggagctgaaggaggccgccggcagcctgctgcacctggccggcatccgcacctgcctgggcagcctcatcagcacagccaagacccagaaccagaagcagaggaagaagtag

SEQ ID NO: 15515 - DNA, 1296 bp, Artificial Sequence
  Description of Artificial Sequence: Synthetic coding sequence
atgggccctgtgattggcatgaccccagacaagagagctgagaccccaggagctgagaagattgctggcctgagccagatctacaagatgggcagcctgcctgaggccgtggatgctgcccggcccaaggccaccctggtggacagcgagagcgcagatgatgagctgaccaacctgaactggctgcacgagagcaccaacctgctgaccaacttcagcctgggcagcgagggcctgcccatcgtgagccccctgtatgacatcgagggagatgatgtgcccagctttggacctgcctgctaccagaaccctgagaagaagagcgccaccagcaagccaccctacagcttcagcctgctgatctacatggccatcgagcacagccccaacaagtgcctgcctgtgaaggagatctacagctggatcctggaccacttcccctactttgccacagcccccaccggctggaagaacagcgtgcgccacaacctgagcctgaacaagtgcttccagaaggtggagaggagccacggcaaggtgaatggcaagggcagcctgtggtgtgtggaccctgagtacaagcccaacctgatccaggccctgaagaagcagcccttcagcagcgccagcagccagaatggcagcctgagcccccactacctgagcagcgtcatcaagcagaaccaggtgaggaacctgaaggagagtgacattgatgctgctgctgccatgatgctgctgaacaccagcattgagcagggcatcctggagtgtgagaagcccctgcccctgaagacagccctgcagaagaagaggagctatggaaatgccttccaccaccccagcgctgtgcggctgcaggagagtgacagcctggccaccagcattgaccccaaggaggaccacaactacagcgccagctccatggccgcccagagatgtgccagccgcagctctgtgagcagcctgagctctgtggatgaggtgtatgagttcatccccaagaacagccacgtgggcagtgatggcagcgagggcttccacagcgaggaggacacagatgtggactatgaagatgaccccctgggggacagcggctacgccagccagccctgtgccaagatcagcgagaagggccagagcggcaagaagatgaggaagcagacctgccaggagattgatgaggagctgaaggaggccgccggcagcctgctgcacctggccggcatccgcacctgcctgggcagcctcatcagcacagccaagacccagaaccagaagcagaggaagaagtag

SEQ ID NO: 15516 - DNA, 741 bp, Artificial Sequence
  Description of Artificial Sequence: Synthetic coding sequence
atgggccctgtgattggcatgaccccagacaagagagctgagaccccaggagctgagaagattgctggcctgagccagatctacaagatgggcagcctgcctgaggccgtggatgctgcccggcccaaggccaccctggtggacagcgagagcgcagatgatgagctgaccaacctgaactggctgcacgagagcaccaacctgctgaccaacttcagcctgggcagcgagggcctgcccatcgtgagccccctgtatgacatcgagggagatgatgtgcccagctttggacctgcctgctaccagaaccctgagaagaagagcgccaccagcaagccaccctacagcttcagcctgctgatctacatggccatcgagcacagccccaacaagtgcctgcctgtgaaggagatctacagctggatcctggaccacttcccctactttgccacagcccccaccggctggaagaacagcgtgcgccacaacctgagcctgaacaagtgcttccagaaggtggagaggagccacggcaaggtgaatggcaagggcagcctgtggtgtgtggaccctgagtacaagcccaacctgatccaggccctgaagaagcagcccttcagcagcgccagcagccagaatggcagcctgagcccccactacctgagcagcgtcatcaagcagaaccaggtgaggaacctgaaggagagtgacattgatgctgctgctgccatgatgctgtag

SEQ ID NO: 15517 - DNA, 879 bp, Artificial Sequence
  Description of Artificial Sequence: Synthetic coding sequence
atgggaaatgaactcttcctggccttcaccaccagccacctgcccctggccgagcagaagctggcccgctacaagctgcgcatcgtgaagccacccaagctgcccctggagaagaagcccaacccagacaaggatggccctgactatgagcccaacctgtggatgtgggtgaaccccaacatcgtgtacccacctgggaagctggaggtgtctggaagaaggaagcgggaggacctgaccagcaccctgcccagcagccagcccccccagaaggaggaggatgccagctgcagcgaggccgccggcgtggagagcctgagccagagcagcagcaagaggagcccccccaggaagagatttgccttcagccccagcacctgggagctgacagaggaggaggaggccgaggaccaggaggacagcagctccatggccctgcccagcccccacaagagggcccccctgcagagccggcggctgcggcaggccagcagccaggccggccgcctgtggagccggccccccctgaactacttccacctgattgccctggccctgaggaacagcagcccctgtggcctgaatgtgcagcagatctacagcttcaccaggaagcacttccccttcttcagaacagcccctgagggctggaagaacacagtgcgccacaacctgtgcttccgggacagctttgagaaggtgcctgtgtccatgcagggcggggccagcacccggcccaggagctgcctgtggaagctgacagaggagggccacagaagatttgctgaggaggcccgggccctggccagcacccggctggagagcatccagcagtgcatgagccagccagatgtgatgcccttcctgtttgacctgtag

SEQ ID NO: 15518 - DNA, 936 bp, Artificial Sequence
  Description of Artificial Sequence: Synthetic coding sequence
atggacctgaagctgaaggactgtgagttctggtacagcctgcacggccaggtgcccggcctgctggactgggacatgagaaatgagctgttcctgccctgcaccacagaccagtgcagcctggccgagcagatcctggccaagtacagagtgggcgtgatgaagcccccagagatgccccagaagagaagacccagcccagatggagatggccccccctgtgagcccaacctgtggatgtgggtggaccccaacatcctgtgccccctgggcagccaggaggcccccaagcccagcggcaaggaggacctgaccaacatcagccccttcccccagcccccccagaaggatgagggcagcaactgcagcgaggacaaggtggtggagagcctgcccagcagcagcagcgagcagagccccctgcagaagcagggcatccacagccccagcgactttgagctgacagaggaggaggccgaggagccagatgacaacagcctgcagagccctgagatgaagtgctaccagagccagaagctgtggcagatcaacaaccaggagaagtcctggcagaggcctcccctgaactgcagccacctgattgccctggccctgaggaacaacccccactgcggcctgtctgtgcaggagatctacaacttcacccggcagcacttccccttcttctggacagccccagatggctggaagagcaccatccactacaacctgtgcttcctggacagctttgagaaggtgcctgacagcctgaaggatgaggacaatgcccggcccaggagctgcctgtggaagctgaccaaggagggccaccggcgcttctgggaggagaccagggtgctggcctttgcccagcgggagcgcatccaggagtgcatgagccagcctgagctgctgaccagcctgtttgacctgtag

SEQ ID NO: 15519 - DNA, 993 bp, Artificial Sequence
  Description of Artificial Sequence: Synthetic coding sequence
atgcagcagcagcccctgcccggccctggggcccccaccacagagcccaccaagccaccctacagctacatcgccctgattgccatggccatccagagcagccctggccagagggccaccctgagcggcatctaccgctacatcatgggccgctttgccttctaccgccacaaccggcccggctggcagaacagcatccgccacaacctgagcctgaatgaatgttttgtgaaggtgcccagagatgacaggaagccaggcaagggcagctactggaccctggaccctgactgccacgacatgtttgagcacggcagcttcctgcggaggagaagacgcttcacccggcagacaggagctgagggcacccggggccctgccaaggcccggcggggccccctgcgggccaccagccaggaccccggggtgcccaatgccaccaccggccggcagtgcagcttccccccagagctgcctgaccccaagggcctgagctttggaggcctggtgggcgccatgcctgcctccatgtgcccagccaccacagatggccggccccggccccccatggagcccaaggagatcagcacccccaagccagcctgccctggagagctgcctgtggccaccagcagcagcagctgcccagccttcggcttccctgctggcttcagcgaggccgagagcttcaacaaggcccccacccctgtgctgagccctgagagcggcatcggcagcagctaccagtgccgcctgcaggccctgaacttctgcatgggcgctgaccccggcctggagcacctgctggccagcgctgcccccagccctgccccacccaccccacctggcagcctgcgggcccccctgcccctgcccacagaccacaaggagccctgggtggccggcggcttccctgtgcagggcggcagcggctaccccctgggcctgaccccctgcctgtaccgcaccccaggcatgttcttctttgaatag

SEQ ID NO: 15520 - DNA, 957 bp, Artificial Sequence
  Description of Artificial Sequence: Synthetic coding sequence
atgaaccgcttcggcacccggctggtgggcgccacagccaccagcagccccccacccaaggcccggagcaatgaaaacctggacaagattgacatgagcctggatgacatcatcaagctgaacaggaaggagggcaagaagcagaacttcccccggctgaacagaaggctgctgcagcagagcggggcccagcagttcaggatgagggtgcgctggggcatccagcagaacagcggctttgggaagaccagcctgaacagaagaggccgggtgatgcctgggaagaggcggcccaatggagtcatcaccggcctggccgccaggaagaccaccggcatcaggaagggcatcagccccatgaacagaccacccctgagtgacaagaacatcgagcagtacttccctgtgctgaagaggaaggccaacctgctgcggcagaatgaaggccagaggaagcctgtggccgtgctgaagaggcccagccagctgagcaggaagaacaacatcccagccaacttcaccaggagcggcaacaagctgaaccaccagaaggacacccggcaggccaccttcctgttccggcggggcctgaaggtgcaggcccagctgaacacagagcagctgctggatgatgtggtggccaagaggacccggcagtggaggaccagcaccaccaacggcggcatcctgactgtgtccattgacaaccctggagctgtgcagtgccctgtgacccagaagccccggctgaccaggacagctgtgcccagcttcctgaccaagcgggagcagagtgatgtgaagaaggtgcccaagggcgtgcccctgcagtttgacatcaacagcgtgggcaagcagacaggcatgaccctgaatgaaagatttggcatcctgaaggagcagagggccaccctgacctacaacaagggcggcagcagatttgtgacagtgggctag

SEQ ID NO: 15521 - DNA, 684 bp, Artificial Sequence
  Description of Artificial Sequence: Synthetic coding sequence
atgcctgggaagagaagacccaacggggtcatcaccggcctggccgccaggaagaccaccggcatcaggaagggcatcagccccatgaaccggccccccctgagtgacaagaacatcgagcagtacttccctgtgctgaagaggaaggccaacctgctgcggcagaatgaaggccagaggaagcctgtggccgtgctgaagaggcccagccagctgagcaggaagaacaacatcccagccaacttcaccaggagcggcaacaagctgaaccaccagaaggacacccggcaggccaccttcctgttcagaagaggcctgaaggtgcaggcccagctgaacacagagcagctgctggatgatgtggtggccaagaggacccggcagtggaggaccagcaccaccaatggaggcatcctgactgtgtccattgacaaccctggagctgtgcagtgccctgtgacccagaagccccggctgaccaggacagctgtgcccagcttcctgaccaagcgggagcagagtgatgtgaagaaggtgcccaagggcgtgcccctgcagtttgacatcaacagcgtgggcaagcagacaggcatgaccctgaatgaacgcttcggcatcctgaaggagcagagggccaccctgacctacaacaagggcggcagcagatttgtgacagtgggctag

SEQ ID NO: 15522 - DNA, 879 bp, Artificial Sequence
  Description of Artificial Sequence: Synthetic coding sequence
atggagcccagcgtcatcatgggaaatgacatcatcaagctgaacaggaaggagggcaagaagcagaacttcccccggctgaacagaaggctgctgcagcagagcggggcccagcagttcaggatgagggtgcgctggggcatccagcagaacagcggctttgggaagaccagcctgaacagaagaggccgggtgatgcctgggaagaggcggcccaatggagtcatcaccggcctggccgccaggaagaccaccggcatcaggaagggcatcagccccatgaacagaccacccctgagtgacaagaacatcgagcagtacttccctgtgctgaagaggaaggccaacctgctgcggcagaatgaaggccagaggaagcctgtggccgtgctgaagaggcccagccagctgagcaggaagaacaacatcccagccaacttcaccaggagcggcaacaagctgaaccaccagaaggacacccggcaggccaccttcctgttccggcggggcctgaaggtgcaggcccagctgaacacagagcagctgctggatgatgtggtggccaagaggacccggcagtggaggaccagcaccaccaacggcggcatcctgactgtgtccattgacaaccctggagctgtgcagtgccctgtgacccagaagccccggctgaccaggacagctgtgcccagcttcctgaccaagcgggagcagagtgatgtgaagaaggtgcccaagggcgtgcccctgcagtttgacatcaacagcgtgggcaagcagacaggcatgaccctgaatgaaagatttggcatcctgaaggagcagagggccaccctgacctacaacaagggcggcagcagatttgtgacagtgggctag

SEQ ID NO: 15523 - DNA, 837 bp, Artificial Sequence
  Description of Artificial Sequence: Synthetic coding sequence
atgggcaaaggaaatgaagatcctgacctgcactgcagcagcatccagtgcagcacagaccagccccccttccagcagatctccttcacagagaagggcagtgatgagaagaagcccttcaaggagaagggcaagacagccttcagccacagcagcgagaagcacatccagaggcagggcagcgagcccaaccccaacaaggagaacagcgaggagaccaagctgaaggccggcaacagcacagctggcagcgagcctgagagcagcagctaccgggagaactgcaggaagaggaagatgagcagcaaggacagctgccaggacacagctggcaactgcccagagaaggaatgttccctgagcctgaacaagaagagccgcagcagcacccctgtgcacaacagcgagatccaggagacctgtgatgcccaccaccggggccgcagccgggcctgcaccggccgcagcaagaggcacaggagccgggccctgggcgtgcagacccccagcatcaggaagagcctggtgacctctgtgcgggccatgtctgaggccgtgtaccaggacctggcccaggtgtgggcccagcagatccacagccccctgacctgtgagcagctgaccctgctgacccggctgcggggccccctgtgtgcccaggtgcagaccctgtacagcatggccacccaggccgcctacgtgtttcctgctgagagctggctggtgcctgccaccctgcccggccctggagagagcgccctggaccgggaggcccaccccttccctggccaggagatcacagaaacagtgtctggcagtgatgaggccaagctgtag

SEQ ID NO: 15524 - DNA, 840 bp, Artificial Sequence
  Description of Artificial Sequence: Synthetic coding sequence
atgggcaaaggaaatgaagatcctgacctgcactgcagcagcatccagtgcagcacagaccagccccccttccagcagatctccttcacagagaagggcagtgatgagaagaagcccttcaaggagaagggcaagacagccttcagccacagcagcgagaagcacatccagaggcaggccggcagcgagcccaaccccaacaaggaaaattctgaggagaccaagctgaaggccggcaacagcacagctggcagcgagcctgagagcagcagctaccgggagaactgcaggaagaggaagatgagcagcaaggacagctgccaggacacagctggcaactgcccagagaaggagtgcagcctgagcctgaacaagaagagccgcagcagcacccctgtgcacaacagcgagatccaggagacctgtgatgcccaccaccggggccgcagccgggcctgcaccggccgcagcaagaggcacaggagccgggccctgggcgtgcagacccccagcatcaggaagagcctggtgacctctgtgcgggccatgtctgaggccgtgtaccaggacctggcccaggtgtgggcccagcagatccacagccccctgacctgtgagcagctgaccctgctgacccggctgcggggccccctgtgtgcccaggtgcagaccctgtacagcatggccacccaggccgcctacgtgtttcctgctgagagctggctggtgcctgccaccctgcccggccctggagagagcgccctggaccgggaggcccaccccttccctggccaggagatcacagagaccgtgtctggcagtgatgaggccaagctgtag

SEQ ID NO: 15525 - DNA, 2544 bp, Artificial Sequence
  Description of Artificial Sequence: Synthetic coding sequence
atgggcaagaagggcaaggtgggcaagagcagaagagacaagttctaccacctggccaaggagaccggctaccgcagccgcagcgccttcaagctgatccagctgaacagacgcttccagttcctgcagaaggcccgggccctgctggacctgtgtgccgcccctgggggctggctgcaggtggccgccaagttcatgcctgtgagcagcctcatcgtgggcgtggacctggtgcccatcaagcccctgcccaacgtggtgaccctgcagcaggacatcaccacagagcgctgccggcaggccctgaggaaggagctgaagacctggaaggtggatgtggtgctgaatgatggagccccaaatgtgggcgcctcctgggtgcatgatgcctacagccaggcccacctgaccctgatggccctgcggctggcctgtgacttcctggcccggggcggcagcttcatcaccaaggtgttccgcagccgggactaccagcccctgctgtggatcttccagcagctgttccggcgggtgcaggccaccaagccccaggccagcagacatgagagcgctgagatctttgtggtgtgccagggcttcctggccccagacaaggtggacagcaagttctttgaccccaagtttgccttcaaggaggtggaggtgcaggccaagacagtgacagagctggtgaccaagaagaagcccaaggccgagggctacgccgagggggacctgaccctgtaccacaggacctctgtgacagacttcctgcgggccgccaaccctgtggacttcctgagcaaggccagcgagatcatggtggatgatgaggagctggcccagcacccagccaccacagaggacatccgggtgtgctgccaggacatccgggtgctgggcaggaaggagctgcggagcctgctgaactggaggaccaagctgcggcgctacgtggccaagaagctgaaggagcaggccaaggccctggacatcagcctgagcagcggggaggaggatgaaggagatgaggaggacagcacagctggcaccaccaagcagcccagcaaggaggaggaggaggaggaggaggaggagcagctgaaccagaccctggccgagatgaaggcccaggaggtggccgagctgaagaggaagaagaagaagctgctgcgggagcagaggaagcagcgggagcgggtggagctgaagatggacctgcccggggtgtccattgctgatgaaggagagaccggcatgttcagcctgagcaccatccggggccaccagctgctggaggaggtgacccagggcgacatgtctgctgctgacaccttcctgagtgacctgcccagagatgacatctacgtgtctgatgtggaggatgatggagatgacaccagcctggacagcgacctggaccctgaggagctggccggcgtgcggggccaccagggcctgcgggaccagaagaggatgaggctgacagaggtgcaggatgacaaggaggaggaggaggaggagaaccccctgctggtgcccctggaggagaaggctgtgctgcaggaggagcaggccaacctgtggttcagcaagggcagctttgctggcattgaagatgatgctgatgaggccctggagatcagccaggcccagctgctgtttgagaacagaaggaagggccggcagcagcagcagaagcagcagctgccccagaccccacccagctgcctgaagacagagatcatgagccccctgtaccaggatgaggcccccaagggcacagaggccagcagcggcacagaagctgccaccggcctggagggggaggagaaggatggcatcagtgacagcgacagcagcaccagcagcgaggaggaggagagctgggagcccctgcggggcaagaagaggagccggggccccaagagtgatgatgatggctttgaaattgtgcccattgaagatcctgccaagcaccgcatcctggaccctgagggcctggccctgggcgccgtcatcgccagcagcaagaaggccaagagggacctgattgacaacagcttcaaccgctacaccttcaatgaagatgaaggagagctgcctgagtggtttgtgcaggaggagaagcagcaccgcatccggcagctgcctgtgggcaagaaggaggtggagcactacaggaagcgctggagggagatcaatgcccggcccatcaagaaggtggccgaggccaaggccaggaagaagaggaggatgctgaagaggctggagcagaccaggaagaaggccgaggccgtggtgaacacagtggacatcagcgagcgggagaaggtggcccagctgcggagcctgtacaagaaggccggcctgggcaaggagaagagacatgtgacctacgtggtggccaagaagggcgtgggcaggaaggtgcggcggcctgctggggtgcggggccacttcaaggtggtggacagcaggatgaagaaggaccagagggcccagcagaggaaggagcagaagaagaagcacaagaggaagtag

SEQ ID NO: 15526 - DNA, 1431 bp, Artificial Sequence
  Description of Artificial Sequence: Synthetic coding sequence
atggctgacagcaaggagggcgtgctgcccctgacagctgccagcacagcccccatcagctttggcttcaccaggaccagcgcccggcggcggctggccgacagcggagatggagctggccccagccctgaggagaaggacttcctgaagacagtggagggccgggagctgcagagcgtgaagccccaggaggcccccaaggagctggtgatccccctcatccagaatggccaccggcggcagcccccagcccggcccccaggccccagcacagacacaggagccctggctgatggagtggtgtcccaggccgtgaaggagctgattgctgagagcaagaagagcctggaggagcgggagaatgctggggtggaccccaccctggccatccccatgatccagaagggctgcacccccagcggggagggcgctgacagcgagcccagggctgagaccgtgcctgaggaggccaactatgaagctgtgcctgtggaggcctacggcctggccatgctgcggggcatgggctggaagccaggagagggcattggaagaaccttcaaccaggtggtgaagccccgggtgaacagcctgcggcccaagggcctgggcctgggcgccaacctgacagaggcccaggccctgacccccaccggccccagcaggatgcccaggccagatgaggagcaggagaaggacaaggaggaccagccccagggcctggtgcctggaggagctgtggtggtgctgagcggcccccaccggggcctgtatggcaaggtggagggcctggaccctgacaacgtgcgggccatggtgcggctggccgtgggcagccgggtggtgacagtgtctgagtactacctgcggcctgtgtcccagcaggagtttgacaagaacaccctggacctgcggcagcagaatggaacagccagcagcaggaagaccctgtggaaccaggagctgtacatccagcaggacaacagcgagaggaagaggaagcacctgcctgaccggcaggacggccctgctgccaagtctgagaaggccgcccccaggagccagcactggctgcaccgggacctgcgggtgcgctttgtggacaacatgtacaagggcggccagtactacaacaccaagatgatcattgaagatgtgctgagcccagacacctgtgtgtgcaggacagatgagggccgggtgctggagggcctgcgggaggacatgctggagaccctggtgcccaaggccgagggggacagagtgatggtggtgctgggcccccagacaggccgggtgggccacctgctgagccgggaccgggcccggagccgggccctggtgcagctgccccgggagaaccaggtggtggagctgcactatgatgccatctgccagtacatgggccccagcgacacagatgatgactag

SEQ ID NO: 15527 - DNA, 2796 bp, Artificial Sequence
  Description of Artificial Sequence: Synthetic coding sequence
atggccgcccgggacagcgacagcgaggaggacctggtgtcctatggaacaggcctggagcccctggaggagggggagcggcccaagaagcccatccccctgcaggaccagacagtgagagatgagaagggccgctacaagcgcttccacggggccttcagcggcggcttctctgctggctacttcaacacagtgggcagcaaggagggctggacccccagcacctttgtgagcagccggcagaacagagctgacaagtctgtgctgggccctgaggacttcatggatgaggaggacctgtctgaatttggaattgcccccaaggccatcgtgaccacagatgactttgccagcaagaccaaggaccgcatccgggagaaggcccggcagctggccgccgccacagcccccatccctggggccaccctgctggatgacctgatcaccccagccaagctgtctgtgggctttgagctgctgaggaagatgggctggaaggagggccagggcgtgggcccccgggtgaagagaagaccccggcggcagaagccagaccccggggtgaagatctacggctgtgccctgcccccaggcagcagcgagggcagcgagggggaggatgatgactacctgcctgacaacgtgacctttgcccccaaggatgtgacccctgtggacttcacccccaaggacaacgtgcacggcctggcctacaagggcctggacccccaccaggccctgtttggcaccagcggggagcacttcaacctcttcagcggcggcagcgagagagctggggacctgggggagatcggcctgaacaagggcaggaagctgggcatcagcggccaggccttcggcgtgggcgccctggaggaggaggatgatgacatctatgccacagagaccctgagcaaatatgacacagtgctgaaggatgaggagcctggagatggcctgtatggctggacagccccccggcagtacaagaaccagaaggagagcgagaaggacctgcgctacgtgggcaagatcctggatggcttcagcctggccagcaagcccctgagcagcaagaagatctacccacctcctgagctgccccgggactacagacctgtgcactacttccggcccatggtggccgccaccagcgagaacagccacctgctgcaggtgctgtctgagagcgctgggaaggccaccccagaccccggcacccacagcaagcaccagctgaatgccagcaagagagctgagctgctgggggagacccccatccagggcagcgccacctctgtgctggagttcctgagccagaaggacaaggagcgcatcaaggagatgaagcaggccacagacctgaaggccgcccagctgaaggcccggagcctggcccagaatgcccagagcagccgggcccagctgagccctgctgctgctgctggccactgctcctggaacatggccctgggcggcggcacagccaccctgaaggccagcaacttcaagccctttgccaaggaccctgagaagcagaagagatatgatgagttcctggtgcacatgaagcagggccagaaggatgccctggagcgctgcctggaccccagcatgacagagtgggagcggggccgggagagagatgaatttgcccgggccgccctgctgtatgccagcagccacagcaccctgagcagccgcttcacccacgccaaggaggaggatgacagcgaccaggtggaggtgccccgggaccaggagaatgatgtgggggacaagcagagcgctgtgaagatgaagatgtttgggaagctgacccgggacacctttgagtggcacccagacaagctgctgtgcaagcgcttcaacgtgcctgacccctacccagacagcaccctggtgggcctgccccgggtgaagagggacaagtacagcgtcttcaacttcctgaccctgcctgagacagccagcctgcccaccacccaggccagcagcgagaaggtgtcccagcaccggggccctgacaagagcaggaagcccagccgctgggacaccagcaagcatgagaagaaggaggacagcatcagcgagttcctgagcctggcccggagcaaggccgagccccccaagcagcagagcagccccctggtgaacaaggaggaggagcacgcccctgagctgagcgccaaccagacagtgaacaaggatgtggatgcccaggccgagggggagggcagccggcccagcatggacctcttccgggccatctttgccagcagcagtgatgagaagagcagcagcagtgaagatgagcagggcgacagtgaagatgaccaggccggcagcggggaggccaacttccagagcagccaggacacagacctgggggagaccagctctgtggcccacgccctggtgcctgccccccaggagcccccacccagcttccccatccagaagatgcagattgatgagcgggaggagtttggcccccggctgccccctgtgttctgccccaatgcccggcagaccctggaggtgccccagaaggagaagcacaagaagaacaaggacaagcacaaggccaagaaggagcacaggaggaagaaggagaagaagaagaagcacaggaagcacaagcacaagggcaagcagaagaacaagaagccagagaagagcagcagcagcgagagcagtgacagcagtgacagccagagtgatgaggagacagcagatgtgagcccccaggagctgctgcggcggctgaagagcctgcccctgcggcggcagtag

SEQ ID NO: 15528 - DNA, 984 bp, Artificial Sequence
  Description of Artificial Sequence: Synthetic coding sequence
atgcctgccctgctggagcggcccaagctgagcaatgccatggcccgggccctgcaccgccacatcatgatggagcgggagaggaagaggcaggaggaggaggaggtggacaagatgatggagcagaagatgaaggaggagcaggagaggaggaagaagaaggagatggaggagaggatgagcctggaggagaccaaggagcagatcctgaagctggaggagaagctgctggccctgcaggaggagaagcaccagctgttcctgcagctgaagaaggtgctgcacgaggaggagaagagaagaaggaaggagcagagcgacctgaccaccctgaccagcgctgcctaccagcagagcctgactgtgcacacaggcacccacctgctgtccatgcagggcagccctgggggccacaacagacctggcaccctgatggctgctgaccgggccaagcagatgtttggcccccaggtgctgaccaccaggcactacgtgggcagcgctgctgcctttgctggcaccccagagcacggccagttccagggcagccctgggggcgcctacggcacagcccagcccccaccccactacggccccacccagcctgcctacagccccagccagcagctgcgggcccccagcgccttccctgctgtgcagtacctgagccagccccagccccagccctatgctgtgcacggccacttccagcccacccagacaggcttcctgcagcccggcggggccctgagcctgcagaagcagatggagcacgccaaccagcagacaggcttcagtgacagcagcagcctgcggcccatgcacccccaggccctgcacccagcccctggcctgctggccagcccccagctgcctgtgcagatgcagcctgctgggaagagcggctttgctgccaccagccagcccggcccccggctgcccttcatccagcacagccagaacccccgcttctaccacaagtag

SEQ ID NO: 15529 - DNA, 984 bp, Artificial Sequence; identical to SEQ ID NO: 15528
  Description of Artificial Sequence: Synthetic coding sequence

SEQ ID NO: 15530 - DNA, 984 bp, Artificial Sequence; identical to SEQ ID NO: 15528
  Description of Artificial Sequence: Synthetic coding sequence

SEQ ID NO: 15531 - DNA, 912 bp, Artificial Sequence
  Description of Artificial Sequence: Synthetic coding sequence
atgcctgccctgctggagcggcccaagctgagcaatgccatggcccgggccctgcaccgccacatcatgatggagcgggagaggaagaggcaggaggaggaggaggtggacaagatgatggagcagaagatgaaggaggagcaggagaggaggaagaagaaggagatggaggagaggatgagcctggaggagaccaaggagcagatcctgaagctggaggagaagctgctggccctgcaggaggagaagcaccagctgttcctgcagctgaagaaggtgctgcacgaggaggagaagagaagaaggaaggagcagagcgacctgaccaccctgaccagcgctgcctaccagcagagcctgactgtgcacacaggcacccacctgctgtccatgcagggcagccctgggggccacaacagacctggcaccctgatggctgctgaccgggccaagcagatgtttggcccccaggtgctgaccaccaggcactacgtgggcagcgctgctgcctttgctggcaccccagagcacggccagttccagggcagccctgggggcgcctacggcacagcccagcccccaccccactacggccccacccagcctgcctacagccccagccagcagctgcgggcccccagcgccttccctgctgtgcagtacctgagccagccccagccccagccctatgctgtgcacggccacttccagcccacccagacaggcttcctgcagcccggcggggccctgagcctgcagaagcagatggagcacgccaaccagcagacaggcttcagtgacagcagcagcctgcggcccatgcacccccaggccctgcacccagcccctggcctgctggccagcccccagctgcctgtgcagatgcagcctgctgggaagacagccccctag

SEQ ID NO: 15532 - DNA, 1986 bp, Artificial Sequence
  Description of Artificial Sequence: Synthetic coding sequence
atgagcaagaggctgcggagcagcgaggtgtgtgccgactgcagcggccctgaccccagctgggcctctgtgaacagaggcaccttcctgtgtgatgagtgctgcagcgtgcacaggagcctgggccgccacatcagccaggtgcgccacctgaagcacaccccctggccacccaccctgctgcagatggtggagaccctgtacaacaacggggccaacagcatctgggagcacagcctgctggaccctgccagcatcatgagcggccgcaggaaggccaacccccaggacaaggtgcaccccaacaaggccgagttcatccgggccaagtaccagatgctggcctttgtgcaccggctgccctgcagagatgatgattctgtgacagccaaggacctgagcaagcagctgcacagctctgtgaggactggaaacctggagacctgcctgcggctgctgagcctgggcgcccaggccaacttcttccaccctgagaagggcaacacccccctgcacgtggccagcaaggccggccagatcctgcaggccgagctgctggccgtgtatggagctgaccccggcacccaggacagcagcggcaagacccctgtggactatgcccggcagggcggccaccacgagctggccgagcggctggtggagatccagtatgagctgacagaccggctggccttctacctgtgtggcaggaagccagaccacaagaatggccagcacttcatcatcccccagatggctgacagcagcctggacctgtctgagctggccaaggccgccaagaagaagctgcagagcctgagcaaccacctgtttgaggagctggccatggatgtgtatgatgaggtggacagaagagaaacagatgctgtgtggctggccacccagaaccacagcgccctggtgacagagaccaccgtggtgcccttcctgcctgtgaaccctgagtacagcagcaccaggaaccagggccggcagaagctggcccgcttcaatgcccacgagtttgccaccctggtgattgacatcctgagtgatgccaagaggcggcagcagggcagcagcctgagcggcagcaaggacaacgtggagctgatcctgaagaccatcaacaaccagcacagcgtggagagccaggacaatgaccagcctgactatgacagcgtggccagtgatgaggacacagacctggagaccacagccagcaagaccaaccggcagaagagcctggacagcgacctgagtgatggccctgtgacagtgcaggagttcatggaggtgaagaatgccctggtggccagcgaggccaagatccagcagctgatgaagattggccgcagcgccctggtgaccagcagcagcagcctgcccagcttccccagcaccctgtcctggagcagagatgagagcgcccggcgggccagccggctggagaagcagaacagcaccccagagagtgactatgacaacaccccaaatgacatggagccagatggcatgggcagcagcaggaagggccggcagaggtccatggtgtggccaggagatggcctggtgcctgacacagctgagccccacgtggcccccagccccaccctgcccagcacagaagatgtgatcaggaagacagagcagatcaccaagaacatccaggagctgctgcgggccgcccaggagaacaagcatgacagctacatcccctgcagcgagcgcatccacgtggccgtgacagagatggccgccctcttccccaagaagcccaagagtgacatggtgaggaccagcctgcggctgctgaccagcagcgcctaccgcctgcagagcgagtgcaagaagaccctgcccggggaccccggcagccccacagatgtgcagctggtgacccagcaggtgatccagtgtgcctatgacatcgccaaggccgccaagcagctggtgaccatcaccaccaaggagaacaacaactag

SEQ ID NO: 15533 - DNA, 1950 bp, Artificial Sequence
  Description of Artificial Sequence: Synthetic coding sequence
atgagcaagaggctgcggagcagcgaggtgtgtgccgactgcagcggccctgaccccagctgggcctctgtgaacagaggcaccttcctgtgtgatgagtgctgcagcgtgcacaggagcctgggccgccacatcagccaggtgcgccacctgaagcacaccccctggccacccaccctgctgcagatggtggagaccctgtacaacaacggggccaacagcatctgggagcacagcctgctggaccctgccagcatcatgagcggccgcaggaaggccaacccccaggacaaggtgcaccccaacaaggccgagttcatccgggccaagtaccagatgctggcctttgtgcaccggctgccctgcagagatgatgattctgtgacagccaaggacctgagcaagcagctgcacagctctgtgaggactggaaacctggagacctgcctgcggctgctgagcctgggcgcccaggccaacttcttccaccctgagaagggcaacacccccctgcacgtggccagcaaggccggccagatcctgcaggccgagctgctggccgtgtatggagctgaccccggcacccaggacagcagcggcaagacccctgtggactatgcccggcagggcggccaccacgagctggccgagcggctggtggagatccagtatgagctgacagaccggctggccttctacctgtgtggcaggaagccagaccacaagaatggccagcacttcatcatcccccagatggctgacagcagcctggacctgtctgagctggccaaggccgccaagaagaagctgcagagcctgagcaaccacctgtttgaggagctggccatggatgtgtatgatgaggtggacagaagagaaacagatgctgtgtggctggccacccagaaccacagcgccctggtgacagagaccaccgtggtgcccttcctgcctgtgaaccctgagtacagcagcaccaggaaccagggccagcccaagaagagcctggacagcgacctgagtgatggccctgtgacagtgcaggagttcatggaggtgaagaatgccctggtggccagcgaggccaagatccagcagctgatgaaggtgaacaacaacctgagtgatgagctgcgcatcatgcagaagaagctgcagaccctgcagagcgagaacagcaacctgaggaagcaggccaccaccaacgtgtaccaggtgcagacaggcagcgagtacacagacaccagcaaccacagcagcctgaagagaagacccagcgcccggggcagccggcccatgtccatgtatgagaccggcagcggccagaagccctacctgcccatgggagaggccagcaggcctgaggagagcaggatgaggctgcagcccttccctgcccacgccagccggctggagaagcagaacagcaccccagagagtgactatgacaacaccccaaatgacatggagccagatggcatgggcagcagcaggaagggccggcagaggtccatggtgtggccaggagatggcctggtgcctgacacagctgagccccacgtggcccccagccccaccctgcccagcacagaagatgtgatcaggaagacagagcagatcaccaagaacatccaggagctgctgcgggccgcccaggagaacaagcatgacagctacatcccctgcagcgagcgcatccacgtggccgtgacagagatggccgccctcttccccaagaagcccaagagtgacatggtgaggaccagcctgcggctgctgaccagcagcgcctaccgcctgcagagcgagtgcaagaagaccctgcccggggaccccggcagccccacagatgtgcagctggtgacccagcaggtgatccagtgtgcctatgacatcgccaaggccgccaagcagctggtgaccatcaccaccaaggagaacaacaactag

SEQ ID NO: 15534 - DNA, 2046 bp, Artificial Sequence
  Description of Artificial Sequence: Synthetic coding sequence
atgagcaagaggctgcggagcagcgaggtgtgtgccgactgcagcggccctgaccccagctgggcctctgtgaacagaggcaccttcctgtgtgatgagtgctgcagcgtgcacaggagcctgggccgccacatcagccaggtgcgccacctgaagcacaccccctggccacccaccctgctgcagatggtggagaccctgtacaacaacggggccaacagcatctgggagcacagcctgctggaccctgccagcatcatgagcggccgcaggaaggccaacccccaggacaaggtgcaccccaacaaggccgagttcatccgggccaagtaccagatgctggcctttgtgcaccggctgccctgcagagatgatgattctgtgacagccaaggacctgagcaagcagctgcacagctctgtgaggactggaaacctggagacctgcctgcggctgctgagcctgggcgcccaggccaacttcttccaccctgagaagggcaacacccccctgcacgtggccagcaaggccggccagatcctgcaggccgagctgctggccgtgtatggagctgaccccggcacccaggacagcagcggcaagacccctgtggactatgcccggcagggcggccaccacgagctggccgagcggctggtggagatccagtatgagctgacagaccggctggccttctacctgtgtggcaggaagccagaccacaagaatggccagcacttcatcatcccccagatggctgacagaagaagcagcctggacctgtctgagctggccaaggccgccaagaagaagctgcagagcctgagcaaccacctgtttgaggagctggccatggatgtgtatgatgaggtggacagaagagaaacagatgctgtgtggctggccacccagaaccacagcgccctggtgacagagaccaccgtggtgcccttcctgcctgtgaaccctgagtacagcagcaccaggaaccagggccggcagaagctggcccgcttcaatgcccacgagtttgccaccctggtgattgacatcctgagtgatgccaagaggcggcagcagggcagcagcctgagcggcagcaaggacaacgtggagctgatcctgaagaccatcaacaaccagcacagcgtggagagccaggacaatgaccagcctgactatgacagcgtggccagtgatgaggacacagacctggagaccacagccagcaagaccaaccggcagaagctgcagaccctgcagagcgagaacagcaacctgaggaagcaggccaccaccaacgtgtaccaggtgcagacaggcagcgagtacacagacaccagcaaccacagcagcctgaagagaagacccagcgcccggggcagccggcccatgtccatgtatgagaccggcagcggccagaagccctacctgcccatgggagaggccagcaggcctgaggagagcaggatgaggctgcagcccttccctgcccacgccagccggctggagaagcagaacagcaccccagagagtgactatgacaacaccccaaatgacatggagccagatggcatgggcagcagcaggaagggccggcagaggtccatggtgtggccaggagatggcctggtgcctgacacagctgagccccacgtggcccccagccccaccctgcccagcacagaagatgtgatcaggaagacagagcagatcaccaagaacatccaggagctgctgcgggccgcccaggagaacaagcatgacagctacatcccctgcagcgagcgcatccacgtggccgtgacagagatggccgccctcttccccaagaagcccaagagtgacatggtgaggaccagcctgcggctgctgaccagcagcgcctaccgcctgcagagcgagtgcaagaagaccctgcccggggaccccggcagccccacagatgtgcagctggtgacccagcaggtgatccagtgtgcctatgacatcgccaaggccgccaagcagctggtgaccatcaccaccaaggagaacaacaactag

SEQ ID NO: 15535 - DNA, 2280 bp, Artificial Sequence
  Description of Artificial Sequence: Synthetic coding sequence
atgagcaagaggctgcggagcagcgaggtgtgtgccgactgcagcggccctgaccccagctgggcctctgtgaacagaggcaccttcctgtgtgatgagtgctgcagcgtgcacaggagcctgggccgccacatcagccaggtgcgccacctgaagcacaccccctggccacccaccctgctgcagatggtggagaccctgtacaacaacggggccaacagcatctgggagcacagcctgctggaccctgccagcatcatgagcggccgcaggaaggccaacccccaggacaaggtgcaccccaacaaggccgagttcatccgggccaagtaccagatgctggcctttgtgcaccggctgccctgcagagatgatgattctgtgacagccaaggacctgagcaagcagctgcacagctctgtgaggactggaaacctggagacctgcctgcggctgctgagcctgggcgcccaggccaacttcttccaccctgagaagggcaacacccccctgcacgtggccagcaaggccggccagatcctgcaggccgagctgctggccgtgtatggagctgaccccggcacccaggacagcagcggcaagacccctgtggactatgcccggcagggcggccaccacgagctggccgagcggctggtggagatccagtatgagctgacagaccggctggccttctacctgtgtggcaggaagccagaccacaagaatggccagcacttcatcatcccccagatggctgacagcagcctggacctgtctgagctggccaaggccgccaagaagaagctgcagagcctgagcaaccacctgtttgaggagctggccatggatgtgtatgatgaggtggacagaagagaaacagatgctgtgtggctggccacccagaaccacagcgccctggtgacagagaccaccgtggtgcccttcctgcctgtgaaccctgagtacagcagcaccaggaaccagggccggcagaagctggcccgcttcaatgcccacgagtttgccaccctggtgattgacatcctgagtgatgccaagaggcggcagcagggcagcagcctgagcggcagcaaggacaacgtggagctgatcctgaagaccatcaacaaccagcacagcgtggagagccaggacaatgaccagcctgactatgacagcgtggccagtgatgaggacacagacctggagaccacagccagcaagaccaaccggcagaagagcctggacagcgacctgagtgatggccctgtgacagtgcaggagttcatggaggtgaagaatgccctggtggccagcgaggccaagatccagcagctgatgaaggtgaacaacaacctgagtgatgagctgcgcatcatgcagaagaagctgcagaccctgcagagcgagaacagcaacctgaggaagcaggccaccaccaacgtgtaccaggtgcagacaggcagcgagtacacagacaccagcaaccacagcagcctgaagagaagacccagcgcccggggcagccggcccatgtccatgtatgagaccggcagcggccagaagccctacctgcccatgggagaggccagcaggcctgaggagagcaggatgaggctgcagcccttccctgcccacatcggccgcagcgccctggtgaccagcagcagcagcctgcccagcttccccagcaccctgtcctggagcagagatgagagcgcccggcgggccagccggctggagaagcagaacagcaccccagagagtgactatgacaacaccccaaatgacatggagccagatggcatgggcagcagcaggaagggccggcagaggtccatggtgtggccaggagatggcctggtgcctgacacagctgagccccacgtggcccccagccccaccctgcccagcacagaagatgtgatcaggaagacagagcagatcaccaagaacatccaggagctgctgcgggccgcccaggagaacaagcatgacagctacatcccctgcagcgagcgcatccacgtggccgtgacagagatggccgccctcttccccaagaagcccaagagtgacatggtgaggaccagcctgcggctgctgaccagcagcgcctaccgcctgcagagcgagtgcaagaagaccctgcccggggaccccggcagccccacagatgtgcagctggtgacccagcaggtgatccagtgtgcctatgacatcgccaaggccgccaagcagctggtgaccatcaccaccaaggagaacaacaactag

SEQ ID NO: 15536 - DNA, 1941 bp, Artificial Sequence
  Description of Artificial Sequence: Synthetic coding sequence
atgagcaagaggctgcggagcagcgaggtgtgtgccgactgcagcggccctgaccccagctgggcctctgtgaacagaggcaccttcctgtgtgatgagtgctgcagcgtgcacaggagcctgggccgccacatcagccaggtgcgccacctgaagcacaccccctggccacccaccctgctgcagatggtggagaccctgtacaacaacggggccaacagcatctgggagcacagcctgctggaccctgccagcatcatgagcggccgcaggaaggccaacccccaggacaaggtgcaccccaacaaggccgagttcatccgggccaagtaccagatgctggcctttgtgcaccggctgccctgcagagatgatgattctgtgacagccaaggacctgagcaagcagctgcacagctctgtgaggactggaaacctggagacctgcctgcggctgctgagcctgggcgcccaggccaacttcttccaccctgagaagggcaacacccccctgcacgtggccagcaaggccggccagatcctgcaggccgagctgctggccgtgtatggagctgaccccggcacccaggacagcagcggcaagacccctgtggactatgcccggcagggcggccaccacgagctggccgagcggctggtggagatccagtatgagctgacagaccggctggccttctacctgtgtggcaggaagccagaccacaagaatggccagcacttcatcatcccccagatggctgacagcagcctggacctgtctgagctggccaaggccgccaagaagaagctgcagagcctgagcaaccacctgtttgaggagctggccatggatgtgtatgatgaggtggacagaagagaaacagatgctgtgtggctggccacccagaaccacagcgccctggtgacagagaccaccgtggtgcccttcctgcctgtgaaccctgagtacagcagcaccaggaaccagggccggcagaagctggcccgcttcaatgcccacgagtttgccaccctggtgattgacatcctgagtgatgccaagaggcggcagcagggcagcagcctgagcggcagcaaggacaacgtggagctgatcctgaagaccatcaacaaccagcacagcgtggagagccaggacaatgaccagcctgactatgacagcgtggccagtgatgaggacacagacctggagaccacagccagcaagaccaaccggcagaagagcctggacagcgacctgagtgatggccctgtgacagtgcaggagttcatggaggtgaagaatgccctggtggccagcgaggccaagatccagcagctgatgaaggtgaacaacaacctgagtgatgagctgcgcatcatgcagaagaaggccagccggctggagaagcagaacagcaccccagagagtgactatgacaacaccccaaatgacatggagccagatggcatgggcagcagcaggaagggccggcagaggtccatggtgtggccaggagatggcctggtgcctgacacagctgagccccacgtggcccccagccccaccctgcccagcacagaagatgtgatcaggaagacagagcagatcaccaagaacatccaggagctgctgcgggccgcccaggagaacaagcatgacagctacatcccctgcagcgagcgcatccacgtggccgtgacagagatggccgccctcttccccaagaagcccaagagtgacatggtgaggaccagcctgcggctgctgaccagcagcgcctaccgcctgcagagcgagtgcaagaagaccctgcccggggaccccggcagccccacagatgtgcagctggtgacccagcaggtgatccagtgtgcctatgacatcgccaaggccgccaagcagctggtgaccatcaccaccaaggagaacaacaactag

SEQ ID NO: 15537 - DNA, 2130 bp, Artificial Sequence
  Description of Artificial Sequence: Synthetic coding sequence
atgagcaagaggctgcggagcagcgaggtgtgtgccgactgcagcggccctgaccccagctgggcctctgtgaacagaggcaccttcctgtgtgatgagtgctgcagcgtgcacaggagcctgggccgccacatcagccaggtgcgccacctgaagcacaccccctggccacccaccctgctgcagatggtggagaccctgtacaacaacggggccaacagcatctgggagcacagcctgctggaccctgccagcatcatgagcggccgcaggaaggccaacccccaggacaaggtgcaccccaacaaggccgagttcatccgggccaagtaccagatgctggcctttgtgcaccggctgccctgcagagatgatgattctgtgacagccaaggacctgagcaagcagctgcacagctctgtgaggactggaaacctggagacctgcctgcggctgctgagcctgggcgcccaggccaacttcttccaccctgagaagggcaacacccccctgcacgtggccagcaaggccggccagatcctgcaggccgagctgctggccgtgtatggagctgaccccggcacccaggacagcagcggcaagacccctgtggactatgcccggcagggcggccaccacgagctggccgagcggctggtggagatccagtatgagctgacagaccggctggccttctacctgtgtggcaggaagccagaccacaagaatggccagcacttcatcatcccccagatggctgacagcagcctggacctgtctgagctggccaaggccgccaagaagaagctgcagagcctgagcaaccacctgtttgaggagctggccatggatgtgtatgatgaggtggacagaagagaaacagatgctgtgtggctggccacccagaaccacagcgccctggtgacagagaccaccgtggtgcccttcctgcctgtgaaccctgagtacagcagcaccaggaaccagggccggcagaagctggcccgcttcaatgcccacgagtttgccaccctggtgattgacatcctgagtgatgccaagaggcggcagcagggcagcagcctgagcggcagcaaggacaacgtggagctgatcctgaagaccatcaacaaccagcacagcgtggagagccaggacaatgaccagcctgactatgacagcgtggccagtgatgaggacacagacctggagaccacagccagcaagaccaaccggcagaagctgcagaccctgcagagcgagaacagcaacctgaggaagcaggccaccaccaacgtgtaccaggtgcagacaggcagcgagtacacagacaccagcaaccacagcagcctgaagagaagacccagcgcccggggcagccggcccatgtccatgtatgagaccggcagcggccagaagccctacctgcccatgggagaggccagcaggcctgaggagagcaggatgaggctgcagcccttccctgcccacatcggccgcagcgccctggtgaccagcagcagcagcctgcccagcttccccagcaccctgtcctggagcagagatgagagcgcccggcgggccagccggctggagaagcagaacagcaccccagagagtgactatgacaacaccccaaatgacatggagccagatggcatgggcagcagcaggaagggccggcagaggtccatggtgtggccaggagatggcctggtgcctgacacagctgagccccacgtggcccccagccccaccctgcccagcacagaagatgtgatcaggaagacagagcagatcaccaagaacatccaggagctgctgcgggccgcccaggagaacaagcatgacagctacatcccctgcagcgagcgcatccacgtggccgtgacagagatggccgccctcttccccaagaagcccaagagtgacatggtgaggaccagcctgcggctgctgaccagcagcgcctaccgcctgcagagcgagtgcaagaagaccctgcccggggaccccggcagccccacagatgtgcagctggtgacccagcaggtgatccagtgtgcctatgacatcgccaaggccgccaagcagctggtgaccatcaccaccaaggagaacaacaactag

SEQ ID NO: 15538 - DNA, 2190 bp, Artificial Sequence
  Description of Artificial Sequence: Synthetic coding sequence
atgagcaagaggctgcggagcagcgaggtgtgtgccgactgcagcggccctgaccccagctgggcctctgtgaacagaggcaccttcctgtgtgatgagtgctgcagcgtgcacaggagcctgggccgccacatcagccaggtgcgccacctgaagcacaccccctggccacccaccctgctgcagatggtggagaccctgtacaacaacggggccaacagcatctgggagcacagcctgctggaccctgccagcatcatgagcggccgcaggaaggccaacccccaggacaaggtgcaccccaacaaggccgagttcatccgggccaagtaccagatgctggcctttgtgcaccggctgccctgcagagatgatgattctgtgacagccaaggacctgagcaagcagctgcacagctctgtgaggactggaaacctggagacctgcctgcggctgctgagcctgggcgcccaggccaacttcttccaccctgagaagggcaacacccccctgcacgtggccagcaaggccggccagatcctgcaggccgagctgctggccgtgtatggagctgaccccggcacccaggacagcagcggcaagacccctgtggactatgcccggcagggcggccaccacgagctggccgagcggctggtggagatccagtatgagctgacagaccggctggccttctacctgtgtggcaggaagccagaccacaagaatggccagcacttcatcatcccccagatggctgacagcagcctggacctgtctgagctggccaaggccgccaagaagaagctgcagagcctgagcaaccacctgtttgaggagctggccatggatgtgtatgatgaggtggacagaagagaaacagatgctgtgtggctggccacccagaaccacagcgccctggtgacagagaccaccgtggtgcccttcctgcctgtgaaccctgagtacagcagcaccaggaaccagggccggcagaagctggcccgcttcaatgcccacgagtttgccaccctggtgattgacatcctgagtgatgccaagaggcggcagcagggcagcagcctgagcggcagcaaggacaacgtggagctgatcctgaagaccatcaacaaccagcacagcgtggagagccaggacaatgaccagcctgactatgacagcgtggccagtgatgaggacacagacctggagaccacagccagcaagaccaaccggcagaagagcctggacagcgacctgagtgatggccctgtgacagtgcaggagttcatggaggtgaagaatgccctggtggccagcgaggccaagatccagcagctgatgaaggtgaacaacaacctgagtgatgagctgcgcatcatgcagaagaagctgcagaccctgcagagcgagaacagcaacctgaggaagcaggccaccaccaacgtgtaccaggtgcagacaggcagcgagtacacagacaccagcaaccacagcagcctgaagagaagacccagcgcccggggcagccggcccatgtccatgtatgagaccggcagcggccagaagccctacctgcccatgggagaggccagcaggcctgaggagagcaggatgaggctgcagcccttccctgcccacgccagccggctggagaagcagaacagcaccccagagagtgactatgacaacaccccaaatgacatggagccagatggcatgggcagcagcaggaagggccggcagaggtccatggtgtggccaggagatggcctggtgcctgacacagctgagccccacgtggcccccagccccaccctgcccagcacagaagatgtgatcaggaagacagagcagatcaccaagaacatccaggagctgctgcgggccgcccaggagaacaagcatgacagctacatcccctgcagcgagcgcatccacgtggccgtgacagagatggccgccctcttccccaagaagcccaagagtgacatggtgaggaccagcctgcggctgctgaccagcagcgcctaccgcctgcagagcgagtgcaagaagaccctgcccggggaccccggcagccccacagatgtgcagctggtgacccagcaggtgatccagtgtgcctatgacatcgccaaggccgccaagcagctggtgaccatcaccaccaaggagaacaacaactag

SEQ ID NO: 15539 - DNA, 2046 bp, Artificial Sequence
  Description of Artificial Sequence: Synthetic coding sequence
atgagcaagaggctgcggagcagcgaggtgtgtgccgactgcagcggccctgaccccagctgggcctctgtgaacagaggcaccttcctgtgtgatgagtgctgcagcgtgcacaggagcctgggccgccacatcagccaggtgcgccacctgaagcacaccccctggccacccaccctgctgcagatggtggagaccctgtacaacaacggggccaacagcatctgggagcacagcctgctggaccctgccagcatcatgagcggccgcaggaaggccaacccccaggacaaggtgcaccccaacaaggccgagttcatccgggccaagtaccagatgctggcctttgtgcaccggctgccctgcagagatgatgattctgtgacagccaaggacctgagcaagcagctgcacagctctgtgaggactggaaacctggagacctgcctgcggctgctgagcctgggcgcccaggccaacttcttccaccctgagaagggcaacacccccctgcacgtggccagcaaggccggccagatcctgcaggccgagctgctggccgtgtatggagctgaccccggcacccaggacagcagcggcaagacccctgtggactatgcccggcagggcggccaccacgagctggccgagcggctggtggagatccagtatgagctgacagaccggctggccttctacctgtgtggcaggaagccagaccacaagaatggccagcacttcatcatcccccagatggctgaccggcggctgagcctggacctgtctgagctggccaaggccgccaagaagaagctgcagagcctgagcaaccacctgtttgaggagctggccatggatgtgtatgatgaggtggacagaagagaaacagatgctgtgtggctggccacccagaaccacagcgccctggtgacagagaccaccgtggtgcccttcctgcctgtgaaccctgagtacagcagcaccaggaaccagggccggcagaagctggcccgcttcaatgcccacgagtttgccaccctggtgattgacatcctgagtgatgccaagaggcggcagcagggcagcagcctgagcggcagcaaggacaacgtggagctgatcctgaagaccatcaacaaccagcacagcgtggagagccaggacaatgaccagcctgactatgacagcgtggccagtgatgaggacacagacctggagaccacagccagcaagaccaaccggcagaagctgcagaccctgcagagcgagaacagcaacctgaggaagcaggccaccaccaacgtgtaccaggtgcagacaggcagcgagtacacagacaccagcaaccacagcagcctgaagagaagacccagcgcccggggcagccggcccatgtccatgtatgagaccggcagcggccagaagccctacctgcccatgggagaggccagcaggcctgaggagagcaggatgaggctgcagcccttccctgcccacgccagccggctggagaagcagaacagcaccccagagagtgactatgacaacaccccaaatgacatggagccagatggcatgggcagcagcaggaagggccggcagaggtccatggtgtggccaggagatggcctggtgcctgacacagctgagccccacgtggcccccagccccaccctgcccagcacagaagatgtgatcaggaagacagagcagatcaccaagaacatccaggagctgctgcgggccgcccaggagaacaagcatgacagctacatcccctgcagcgagcgcatccacgtggccgtgacagagatggccgccctcttccccaagaagcccaagagtgacatggtgaggaccagcctgcggctgctgaccagcagcgcctaccgcctgcagagcgagtgcaagaagaccctgcccggggaccccggcagccccacagatgtgcagctggtgacccagcaggtgatccagtgtgcctatgacatcgccaaggccgccaagcagctggtgaccatcaccaccaaggagaacaacaactag

SEQ ID NO: 15540 - DNA, 1806 bp, Artificial Sequence
  Description of Artificial Sequence: Synthetic coding sequence
atggtggagaccctgtacaacaacggggccaacagcatctgggagcacagcctgctggaccctgccagcatcatgagcggccgcaggaaggccaacccccaggacaaggtgcaccccaacaaggccgagttcatccgggccaagtaccagatgctggcctttgtgcaccggctgccctgcagagatgatgattctgtgacagccaaggacctgagcaagcagctgcacagctctgtgaggactggaaacctggagacctgcctgcggctgctgagcctgggcgcccaggccaacttcttccaccctgagaagggcaacacccccctgcacgtggccagcaaggccggccagatcctgcaggccgagctgctggccgtgtatggagctgaccccggcacccaggacagcagcggcaagacccctgtggactatgcccggcagggcggccaccacgagctggccgagcggctggtggagatccagtatgagctgacagaccggctggccttctacctgtgtggcaggaagccagaccacaagaatggccagcacttcatcatcccccagatggctgacagcagcctggacctgtctgagctggccaaggccgccaagaagaagctgcagagcctgagcaaccacctgtttgaggagctggccatggatgtgtatgatgaggtggacagaagagaaacagatgctgtgtggctggccacccagaaccacagcgccctggtgacagagaccaccgtggtgcccttcctgcctgtgaaccctgagtacagcagcaccaggaaccagggccggcagaagctggcccgcttcaatgcccacgagtttgccaccctggtgattgacatcctgagtgatgccaagaggcggcagcagggcagcagcctgagcggcagcaaggacaacgtggagctgatcctgaagaccatcaacaaccagcacagcgtggagagccaggacaatgaccagcctgactatgacagcgtggccagtgatgaggacacagacctggagaccacagccagcaagaccaaccggcagaagagcctggacagcgacctgagtgatggccctgtgacagtgcaggagttcatggaggtgaagaatgccctggtggccagcgaggccaagatccagcagctgatgaaggtgaacaacaacctgagtgatgagctgcgcatcatgcagaagaagctgcagaccctgcagagcgagaacagcaacctgaggaagcaggccaccaccaacgtgtaccaggtgcagacaggcagcgagtacacagacaccagcaaccacagcagcctgaagagaagacccagcgcccggggcagccggcccatgtccatgtatgagaccggcagcggccagaagccctacctgcccatgggagaggccagcaggcctgaggagagcaggatgaggctgcagcccttccctgcccacgccagccggctggagaagcagaacagcaccccagagagtgactatgacaacaccccaaatgacatggagccagatggcatgggcagcagcaggaagggccggcagaggtccatggtgtggccaggagatggcctggtgcctgacacagctgagccccacgtggcccccagccccaccctgcccagcacagaagatgtgatcaggaagacagagcagatcaccaagaacatccaggagctgctgcgggccgcccaggagaacaagcatgacagctacatcccctgcagcgagcgcatccacgtggccgtgacagagatggccgccctcttccccaaggagacccaggtgtag

SEQ ID NO: 15541 - DNA, 1416 bp, Artificial Sequence
  Description of Artificial Sequence: Synthetic coding sequence
atgagcaagaggctgcggagcagcgaggtgtgtgccgactgcagcggccctgaccccagctgggcctctgtgaacagaggcaccttcctgtgtgatgagtgctgcagcgtgcacaggagcctgggccgccacatcagccaggtgcgccacctgaagcacaccccctggccacccaccctgctgcagatggtggagaccctgtacaacaacggggccaacagcatctgggagcacagcctgctggaccctgccagcatcatgagcggccgcaggaaggccaacccccaggacaaggtgcaccccaacaaggccgagttcatccgggccaagtaccagatgctggcctttgtgcaccggctgccctgcagagatgatgattctgtgacagccaaggacctgagcaagcagctgcacagctctgtgaggactggaaacctggagacctgcctgcggctgctgagcctgggcgcccaggccaacttcttccaccctgagaagggcaacacccccctgcacgtggccagcaaggccggccagatcctgcaggccgagctgctggccgtgtatggagctgaccccggcacccaggacagcagcggcaagacccctgtggactatgcccggcagggcggccaccacgagctggccgagcggctggtggagatccagtatgagctgacagaccggctggccttctacctgtgtggcaggaagccagaccacaagaatggccagcacttcatcatcccccagatggctgacagcagcctggacctgtctgagctggccaaggccgccaagaagaagctgcagagcctgagcaaccacctgtttgaggagctggccatggatgtgtatgatgaggtggacagaagagaaacagatgctgtgtggctggccacccagaaccacagcgccctggtgacagagaccaccgtggtgcccttcctgcctgtgaaccctgagtacagcagcaccaggaaccagggccggcagaagctggcccgcttcaatgcccacgagtttgccaccctggtgattgacatcctgagtgatgccaagaggcggcagcagggcagcagcctgagcggcagcaaggacaacgtggagctgatcctgaagaccatcaacaaccagcacagcgtggagagccaggacaatgaccagcctgactatgacagcgtggccagtgatgaggacacagacctggagaccacagccagcaagaccaaccggcagaagagcctggacagcgacctgagtgatggccctgtgacagtgcaggagttcatggaggtgaagaatgccctggtggccagcgaggccaagatccagcagctgatgaaggtgaacaacaacctgagtgatgagctgcgcatcatgcagaagaagctgctgggcaaggatgccaactag

SEQ ID NO: 15542 - DNA, 1896 bp, Artificial Sequence
  Description of Artificial Sequence: Synthetic coding sequence
atgagcaagaggctgcggagcagcgaggtgtgtgccgactgcagcggccctgaccccagctgggcctctgtgaacagaggcaccttcctgtgtgatgagtgctgcagcgtgcacaggagcctgggccgccacatcagccaggtgcgccacctgaagcacaccccctggccacccaccctgctgcagatggtggagaccctgtacaacaacggggccaacagcatctgggagcacagcctgctggaccctgccagcatcatgagcggccgcaggaaggccaacccccaggacaaggtgcaccccaacaaggccgagttcatccgggccaagtaccagatgctggcctttgtgcaccggctgccctgcagagatgatgattctgtgacagccaaggacctgagcaagcagctgcacagctctgtgaggactggaaacctggagacctgcctgcggctgctgagcctgggcgcccaggccaacttcttccaccctgagaagggcaacacccccctgcacgtggccagcaaggccggccagatcctgcaggccgagctgctggccgtgtatggagctgaccccggcacccaggacagcagcggcaagacccctgtggactatgcccggcagggcggccaccacgagctggccgagcggctggtggagatccagtatgagctgacagaccggctggccttctacctgtgtggcaggaagccagaccacaagaatggccagcacttcatcatcccccagatggctgacagcagcctggacctgtctgagctggccaaggccgccaagaagaagctgcagagcctgagcaaccacctgtttgaggagctggccatggatgtgtatgatgaggtggacagaagagaaacagatgctgtgtggctggccacccagaaccacagcgccctggtgacagagaccaccgtggtgcccttcctgcctgtgaaccctgagtacagcagcaccaggaaccagggccggcagaagctggcccgcttcaatgcccacgagtttgccaccctggtgattgacatcctgagtgatgccaagaggcggcagcagggcagcagcctgagcggcagcaaggacaacgtggagctgatcctgaagaccatcaacaaccagcacagcgtggagagccaggacaatgaccagcctgactatgacagcgtggccagtgatgaggacacagacctggagaccacagccagcaagaccaaccggcagaagagcctggacagcgacctgagtgatggccctgtgacagtgcaggagttcatggaggtgaagaatgccctggtggccagcgaggccaagatccagcagctgatgaaggccagccggctggagaagcagaacagcaccccagagagtgactatgacaacaccccaaatgacatggagccagatggcatgggcagcagcaggaagggccggcagaggtccatggtgtggccaggagatggcctggtgcctgacacagctgagccccacgtggcccccagccccaccctgcccagcacagaagatgtgatcaggaagacagagcagatcaccaagaacatccaggagctgctgcgggccgcccaggagaacaagcatgacagctacatcccctgcagcgagcgcatccacgtggccgtgacagagatggccgccctcttccccaagaagcccaagagtgacatggtgaggaccagcctgcggctgctgaccagcagcgcctaccgcctgcagagcgagtgcaagaagaccctgcccggggaccccggcagccccacagatgtgcagctggtgacccagcaggtgatccagtgtgcctatgacatcgccaaggccgccaagcagctggtgaccatcaccaccaaggagaacaacaactag

SEQ ID NO: 15543 - DNA, 1233 bp, Artificial Sequence
  Description of Artificial Sequence: Synthetic coding sequence
atgagcctggtggacctgggcaagaggctgctggaggccgccaggaagggccaggatgatgaggtgaggaccctgatggccaacggggcccccttcaccacagactggctgggcaccagccccctgcacctggccgcccagtatggccactacagcacagctgaggtgctgctgcgggccggcgtgtccagagatgcccggaccaaggtggacaggacccccctgcacatggctgctgctgatggccacgcccacatcgtggagctgctggtgagaaatggagcagatgtgaatgccaaggacatgctgaagatgacagccctgcactgggccacagagcggcaccacagagatgtggtggagctgctgatcaagtacggggctgatgtgcacgccttcagcaagtttgacaagagcgcctttgatattgccctggagaagaacaatgctgagatcctggtgatcctgcaggaggccatgcagaaccaggtgaatgtgaaccctgagcgggccaaccctgtgacagatcctgtgtccatggccgcccccttcatcttcaccagcggggaggtggtgaacctggccagcctcatcagcagcaccaacaccaagaccaccagcgccaacacagaggagatcatcgagggcaacagcgtggacagcagcatccagcaggtgatgggcagcggcggccagagggtcatcaccatcgtgacagatggagtgcccctgggcaacatccagaccagcatccccactggaggcatcggccagcccttcatcgtgacagtgcaggacggccagcaggtgctgactgtgcctgctgggaaggtggccgaggagaccgtcatcaaggaggaggaggaggagaagctgcccctgaccaagaagccccgcatcggggagaagaccaacagcgtggaggagagcaaggagggcaatgaaagagagctgctgcagcagcagctgcaggaggccaacagaagagcccaggagtaccgccaccagctgctgaagaaggagcaggaggccgagcagtaccgcctgaagctggaggccatcgcccggcagcagcccaacggggtggacttcaccatggtggaggaggtggccgaggtggatgctgtggtggtgacagaaggagagctggaggagcgggagaccaaggtgactggatctgctggcaccacagagccccacaccagggtgtccatggccaccgtgagcagctag

SEQ ID NO: 15544 - DNA, 1233 bp, Artificial Sequence; identical to SEQ ID NO: 15543
  Description of Artificial Sequence: Synthetic coding sequence

SEQ ID NO: 15545 - DNA, 1347 bp, Artificial Sequence
  Description of Artificial Sequence: Synthetic coding sequence
atgagcctggtggacctgggcaagaggctgctggaggccgccaggaagggccaggatgatgaggtgaggaccctgatggccaacggggcccccttcaccacagactggctgggcaccagccccctgcacctggccgcccagtatggccactacagcacagctgaggtgctgctgcgggccggcgtgtccagagatgcccggaccaaggtggacaggacccccctgcacatggctgctgctgatggccacgcccacatcgtggagctgctggtgagaaatggagcagatgtgaatgccaaggacatgctgaagatgacagccctgcactgggccacagagcggcaccacagagatgtggtggagctgctgatcaagtacggggctgatgtgcacgccttcagcaagtttgacaagagcgcctttgatattgccctggagaagaacaatgctgagatcctggtgatcctgcaggaggccatgcagaaccaggtgaatgtgaaccctgagcgggccaaccctgtgacagatcctgtgtccatggccgcccccttcatcttcaccagcggggaggtggtgaacctggccagcctcatcagcagcaccaacaccaagaccaccagcggggacccccacgccagcacagtgcagttcagcaacagcaccacctctgtgctggccaccctggccgccctggccgaggcctctgtgcccctgagcaacagccaccgggccacagccaacacagaggagatcatcgagggcaacagcgtggacagcagcatccagcaggtgatgggcagcggcggccagagggtcatcaccatcgtgacagatggagtgcccctgggcaacatccagaccagcatccccactggaggcatcggccagcccttcatcgtgacagtgcaggacggccagcaggtgctgactgtgcctgctgggaaggtggccgaggagaccgtcatcaaggaggaggaggaggagaagctgcccctgaccaagaagccccgcatcggggagaagaccaacagcgtggaggagagcaaggagggcaatgaaagagagctgctgcagcagcagctgcaggaggccaacagaagagcccaggagtaccgccaccagctgctgaagaaggagcaggaggccgagcagtaccgcctgaagctggaggccatcgcccggcagcagcccaacggggtggacttcaccatggtggaggaggtggccgaggtggatgctgtggtggtgacagaaggagagctggaggagcgggagaccaaggtgactggatctgctggcaccacagagccccacaccagggtgtccatggccaccgtgagcagctag

SEQ ID NO: 15546 - DNA, 1188 bp, Artificial Sequence
  Description of Artificial Sequence: Synthetic coding sequence
atgagcctggtggacctgggcaagaggctgctggaggccgccaggaagggccaggatgatgaggtgaggaccctgatggccaacggggcccccttcaccacagactggttcagcaagctgcgggtgtcctgtggctacatcggggacaactgcaagctgggcaccagccccctgcacctggccgcccagtatggccactacagcacagctgaggtgctgctgcgggccggcgtgtccagagatgcccggaccaaggtggacaggacccccctgcacatggctgctgctgatggccacgcccacatcgtggagctgctggtgagaaatggagcagatgtgaatgccaaggacatgctgaagatgacagccctgcactgggccacagagcggcaccacagagatgtggtggagctgctgatcaagtacggggctgatgtgcacgccttcagcaagtttgacaagagcgcctttgatattgccctggagaagaacaatgctgagatcctggtgatcctgcaggaggccatgcagaaccaggtgaatgtgaaccctgagcgggccaaccctgtgacagatcctgtgtccatggccgcccccttcatcttcaccagcggggaggtggtgaacctggccagcctcatcagcagcaccaacaccaagaccaccagcggggacccccacgccagcacagtgcagttcagcaacagcaccacctctgtgctggccaccctggccgccctggccgaggcctctgtgcccctgagcaacagccaccgggccacagccaacacagaggagaccgtcatcaaggaggaggaggaggagaagctgcccctgaccaagaagcccagaattggagagaagaccaacagcgtggaggagagcaaggagggcaatgaaagagagctgctgcagcagcagctgcaggaggccaacagaagagcccaggagtaccgccaccagctgctgaagaaggagcaggaggccgagcagtaccgcctgaagctggaggccatcgcccggcagcagcccaatggagtggacttcaccatggtggaggaggtggccgaggtggatgctgtggtggtgacagaaggagagctggaggagcgggagaccaaggtgacaggcagcgctggcaccacagagccccacaccagggtgtccatggccaccgtgagcagctag

SEQ ID NO: 15547 - DNA, 1827 bp, Artificial Sequence
  Description of Artificial Sequence: Synthetic coding sequence
atgacagaggaggcctgcaggaccaggagccagaagagggccctggagcgggaccccacagaagatgatgtggagagcaagaagatcaagatggagcggggcctgctggccagtgacctgaacacagatggagacatgagggtgaccccagagcccggggccggccccacccagggcctgctgcgggccacagaggccacagccatggccatgggccgcggggagggcctggtgggagatggccctgtggacatgaggaccagccacagcgacatgaagtctgagcggcggccccccagcccagatgtgattgtgctgagtgacaatgagcagcccagcagcccccgggtgaatggcctgaccaccgtggccctgaaggagaccagcacagaggccctgatgaagagcagccctgaggagcgggagaggatgatcaagcagctgaaggaggagctgcggctggaggaggccaagctggtgctgctgaagaagctgcggcagagccagatccagaaggaggccacagcccagaagcccaccggctctgtgggcagcacagtgaccaccccaccacccctggtgcggggcacccagaacatcccagctgggaagcccagcctgcagaccagcagcgccaggatgcctggcagcgtcatccccccacccctggtgcggggcggccagcaggccagcagcaagctgggcccccaggccagcagccaggtggtgatgccacccctggtgcggggggcccagcagatccacagcatccggcagcacagcagcactggacctccacccctgctgctggccccccgggcctctgtgcccagcgtgcagatccagggccagaggatcatccagcagggcctcatccgggtggccaacgtgcccaacaccagcctgctggtgaacatcccccagcccaccccagccagcctgaagggcaccacagccaccagcgcccaggccaacagcacccccacctctgtggcctctgtggtgaccagcgctgagagccctgccagccggcaggccgccgccaagctggccctgaggaagcagctggagaagaccctgctggagatccccccacccaagcccccagcccctgagatgaacttcctgcccagcgctgccaacaatgagttcatctacctggtgggcctggaggaggtggtgcagaacctgctggagacccagggccgcatgtctgctgccaccgtgctgagccgggagccctacatgtgtgcccagtgcaagacagacttcacctgccgctggagggaggagaagagcggggccatcatgtgtgagaactgcatgaccaccaaccagaagaaggccctgaaggtggagcacaccagccggctgaaggccgcctttgtgaaggccctgcagcaggagcaggagattgagcagaggctgctgcagcagggcacagccccagcccaggccaaggccgagcccacagctgccccccaccctgtgctgaagcaggccagcagccagctgagccggggcagcgccaccaccccccggggcgtgctgcacaccttcagccccagccccaagctgcagaacagcgccagcgccacagccctggtgtccaggacaggccgccacagcgagaggacagtgtctgctggaaaaggaagtgccaccagcaactggaagaagacccccctgagcactggaggcaccctggcctttgtgagccccagcctggccgtgcacaagagcagcagcgctgtggaccggcagcgggagtacctgctggacatgatccccccaagaagcatcccccagagcgccacctggaagtag

SEQ ID NO: 15548 - DNA, 1902 bp, Artificial Sequence
  Description of Artificial Sequence: Synthetic coding sequence
atgacagaggaggcctgcaggaccaggagccagaagagggccctggagcgggaccccacagaagatgatgtggagagcaagaagatcaagatggagcggggcctgctggccagtgacctgaacacagatggagacatgagggtgaccccagagcccggggccggccccacccagggcctgctgcgggccacagaggccacagccatggccatgggccgcggggagggcctggtgggagatggccctgtggacatgaggaccagccacagcgacatgaagtctgagcggcggccccccagcccagatgtgattgtgctgagtgacaatgagcagcccagcagcccccgggtgaatggcctgaccaccgtggccctgaaggagaccagcacagaggccctgatgaagagcagccctgaggagcgggagaggatgatcaagcagctgaaggaggagctgcggctggaggaggccaagctggtgctgctgaagaagctgcggcagagccagatccagaaggaggccacagcccagaagcccaccggctctgtgggcagcacagtgaccaccccaccacccctggtgcggggcacccagaacatcccagctgggaagcccagcctgcagaccagcagcgccaggatgcctggcagcgtcatccccccacccctggtgcggggcggccagcaggccagcagcaagctgggcccccaggccagcagccaggtggtgatgccacccctggtgcggggggcccagcagatccacagcatccggcagcacagcagcactggacctccacccctgctgctggccccccgggcctctgtgcccagcgtgcagatccagggccagaggatcatccagcagggcctcatccgggtggccaacgtgcccaacaccagcctgctggtgaacatcccccagcccaccccagccagcctgaagggcaccacagccaccagcgcccaggccaacagcacccccacctctgtggcctctgtggtgaccagcgctgagagccctgccagccggcaggccgccgccaagctggccctgaggaagcagctggagaagaccctgctggagatccccccacccaagcccccagcccctgagatgaacttcctgcccagcgctgccaacaatgagttcatctacctggtgggcctggaggaggtggtgcagaacctgctggagacccagggccgcatgtctgctgccaccgtgctgagccgggagccctacatgtgtgcccagtgcaagacagacttcacctgccgctggagggaggagaagagcggggccatcatgtgtgagaactgcatgaccaccaaccagaagaaggccctgaaggtggagcacaccagccggctgaaggccgcctttgtgaaggccctgcagcaggagcaggagattgagcagaggctgctgcagcagggcacagccccagcccaggccaaggccgagcccacagctgccccccaccctgtgctgaagcaggtgatcaagcccaggaggaagctggccttccgcagcggggaggcccgggactggagcaatggagctgtgctgcaggccagcagccagctgagccggggcagcgccaccaccccccggggcgtgctgcacaccttcagccccagccccaagctgcagaacagcgccagcgccacagccctggtgtccaggacaggccgccacagcgagaggacagtgtctgctgggaagggcagcgccaccagcaactggaagaagacccccctgagcactggaggcaccctggcctttgtgagccccagcctggccgtgcacaagagcagcagcgctgtggaccggcagcgggagtacctgctggacatgatcccccccaggagcatcccccagagcgccacctggaagtag

SEQ ID NO: 15549 - DNA, 1902 bp, Artificial Sequence; identical to SEQ ID NO: 15548
  Description of Artificial Sequence: Synthetic coding sequence

SEQ ID NO: 15550 - DNA, 534 bp, Artificial Sequence
  Description of Artificial Sequence: Synthetic coding sequence
atgacagaggaggcctgcaggaccaggagccagaagagggccctggagcgggaccccacagaagatgatgtggagagcaagaagatcaagatggagcggggcctgctggccagtgacctgaacacagatggagacatgagggtgaccccagagcccggggccggccccacccagggcctgctgcgggccacagaggccacagccatggccatgggccgcggggagggcctggtgggagatggccctgtggacatgaggaccagccacagcgacatgaagtctgagcggcggccccccagcccagatgtgattgtgctgagtgacaatgagcagcccagcagcccccgggtgaatggcctgaccaccgtggccctgaaggagaccagcacagaggccctgatgaagagcagccctgaggagcgggagaggatgatcaagcagctgaaggaggagctgcggctggaggaggccaagctggtgctgctgaagaagctgcggcagagccagatccagaaggaggccacagcccagtag

SEQ ID NO: 15551 - DNA, 381 bp, Artificial Sequence
  Description of Artificial Sequence: Synthetic coding sequence
atgacagaggaggcctgcaggaccaggagccagaagagggccctggagcgggaccccacagaagatgatgtggagagcaagaagatcaagatggagcggggcctgctggccagtgacctgaacacagatggagacatgagggtgaccccagagcccggggccggccccacccagggcctgctgcgggccacagaggccacagccatggccatgggccgcggggagggcctggtgggagatggccctgtggacatgaggaccagccacagcgacatgaagtctgagcggcggccccccagcccagatgtgattgtgctgagtgacaatgagcagcccagcagcccccgggtgaatggcctgaccaccgtggccctgaagtag

SEQ ID NO: 15552 - DNA, 1311 bp, Artificial Sequence
  Description of Artificial Sequence: Synthetic coding sequence
atgatcaagcagctgaaggaggagctgcggctggaggaggccaagctggtgctgctgaagaagctgcggcagagccagatccagaaggaggccacagcccagaagaccagcagcgccaggatgcctggcagcgtcatccccccacccctggtgcggggcggccagcaggccagcagcaagctgggcccccaggccagcagccaggtggtgatgccacccctggtgcggggggcccagcagatccacagcatccggcagcacagcagcacaggccccccacccctgctgctggccccccgggcctctgtgcccagcgtgcagatccagggccagaggatcatccagcagggcctcatccgggtggccaacgtgcccaacaccagcctgctggtgaacatcccccagcccaccccagccagcctgaagggcaccacagccaccagcgcccaggccaacagcacccccacctctgtggcctctgtggtgaccagcgctgagagccctgccagccggcaggccgccgccaagctggccctgaggaagcagctggagaagaccctgctggagatccccccacccaagcccccagcccctgagatgaacttcctgcccagcgctgccaacaatgagttcatctacctggtgggcctggaggaggtggtgcagaacctgctggagacccaggccggccgcatgtctgctgccaccgtgctgagccgggagccctacatgtgtgcccagtgcaagacagacttcacctgccgctggagggaggagaagagcggggccatcatgtgtgagaactgcatgaccaccaaccagaagaaggccctgaaggtggagcacaccagccggctgaaggccgcctttgtgaaggccctgcagcaggagcaggagattgagcagaggctgctgcagcagggcacagccccagcccaggccaaggccgagcccacagctgccccccaccctgtgctgaagcaggccagcagccagctgagccggggcagcgccaccaccccccggggcgtgctgcacaccttcagccccagccccaagctgcagaacagcgccagcgccacagccctggtgtccaggacaggccgccacagcgagaggacagtgtctgctggaaaaggaagtgccaccagcaactggaagaagacccccctgagcactggaggcaccctggcctttgtgagccccagcctggccgtgcacaagagcagcagcgctgtggaccggcagcgggagtacctgctggacatgatccccccaagaagcatcccccagagcgccacctggaagtag

SEQ ID NO: 15553 - DNA, 420 bp, Artificial Sequence
  Description of Artificial Sequence: Synthetic coding sequence
atgacagaggaggcctgcaggaccaggagccagaagagggccctggagcgggaccccacagaagatgatgtggagagcaagaagatcaagatggagcggggcctgctggccagtgacctgaacacagatggagacatgagggtgaccccagagcccggggccggccccacccagggcctgctgcgggccacagaggccacagccatggccatgggccgcggggagggcctggtgggagatggccctgtggacatgaggaccagccacagcgacatgaagtctgagcggcggccccccagcccagatgtgattgtgctgagtgacaatgagcagcccagcagcccccgggtgaatggcctgaccaccgtggccctgaaggagaccagcacagaggccctgatgaagagcagccctgagtag

SEQ ID NO: 15554 - DNA, 282 bp, Artificial Sequence
  Description of Artificial Sequence: Synthetic coding sequence
atgacagaggaggcctgcaggaccaggagccagaagagggccctggagcgggaccccacagaagatgatgtggagagcaagaagatcaagatggagcggggcctgctggccagtgacctgaacacagatggagacatgagggtgaccccagagcccggggccggccccacccagggcctgctgcgggccacagaggccacagccatggccatgggccgcggggagggcctggtgggagatggccctgtggacatgaggaccagccacagcgacatgaagtag

SEQ ID NO: 15555 - DNA, 57 bp, Artificial Sequence
  Description of Artificial Sequence: Synthetic coding sequence
atgagcctgtggccctggcccaccggccgcaccagcaccccctacccagaggcctag

SEQ ID NO: 15556 - DNA, 507 bp, Artificial Sequence
  Description of Artificial Sequence: Synthetic coding sequence
atgacagaggaggcctgcaggaccaggagccagaagagggccctggagcgggaccccacagaagatgatgtggagagcaagaagatcaagatggagcggggcctgctggccagtgacctgaacacagatggagacatgagggtgaccccagagcccggggccggccccacccagggcctgctgcgggccacagaggccacagccatggccatgggccgcggggagggcctggtgggagatggccctgtggacatgaggaccagccacagcgacatgaagtctgagcggcggccccccagcccagatgtgattgtgctgagtgacaatgagcagcccagcagcccccgggtgaatggcctgaccaccgtggccctgaaggagaccagcacagaggccctgatgaagagcagccctgaggagcgggagaggatgatcaagcagctgaaggaggagctgcggctggaggaggccaagctggtgctgctgaagaagctgcggcagagctag

SEQ ID NO: 15557 - DNA, 789 bp, Artificial Sequence
  Description of Artificial Sequence: Synthetic coding sequence
atgaacttcctgcccagcgctgccaacaatgagttcatctacctggtgggcctggaggaggtggtgcagaacctgctggagacccaggccggccgcatgtctgctgccaccgtgctgagccgggagccctacatgtgtgcccagtgcaagacagacttcacctgccgctggagggaggagaagagcggggccatcatgtgtgagaactgcatgaccaccaaccagaagaaggccctgaaggtggagcacaccagccggctgaaggccgcctttgtgaaggccctgcagcaggagcaggagattgagcagaggctgctgcagcagggcacagccccagcccaggccaaggccgagcccacagctgccccccaccctgtgctgaagcaggtgatcaagcccaggaggaagctggccttccgctctggagaggcccgggactggagcaatggagctgtgctgcaggccagcagccagctgagccggggcagcgccaccaccccccggggcgtgctgcacaccttcagccccagccccaagctgcagaacagcgccagcgccacagccctggtgtccaggacaggccgccacagcgagaggacagtgtctgctggaaaaggaagtgccaccagcaactggaagaagacccccctgagcactggaggcaccctggcctttgtgagccccagcctggccgtgcacaagagcagcagcgctgtggaccggcagcgggagtacctgctggacatgatccccccaagaagcatcccccagagcgccacctggaagtag

SEQ ID NO: 15558 - DNA, 1782 bp, Artificial Sequence
  Description of Artificial Sequence: Synthetic coding sequence
atggacaggatgacagaagatgccctgcggctgaacctgctgaagaggagcctggaccctgcagatgaaagagatgatgtgctggccaagaggctgaagatggagggccacgaggccatggagcggctgaagatgctggccctgctgaagaggaaggacctggccaacctggaggtgccccatgagctgcccaccaagcaggacggcagcggcgtgaagggctatgaggagaagctgaatggaaacctgcggccccacggggacaacagaacagctggccggcctgggaaggagaacatcaatgatgagcctgtggacatgtctgcccggcgctctgagcctgagcggggccgcctgacccccagcccagacatcatcgtgctgagtgacaatgaggccagcagccccaggagcagcagcaggatggaggagcggctgaaggccgccaacctggagatgtttaaaggaaaaggaattgaggagcggcagcagctgatcaagcagctgagagatgagctgcggctggaggaggcccggctggtgctgctgaagaagctgcggcagagccagctgcagaaggaaaatgtggtgcagaagacccctgtggtgcagaatgctgccagcatcgtgcagcccagccctgcccacgtgggccagcagggcctgagcaagctgcccagcaggcctggggcccagggcgtggagccccagaacctgcggaccctgcagggccacagcgtcatccgcagcgccaccaacaccaccctgccccacatgctgatgagccagagggtcatcgcccccaacccagcccagctgcagggccagaggggcccccccaagccaggcctggtgaggaccaccacccccaacatgaacccagccatcaactaccagccccagagcagcagctctgtgccctgccagaggaccaccagcagcgccatctacatgaacctggccagccacatccagcccggcaccgtgaacagagtgagcagccccctgcccagccccagcgccatgacagatgctgccaacagccaggccgccgccaagctggccctgaggaagcagctggagaagaccctgctggagatccccccacccaagcccccagcccccctgctgcacttcctgcccagcgctgccaacagcgagttcatctacatggtgggcctggaggaggtggtgcagagcgtcatcgacagccagggcaagagctgtgccagcctgctgcgggtggagccctttgtgtgtgcccagtgcaggacagacttcaccccccactggaagcaggagaagaatggcaagatcctgtgtgagcagtgcatgaccagcaaccagaagaaggccctgaaggccgagcacaccaaccggctgaagaatgcctttgtgaaggccctgcagcaggagcaggagattgagcagaggctgcagcagcaggccgccctgagccccaccacagccccagctgtgtcctctgtgtccaagcaggagaccatcatgaggcaccacaccctgcggcaggccccccagccccagagcagcctgcagaggggcatccccaccagcgcccgctccatgctgagcaactttgcccaggccccccagctgtctgtgcctgggggcctgctgggcatgcctggggtgaacatcgcctacctgaacacaggcatcggcggccacaagggccccagcctggccgaccggcagcgggagtacctgctggacatgatccccccaagaagcatcagccagagcatcagcggccagaagtag

SEQ ID NO: 15559 - DNA, 1425 bp, Artificial Sequence
  Description of Artificial Sequence: Synthetic coding sequence
atggcccagcacgactttgtgcctgcctggctgaacttcagcaccccccagagcgccaagagccccacagccacctttgagaagcatggagagcacctgcccagaggagagggccgcttcggcgtgtccagaagaagacacaacagcagtgatggcttcttcaacaacggccccctgaggacagctggggacagctggcaccagcccagcctcttcagacatgacagcgtggacagcggcgtgtccaaaggagcctatgccggcatcaccggcaaccccagcggctggcacagcagcagccggggccatgatggcatgagccagaggtctgggggcggcaccggcaaccaccgccactggaatggcagcttccacagcaggaagggctgtgccttccaggagaagccacccatggagatccgggaggagaagaaggaggacaaggtggagaagctgcagtttgaggaggaggacttccccagcctgaaccctgaggccggcaagcagcaccagccctgccggcccatcggcacccccagcggcgtgtgggagaacccccccagcgccaagcagcccagcaagatgctggtgatcaagaaggtgtccaaggaggaccctgctgctgccttctctgctgccttcaccagccctggcagccaccacgccaatggaaacaagctgagctctgtggtgcccagcgtgtacaagaacctggtgcccaagcctgtgcccccacccagcaagcccaatgcctggaaggccaacaggatggagcacaagagcggcagcctgagcagcagccgggagagcgccttcaccagccccatctctgtgaccaagcctgtggtgctggccagcggggccgccctgagcagccccaaggagagccccagcagcaccaccccacccatcgagatcagcagcagccggctgaccaagctgaccaggaggaccacagacaggaagtctgagttcctgaagaccctgaaggatgacagaaatggagacttctctgaaaatagagactgtgacaagctggaggacctggaggacaacagcaccccagagcccaaggaaaatggagaggagggctgccaccagaatggcctggccctgcctgtggtggaggagggggaggtgctgagccacagcctggaggccgagcaccggctgctgaaggccatgggctggcaggagtacccagaaaatgatgagaactgcctgcccctgacagaagatgagctgaaggagttccacatgaagacagagcagctgcggagaaatggatttgggaagaatggcttcctgcagagccgcagcagcagcctcttcagcccctggaggagcacctgcaaggccgagtttgaggacagcgacacagagaccagcagcagcgagaccagtgatgatgatgcctggaagtag

SEQ ID NO: 15560 - DNA, 1425 bp, Artificial Sequence; identical to SEQ ID NO: 15559
  Description of Artificial Sequence: Synthetic coding sequence

SEQ ID NO: 15561 - DNA, 2448 bp, Artificial Sequence
  Description of Artificial Sequence: Synthetic coding sequence
atgttcaggaaggcccggcgggtgaatgtgaggaagagaaatgacagcgaggaggaggagcgggagagagatgaggagcaggagcccccacccctgctgcccccacctggcaccggggaggaggccggccctgggggcggggaccgggcccctggaggagagagcctgctgggccctggccccagccccccatctgccctgaccccaggcctgggcgctgaggccggcggcggcttccctgggggcgctgagcctggaaatggcctgaagcccaggaagaggccccgggagaacaaggaggtgccccgggccagcctgctgtccttccaggatgaggaggaggagaatgaggaggtgttcaaggtgaagaagagcagctacagcaagaagatcgtgaagctgctgaagaaggagtacaaggaggacctggagaagagcaagatcaagacagagctgaacagcagcgctgagagcgagcagcccctggacaagacaggccacgtgaaggacaccaaccaggaggatggagtcatcatcagcgagcacggggaggatgagatggacatggagagcgagaaggaggaggagaagcccaagacaggaggagccttcagcaatgccctgagcagcctgaatgtgctgcggcctggagagatcccagatgctgccttcatccatgctgccaggaagaagaggcagatggcccgggagctgggggacttcacccctcatgacaatgagcccgggaagggccgcctggtgcgggaggatgaaaatgatgccagtgatgatgaagatgatgatgagaagagaagaattgtgttttctgtgaaggagaagagccagaggcagaagattgctgaggagatcggcatcgagggcagtgatgatgatgccctggtgactggagagcaggatgaggagctgagccgctgggagcaggagcagatcaggaagggcatcaacatcccccaggtgcaggccagccagcctgctgaggtgaacatgtactaccagaacacctaccagaccatgccctacggcagcagctatggcatcccctacagctacacagcctacggcagcagtgatgccaagagccagaagacagacaacacagtgcccttcaagacccccagcaatgagatgacccctgtgaccatcgacctggtgaagaagcagctgaaggaccggctggacagcatgaaggagctgcacaagaccaaccggcagcagcacgagaagcacctgcagagccgggtggacagcacccgggccatcgagcggctggagggcagcagcggcggcattggagagcgctacaagttcctgcaggagatgaggggctacgtgcaggacctgctggagtgcttcagcgagaaggtgcccctcatcaatgagctggagagcgccatccaccagctgtacaagcagagggccagccggctggtgcagaggcggcaggatgacatcaaggatgagagcagcgagttcagcagccacagcaacaaggccctgatggcccccaacctggacagctttggccgggaccgggccctgtaccaggagcacgccaagagaagaattgctgagcgggaggcccggaggacccggcggcggcaggcccgggagcagacaggcaagatggctgaccacctggagggcctgagcagtgatgatgaggagaccagcacagacatcaccaacttcaacctggagaaggaccgcatcagcaaggagagcggcaaggtgtttgaagatgtgctggagagcttctacagcattgactgcatcaagagccagtttgaggcctggaggagcaagtactacaccagctacaaggatgcctacatcggcctgtgcctgcccaagctgttcaaccccctcatccggctgcagctgctgacctggacccccctggaggccaagtgccgggactttgagaacatgctgtggtttgagagcctgctcttctacggctgtgaggagcgggagcaggagaaggatgatgtggatgtggccctgctgcccaccatcgtggagaaggtgatcctgcccaagctgactgtgattgctgagaacatgtgggaccccttcagcaccacccagaccagcaggatggtgggcatcaccctgaagctgatcaatggctaccccagcgtggtgaatgctgagaacaagaacacccaggtgtacctgaaggccctgctgctgaggatgaggaggaccctggatgatgatgtgttcatgcccctgtaccccaagaatgtgctggagaacaagaacagcggcccctacctgttcttccagaggcagttctggagctctgtgaaggtgatcaagccacccttccagaggggcagctgccccatccccaggaggaaggagtgctgcagcgagcggccccggcgcatctggacagaccggccctgtgtggtgttctcctag

SEQ ID NO: 15562 - DNA, 2754 bp, Artificial Sequence
  Description of Artificial Sequence: Synthetic coding sequence
atgttcaggaaggcccggcgggtgaatgtgaggaagagaaatgacagcgaggaggaggagcgggagagagatgaggagcaggagcccccacccctgctgcccccacctggcaccggggaggaggccggccctgggggcggggaccgggcccctggaggagagagcctgctgggccctggccccagccccccatctgccctgaccccaggcctgggcgctgaggccggcggcggcttccctgggggcgctgagcctggaaatggcctgaagcccaggaagaggccccgggagaacaaggaggtgccccgggccagcctgctgtccttccaggatgaggaggaggagaatgaggaggtgttcaaggtgaagaagagcagctacagcaagaagatcgtgaagctgctgaagaaggagtacaaggaggacctggagaagagcaagatcaagacagagctgaacagcagcgctgagagcgagcagcccctggacaagacaggccacgtgaaggacaccaaccaggaggatggagtcatcatcagcgagcacggggaggatgagatggacatggagagcgagaaggaggaggagaagcccaagacaggaggagccttcagcaatgccctgagcagcctgaatgtgctgcggcctggagagatcccagatgctgccttcatccatgctgccaggaagaagaggcagatggcccgggagctgggggacttcacccctcatgacaatgagcccgggaagggccgcctggtgcgggaggatgaaaatgatgccagtgatgatgaagatgatgatgagaagagaagaattgtgttttctgtgaaggagaagagccagaggcagaagattgctgaggagatcggcatcgagggcagtgatgatgatgccctggtgactggagagcaggatgaggagctgagccgctgggagcaggagcagatcaggaagggcatcaacatcccccaggtgcaggccagccagcctgctgaggtgaacatgtactaccagaacacctaccagaccatgccctacggcagcagctatggcatcccctacagctacacagcctacggcagcagtgatgccaagagccagaagacagacaacacagtgcccttcaagacccccagcaatgagatgacccctgtgaccatcgacctggtgaagaagcagctgaaggaccggctggacagcatgaaggagctgcacaagaccaaccggcagcagcacgagaagcacctgcagagccgggtggacagcacccgggccatcgagcggctggagggcagcagcggcggcattggagagcgctacaagttcctgcaggagatgaggggctacgtgcaggacctgctggagtgcttcagcgagaaggtgcccctcatcaatgagctggagagcgccatccaccagctgtacaagcagagggccagccggctggtgcagaggcggcaggatgacatcaaggatgagagcagcgagttcagcagccacagcaacaaggccctgatggcccccaacctggacagctttggccgggaccgggccctgtaccaggagcacgccaagagaagaattgctgagcgggaggcccggaggacccggcggcggcaggcccgggagcagacaggcaagatggctgaccacctggagggcctgagcagtgatgatgaggagaccagcacagacatcaccaacttcaacctggagaaggaccgcatcagcaaggagagcggcaaggtgtttgaagatgtgctggagagcttctacagcattgactgcatcaagagccagtttgaggcctggaggagcaagtactacaccagctacaaggatgcctacatcggcctgtgcctgcccaagctgttcaaccccctcatccggctgcagctgctgacctggacccccctggaggccaagtgccgggactttgagaacatgctgtggtttgagagcctgctcttctacggctgtgaggagcgggagcaggagaaggatgatgtggatgtggccctgctgcccaccatcgtggagaaggtgatcctgcccaagctgactgtgattgctgagaacatgtgggaccccttcagcaccacccagaccagcaggatggtgggcatcaccctgaagctgatcaatggctaccccagcgtggtgaatgctgagaacaagaacacccaggtgtacctgaaggccctgctgctgaggatgaggaggaccctggatgatgatgtgttcatgcccctgtaccccaagaatgtgctggagaacaagaacagcggcccctacctgttcttccagaggcagttctggagctctgtgaagctgctgggcaacttcctgcagtggtacggcatcttcagcaacaagaccctgcaggagctgagcattgatggcctgctgaaccgctacatcctgatggccttccagaacagtgaatatggagatgacagcatcaagaaggcccagaatgtcatcaactgcttccccaagcagtggttcatgaacctgaagggggagaggaccatcagccagctggagaacttctgccgctacctggtgcacctggccgacaccatctacagaaattccatcggctgcagtgatgtggagaagagaaatgcccgggagaacatcaagcagatcgtgaagctgctggcctctgtgcgggccctggaccacgccatgtctgtggccagtgaccacaacgtgaaggagttcaagagcctcatcgagggcaagtag

SEQ ID NO: 15563 - DNA, 2346 bp, Artificial Sequence
  Description of Artificial Sequence: Synthetic coding sequence
atggcccaccggcccaagaggaccttccggcagagagctgctgacagcagtgacagtgatggagctgaggagagccctgctgagcccggggccccccgggagctgcctgtgcccggcagcgctgaggaggagcccccatctgggggcggccgggcccaggtggccggcctgccccaccgggtgcggggcccccggggccggggccgggtgtgggccagcagcagaagagccaccaaggccgcccccagggcagatgagggcagcgagagcaggaccctggatgtgtccacagatgaggaggacaagatccaccacagcagcgagagcaaggatgaccagggcctgagcagtgacagcagcagcagcctgggggagaaggagctgagcagcacagtgaagatcccagatgctgccttcatccaggccgcccggaggaagcgggagctggcccgggcccaggatgactacatcagcctggatgtgcagcacaccagcagcatcagcggcatgaagcgggagagtgaagatgatcctgagagcgagccagatgaccacgagaagaggatccccttcaccctgcggccccagaccctgcggcagaggatggccgaggagagcatcagcagaaatgaggagaccagcgaggagagccaggaggatgagaagcaggacacctgggagcagcagcagatgaggaaggctgtgaagatcatcgaggagcgggacatcgacctgagctgtggaaatggcagcagcaaggtgaagaagtttgacaccagcatctccttcccccctgtgaacctggagatcatcaagaagcagctgaacacccggctgaccctgctgcaggagacccacaggagccacctgcgggagtatgagaagtatgtgcaggatgtgaagagcagcaagagcaccatccagaacctggagagcagcagcaaccaggccctgaactgcaagttctacaagtccatgaagatctacgtggagaacctgattgactgcctgaatgagaagatcatcaacatccaggagattgagagctccatgcacgccctgctgctgaagcaggccatgaccttcatgaagaggcggcaggatgagctgaagcatgagagcacctacctgcagcagctgagcaggaaggatgagaccagcaccagcggcaacttctctgtggatgagaagacccagtggatcctggaggagattgagagcaggaggaccaagaggcggcaggcccgggtgctgagcggcaactgcaaccaccaggagggcaccagcagtgatgatgagctgcccagcgctgagatgattgacttccagaagagccagggcgacatcctgcagaagcagaagaaggtgtttgaggaggtgcaggatgacttctgcaacatccagaacatcctgctgaagttccagcagtggagggagaagttcccagacagctactatgaggccttcatcagcctgtgcatccccaagctgctgaaccccctcatccgggtgcagctgattgactggaaccccctgaagctggagagcacaggcctgaaggagatgccctggttcaagtctgtggaggagttcatggacagctctgtggaggacagcaagaaggagagcagcagtgacaagaaggtgctgagcgccatcatcaacaagaccatcatcccccggctgacagactttgtggagttcctgtgggaccccctgagcaccagccagaccaccagcctcatcacccactgcagggtcatcctggaggagcacagcacctgtgaaaatgaggtgtccaagagccggcaggacctgctgaagagcatcgtgtccaggatgaagaaggctgtggaggatgatgtgttcatccccctgtaccccaagtctgctgtggagaacaagaccagcccccacagcaagttccaggagcggcagttctggagcggcctgaagctgttcaggaacatcctgctgtggaatggcctgctgacagatgacaccctgcaggagctgggcctgggcaagctgctgaaccgctacctgatcatcgccctgctgaatgccaccccaggcccagatgtggtgaagaagtgcaaccaggtggccgcctgcctgcctgagaagtggtttgagaacagcgccatgaggaccagcatcccccagctggagaacttcatccagttcctgctgcagagcgcccacaagctgagccgctctgagttcagagatgaggtggaggagatcatcctgatcctggtgaagatcaaggccctgaaccaggccgagagcttcatcggggagcaccacctggaccacctgaagagcctcatcaaggaggactag

SEQ ID NO: 15564 - DNA, 2232 bp, Artificial Sequence
  Description of Artificial Sequence: Synthetic coding sequence
atggcccaccggcccaagaggaccttccggcagagagctgctgacagcagtgacagtgatggagctgaggagagccctgctgagcccggggccccccgggagctgcctgtgcccggcagcgctgaggaggagcccccatctgggggcggccgggcccaggtggccggcctgccccaccgggtgcggggcccccggggccggggccgggtgtgggccagcagcagaagagccaccaaggccgcccccagggcagatgagggcagcgagagcaggaccctggatgtgtccacagatgaggaggacaagatccaccacagcagcgagagcaaggatgaccagggcctgagcagtgacagcagcagcagcctgggggagaaggagctgagcagcacagtgaagatcccagatgctgccttcatccaggccgcccggaggaagcgggagctggcccgggcccaggatgactacatcagcctggatgtgcagcacaccagcagcatctctgtgtccagaaatgaggagaccagcgaggagagccaggaggatgagaagcaggacacctgggagcagcagcagatgaggaaggctgtgaagatcatcgaggagcgggacatcgacctgagctgtggaaatggcagcagcaaggtgaagaagtttgacaccagcatctccttcccccctgtgaacctggagatcatcaagaagcagctgaacacccggctgaccctgctgcaggagacccacaggagccacctgcgggagtatgagaagtatgtgcaggatgtgaagagcagcaagagcaccatccagaacctggagagcagcagcaaccaggccctgaactgcaagttctacaagtccatgaagatctacgtggagaacctgattgactgcctgaatgagaagatcatcaacatccaggagattgagagctccatgcacgccctgctgctgaagcaggccatgaccttcatgaagaggcggcaggatgagctgaagcatgagagcacctacctgcagcagctgagcaggaaggatgagaccagcaccagcggcaacttctctgtggatgagaagacccagtggatcctggaggagattgagagcaggaggaccaagaggcggcaggcccgggtgctgagcggcaactgcaaccaccaggagggcaccagcagtgatgatgagctgcccagcgctgagatgattgacttccagaagagccagggcgacatcctgcagaagcagaagaaggtgtttgaggaggtgcaggatgacttctgcaacatccagaacatcctgctgaagttccagcagtggagggagaagttcccagacagctactatgaggccttcatcagcctgtgcatccccaagctgctgaaccccctcatccgggtgcagctgattgactggaaccccctgaagctggagagcacaggcctgaaggagatgccctggttcaagtctgtggaggagttcatggacagctctgtggaggacagcaagaaggagagcagcagtgacaagaaggtgctgagcgccatcatcaacaagaccatcatcccccggctgacagactttgtggagttcctgtgggaccccctgagcaccagccagaccaccagcctcatcacccactgcagggtcatcctggaggagcacagcacctgtgaaaatgaggtgtccaagagccggcaggacctgctgaagagcatcgtgtccaggatgaagaaggctgtggaggatgatgtgttcatccccctgtaccccaagtctgctgtggagaacaagaccagcccccacagcaagttccaggagcggcagttctggagcggcctgaagctgttcaggaacatcctgctgtggaatggcctgctgacagatgacaccctgcaggagctgggcctgggcaagctgctgaaccgctacctgatcatcgccctgctgaatgccaccccaggcccagatgtggtgaagaagtgcaaccaggtggccgcctgcctgcctgagaagtggtttgagaacagcgccatgaggaccagcatcccccagctggagaacttcatccagttcctgctgcagagcgcccacaagctgagccgctctgagttcagagatgaggtggaggagatcatcctgatcctggtgaagatcaaggccctgaaccaggccgagagcttcatcggggagcaccacctggaccacctgaagagcctcatcaaggaggactag

SEQ ID NO: 15565 - DNA, 765 bp, Artificial Sequence
  Description of Artificial Sequence: Synthetic coding sequence
atggcccaccggcccaagaggaccttccggcagagagctgctgacagcagtgacagtgatggagctgaggagagccctgctgagcccggggccccccgggagctgcctgtgcccggcagcgctgaggaggagcccccatctgggggcggccgggcccaggtggccggcctgccccaccgggtgcggggcccccggggccggggccgggtgtgggccagcagcagaagagccaccaaggccgcccccagggcagatgagggcagcgagagcaggaccctggatgtgtccacagatgaggaggacaagatccaccacagcagcgagagcaaggatgaccagggcctgagcagtgacagcagcagcagcctgggggagaaggagctgagcagcacagtgaagatcccagatgctgccttcatccaggccgcccggaggaagcgggagctggcccgggcccaggatgactacatcagcctggatgtgcagcacaccagcagcatcagcggcatgaagcgggagagtgaagatgatcctgagagcgagccagatgaccacgagaagaggatccccttcaccctgcggccccagaccctgcggcagaggatggccgaggagagcatcagcagaaatgaggagaccagcgaggagagccaggaggatgagaagcaggacacctgggagcagcagcagatgaggaaggctgtgaagatcatcgagatcaacatcaccaccggcaacagccccctgaccccagagggcgtgtag

SEQ ID NO: 15566 - DNA, 504 bp, Artificial Sequence
  Description of Artificial Sequence: Synthetic coding sequence
atgtctgagtggatgaagaagggccccctggagtggcaggactacatctacaaggaggtgcgggtgacagccagcgagaagaatgagtacaagggctgggtgctgaccacagatcctgtgtctgccaacatcgtgctggtgaacttcctggaggatggctccatgtctgtgacaggcatcatgggccatgctgtgcagacagtggagaccatgaatgaaggagaccaccgggtgcgggagaagctgatgcacctgttcaccagcggggactgcaaggcctacagccctgaggacctggaggagaggaagaacagcctgaagaagtggctggagaagaaccacatccccatcacagagcagggagatgcccccaggaccctgtgtgtggccggcgtgctgaccattgatcctccctacggccctgagaactgcagcagcagcaatgagatcatcctgagccgggtgcaggacctgattgagggccacctgacagccagccagtag

SEQ ID NO: 15567 - DNA, 336 bp, Artificial Sequence
  Description of Artificial Sequence: Synthetic coding sequence
atgtctgagtggatgaagaagggccccctggagtggcaggactacatctacaaggaggtgcgggtgacagccagcgagaagaatgagtacaagggctgggtgctgaccacagatcctgtgtctgccaaggtgctgctgagcccccggctggagtgcagcggggagatcagcgccctgtgcaacctgcacctggccggcagcagtgacagccctgccctggccagccgggtggccggcaccaccggcatctgccaccacgtgtggctgatctttgtgttctttgtggagaccggcctgcggcacgtggcccagtactgcccctgtgagctgccctag

SEQ ID NO: 15568 - DNA, 330 bp, Artificial Sequence
  Description of Artificial Sequence: Synthetic coding sequence
atggcctaccagctgtacagaaacaccaccctgggcaacagcctgcaggagagcctggatgagctgatccagagccagcagatcaccccccagctggccctgcaggtgctgctgcagtttgacaaggccatcaatgctgccctggcccagagggtgaggaacagagtgaacttccggggcagcctgaacacctaccgcttctgtgacaacgtgtggacctttgtgctgaatgatgtggagttccgggaggtgacagagctgatcaaggtggacaaggtgaagatcgtggcctgtgatggcaagaacacaggcagcaacaccacagaatag

SEQ ID NO: 15569 - DNA, 330 bp, Artificial Sequence; identical to SEQ ID NO: 15568
  Description of Artificial Sequence: Synthetic coding sequence

SEQ ID NO: 15570 - DNA, 330 bp, Artificial Sequence; identical to SEQ ID NO: 15568
  Description of Artificial Sequence: Synthetic coding sequence

SEQ ID NO: 15571 - DNA, 1320 bp, Artificial Sequence
  Description of Artificial Sequence: Synthetic coding sequence
atggctgaccctgatgtgctgacagaggtgcctgctgccctgaagaggctggccaagtatgtgatccggggcttctacggcatcgagcacgccctggccctggacatcctgatccggaacagctgtgtgaaggaggaggacatgctggagctgctgaagtttgacaggaagcagctgcggtctgtgctgaacaacctgaagggggacaagttcatcaagtgcaggatgagggtggagacagctgctgatggcaagaccaccaggcacaactactacttcatcaactaccgcaccctggtgaatgtggtgaagtacaagctggaccacatgagaagacgcatcgagacagatgagcgggacagcaccaacagagccagcttcaagtgccctgtgtgcagcagcaccttcacagacctggaggccaaccagctgtttgaccccatgacaggcaccttccgctgcaccttctgccacacagaggtggaggaggatgagagcgccatgcccaagaaggatgcccggaccctgctggcccgcttcaatgagcagatcgagcccatctatgccctgctgcgggagacagaagatgtgaacctggcctatgagatcctggagcctgagcccacagagatcccagccctgaagcagagcaaggaccatgctgccaccacagctggagctgccagcctggccggcggccaccaccgggaggcctgggccaccaagggccccagctatgaagatctctacacccagaatgtggtgatcaacatggatgaccaggaggacctgcaccgggccagcctggagggcaagagcgccaaggagcggcccatctggctgcgggagagcacagtgcagggcgcctacggcagcgaggacatgaaggagggcggcatcgacatggatgccttccaggagcgggaggagggccatgctggcccagatgacaatgaggaggtgatgagggccctgctgatccacgagaagaagaccagcagcgccatggccggctctgtgggcgctgctgcccctgtgacagctgccaacggcagtgacagcgagagcgagaccagcgagagtgatgatgacagcccccccaggcctgctgctgtggccgtgcacaagcgggaggaggatgaggaggaggatgatgaatttgaggaggtggctgatgaccccatcgtgatggtggccggccggcccttctcctacagcgaggtgtcccagaggcctgagctggtggcccagatgaccccagaggagaaggaggcctacatcgccatgggccagaggatgtttgaggacctgtttgaatag

SEQ ID NO: 15572 - DNA, 150 bp, Artificial Sequence
  Description of Artificial Sequence: Synthetic coding sequence
atggctgaccctgatgtgctgacagaggtgcctgctgccctgaagaggctggccaagtatgtgatccggggcttctacggcatcgagcacgccctggccctggacatcctgatccggaacagctgtgtgaaggaggaggacatgctgtag

SEQ ID NO: 15573 - DNA, 369 bp, Artificial Sequence
  Description of Artificial Sequence: Synthetic coding sequence
atggctgaccctgatgtgctgacagaggtgcctgctgccctgaagaggctggccaagtatgtgatccggggcttctacggcatcgagcacgccctggccctggacatcctgatccggaacagctgtgtgaaggaggaggacatgctggagctgctgaagtttgacaggaagcagctgcggtctgtgctgaacaacctgaagggggacaagttcatcaagtgcaggatgagggtggagacagctgctgatggcaagaccaccaggcacaactactacttcatcaactaccgcaccctggtgaatgtggtgaagtacaagctggaccacatgagaagacgcatcgagacagatgagcgggacagcacctag

SEQ ID NO: 15574 - DNA, 1188 bp, Artificial Sequence
  Description of Artificial Sequence: Synthetic coding sequence
atggatgaggagcctgagaggaccaagcgctgggagggcggctatgaaagaacctgggagatcctgaaggaggatgaaagtggcagcctgaaggccaccatcgaggacatcctcttcaaggccaagaggaagagggtgtttgagcaccacggccaggtgcggctgggcatgatgaggcacctgtatgtggtggtggatggcagcaggaccatggaggaccaggacctgaagcccaaccggctgacctgcaccctgaagctgctggagtactttgtggaggagtactttgaccagaaccccatcagccagatcggcatcatcgtgaccaagagcaagagagctgagaagctgacagagctgagcggcaaccccaggaagcacatcaccagcctgaaggaggccgtggacatgacctgccacggggagcccagcctgtacaacagcctgtccatggccatgcagaccctgaagcacatgcctggccacaccagccgggaggtgctgatcatcttcagcagcctgaccacctgtgaccccagcaacatctatgacctgatcaagaccctgaaggccgccaagatccgggtgtctgtgattggcctgtctgctgaggtgcgggtgtgcaccgtgctggcccgggagactggaggcacctaccacgtgatcctggatgagagccactacaaggagctgctgacccaccacctgagccccccaccagccagcagcagcagcgagtgcagcctcatccgcatgggcttcccccagcacaccatcgccagcctgagtgaccaggatgccaagcccagcttctccatggcccacctggatggcaacacagagcccggcctgaccctgggcggctacttctgcccccagtgccgggccaagtactgtgagctgcctgtggagtgcaagatctgtggcctgaccctggtgtctgccccccacctggcccggagctaccaccacctgttccccctggatgccttccaggagatccccctggaggagtacaacggggagcgcttctgctacggctgccagggcgagctgaaggaccagcacgtgtatgtgtgtgctgtgtgccagaatgtgttctgtgtggactgtgatgtgtttgtgcatgacagcctgcactgctgccccggctgcatccacaagatcccagcccccagcggcgtgtag

SEQ ID NO: 15575 - DNA, 1017 bp, Artificial Sequence
  Description of Artificial Sequence: Synthetic coding sequence
atgaggcacctgtatgtggtggtggatggcagcaggaccatggaggaccaggacctgaagcccaaccggctgacctgcaccctgaagctgctggagtactttgtggaggagtactttgaccagaaccccatcagccagatcggcatcatcgtgaccaagagcaagagagctgagaagctgacagagctgagcggcaaccccaggaagcacatcaccagcctgaaggaggccgtggacatgacctgccacggggagcccagcctgtacaacagcctgtccatggccatgcagaccctgaagcacatgcctggccacaccagccgggaggtgctgatcatcttcagcagcctgaccacctgtgaccccagcaacatctatgacctgatcaagaccctgaaggccgccaagatccgggtgtctgtcatcggcctgtctgctgaggtgcgggtgtgcaccgtgctggcccgggagaccggcggcacctaccacgtgatcctggatgagagccactacaaggagctgctgacccaccacctgagccccccaccagccagcagcagcagtgaatgttccctcatccgcatgggcttcccccagcacaccatcgccagcctgagtgaccaggatgccaagcccagcttctccatggcccacctggatggcaacacagagcccggcctgaccctgggcggctacttctgcccccagtgccgggccaagtactgtgagctgcctgtggagtgcaagatctgtggcctgaccctggtgtctgccccccacctggcccggagctaccaccacctgttccccctggatgccttccaggagatccccctggaggagtacaatggagagcgcttctgctacggctgccagggcgagctgaaggaccagcacgtgtatgtgtgtgctgtgtgccagaatgtgttctgtgtggactgtgatgtgtttgtgcatgacagcctgcactgctgccccggctgcatccacaagatcccagcccccagcggcgtgtag

SEQ ID NO: 15576 - DNA, 1188 bp, Artificial Sequence; identical to SEQ ID NO: 15574
  Description of Artificial Sequence: Synthetic coding sequence

SEQ ID NO: 15577 - DNA, 606 bp, Artificial Sequence
  Description of Artificial Sequence: Synthetic coding sequence
atgacagagaaggcccctgagccccacgtggaggaggatgatgatgatgagctggacagcaagctgaactacaagcccccaccccagaagagcctgaaggagctgcaggagatggacaaggatgatgagagcctcatcaagtacaagaagaccctgctgggagatggccctgtggtgacagaccccaaggcccccaacgtggtggtgacccggctgaccctggtgtgtgagagcgcccctggccccatcaccatggacctgaccggggacctggaggccctgaagaaggagaccatcgtgctgaaggagggcagcgagtacagagtgaagatccacttcaaggtgaacagagacatcgtgtctggcctgaagtatgtgcagcacacctacagaactggagtgaaggtggacaaggccaccttcatggtgggcagctatggccccaggcctgaggagtatgagttcctgacccctgtggaggaggcccccaagggcatgctggcccggggcacctaccacaacaagagcttcttcacagatgatgacaagcaggaccacctgtcctgggagtggaacctgagcatcaagaaggagtggacagaatag

SEQ ID NO: 15578 - DNA, 777 bp, Artificial Sequence
  Description of Artificial Sequence: Synthetic coding sequence
atgaacagaagcaacaagctggccgtcatcgccagccacatccaggagagccgcttcctgtacccaggcaagaatggccgcctgggggacttcttcggggaccccggcaaccccccagagttcaaccccagcggcagcaaggatggcaagtatgagctgctgaccagcgccaatgaggtgattgtggaggagatcaaggacctgatgaccaagagtgacatcaagggccagcacacagagaccctgctggccggcagcctggccaaggccctgtgctacatccacaggatgaacaaggaggtgaaggacaaccaggagatgaagagccgcatcctggtgatcaaggctgctgaggacagcgccctgcagtacatgaacttcatgaatgtcatctttgctgcccagaagcagaacatcctgattgatgcctgtgtgctggacagcgacagcggcctgctgcagcaggcctgtgacatcaccggcggcctgtacctgaaggtgccccagatgcccagcctgctgcagtacctgctgtgggtgttcctgcctgaccaggaccagaggagccagctgatcctgcccccacctgtgcacgtggactacagagctgcctgcttctgccacaggaacctgattgagatcggctacgtgtgcagcgtgtgcctgagcatcttctgcaacttcagccccatctgcaccacctgtgaaacagccttcaagatcagcctgccccctgtgctgaaggccaagaagaagaagctgaaggtgtctgcctag

SEQ ID NO: 15579 - DNA, 927 bp, Artificial Sequence
  Description of Artificial Sequence: Synthetic coding sequence
atggtgtctgatgaagatgagctgaacctgctggtgattgtggtggatgccaaccccatctggtggggcaagcaggccctgaaggagagccagttcaccctgagcaagtgcattgatgctgtgatggtgctgggcaacagccacctgttcatgaacagaagcaacaagctggccgtcatcgccagccacatccaggagagccgcttcctgtacccaggcaagaatggccgcctgggggacttcttcggggaccccggcaaccccccagagttcaaccccagcggcagcaaggatggcaagtatgagctgctgaccagcgccaatgaggtgattgtggaggagatcaaggacctgatgaccaagagtgacatcaagggccagcacacagagaccctgctggccggcagcctggccaaggccctgtgctacatccacaggatgaacaaggaggtgaaggacaaccaggagatgaagagccgcatcctggtgatcaaggctgctgaggacagcgccctgcagtacatgaacttcatgaatgtcatctttgctgcccagaagcagaacatcctgattgatgcctgtgtgctggacagcgacagcggcctgctgcagcaggcctgtgacatcaccggcggcctgtacctgaaggtgccccagatgcccagcctgctgcagtacctgctgtgggtgttcctgcctgaccaggaccagaggagccagctgatcctgcccccacctgtgcacgtggactacagagctgcctgcttctgccacaggaacctgattgagatcggctacgtgtgcagcgtgtgcctgagcatcttctgcaacttcagccccatctgcaccacctgtgaaacagccttcaagatcagcctgccccctgtgctgaaggccaagaagaagaagctgaaggtgtctgcctag

SEQ ID NO: 15580 - DNA, 6330 bp, Artificial Sequence
  Description of Artificial Sequence: Synthetic coding sequence
atggatgccctggagagcctgctggatgaggtggccctggagggcctggatggcctgtgcctgcctgccctgtggagccggctggagaccagggtgccccccttccccctgcccctggagccctgcacccaggagttcctgtggagggccctggccacccaccctggcatctccttctatgaggagccccgggagaggccagacctgcagctgcaggacagatatgaggagattgacctggagaccggcatcctggagagccggcgggaccctgtggccctggaggatgtgtaccccatccacatgatcctggagaacaaggatggcatccagggcagctgccgctacttcaaggagaggaagaacatcaccaatgacatccgcaccaagagcctgcagccccgctgcaccatggtggaggcctttgaccgctggggcaagaagctgatcatcgtggccagccaggccatgagataccgggccctgattggccaggagggggaccctgacctgaagctgcctgacttctcctactgcatcctggagcggctgggccgcagccgctggcagggcgagctgcagagggacctgcacaccacagccttcaaggtggatgctgggaagctgcactaccacaggaagatcctgaacaagaatggcctcatcaccatgcagagccacgtgatccggctgcccactggagcccagcagcacagcatcctgctgctgctgaaccgcttccacgtggacagaagaagcaaatatgacatcctgatggagaagctgtctgtgatgctgagcaccaggaccaaccacatcgagaccctgggcaagctgcgggaggagctgggcctgtgtgagaggaccttcaagaggctgtaccagtacatgctgaatgccggcctggccaaggtggtgtccctgcggctgcaggagatccacccagaatgtggcccctgcaagaccaagaagggcacagatgtgatggtgcgctgcctgaagctgctgaaggagttcaagagaaatgaccatgatgatgatgaagatgaggaggtgatcagcaagacagtgccccctgtggacatcgtgtttgagcgggacatgctgacccagacctatgacctgattgaaagaagaggcaccaagggcatcagccaggccgagatccgggtggccatgaatgtgggcaagctggaggccaggatgctgtgccgcctgctgcagcgcttcaaggtggtgaagggcttcatggaggatgagggccggcagaggaccaccaagtacatcagctgtgtgtttgctgaggagagtgacctgagccggcagtaccagcgggagaaggcccggtctgagctgctgaccaccgtgtccctggcctccatgcaggaggagagcctgctgcctgaaggagaggacaccttcctgtctgagagtgacagcgaggaggagaggagcagcagcaagagaagaggccggggcagccagaaggacacccgggccagcgccaacctgcggcccaagacccagccccaccacagcacccccaccaagggcggctggaaggtggtgaacctgcaccccctgaagaagcagccccccagcttccctggagctgctgaggagcgggcctgccagagcctggccagccgggacagcctgctggacaccagctctgtgtctgagcccaacgtgtcctttgtgagccactgtgccgacagcaacagcggggacattgctgtgattgaggaggtgaggatggagaaccccaaggagagcagcagcagcctgaagacaggccgccacagcagcggccaggacaagccccatgagacctaccgcctgctgaagagaagaaacctgatcatcgaggccgtgaccaacctgcggctgattgagagcctcttcaccatccagaagatgatcatggaccaggagaagcaggagggcgtgtccaccaagtgctgcaagaagagcatcgtgcggctggtgaggaacctgtctgaggagggcctgctgcggctgtaccgcaccaccgtcatccaggacggcatcaagaagaaggtggacctggtggtgcaccccagcatggaccagaatgaccccctggtgcgcagcgccatcgagcaggtgcgcttccgcatcagcaacagcagcacagccaacagagtgaagaccagccagccccctgtgccccagggcgaggccgaggaggacagccagggcaaggagggccccagcggcagcggggacagccagctgagcgccagcagccgctctgagagcggccgcatgaagaagagtgacaacaagatgggcatcacccccctgaggaactaccaccccatcgtggtgcccggcctgggccgcagcctgggcttcctgcccaagatgccccggctgcgggtggtgcacatgttcctgtggtacctgatctacggccacccagccagcaacacagtggagaagcccagcttcatcagcgagaggaggaccatcaagcaggagagcggccgggccggcgtgcggcccagcagcagcggcagcgcctgggaggcctgcagcgaggcccccagcaagggcagccaggatggagtgacctgggaggccgaggtggagctggccacagaaacagtgtatgtggatgatgcctcctggatgagatacatcccccccatccctgtgcaccgggactttggcttcggctgggccctggtgtctgacatcctgctgtgcctgcccctgagcatcttcatccagatcgtgcaggtgtcctacaaggtggacaacctggaggagttcctgaatgaccccctgaagaagcacaccctcatccgcttcctgccccggcccatccggcagcagctgctgtacaagaggcgctacatcttctctgtggtggagaacctgcagaggctgtgctacatgggcctgctgcagtttggccccacagagaagttccaggacaaggaccaggtgttcatcttcctgaagaagaatgctgtgattgtggacaccaccatctgtgacccccactacaacctggcccggagcagccggccctttgaaagaaggctgtatgtgctgaacagcatgcaggatgtggagaactactggtttgacctgcagtgtgtgtgcctgaacacccccctgggcgtggtgcgctgcccccgggtgaggaagaacagcagcacagaccagggcagtgatgaggagggcagcctgcagaaggagcaggagagcgccatggacaagcacaacctggagaggaaatgtgccatgctggagtacaccaccggcagccgggaggtggtggatgagggcctcatccctggagatggcctgggcgctgctggcctggacagcagcttctacggccacctgaagaggaactggatctggaccagctacatcatcaaccaggccaagaaggagaacacagctgctgaaaatggcctgactgtgcggctgcagaccttcctgagcaagaggcccatgcccctgagcgcccggggcaacagccggctgaacatctggggcgaggcccgggtgggcagcgagctgtgtgccggctgggaggagcagtttgaggtggaccgggagcccagcctggacaggaacagaagagtgcggggcggcaagagccagaagaggaagaggctgaagaaggaccccgggaagaagatcaagaggaagaagaagggggagttccctggagagaagagcaagaggctgcgctaccatgatgaggccgaccagagcgccctgcagaggatgacccggctgcgggtgacctggagcatgcaggaggatggcctgctggtgctgtgccgcatcgccagcaatgtgctgaacaccaaggtgaagggcccctttgtgacctggcaggtggtgcgggacatcctgcacgccacctttgaggagagcctggacaagaccagccacagcgtgggccggcgggcccgctacatcgtgaagaacccccaggcctacctgaactacaaggtgtgcctggccgaggtgtaccaggacaaggccctggtgggggacttcatgaacagaagaggagactatgatgaccccaaggtgtgtgccaatgagttcaaggagtttgtggagaagctgaaggagaagttcagcagcgccctgaggaacagcaacctggagatcccagacaccctgcaggagctgtttgcccgctacagagtgctggccatcggagatgagaaggaccagaccaggaaagaagatgagctgaacagcgtggatgacatccacttcctggtgctgcagaacctgatccagagcaccctggccctgagtgacagccagatgaagagctaccagagcttccagaccttccggctgtaccgggagtacaaggaccacgtgctggtgaaggccttcatggagtgccagaagaggagcctggtgaacagaagaagagtgaaccacaccctgggccccaagaagaacagagccctgccctttgtgcccatgagctaccagctgagccagacctactaccgcatcttcacctggaggttccccagcaccatctgcacagagagcttccagttcctggacaggatgagagctgctgggaagctggaccagcctgaccgcttctccttcaaggaccaggacaacaatgagcccaccaatgacatggtggccttcagcctggatggccctgggggcaactgtgtggccgtgctgaccctcttcagcctgggcctcatctctgtggatgtgcgcatccctgagcagatcatcgtggtggacagctccatggtggagaatgaggtgatcaagagcctgggcaaggatggcagcctggaggatgatgaagatgaagaagatgacctggatgaaggagtgggcggcaagaggaggtccatggaggtgaagccagcccaggccagccacaccaactacctgctgatgaggggctactacagccctggcatcgtgtccaccaggaacctgaaccccaatgacagcatcgtggtgaacagctgccagatgaagttccagctgcgctgcacccctgtgcctgcccggctgcggcctgctgctgcccccctggaggagctgaccatgggcaccagctgcctgcctgacaccttcaccaagctgatcaacccccaggagaacacctgcagcctggaggagtttgtgctgcagctggagctgagcggctacagccctgaggacctgacagctgccctggagatcctggaggccatcatcgccaccggctgctttggaattgacaaggaggagctgcggcggcgcttcagcgccctggagaaggccggcggcggccgcaccaggacctttgctgactgcatccaggccctgctggagcagcaccaggtgctggaggtgggcggcaacacagcccggctggtggccatgggcagcgcctggccctggctgctgcacagcgtgcggctgaaggacagagaagatgctgacatccagcgggaggacccccaggcccggcccctggagggcagcagcagcgaggacagccccccagagggccaggccccacccagccacagcccccggggcaccaagaggcgggcctcctgggcctctgaaaatggagaaacagatgctgagggcacccagatgaccccagccaagaggcctgccctgcaggacagcaacctggcccccagcctgggccctggagcagaagatggagctgaggcccaggcccccagccccccaccagccctggaggacacagctgctgctggggccgcccaggaggaccaggagggcgtgggggagttcagcagccctggccaggagcagctgagcggccaggcccagcccccagagggcagcgaggacccccggggcttcacagagagctttggagctgccaacatcagccaggccgcccgggagcgggactgtgagagcgtgtgcttcatcggccggccctggagggtggtggatggccacctgaacctgcctgtgtgcaagggcatgatggaggccatgctgtaccacatcatgacccggcccggcatccctgagagcagcctgctgcggcactaccagggcgtgctgcagcctgtggccgtgctggagctgctgcagggcctggagagcctgggctgcatcaggaagcgctggctgaggaagcccaggcctgtgtccctcttcagcacccctgtggtggaggaggtggaggtgcccagcagcctggatgagagccccatggccttctatgagcccaccctggactgcaccctgcggctgggccgggtcttcccccatgaggtgaactggaacaagtggatccacctgtag

SEQ ID NO: 15581 - DNA, 5064 bp, Artificial Sequence
  Description of Artificial Sequence: Synthetic coding sequence
atggatgccctggagagcctgctggatgaggtggccctggagggcctggatggcctgtgcctgcctgccctgtggagccggctggagaccagggtgccccccttccccctgcccctggagccctgcacccaggagttcctgtggagggccctggccacccaccctggcatctccttctatgaggagccccgggagaggccagacctgcagctgcaggacagatatgaggagattgacctggagaccggcatcctggagagccggcgggaccctgtggccctggaggatgtgtaccccatccacatgatcctggagaacaaggatggcatccagggcagctgccgctacttcaaggagaggaagaacatcaccaatgacatccgcaccaagagcctgcagccccgctgcaccatggtggaggcctttgaccgctggggcaagaagctgatcatctgcctgcccggccatgctgtgcagggcctggacaggcctgggggcggcagcaggcctgaggccgcccggctgctgctgctgcaccctggaacagcccggcctgtgcagcagggcgagctgcagagggacctgcacaccacagccttcaaggtggatgctgggaagctgcactaccacaggaagatcctgaacaagaatggcctcatcaccatgcagagccacgtgatccggctgcccactggagcccagcagcacagcatcctgctgctgctgaaccgcttccacgtggacagaagaagcaaatatgacatcctgatggagaagctgtctgtgatgctgagcaccaggaccaaccacatcgagaccctgggcaagctgcgggaggagctgggcctgtgtgagaggaccttcaagaggctgtaccagtacatgctgaatgccggcctggccaaggtggtgtccctgcggctgcaggagatccacccagaatgtggcccctgcaagaccaagaagggcacagatgtgatggtgcgctgcctgaagctgctgaaggagttcaagagaaatgaccatgatgatgatgaagatgaggaggtgatcagcaagacagtgccccctgtggacatcgtgtttgagcgggacatgctgacccagacctatgacctgattgaaagaagaggcaccaagggcatcagccaggccgagatccgggtggccatgaatgtgggcaagctggaggccaggatgctgtgccgcctgctgcagcgcttcaaggtggtgaagggcttcatggaggatgagggccggcagaggaccaccaagtacatcagctgtgtgtttgctgaggagagtgacctgagccggcagtaccagcgggagaaggcccggtctgagctgctgaccaccgtgtccctggcctccatgcaggaggagagcctgctgcctgaaggagaggacaccttcctgtctgagagtgacagcgaggaggagaggagcagcagcaagagaagaggccggggcagccagaaggacacccgggccagcgccaacctgcggcccaagacccagccccaccacagcacccccaccaagggcggctggaaggtggtgaacctgcaccccctgaagaagcagccccccagcttccctggagctgctgaggagcgggcctgccagagcctggccagccgggacagcctgctggacaccagctctgtgtctgagcccaacgtgtcctttgtgagccactgtgccgacagcaacagcggggacattgctgtgattgaggaggtgaggatggagaaccccaaggagagcagcagcagcctgaagacaggccgccacagcagcggccaggacaagccccatgagacctaccgcctgctgaagagaagaaacctgatcatcgaggccgtgaccaacctgcggctgattgagagcctcttcaccatccagaagatgatcatggaccaggagaagcaggagggcgtgtccaccaagtgctgcaagaagagcatcgtgcggctggtgaggaacctgtctgaggagggcctgctgcggctgtaccgcaccaccgtcatccaggacggcatcaagaagaaggtggacctggtggtgcaccccagcatggaccagaatgaccccctggtgcgcagcgccatcgagcaggtgcgcttccgcatcagcaacagcagcacagccaacagagtgaagaccagccagccccctgtgccccagggcgaggccgaggaggacagccagggcaaggagggccccagcggcagcggggacagccagctgagcgccagcagccgctctgagagcggccgcatgaagaagagtgacaacaagatgggcatcacccccctgaggaactaccaccccatcgtggtgcccggcctgggccgcagcctgggcttcctgcccaagatgccccggctgcgggtggtgcacatgttcctgtggtacctgatctacggccacccagccagcaacacagtggagaagcccagcttcatcagcgagaggaggaccatcaagcaggagagcggccgggccggcgtgcggcccagcagcagcggcagcgcctgggaggcctgcagcgaggcccccagcaagggcagccaggatggagtgacctgggaggccgaggtggagctggccacagaaacagtgtatgtggatgatgcctcctggatgagatacatcccccccatccctgtgcaccgggactttggcttcggctgggccctggtgtctgacatcctgctgtgcctgcccctgagcatcttcatccagatcgtgcaggtgtcctacaaggtggacaacctggaggagttcctgaatgaccccctgaagaagcacaccctcatccgcttcctgccccggcccatccggcagcagctgctgtacaagaggcgctacatcttctctgtggtggagaacctgcagaggctgtgctacatgggcctgctgcagtttggccccacagagaagttccaggacaaggaccaggtgttcatcttcctgaagaagaatgctgtgattgtggacaccaccatctgtgacccccactacaacctggcccggagcagccggccctttgaaagaaggctgtatgtgctgaacagcatgcaggatgtggagaactactggtttgacctgcagtgtgtgtgcctgaacacccccctgggcgtggtgcgctgcccccgggtgaggaagaacagcagcacagaccagggcagtgatgaggagggcagcctgcagaaggagcaggagagcgccatggacaagcacaacctggagaggaaatgtgccatgctggagtacaccaccggcagccgggaggtggtggatgagggcctcatccctggagatggcctgggcgccggcagcatcccagccagcacagacaccagcagcgccactggaagtggccctgccaccagcagcacccggcccaagaggaggaccctgccccagaggatggacacagtgcggctgcagaccttcctgagcaagaggcccatgcccctgagcgcccggggcaacagccggctgaacatctggggcgaggcccgggtgggcagcgagctgtgtgccggctgggaggagcagtttgaggtggaccgggagcccagcctggacaggaacagaagagtgcggggcggcaagagccagaagaggaagaggctgaagaaggaccccgggaagaagatcaagaggaagaagaagggggagttccctggagagaagagcaagaggctgcgctaccatgatgaggccgaccagagcgccctgcagaggatgacccggctgcgggtgacctggagcatgcaggaggatggcctgctggtgctgtgccgcatcgccagcaatgtgctgaacaccaaggtgaagggcccctttgtgacctggcaggtggtgcgggacatcctgcacgccacctttgaggagagcctggacaagaccagccacagcgtgggccggcgggcccgctacatcgtgaagaacccccaggcctacctgaactacaaggtgtgcctggccgaggtgtaccaggacaaggccctggtgggggacttcatgaacagaagaggagactatgatgaccccaaggtgtgtgccaatgagttcaaggagtttgtggagaagctgaaggagaagttcagcagcgccctgaggaacagcaacctggagatcccagacaccctgcaggagctgtttgcccgctacagagtgctggccatcggagatgagaaggaccagaccaggaaagaagatgagctgaacagcgtggatgacatccacttcctggtgctgcagaacctgatccagagcaccctggccctgagtgacagccagatgaagagctaccagagcttccagaccttccggctgtaccgggagtacaaggaccacgtgctggtgaaggccttcatggagtgccagaagaggagcctggtgaacagaagaagagtgaaccacaccctgggccccaagaagaacagagccctgccctttgtgcccatgagctaccagctgagccagacctactaccgcatcttcacctggaggttccccagcaccatctgcacagagagcttccagttcctggacaggatgagagctgctgggaagctggaccagcctgaccgcttctccttcaaggaccaggacaacaatgagcccaccaatgacatggtggccttcagcctggatggccctgggggcaactgtgtggccgtgctgaccctcttcagcctgggcctcatctctgtggatgtgcgcatccctgagcagatcatcgtggtggacagctccatggtggagaatgaggtgatcaagagcctgggcaaggatggcagcctggaggatgatgaagatgaagaagatgacctggatgaaggagtgggcggcaagaggaggtccatggaggtgaagccagcccaggccagccacaccaactacctgctgatgaggggctactacagccctggcatcgtgtccaccaggaacctgaaccccaatgacagcatcgtggtgaacagctgccagatgaagttccagctgcgctgcacccctgtgcctgcccggctgcggcctgcctag

SEQ ID NO: 15582 - DNA, 2736 bp, Artificial Sequence
  Description of Artificial Sequence: Synthetic coding sequence
atggacacctgtggggtgggctacgtggccctgggggaggccggccctgtgggcaacatgacagtggtggacagccctggccaggaggtgctgaaccagctggatgtgaagaccagcagcgagatgaccagcgctgaggcctctgtggagatgagcctgcccacccccctgcccggctttgaggacagcccagaccagaggcggctgcccccagagcaggagagcctgagccggctggagcagcctgacctgagcagcgagatgagcaaggtgtccaagccccgggccagcaagccaggcaggaagaggggcggccgcaccaggaagggccccaagaggccccagcagcccaaccccccatctgcccccctggtgcccggcctgctggaccagagcaaccccctgagcacccccatgcccaagaagaggggcaggaagagcaaggccgagctgctgctgctgaagctgagcaaggacctggacaggcctgagagccagagccccaagaggcccccagaagattttgagaccccatctggagagcggcccaggagaagagctgcccaggtggccctgctgtacctgcaggagctggccgaggagctgagcacagccctgcctgcccctgtgtcctgcccagagggccccaaggtgagcagccccaccaagcccaagaagatccggcagcctgctgcctgccctggaggagaggaggtggatggagcccccagagatgaggacttcttcctgcaggtggaggctgaagatgtggaggagagcgagggccccagcgagagcagcagcgagcctgagcctgtggtgcccaggagcaccccccggggcagcaccagcggcaagcagaagccccactgccggggcatggccccaaatggcctgcccaaccacatcatggcccctgtgtggaagtgcctgcacctgaccaaggacttccgggagcagaagcacagctactgggagtttgctgagtggatccccctggcctggaagtggcacctgctgtctgagctggaggccgccccctacctgccccaggaggagaagagccccctcttctctgtgcagcgggagggcctgcctgaagatggcaccctgtaccgcatcaaccgcttcagcagcatcacagcccaccctgagcgctgggatgtgtccttcttcaccggcggccccctgtgggccctggactggtgccctgtgcctgagggcgctggggccagccagtatgtggccctcttcagcagcccagacatgaatgagacccaccccctgagccagctgcacagcggccctggcctgctgcagctgtggggcctgggcaccctgcagcaggagagctgccccggcaacagagcccactttgtgtatggaattgcctgtgacaatggctgcatctgggacctgaagttctgccccagcggggcctgggagctgcccggcacccccaggaaggcccccctgctgccccggctgggcctgctggccctggcctgcagtgatggcaaggtgctgctcttcagcctgccccaccctgaggccctgctggcccagcagcccccagatgctgtgaagccagccatctacaaggtgcagtgtgtggccaccctgcaggtgggctccatgcaggccacagaccccagtgaatgtggccagtgcctgagcctggcctggatgcccacccggccccaccagcacctggccgccggctactacaacggcatggtggtgttctggaacctgcccaccaacagccccctgcagaggatccggctgagtgatggcagcctgaagctgtaccccttccagtgcttcctggcccatgaccaggccgtgaggaccctgcagtggtgcaaggccaacagccacttcctggtgtctgctggcagtgacaggaagatcaagttctgggacctgcggcggccctatgagcccatcaacagcatcaagcgcttcctgagcacagagctggcctggctgctgccctacaacggggtgacagtggcccaggacaactgctacgccagctatggcctgtgtggcatccactacattgatgctggctacctgggcttcaaggcctacttcaccgcccccaggaaaggaacagtgtggagcctgagcggcagtgactggctgggcaccatcgccgccggggacatcagcggggagctgattgctgccatcctgcctgacatggccctgaaccccatcaacgtgaagaggcctgtggagcggcgcttccccatctacaaggctgacctgatcccctaccaggacagccctgagggccctgaccacagcagcgccagcagcggcgtgcccaacccccccaaggcccggacctacacagagaccgtgaaccaccactacctgctcttccaggacacagacctgggcagcttccatgacctgctgcggcgggagcccatgctgaggatgcaggagggggagggccacagccagctgtgcctggaccggctgcagctggaggccatccacaaggtgcgcttcagccccaacctggacagctatggctggctggtgtctgggggccagagcggcctggtgcgcatccactttgtgcggggcctggccagccccctgggccacaggatgcagctggagagccgggcccacttcaatgccatgttccagcccagcagccccacccggcggcccggcttcagccccaccagccaccggctgctgcccaccccctag

SEQ ID NO: 15583 - DNA, 2736 bp, Artificial Sequence; identical to SEQ ID NO: 15582
  Description of Artificial Sequence: Synthetic coding sequence

SEQ ID NO: 15584 - DNA, 225 bp, Artificial Sequence
  Description of Artificial Sequence: Synthetic coding sequence
atggacacctgtggggtgggctacgtggccctgggggaggccggccctgtgggcaacatgacagtggtggacagccctggccaggaggtgctgaaccagctggatgtgaagaccagcagcgagatgaccagcgctgaggcctctgtggagatgagcctgcccacccccctgcccggctttgaggacagcccagaccagaggcggctgcccccagagcaggagtag

SEQ ID NO: 15585 - DNA, 408 bp, Artificial Sequence
  Description of Artificial Sequence: Synthetic coding sequence
atggacacctgtggggtgggctacgtggccctgggggaggccggccctgtgggcaacatgacagtggtggacagccctggccaggaggtgctgaaccagctggatgtgaagaccagcagcgagatgaccagcgctgaggcctctgtggagatgagcctgcccacccccctgcccggctttgaggacagcccagaccagaggcggctgcccccagagcaggagagcctgagccggctggagcagcctgacctgagcagcgagatgagcaaggtgtccaagccccgggccagcaagccaggcaggaagaggggcggccgcaccaggaagggccccaagaggccccagcagcccaaccccccatctgcccccctggtgcccggcctgctggaccagagcaaccccctgtag

SEQ ID NO: 15586 - DNA, 2661 bp, Artificial Sequence
  Description of Artificial Sequence: Synthetic coding sequence
atgagcggcttcagccctgagctgattgactacctggagggcaagatcagctttgaggagtttgaaagaagaagagaggagaggaagacccgggagaagaagagcctgcaggagaagggcaagctgtctgctgaggagaacccagatgattctgaggtgcccagcagcagcggcatcaacagcaccaagagccaggacaaggatgtgaatgaaggagagaccagtgatggagtgaggaagtctgtgcacaaggtgtttgcctccatgctgggggagaatgaagatgatgaggaggaggaggaggaggaggaggaggaggaggaggaggaggagaccccagagcagcccacagctggagatgtgtttgtgctggagatggtgctgaaccgggagaccaagaagatgatgaaggagaagaggcccaggagcaagctgccccgggccctgcggggcctgatgggagaggccaacatccgctttgcccggggggagcgggaggaggccatcctgatgtgcatggagatcatccggcaggcccccctggcctatgagcccttcagcaccctggccatgatctatgaggaccagggcgacatggagaagagcctgcagtttgagctgattgctgcccacctgaaccccagcgacacagaggagtgggtgcggctggccgagatgagcctggagcaggacaacatcaagcaggccatcttctgctacaccaaggccctgaagtatgagcccaccaacgtgcgctacctgtgggagaggagcagcctgtatgagcagatgggagaccacaagatggccatggatggctaccgccgcatcctgaacctgctgagccccagtgatggagagcgcttcatgcagctggcccgggacatggccaagagctactatgaggccaatgatgtgaccagcgccatcaacatcattgatgaggccttcagcaagcaccagggcctggtgtccatggaggatgtgaacattgctgctgagctgtacatcagcaacaagcagtatgacaaggccctggagatcatcacagacttctctggaattgtgctggagaagaagaccagcgaggagggcaccagcgaggagaacaaggccccagaaaatgtgacctgcaccatcccagatggagtgcccatcgacatcaccgtgaagctgatggtgtgcctggtgcacctgaacatcctggagcccctgaaccccctgctgaccaccctggtggagcagaaccctgaggacatgggagacctgtacctggatgtggccgaggccttcctggatgtgggggagtacaacagcgccctgcccctgctgagcgccctggtgtgcagcgagcgctacaacctggccgtggtgtggctgcggcatgctgagtgcctgaaggccctgggctacatggagagagctgctgagagctatggcaaggtggtggacctggcccccctgcacctggatgcccgcatcagcctgagcaccctgcagcagcagctgggccagcctgagaaggccctggaggccctggagcccatgtatgaccctgacaccctggcccaggatgccaatgctgcccagcaggagctgaagctgctgctgcacaggagcaccctgctcttcagccagggcaagatgtatggctacgtggacaccctgctgaccatgctggccatgctgctgaaggtggccatgaacagagcccaggtgtgcctgatcagcagcagcaagtctggagagcggcacctgtacctgatcaaggtgtcccgggacaagatcagtgacagcaatgaccaggagagcgccaactgtgatgccaaggccatctttgctgtgctgacctctgtgctgaccaaggatgactggtggaacctgctgctgaaggccatctacagcctgtgtgacctgagccgcttccaggaggccgagctgctggtggacagcagcctggagtactacagcttctatgatgaccggcagaagaggaaggagctggagtacttcggcctgtctgctgccatcctggacaagaacttcaggaaggcctacaactacatccgcatcatggtgatggagaatgtgaacaagccccagctgtggaacatcttcaaccaggtgaccatgcacagccaggatgtgcgccaccaccgcttctgcctgcggctgatgctgaagaacccagaaaatcatgccctgtgtgtgctgaatggccacaatgcctttgtgtctggcagcttcaagcacgccctgggccagtatgtgcaggccttccgcacccacccagatgagcccctgtacagcttctgcatcggcctgaccttcatccacatggccagccagaagtatgtgctgcggagacatgccctgattgtgcagggcttctccttcctgaaccgctacctgagcctgcggggcccctgccaggagagcttctacaacctgggccggggcctgcaccagctgggcctcatccacctggccatccactactaccagaaggccctggagctgccccccctggtggtggagggcatcgagctggaccagctggacctgcggcgggacatcgcctacaacctgagcctcatctaccagagcagcggcaacacaggcatggcccagaccctgctgtacacctactgcagcatctag

SEQ ID NO: 15587 - DNA, 1242 bp, Artificial Sequence
  Description of Artificial Sequence: Synthetic coding sequence
atgagcggcttcagccctgagctgattgactacctggagggcaagatcagctttgaggagtttgaaagaagaagagaggagaggaagacccgggagaagaagagcctgcaggagaagggcaagctgtctgctgaggagaacccagatgattctgaggtgcccagcagcagcggcatcaacagcaccaagagccaggacaaggatgtgaatgaaggagagaccagtgatggagtgaggaagtctgtgcacaaggtgtttgcctccatgctgggggagaatgaagatgatgaggaggaggaggaggaggaggaggaggaggaggaggaggaggagaccccagagcagcccacagctggagatgtgtttgtgctggagatggtgctgaaccgggagaccaagaagatgatgaaggagaagaggcccaggagcaagctgccccgggccctgcggggcctgatgggagaggccaacatccgctttgcccggggggagcgggaggaggccatcctgatgtgcatggagatcatccggcaggcccccctggcctatgagcccttcagcaccctggccatgatctatgaggaccagggcgacatggagaagagcctgcagtttgagctgattgctgcccacctgaaccccagcgacacagaggagtgggtgcggctggccgagatgagcctggagcaggacaacatcaagcaggccatcttctgctacaccaaggccctgaagtatgagcccaccaacgtgcgctacctgtgggagaggagcagcctgtatgagcagatgggagaccacaagatggccatggatggctaccgccgcatcctgaacctgctgagccccagtgatggagagcgcttcatgcagctggcccgggacatggccaagagctactatgaggccaatgatgtgaccagcgccatcaacatcattgatgaggccttcagcaagcaccagggcctggtgtccatggaggatgtgaacattgctgctgagctgtacatcagcaacaagcagtatgacaaggccctggagatcatcacagacttctctggaattgtgctggagaagaagaccagcgaggagggcaccagcgaggagaacaaggccccagaaaatgtgacctgcaccatcccagatggagtgcccatcgacatcaccgtgaagctgatggtgtgcctggtgcacctgaacatcctggagcccctgaatgtgtgcaacaagatctgcacctag

SEQ ID NO: 15588 - DNA, 2469 bp, Artificial Sequence
  Description of Artificial Sequence: Synthetic coding sequence
atgaacacagctgaccaggcccgggtgggccctgcagatgatggccctgcccccagcggggaggaggagggggagggcggcggggaggccggcggcaaggagcctgctgctgatgctgcccctggccccagcgctgccttccggctgatggtgacccggcgggagcctgctgtgaagctgcagtatgctgtgtctggcctggagcccctggcctggagcgaggaccaccgggtgtctgtgtccacagcccggagcattgctgtgctggagctgatctgtgatgtgcacaaccctggccaggacctggtgatccacaggacctctgtgcctgcccccctgaacagctgcctgctgaaggtgggcagcaagacagaggtggccgagtgcaaggagaagtttgctgccagcaaggaccccaccgtgtcccagaccttcatgctggacagagtcttcaaccctgagggcaaggccctgccccccatgaggggcttcaagtacacctcctggagccccatgggctgtgatgccaacggccgctgcctgctggccgccctgaccatggacaaccggctgaccatccaggccaacctgaaccggctgcagtgggtgcagctggtggacctgacagagatctacggggagcggctgtatgagaccagctaccgcctgagcaagaatgaggcccctgagggcaacctgggggactttgctgagttccagaggaggcacagcatgcagacccctgtgaggatggagtggagcggcatctgcaccacccagcaggtgaagcacaacaatgaatgtagagatgtgggctctgtgctgctggccgtgctgtttgaaaatggaaatattgctgtgtggcagttccagctgccctttgtgggcaaggagagcatcagcagctgcaacaccatcgagagcggcatcaccagccccagcgtgctcttctggtgggagtatgagcacaacaacaggaagatgagcggcctcatcgtgggcagcgccttcggccccatcaagatcctgcctgtgaacctgaaggctgtgaagggctacttcaccctgcggcagcctgtgatcctgtggaaggagatggaccagctgcctgtgcacagcatcaagtgtgtgcccctgtaccacccctaccagaagtgcagctgcagcctggtggtggccgcccggggcagctatgtgttctggtgcctgctgctgatcagcaaggccggcctgaatgtgcacaacagccacgtgacaggcctgcacagcctgcccatcgtgtccatgacagctgacaagcagaatggaacagtgtacacctgcagcagtgatggcaaggtgcggcagctgatccccatcttcacagatgtggccctgaagtttgagcaccagctgatcaagctgagtgatgtgtttggatctgtgaggacccacggcattgctgtgagcccctgtggggcctacctggccatcatcaccacagagggcatgatcaatggcctgcaccctgtgaacaagaactaccaggtgcagtttgtgaccctgaagacctttgaggaggccgccgcccagctgctggagagctctgtgcagaacctcttcaagcaggtggacctgattgacctggtgcgctggaagatcctgaaggacaagcacatcccccagttcctgcaggaggccctggagaagaagattgagagcagcggcgtgacctacttctggaggttcaagctgttcctgctgcgcatcctgtaccagagcatgcagaagaccccatctgaggccctgtggaagcccacccatgaggacagcaagatcctgctggtggacagccctggcatgggaaatgctgatgatgagcagcaggaggagggcaccagcagcaagcaggtggtgaagcagggcctgcaggagaggagcaaggagggagatgtggaggagcccacagatgacagcctgcccaccactggagatgctgggggccgggagcccatggaggagaagctgctggagatccagggcaagattgaggccgtggagatgcacctgacccgggagcacatgaagagggtgctgggggaggtgtacctgcacacctggatcacagagaacaccagcatccccacccggggcctgtgcaacttcctgatgtctgatgaggagtatgatgacagaacagcccgggtgctgattggccacatcagcaagaagatgaacaagcagaccttccctgagcactgcagcctgtgcaaggagatcctgcccttcacagacaggaagcaggccgtgtgcagcaatggccacatctggctgcgctgcttcctgacctaccagagctgccagagcctcatctaccgccgctgcctgctgcatgacagcatcgcccggcacccagccccagaagatcctgactggatcaagaggctgctgcagagcccctgccccttctgtgacagccctgtgttctag

SEQ ID NO: 15589 - DNA, 1374 bp, Artificial Sequence
  Description of Artificial Sequence: Synthetic coding sequence
atggctgctgaggccgctgacctgggcctgggcgctgctgtgcctgtggagctgcggcgggagaggaggatggtgtgtgtggagtacccaggagtggtgagagatgtggccaagatgctgcccaccctgggcggggaggagggcgtgagccgcatctatgctgaccccaccaagaggctggagctgtacttccggcccaaggacccctactgccaccctgtgtgtgccaaccgcttcagcaccagcagcctgctgctgcgcatcaggaagaggacccggcggcagaagggcgtgctgggcacagaggcccacagcgaggtgacctttgacatggagatcctgggcatcatcagcaccatctacaagttccagggcatgtctgacttccagtacctggccgtgcacacagaggccggcggcaagcacacctccatgtatgacaaggtgctgatgctgcggcctgagaaggaggccttcttccaccaggagctgcccctgtacatccccccacccatcttcagccggctggatgcccctgtggactacttctacagacctgagacccagcaccgggagggctacaacaacccccccatcagcggggagaacctgattggcctgagccgggcccggcggccccacaatgccatctttgtgaactttgaagatgaggaggtgcccaagcacctgtggatccgcttcggctatgaccccaggaagaacccagatgccaagatctaccaggtgctggacttccgcatccgctgtggcatgaagcacggctacgcccccagcgacctgcctgtgaaggccaagaggagcacctacaactacagcctgcccatcaccgtgaagaagaccagcagccagctggtgaccatgcatgacctgaagcagggcctgggccccagcggcaccagcggggccaggaagccagccagcagcaagtacaagctgaaggtgtccctgcagaccctgcgggacagcgtgtacatcttccgggagggcgccctgcccccctaccggcagatgttctaccagctgtgtgacctgaatgtggaggagctgcagaagatcatccacagaaatgatggagctgagaacagctgcacagaaagagatggctggtgcctgcccaagaccagtgatgagctgcgggacaccatgagcctgatgatccggcagaccatccgcagcaagaggcctgccctcttcagcagcagcgccaaggcagatggcggcaaggagcagctgacctatgagagcggggaggatgaagaagatgaggaggaggaggaggaggaggaggaggacttcaagcccagtgatggctctgaaaatgagatggagacagagatcctggactatgtgtag

SEQ ID NO: 15590 - DNA, 834 bp, Artificial Sequence
  Description of Artificial Sequence: Synthetic coding sequence
atgctgcggcctgagaaggaggccttcttccaccaggagctgcccctgtacatccccccacccatcttcagccggctggatgcccctgtggactacttctacagacctgagacccagcaccgggagggctacaacaacccccccatcagcggggagaacctgattggcctgagccgggcccggcggccccacaatgccatctttgtgaactttgaagatgaggaggtgcccaagcagcccctggaggccgccgcccagacctggaggagagtgtgcaccaaccctgtggacaggaaggtggaggaggagctgaggaagctgtttgacatccggcccatctggagcagaaatgctgtgaaggccaacatctctgtgcacccagacaagctgaaggtgctgctgcccttcatcgcctactacatgatcaccggcccctggaggagcctgtggatccgcttcggctatgaccccaggaagaacccagatgccaagatctaccaggtgctggacttccgcatccgctgtggcatgaagcacggctacgcccccagcgacctgcctgtgaaggccaagaggagcacctacaactacagcctgcccatcaccgtgaagaagaccagcagccagctggtgaccatgcatgacctgaagcagggcctgggccccagcggcaccagcggggccaggaagccagccagcagcaagtacaagctgaaggtgtccctgcagaccaccagcggggaggaggtggtgaccagcctgcgggaggtgtggcaccagcagctgcacgtggtggtgctgctggagcccttcggcagcctgggcccccactag

SEQ ID NO: 15591 - DNA, 1239 bp, Artificial Sequence
  Description of Artificial Sequence: Synthetic coding sequence
atgtctgacttccagtacctggccgtgcacacagaagctgggggcaagcacacctccatgtatgacaaggtgctgatgctgcggcctgagaaggaggccttcttccaccaggagctgcccctgtacatccccccacccatcttcagccggctggatgcccctgtggactacttctacagacctgagacccagcaccgggagggctacaacaacccccccatctctggagaaaatctcatcggcctgagccgggcccggcggccccacaatgccatctttgtgaactttgaagatgaggaggtgcccaagcagcccctggaggccgccgcccagacctggaggagagtgtgcaccaaccctgtggacaggaaggtggaggaggagctgaggaagctgtttgacatccggcccatctggagcagaaatgctgtgaaggccaacatctctgtgcacccagacaagctgaaggtgctgctgcccttcatcgcctactacatgatcaccggcccctggaggagcctgtggatccgcttcggctatgaccccaggaagaacccagatgccaagatctaccaggtgctggacttccgcatccgctgtggcatgaagcacggctacgcccccagcgacctgcctgtgaaggccaagaggagcacctacaactacagcctgcccatcaccgtgaagaagaccagcagccagctggtgaccatgcatgacctgaagcagggcctgggccccagcggcaccagcggggccaggaagccagccagcagcaagtacaagctgaaggtgtccctgcagaccctgcgggtgaggaccagggtgcagagccccagggctgtgtgtgtgggggacatctggaggagaggaggagacaagagccagggcagcctggccccagctgctgcctgtggctgccccagccgggccctgtgggagcccggcccccccctgagccacgtgaccaccccaggcatgattggcatcggccacacccaggaggaccgggcccgggccggccacgtgggctgcagctgtggccgcagcctgaccggcagccgcttccggcagtgtggctgcccagctggggtgggcggcttccagagctgcagccacatccaggccccagccagccgcagcacagccctgggggaggccgagaagggggccagcaggacagtggagagccctgctgagggcgtgggcggcagagatgaatgttccagagatggatag

SEQ ID NO: 15592 - DNA, 1560 bp, Artificial Sequence
  Description of Artificial Sequence: Synthetic coding sequence
atggctgctgaggccgctgacctgggcctgggcgctgctgtgcctgtggagctgcggcgggagaggaggatggtgtgtgtggagtacccaggagtggtgagagatgtggccaagatgctgcccaccctgggcggggaggagggcgtgagccgcatctatgctgaccccaccaagaggctggagctgtacttccggcccaaggacccctactgccaccctgtgtgtgccaaccgcttcagcaccagcagcctgctgctgcgcatcaggaagaggacccggcggcagaagggcgtgctgggcacagaggcccacagcgaggtgacctttgacatggagatcctgggcatcatcagcaccatctacaagttccagggcatgtctgacttccagtacctggccgtgcacacagaggccggcggcaagcacacctccatgtatgacaaggtgctgatgctgcggcctgagaaggaggccttcttccaccaggagctgcccctgtacatccccccacccatcttcagccggctggatgcccctgtggactacttctacagacctgagacccagcaccgggagggctacaacaacccccccatcagcggggagaacctgattggcctgagccgggcccggcggccccacaatgccatctttgtgaactttgaagatgaggaggtgcccaagcagcccctggaggccgccgcccagacctggaggagagtgtgcaccaaccctgtggacaggaaggtggaggaggagctgaggaagctgtttgacatccggcccatctggagcagaaatgctgtgaaggccaacatctctgtgcacccagacaagctgaaggtgctgctgcccttcatcgcctactacatgatcaccggcccctggaggagcctgtggatccgcttcggctatgaccccaggaagaacccagatgccaagatctaccaggtgctggacttccgcatccgctgtggcatgaagcacggctacgcccccagcgacctgcctgtgaaggccaagaggagcacctacaactacagcctgcccatcaccgtgaagaagaccagcagccagctggtgaccatgcatgacctgaagcagggcctgggccccagcggcaccagcggggccaggaagccagccagcagcaagtacaagctgaaggacagcgtgtacatcttccgggagggcgccctgcccccctaccggcagatgttctaccagctgtgtgacctgaatgtggaggagctgcagaagatcatccacagaaatgatggagctgagaacagctgcacagaaagagatggctggtgcctgcccaagaccagtgatgagctgcgggacaccatgagcctgatgatccggcagaccatccgcagcaagaggcctgccctcttcagcagcagcgccaaggcagatggcggcaaggagcagctgacctatgagagcggggaggatgaagaagatgaggaggaggaggaggaggaggaggaggacttcaagcccagtgatggctctgaaaatgagatggagacagagatcctggactatgtgtag

SEQ ID NO: 15593 - DNA, 1533 bp, Artificial Sequence
  Description of Artificial Sequence: Synthetic coding sequence
atggctgctgaggccgctgacctgggcctgggcgctgctgtgcctgtggagctgcggcgggagaggaggatggtgtgtgtggagtacccaggagtggtgagagatgtggccaagatgctgcccaccctgggcggggaggagggcgtgagccgcatctatgctgacccccccaaggacccctactgccaccctgtgtgtgccaaccgcttcagcaccagcagcctgctgctgcgcatcaggaagaggacccggcggcagaagggcgtgctgggcacagaggcccacagcgaggtgacctttgacatggagatcctgggcatcatcagcaccatctacaagttccagggcatgtctgacttccagtacctggccgtgcacacagaagctgggggcaagcacacctccatgtatgacaaggtgctgatgctgcggcctgagaaggaggccttcttccaccaggagctgcccctgtacatccccccacccatcttcagccggctggatgcccctgtggactacttctacagacctgagacccagcaccgggagggctacaacaacccccccatctctggagaaaatctcatcggcctgagccgggcccggcggccccacaatgccatctttgtgaactttgaagatgaggaggtgcccaagcagcccctggaggccgccgcccagacctggaggagagtgtgcaccaaccctgtggacaggaaggtggaggaggagctgaggaagctgtttgacatccggcccatctggagcagaaatgctgtgaaggccaacatctctgtgcacccagacaagctgaaggtgctgctgcccttcatcgcctactacatgatcaccggcccctggaggagcctgtggatccgcttcggctatgaccccaggaagaacccagatgccaagatctaccaggtgctggacttccgcatccgctgtggcatgaagcacggctacgcccccagcgacctgcctgtgaaggccaagaggagcacctacaactacagcctgcccatcaccgtgaagaagaccagcagccagctggtgaccatgcatgacctgaagcagggcctgggccccagcggcaccagcggggccaggaagccagccagcagcaagtacaagctgaaggacagcgtgtacatcttccgggagggcgccctgcccccctaccggcagatgttctaccagctgtgtgacctgaatgtggaggagctgcagaagatcatccacagaaatgatggagctgagaacagctgcacagaaagagatggctggtgcctgcccaagaccagtgatgagctgcgggacaccatgagcctgatgatccggcagaccatccgcagcaagaggcctgccctcttcagcagcagcgccaaggcagatggcggcaaggagcagctgacctatgaaagtggagaagatgaggaggatgaggaggaggaggaggaggaggaggaggacttcaagcccagtgatggctctgaaaatgagatggagacagagatcctggactatgtgtag

SEQ ID NO: 15594 - DNA, 1581 bp, Artificial Sequence
  Description of Artificial Sequence: Synthetic coding sequence
atggctgctgaggccgctgacctgggcctgggcgctgctgtgcctgtggagctgcggcgggagaggaggatggtgtgtgtggagtacccaggagtggtgagagatgtggccaagatgctgcccaccctgggcggggaggagggcgtgagccgcatctatgctgaccccaccaagaggctggagctgtacttccggcccaaggacccctactgccaccctgtgtgtgccaaccgcttcagcaccagcagcctgctgctgcgcatcaggaagaggacccggcggcagaagggcgtgctgggcacagaggcccacagcgaggtgacctttgacatggagatcctgggcatcatcagcaccatctacaagttccagggcatgtctgacttccagtacctggccgtgcacacagaggccggcggcaagcacacctccatgtatgacaaggtgctgatgctgcggcctgagaaggaggccttcttccaccaggagctgcccctgtacatccccccacccatcttcagccggctggatgcccctgtggactacttctacagacctgagacccagcaccgggagggctacaacaacccccccatcagcggggagaacctgattggcctgagccgggcccggcggccccacaatgccatctttgtgaactttgaagatgaggaggtgcccaagcagcccctggaggccgccgcccagacctggaggagagtgtgcaccaaccctgtggacaggaaggtggaggaggagctgaggaagctgtttgacatccggcccatctggagcagaaatgctgtgaaggccaacatctctgtgcacccagacaagctgaaggtgctgctgcccttcatcgcctactacatgatcaccggcccctggaggagcctgtggatccgcttcggctatgaccccaggaagaacccagatgccaagatctaccaggtgctggacttccgcatccgctgtggcatgaagcacggctacgcccccagcgacctgcctgtgaaggccaagaggagcacctacaactacagcctgcccatcaccgtgaagaagaccagcagccagctggtgaccatgcatgacctgaagcagggcctgggccccagcggcaccagcggggccaggaagccagccagcagcaagtacaagctgaaggtgtccctgcagaccctgcgggacagcgtgtacatcttccgggagggcgccctgcccccctaccggcagatgttctaccagctgtgtgacctgaatgtggaggagctgcagaagatcatccacagaaatgatggagctgagaacagctgcacagaaagagatggctggtgcctgcccaagaccagtgatgagctgcgggacaccatgagcctgatgatccggcagaccatccgcagcaagaggcctgccctcttcagcagcagcgccaaggcagatggcggcaaggagcagctgacctatgaaagtggagaagatgaggaggatgaggaggaggaggaggaggaggaggaggacttcaagcccagtgatggctctgaaaatgagatggagacagagatcctggactatgtgtag

SEQ ID NO: 15595 - DNA, 597 bp, Artificial Sequence
  Description of Artificial Sequence: Synthetic coding sequence
tgacccctggaggccgccgcccagacctggaggagagtgtgcaccaaccctgtggacaggaaggtggaggaggagctgaggaagctgtttgacatccggcccatctggagcagaaatgctgtgaaggccaacatctctgtgcacccagacaagctgaaggtgctgctgcccttcatcgcctactacatgatcaccggcccctggaggagcctgtggatccgcttcggctatgaccccaggaagaacccagatgccaagatctaccaggtgctggacttccgcatccgctgtggcatgaagcacggctacgcccccagcgacctgcctgtgaaggccaagaggagcacctacaactacagcctgcccatcaccgtgaagaagaccagcagccagctggtgaccatgcatgacctgaagcagggcctgggccccagcggcaccagcggggccaggaagccagccagcagcaagtacaagctgaaggtgtccctgcagaccagcggggaggaggtggtgaccagcctgcgggaggtgtggcaccagcagctgcacgtggtggtgctgctggagcccttcggcagcctgggcccccactag

SEQ ID NO: 15596 - DNA, 273 bp, Artificial Sequence
  Description of Artificial Sequence: Synthetic coding sequence
tgaatccgctgtggcatgaagcacggctacgcccccagcgacctgcctgtgaaggccaagaggagcacctacaactacagcctgcccatcaccgtgaagaagaccagcagccagctggtgaccatgcatgacctgaagcagggcctgggccccagcggcaccagcggggccaggaagccagccagcagcaagtacaagctgaaggtgggcgcccctgggggccaggagtggaggggcggcctgcccagctggggccgggccccctgtggctag

SEQ ID NO: 15597 - DNA, 675 bp, Artificial Sequence
  Description of Artificial Sequence: Synthetic coding sequence
atgtctgacttccagtacctggccgtgcacacagaagctgggggcaagcacacctccatgtatgacaaggtgctgatgctgcggcctgagaaggaggccttcttccaccaggagctgcccctgtacatccccccacccatcttcagccggctggatgcccctgtggactacttctacagacctgagacccagcaccgggagggctacaacaacccccccatctctggagaaaatctcatcggcctgagccgggcccggcggccccacaatgccatctttgtgaactttgaagatgaggaggtgcccaagcagcccctggaggccgccgcccagacctggaggagagtgtgcaccaaccctgtggacaggaaggtggaggaggagctgaggaagctgtttgacatccggcccatctggagcagaaatgctgtgaaggccaacatctctgtgcacccagacaagctgaaggtgctgctgcccttcatcgcctactacatgatcaccggcccctggaggagcctgtggatccgcttcggctatgaccccaggaagaacccagatgccaagatctaccaggtgctggacttccgcatccgctgtggcatgaagcacggctacgcccccagcgacctgcctgtgaaggccaagaggagcacctacaactacagcctgtag

SEQ ID NO: 15598 - DNA, 735 bp, Artificial Sequence
  Description of Artificial Sequence: Synthetic coding sequence
atgacccgggccatctatgctgaccccaccaagaggctggagctgtacttccggcccaaggacccctactgccaccctgtgtgtgccaaccgcttcagcaccagcagcctgctgctgcgcatcaggaagaggacccggcggcagaagggcgtgctgggcacagaggcccacagcgaggtgacctttgacatggagatcctgggcatcatcagcaccatctacaagttccagggcatgtctgacttccagtacctggccgtgcacacagaagctgggggcaagcacacctccatgtatgacaaggtgctgatgctgcggcctgagaaggaggccttcttccaccaggagctgcccctgtacatccccccacccatcttcagccggctggatgcccctgtggactacttctacagacctgagacccagcaccgggagggctacaacaacccccccatctctggagaaaatctcatcggcctgagccgggcccggcggccccacaatgccatctttgtgaactttgaagatgaggaggtgcccaagcagcccctggaggccgccgcccagacctggaggagagtgtgcaccaaccctgtggacaggaaggtggaggaggagctgaggaagctgtttgacatccggcccatctggagcagaaatgctgtgaaggccaacatctctgtgcacccagacaagctgaaggtgctgctgcccttcatcgcctactacatgtag

SEQ ID NO: 15599 - DNA, 1548 bp, Artificial Sequence
  Description of Artificial Sequence: Synthetic coding sequence
atgggcagcctgagcagccgggtgctgcggcagcccaggcctgccctggcccagcaggcccagggcgcccgggccggcggcagcgcccggcggccagacacaggagatgatgctgctggccacggcttctgctactgtgccggcagccacaagaggaagaggagcagcggcagcttctgctactgccacccagacagcgagacagatgaagatgaggaggagggagatgagcagcagaggctgctgaacacccccaggaggaagaagctgaagagcaccagcaagtacatctaccagaccctcttcctgaatggagagaacagcgacatcaagatctgtgccctgggggaggagtggagcctgcacaagatctacctgtgccagagcggctacttcagctccatgttttctggctcctggaaggagagctccatgaacatcatcgagctggagatcccagaccagaacattgatgtggaggccctgcaggtggccttcggcagcctgtacagagatgatgtgctgatcaagcccagccgggtggtggccatcctggccgccgcctgcctgctgcagctggatggcctcatccagcagtgtggggagaccatgaaggagaccgtgaatgtgaagacagtgtgtggctactacaccagcgctggcacctacggcctggacagcgtgaagaagaagtgcctggagtggctgctgaacaacctgatgacccaccagaatgtggagctgttcaaggagctgagcatcaacgtgatgaagcagctgattggcagcagcaacctgtttgtgatgcaggtggagatggacatctacacagccctgaagaagtggatgttcctgcagctggtgcccagctggaatggcagcctgaagcagctgctgacagaaacagatgtgtggttcagcaagcagaggaaggactttgagggcatggccttcctggagacagagcagggcaagccctttgtgtctgtgttccgccacctgcggctgcagtacatcatcagtgacctggccagcgcccgcatcatcgagcaggatgctgtggtgcccagcgagtggctgagctctgtgtacaagcagcagtggtttgccatgctgcgggcagagcaggacagcgaggtgggcccccaggagatcaacaaggaggagctggagggcaacagcatgagatgtggcaggaagctggccaaggatggagagtactgctggcgctggacaggcttcaactttggatttgacctgctggtgacctacaccaaccgctacatcatcttcaagaggaacaccctgaaccagccctgcagcggctctgtgtccctgcagcccaggaggagcatcgccttccggctgcggctggccagctttgacagcagcggcaagctgatctgcagcaggaccaccggctaccagatcctgaccctggagaaggaccaggagcaggtggtgatgaacctggacagccggctgctgatcttccccctgtacatctgctgcaacttcctgtacatcagccctgagaagaagaactag

SEQ ID NO: 15600 - DNA, 1311 bp, Artificial Sequence
  Description of Artificial Sequence: Synthetic coding sequence
atggagccagatgactttgacagcgaggacaaggagatcctgtcctgggacatcaatgatgtgaagctgccccagaatgtgaagaagacagactggttccaggagtggccagacagctatgccaagcacatctacagcagcgaggacaagaatgcccagaggcacctgagctcctgggccatgaggaacaccaacaaccacaacagccgcatcctgaagaagagctgcctgggcgtggtggtgtgtggccgggactgcctggccgaggagggcaggaagatctacctgcggcctgccatctgtgacaaggcccggcagaagcagcagaggaagcgctgccccaactgtgatggccccctgaagctgatcccctgccggggccacggcggcttccctgtgaccaacttctggaggcatgatggccgcttcatcttcttccagagcaaaggagaacatgaccaccccaagccagagaccaagctggaggccgaggcccggcgggccatgaagaaggtgaacacagcccccagctctgtgtccctgagcctgaagggcagcacagagaccaggagcctgcctggagagacccagagccagggcagcctgcccctgacctggagcttccaggagggcgtgcagctgcccggcagctacagcggccacctgattgccaacaccccccagcagaacagcctgaatgactgcttctccttcagcaagagctatggcctgggcggcatcacagacctgacagaccagaccagcacagtggaccccatgaagctgtatgagaagaggaagctgagcagcagcaggacctacagcagcggggacctgctgcccccatctgccagcggcgtgtacagcgaccatggagacctgcaggcctggagcaagaatgctgccctgggcaggaaccacctggccgacaactgctacagcaactaccccttccccctgacctcctggccctgcagcttcagccccagccagaacagcagcgagcccttctaccagcagctgcccctggagcccccagctgccaagacaggctgcccccccctgtggcccaacccagctggcaacctgtatgaggagaaggtgcacgtggacttcaacagctatgtgcagagccctgcctaccacagcccccaggaggaccccttcctgttcacctacgccagccacccccaccagcagtacagcctgcccagcaagagcagcaagtgggactttgaggaggagatgacctacctgggcctggaccactgcaacaatgacatgctgctgaacctgtgccccctgaggtag

SEQ ID NO: 15601 - DNA, 1521 bp, Artificial Sequence
  Description of Artificial Sequence: Synthetic coding sequence
atgcctgctgctgctgtgcaggaggccgtgggcgtgtgcagctatggcatgcagctgtcctgggacatcaatgacccccagatgccccaggagctggccctgtttgaccagttccgggagtggccagatggctacgtgcgcttcatctacagcagtgatgagaagaaggcccagaggcacctgagcggctgggccatgaggaacaccaacaaccacaacggccacatcctgaagaagagctgcctgggcgtggtggtgtgcacccaggcctgcaccctgcctgatggcagccggctgcagctgcggcctgccatctgtgacaaggcccggctgaagcagcagaagaaggcctgccccaactgccacagcgccctggagctgatcccctgccggggccacagcggctaccctgtgaccaacttctggaggctggatggaaatgccatcttcttccaggccaagggcgtgcatgaccaccccaggcctgagagcaagtcagaaacagaggccaggagaagtgccatcaagaggcagatggccagcttctaccagccccagaagaagaggatccgggagagcgaggccgaggagaaccaggacagcagcggccacttcagcaacatcccccccctggagaacccagaagattttgatattgtgacagagaccagcttccccatccctggccagccctgccccagcttccccaagagtgatgtgtacaaggccacctgtgacctggccaccttccagggcgacaagatgccacccttccagaagtacagcagcccccgcatctacctgcccaggcctccctgcagctatgagctggccaaccctggctacaccaacagcagcccctaccccaccctgtacaaggacagcaccagcatccccaatgacacagactgggtgcacctgaacaccctgcagtgcaatgtgaacagctacagcagctatgaaagaagctttgacttcaccaacaagcagcacggctggaagccagccctgggcaagcccagcctggtggagaggaccaaccacggccagttccaggccatggccacccggccctactacaaccctgagctgccctgccgctacctgaccaccccacctcctggggccccagccctgcagaccgtcatcaccaccaccaccaaggtgtcctaccaggcctaccagcccccagccatgaagtacagcgacagcgtgcgggaggtgaagagcctgagcagctgcaactatgcccctgaggacaccggcatgtctgtgtacccagagccctggggcccccctgtgacagtgaccagggctgccagccccagcggccccccacccatgaagattgctggggactgccgggccatccggcccaccgtggccatcccccatgagcctgtgagcagcaggacagatgaagctgagacctgggatgtgtgcctgagcggcctgggcagcgctgtgtcctacagcgacagagtgggccccttcttcacctacaacaatgaagacttctag

SEQ ID NO: 15602 - DNA, 1863 bp, Artificial Sequence
  Description of Artificial Sequence: Synthetic coding sequence
atggccgaggcccggaccagcctgagcgcccactgccggggccccctggccaccggcctgcacccagacctggacctgcccggccgcagcctggccaccccagcccccagctgctacctgctgggcagcgagcccagcagcggcctgggcctgcagcctgagacccacctgcctgagggcagcctgaagcgctgctgcgtgctgggcctgccccccaccagccctgccagcagcagcccctgtgccagcagtgatgtgaccagcatcatccgcagcagccagaccagcctggtgacctgtgtgaatggcctgcggagcccccccctgaccggggacctgggcggccccagcaagagggcccggcccggccctgccagcacagacagccatgagggcagcctgcagctggaggcctgcaggaaggccagcttcctgaagcaggagccagcagatgagttcagcgagctgtttggcccccaccagcagggcctgcccccaccctaccccctgagccagctgcccccaggccccagcctgggcggcctgggcctgggcctggccggccgggtggtggccggccggcaggcctgccgctgggtggactgctgtgccgcctatgagcagcaggaggagctggtgcgccacatcgagaagagccacatcgaccagaggaaaggagaggacttcacctgcttctgggccggctgtgtgcggcgctacaagcccttcaatgcccgctacaagctgctgatccacatgagggtgcacagcggggagaagcccaacaagtgcatgtttgagggctgcagcaaggccttcagccggctggagaacctgaagatccacctgcggagccacactggagagaagccctacctgtgccagcaccctggctgccagaaggccttcagcaacagcagtgaccgggccaagcaccagaggacccacctggacaccaagccctatgcctgccagatccctggctgcagcaagcgctacacagaccccagcagcctgaggaagcacgtgaaggcccacagcgccaaggagcagcaggtgaggaagaagctgcatgctggccctgacacagaagcagatgtgctgacagagtgcctggtgctgcagcagctgcacaccagcacccagctggccgccagtgatggaaaaggaggctgcggcctgggccaggagctgctgcccggggtgtacccaggcagcatcaccccccacaacggcctggccagcggcctgctgcccccagcccatgatgtgcccagccgccaccaccccctggatgccaccaccagcagccaccaccacctgagccccctgcccatggccgagagcaccagagatggcctgggccctggcctgctgagccccatcgtgagccccctgaagggcctgggccccccacccctgccccccagcagccagagccacagccctgggggccagcccttccccaccctgcccagcaagcccagctacccacccttccagagccccccacctccacccctgcccagcccccagggctaccagggcagcttccacagcatccagagctgcttcccctatggagactgctacaggatggccgagcctgctgctggaggagatggcctggtgggggagacccacggcttcaaccccctgcggcccaacggctaccacagcctgagcacccccctgcctgccaccggctatgaggccctggccgaggccagctgccccacagccctgccccagcagcccagtgaagatgtggtgagcagcggccctgaggactgtggcttcttccccaatggagcctttgaccactgcctgggccacatccccagcatctacacagacacctag

SEQ ID NO: 15603 - DNA, 1662 bp, Artificial Sequence
  Description of Artificial Sequence: Synthetic coding sequence
atggctgctgtgtccctgcggctgggggacctggtgtggggcaagctgggccgctacccaccctggccaggcaagatcgtgaacccccccaaggacctgaagaagccccggggcaagaagtgcttctttgtgaagttctttggaacagaggaccacgcctggatcaaggtggagcagctgaagccctaccacgcccacaaggaggagatgatcaagatcaacaagggcaagcgcttccagcaggccgtggatgctgtggaggagttcctgcggcgggccaagggcaaggaccagaccagcagccacaacagcagtgatgacaagaacagaagaaacagcagcgaggagaggagccggcccaacagcggagatgagaagaggaagctgagcctgtctgagggcaaggtgaagaagaacatgggagagggcaagaagagggtgagcagcggcagcagcgagcggggcagcaagagccccctgaagagggcccaggagcagagccccaggaagaggggccggccccccaaggatgagaaggacctgaccatccctgagagcagcacagtgaagggcatgatggccggccccatggccgccttcaagtggcagcccacagccagcgagcctgtgaaggatgctgacccccacttccaccacttcctgctgagccagacagagaagccagctgtgtgctaccaggccatcaccaagaagctgaagatctgtgaggaggagaccggcagcaccagcatccaggccgctgacagcacagctgtgaatggcagcatcacccccacagacaagaagattggcttcctgggcctgggcctgatgggcagcggcatcgtgagcaacctgctgaagatgggccacacagtgacagtgtggaacagaacagctgagaagtgtgacctcttcatccaggagggcgcccggctgggccgcaccccagctgaggtggtgtccacctgtgacatcacctttgcctgtgtgtctgaccccaaggccgccaaggacctggtgctgggccccagcggcgtgctgcagggcatccggcctggaaaatgttatgtggacatgagcacagtggatgctgacacagtgacagagctggcccaggtgattgtgtccagaggaggccgcttcctggaggcccctgtgtctggcaaccagcagctgagcaatgatggcatgctggtgatcctggccgccggggaccggggcctgtatgaggactgcagcagctgcttccaggccatgggcaagaccagcttcttcctgggggaggtgggcaatgctgccaagatgatgctgattgtgaacatggtgcagggcagcttcatggccaccatcgccgagggcctgaccctggcccacgtgacaggccagagccagcagaccctgctggacatcctgaaccagggccagctggccagcatcttcctggaccagaagtgccagaacatcctgcagggcaacttcaagccagacttctacctgaagtacatccagaaggacctgcggctggccatcgccctgggagatgctgtgaaccaccccacccccatggctgctgctgccaatgaggtgtacaagagggccaaggccctggaccagagcgacaatgacatgtctgctgtgtaccgggcctacatccactag

SEQ ID NO: 15604 - DNA, 1611 bp, Artificial Sequence
  Description of Artificial Sequence: Synthetic coding sequence
atggctgctgtgtccctgcggctgggggacctggtgtggggcaagctgggccgctacccaccctggccaggcaagatcgtgaacccccccaaggacctgaagaagccccggggcaagaagtgcttctttgtgaagttctttggaacagaggaccacgcctggatcaaggtggagcagctgaagccctaccacgcccacaaggaggagatgatcaagatcaacaagggcaagcgcttccagcaggccgtggatgctgtggaggagttcctgcggcgggccaagggcaaggaccagaccagcagccacaacagcagtgatgacaagaacagaagaaacagcagcgaggagaggagccggcccaacagcggagatgagaagaggaagctgagcctgtctgagggcaaggtgaagaagaacatgggagagggcaagaagagggtgagcagcggcagcagcgagcggggcagcaagagccccctgaagagggcccaggagcagagccccaggaagaggggccggccccccaaggatgagaaggacctgaccatccctgagagcagcacagtgaagggcatgatggccggccccatggccgccttcaagtggcagcccacagccagcgagcctgtgaaggatgctgacccccacttccaccacttcctgctgagccagacagagaaggagaccggcagcaccagcatccaggccgctgacagcacagctgtgaatggcagcatcacccccacagacaagaagattggcttcctgggcctgggcctgatgggcagcggcatcgtgagcaacctgctgaagatgggccacacagtgacagtgtggaacagaacagctgagaagtgtgacctcttcatccaggagggcgcccggctgggccgcaccccagctgaggtggtgtccacctgtgacatcacctttgcctgtgtgtctgaccccaaggccgccaaggacctggtgctgggccccagcggcgtgctgcagggcatccggcctgggaagtgctacgtggacatgagcacagtggatgctgacacagtgacagagctggcccaggtgattgtgtcccggggcggccgcttcctggaggcccctgtgtctggcaaccagcagctgagcaatgatggcatgctggtgatcctggccgccggggaccggggcctgtatgaggactgcagcagctgcttccaggccatgggcaagaccagcttcttcctgggggaggtgggcaatgctgccaagatgatgctgattgtgaacatggtgcagggcagcttcatggccaccatcgccgagggcctgaccctggcccacgtgacaggccagagccagcagaccctgctggacatcctgaaccagggccagctggccagcatcttcctggaccagaagtgccagaacatcctgcagggcaacttcaagccagacttctacctgaagtacatccagaaggacctgcggctggccatcgccctgggagatgctgtgaaccaccccacccccatggctgctgctgccaatgaggtgtacaagagggccaaggccctggaccagagcgacaatgacatgtctgctgtgtaccgggcctacatccactag

SEQ ID NO: 15605 - DNA, 1419 bp, Artificial Sequence
  Description of Artificial Sequence: Synthetic coding sequence
atggctgctgtgtccctgcggctgggggacctggtgtggggcaagctgggccgctacccaccctggccaggcaagatcgtgaacccccccaaggacctgaagaagccccggggcaagaagtgcttctttgtgaagttctttggaacagaggaccacgcctggatcaaggtggagcagctgaagccctaccacgcccacaaggaggagatgatcaagatcaacaagggcaagcgcttccagcaggccgtggatgctgtggaggagttcctgcggcgggccaagggcaaggaccaggacctgaccatccctgagagcagcacagtgaagggcatgatggccggccccatggccgccttcaagtggcagcccacagccagcgagcctgtgaaggatgctgacccccacttccaccacttcctgctgagccagacagagaagccagctgtgtgctaccaggccatcaccaagaagctgaagatctgtgaggaggagaccggcagcaccagcatccaggccgctgacagcacagctgtgaatggcagcatcacccccacagacaagaagattggcttcctgggcctgggcctgatgggcagcggcatcgtgagcaacctgctgaagatgggccacacagtgacagtgtggaacagaacagctgagaagtgtgacctcttcatccaggagggcgcccggctgggccgcaccccagctgaggtggtgtccacctgtgacatcacctttgcctgtgtgtctgaccccaaggccgccaaggacctggtgctgggccccagcggcgtgctgcagggcatccggcctgggaagtgctacgtggacatgagcacagtggatgctgacacagtgacagagctggcccaggtgattgtgtcccggggcggccgcttcctggaggcccctgtgtctggcaaccagcagctgagcaatgatggcatgctggtgatcctggccgccggggaccggggcctgtatgaggactgcagcagctgcttccaggccatgggcaagaccagcttcttcctgggggaggtgggcaatgctgccaagatgatgctgattgtgaacatggtgcagggcagcttcatggccaccatcgccgagggcctgaccctggcccacgtgacaggccagagccagcagaccctgctggacatcctgaaccagggccagctggccagcatcttcctggaccagaagtgccagaacatcctgcagggcaacttcaagccagacttctacctgaagtacatccagaaggacctgcggctggccatcgccctgggagatgctgtgaaccaccccacccccatggctgctgctgccaatgaggtgtacaagagggccaaggccctggaccagagcgacaatgacatgtctgctgtgtaccgggcctacatccactag

SEQ ID NO: 15606 - DNA, 6723 bp, Artificial Sequence
  Description of Artificial Sequence: Synthetic coding sequence
atgctgccctgcaagaagaggaggaccaccgtgacagagagcctgcagcacaagggcaaccaggaggagaacaacgtggacctggagagcgctgtgaagccagagagtgaccaggtgaaggacctgagctctgtgtccctgtcctgggaccccagccacggccgggtggccggctttgaggtgcagagcctgcaggatgctggcaaccagctgggcatggaggacaccagcctgagcagcggcatgctgacccagaacaccaacgtgcccatcctggagggcgtggatgtggccatcagccagggcatcaccctgcccagcctggagagcttccaccccctgaacatccacatcggcaagggcaagctgcacgccaccggcagcaagaggggcaagaagatgaccctgcggcccggccctgtgacccaggaggacagatgtgaccacctgaccctgaaggagcccttctctggagagcccagcgaggaggtgaaggaggagggcggcaagccccagatgaacagcgagggggagatccccagcctgcccagcggcagccagagcgccaagcctgtgtcccagcccaggaagagcacccagccagatgtgtgtgccagcccccaggagaagcccctgcggaccctcttccaccagcctgaggaggagattgaagatggcggcctcttcatccccatggaggagcaggacaatgaggagagcgagaagaggaggaagaagaagaagggcaccaagaggaagagagatggccggggccaggagggcaccctggcctatgacctgaagctggatgacatgctggacaggaccctggaggatggagccaagcagcacaacctgacagctgtgaatgtgaggaacatcctgcacgaggtgatcaccaatgaacatgtggtggccatgatgaaggccgccatcagcgagacagaggacatgcccatgtttgagcccaagatgaccaggagcaagctgaaggaggtggtggagaagggcgtggtgatccccacctggaacatcagccccatcaagaaggccaatgagatcaagccaccccagtttgtggacatccacctggaggaggatgacagcagtgatgaggagtaccagccagatgatgaggaggaggatgaaacagctgaggagagcctgctggagagtgatgtggagagcacagccagcagccccaggggggccaagaagagccggctgcggcagagcagcgagatgacagaaacagatgaggagagcggcatcctgtctgaggccgagaaggtgaccaccccagccatccgccacatctctgctgaggtggtgcccatgggccccccacctccacccaagcccaagcagacccgggacagcaccttcatggagaagctgcatgctgtggatgaggagctggccagcagccctgtgtgcatggacagcttccagcccatggatgacagcctgattgccttccgcaccaggagcaagatgcccctgaaggatgtgcccctgggccagctggaggccgagctgcaggccccagacatcaccccagacatgtatgaccccaacacagcagatgatgaggactggaagatgtggctgggcggcctgatgaatgatgatgtgggcaatgaagatgaagcagatgatgatgatgatcctgagtacaacttcctggaggacctggatgagccagacacagaggacttcagaacagacagagctgtgcgcatcaccaagaaggaggtgaatgagctgatggaggagctgtttgagaccttccaggatgagatgggcttcagcaacatggaggatgatggccctgaggaggaggagtgtgtggccgagccccggcccaacttcaacaccccccaggccctgcgctttgaggagcccctggccaacctgctgaatgagcagcacaggacagtgaaggagctgtttgagcagctgaagatgaagaagagcagcgccaagcagctgcaggaggtggagaaggtgaagccccagagcgagaaggtgcaccagaccctcatcctggaccctgcccagaggaagaggctgcagcagcagatgcagcagcacgtgcagctgctgacccagatccacctgctggccacctgcaaccccaacctgaaccctgaggccaccaccacccgcatcttcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcgtgttcaccaaggccgaggacaacctgctggccctgggcctgaagcactttgagggcacagagttccccaaccccctcatcagcaagtacctgctgacctgcaagacagcccaccagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggccagcctgcccagcatccaggaggagctgcggcacatggctgatggagcccgggaggtgggcaacatgacaggcaccacagagatcaacagcgacaggagcctggagaaggacaacctggagctgggcagcgagagccgctaccccctgctgctgcccaagggcgtggtgctgaagctgaagcctgtggccacccgcttccccaggaaggcctggaggcagaagaggagctctgtgctgaagcccctgctgatccagcccagccccagcctgcagcccagcttcaaccctgggaagaccccagcccggagcacccacagcgaggccccacccagcaagatggtgctgcgcatcccccaccccatccagcctgccaccgtgctgcagacagtgcctggggtgccccccctgggcgtgtctggaggagagagctttgagagccctgctgccctgcctgctgtgcccccagaggcccggaccagcttccccctgtctgagagccagaccctgctgagcagcgcccctgtgcccaaggtgatgctgcccagcctggcccccagcaagttcaggaagccctacgtgagaagaagacccagcaagaggcggggcgtgaaggccagcccctgcatgaagccagcccctgtgatccaccacccagccagcgtcatcttcaccgtgcctgccaccaccgtgaagatcgtgtccctgggcggcggctgcaacatgatccagcctgtgaatgctgctgtggcccagagcccccagaccatccccatcaccaccctgctggtgaaccccaccagcttcccctgccccctgaaccagagcctggtggccagctctgtgagccccctgattgtgtctggcaacagcgtgaacctgcccatccccagcaccccagaggacaaggcccacgtgaatgtggacatcgcctgtgctgtggctgatggagaaaatgccttccagggcctggagcccaagctggagccccaggagctgagccccctgagcgccaccgtcttccccaaggtggagcacagccctggcccccccctggctgatgctgagtgccaggagggcctgtctgagaacagcgcctgccgctggacagtggtgaagacagaggagggccggcaggccctggagcccctgccccagggcatccaggagagcctgaacaaccccacccctggggacctggaggagatcgtgaagatggagcctgaggaggcccgggaggagatcagcggcagccctgagcgggacatctgtgatgacatcaaggtggagcacgctgtggagctggacaccggggcccccagcgaggagctgagcagcgctggggaggtgaccaagcagacagtgctgcagaaggaggaggagaggagccagcccaccaagacccccagcagcagccaggagcccccagatgagggcaccagcggcacagatgtgaacaagggcagcagcaagaatgccctgagctccatggaccctgaggtgcggctgagcagccccccaggcaagccagaggacagcagctctgtggatggccagagcgtgggcacccctgtgggccctgagaccggcggggagaagaatggacctgaggaggaggaggaggaggactttgatgacctgacccaggatgaagaagatgagatgagcagcgccagcgaggagagcgtgctgtctgtgcctgagctgcaggagaccatggagaagctgacctggctggccagcgagaggaggatgagccaggagggggagagcgaggaggagaacagccaggaggagaacagcgagcctgaggaggaggaggaggaggaggccgagggcatggagagcctgcagaaggaggatgagatgacagatgaggccgtgggggacagcgctgagaagccacccacctttgccagccctgagacagcccctgaggtggagaccagcaggaccccacctggagagagcatcaaggccgccggcaagggcaggaacaaccaccgggccaggaacaagaggggcagccgggcccgggccagcaaggacaccagcaagctgctgctgctgtatgatgaggacatcctggagcgggaccccctgcgggagcagaaggacctggcctttgcccaggcctacctgaccagggtgcgggaggccctgcagcacatccctgggaagtatgaggacttcctgcaggtgatctatgaatttgagagcagcacccagaggagaacagctgtggacctgtacaagagcctgcagatcctgctgcaggactggccccagctgctgaaggactttgctgccttcctgctgcctgagcaggccctggcctgtggcctgtttgaggagcagcaggcctttgagaagagcaggaagttcctgcggcagctggagatctgctttgctgagaaccccagccaccaccagaagatcatcaaggtgctgcagggctgtgccgactgcctgccccaggagatcacagagctgaagacccagatgtggcagctgctgaagggccatgaccacctgcaggatgagttcagcatcttctttgaccacctgcggcctgctgccagcaggatgggagactttgaggagatcaactggacagaggagaaggagtatgaatttgatggctttgaggaggtggccctgcctgatgtggaggaggaggaggagccccccaagatccccacagccagcaagaacaagaggaagaaggagattggagtgcagaaccacgacaaggagacagagtggccagatggagccaaggactgtgcctgcagctgccatgaaggaggccctgacagcaagctgaagaagagcaagaggaggagctgcagccactgcagcagcaaggtgtgtgacagcaagagctacaagagcaaggagccccatgagctggtgggcagcagcccccaccgggaggccagccccatgcctggggccaaggaggccggccagggcaaggacatgatggaggaggaggcccctgaggagcgggagagcacagaggccacccagagcaggacagtgaggaccaccaggaaaggagagatgcctgtgtctggcctggccgtgggcagcaccctgcccagcccccgggaggtgacagtgacagagcggctgctgctggatggccccccaccccacagccctgagaccccccagtttcctcccaccaccggggctgtgctgtacacagtgaagaggaaccaggtgggccctgaggtgcgcagctgccccaaggccagcccccggctgcagaaggagcgggagggccagaaggctgtgtctgagagcgaggccctgatgctggtgtgggatgccagcgagacagagaagctgcccggcaccgtggagcccccagccagcttcctgagccctgtgagcagcaagaccagagatgctggaagaagacatgtgtctgggaagccagacacccaggagcgctggctgcccagcagccgggcccgggtgaagacccgggacaggacctgccctgtgcatgagagccccagcggcatcgacaccagcgagaccagccccaaggccccccggggcggcctggccaaggacagcggcacccaggccaagggccctgagggggagcagcagcccaaggctgctgaggccaccgtgtgtgccaacaacagcaaggtgagcagcactggagagaaggtggtgctgtggacccgggaggccgacagagtcatcctgaccatgtgccaggagcagggcgcccagccccagaccttcaacatcatcagccagcagctgggcaacaagaccccagctgaggtgagccaccgcttccgggagctgatgcagctgttccacacagcctgtgaggccagcagtgaagatgaagatgatgccaccagcaccagcaatgctgaccagctgagtgaccatggagacctgctgtctgaggaggagctggatgaatag

SEQ ID NO: 15607 - DNA, 4590 bp, Artificial Sequence
  Description of Artificial Sequence: Synthetic coding sequence
atgctgccctgcaagaagaggaggaccaccgtgacagagagcctgcagcacaagggcaaccaggaggagaacaacgtggacctggagagcgctgtgaagccagagagtgaccaggtgaaggacctgagctctgtgtccctgtcctgggaccccagccacggccgggtggccggctttgaggtgcagagcctgcaggatgctggcaaccagctgggcatggaggacaccagcctgagcagcggcatgctgacccagaacaccaacgtgcccatcctggagggcgtggatgtggccatcagccagggcatcaccctgcccagcctggagagcttccaccccctgaacatccacatcggcaagggcaagctgcacgccaccggcagcaagaggggcaagaagatgaccctgcggcccggccctgtgacccaggaggacagatgtgaccacctgaccctgaaggagcccttctctggagagcccagcgaggaggtgaaggaggagggcggcaagccccagatgaacagcgagggggagatccccagcctgcccagcggcagccagagcgccaagcctgtgtcccagcccaggaagagcacccagccagatgtgtgtgccagcccccaggagaagcccctgcggaccctcttccaccagcctgaggaggagattgaagatggcggcctcttcatccccatggaggagcaggacaatgaggagagcgagaagaggaggaagaagaagaagggcaccaagaggaagagagatggccggggccaggagggcaccctggcctatgacctgaagctggatgacatgctggacaggaccctggaggatggagccaagcagcacaacctgacagctgtgaatgtgaggaacatcctgcacgaggtgatcaccaatgaacatgtggtggccatgatgaaggccgccatcagcgagacagaggacatgcccatgtttgagcccaagatgaccaggagcaagctgaaggaggtggtggagaagggcgtggtgatccccacctggaacatcagccccatcaagaaggccaatgagatcaagccaccccagtttgtggacatccacctggaggaggatgacagcagtgatgaggagtaccagccagatgatgaggaggaggatgaaacagctgaggagagcctgctggagagtgatgtggagagcacagccagcagccccaggggggccaagaagagccggctgcggcagagcagcgagatgacagaaacagatgaggagagcggcatcctgtctgaggccgagaaggtgaccaccccagccatccgccacatctctgctgaggtggtgcccatgggccccccacctccacccaagcccaagcagacccgggacagcaccttcatggagaagctgcatgctgtggatgaggagctggccagcagccctgtgtgcatggacagcttccagcccatggatgacagcctgattgccttccgcaccaggagcaagatgcccctgaaggatgtgcccctgggccagctggaggccgagctgcaggccccagacatcaccccagacatgtatgaccccaacacagcagatgatgaggactggaagatgtggctgggcggcctgatgaatgatgatgtgggcaatgaagatgaagcagatgatgatgatgatcctgagtacaacttcctggaggacctggatgagccagacacagaggacttcagaacagacagagctgtgcgcatcaccaagaaggaggtgaatgagctgatggaggagctgtttgagaccttccaggatgagatgggcttcagcaacatggaggatgatggccctgaggaggaggagtgtgtggccgagccccggcccaacttcaacaccccccaggccctgcgctttgaggagcccctggccaacctgctgaatgagcagcacaggacagtgaaggagctgtttgagcagctgaagatgaagaagagcagcgccaagcagctgcaggaggtggagaaggtgaagccccagagcgagaaggtgcaccagaccctcatcctggaccctgcccagaggaagaggctgcagcagcagatgcagcagcacgtgcagctgctgacccagatccacctgctggccacctgcaaccccaacctgaaccctgaggccaccaccacccgcatcttcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcgtgttcaccaaggccgaggacaacctgctggccctgggcctgaagcactttgagggcacagagttccccaaccccctcatcagcaagtacctgctgacctgcaagacagcccaccagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggccagcctgcccagcatccaggaggagctgcggcacatggctgatggagcccgggaggtgggcaacatgacaggcaccacagagatcaacagcgacaggagcctggagaaggacaacctggagctgggcagcgagagccgctaccccctgctgctgcccaagggcgtggtgctgaagctgaagcctgtggccacccgcttccccaggaaggcctggaggcagaagaggagctctgtgctgaagcccctgctgatccagcccagccccagcctgcagcccagcttcaaccctgggaagaccccagcccggagcacccacagcgaggccccacccagcaagatggtgctgcgcatcccccaccccatccagcctgccaccgtgctgcagacagtgcctggggtgccccccctgggcgtgtctggaggagagagctttgagagccctgctgccctgcctgctgtgcccccagaggcccggaccagcttccccctgtctgagagccagaccctgctgagcagcgcccctgtgcccaaggtgatgctgcccagcctggcccccagcaagttcaggaagccctacgtgagaagaagacccagcaagaggcggggcgtgaaggccagcccctgcatgaagccagcccctgtgatccaccacccagccagcgtcatcttcaccgtgcctgccaccaccgtgaagatcgtgtccctgggcggcggctgcaacatgatccagcctgtgaatgctgctgtggcccagagcccccagaccatccccatcaccaccctgctggtgaaccccaccagcttcccctgccccctgaaccagagcctggtggccagctctgtgagccccctgattgtgtctggcaacagcgtgaacctgcccatccccagcaccccagaggacaaggcccacgtgaatgtggacatcgcctgtgctgtggctgatggagaaaatgccttccagggcctggagcccaagctggagccccaggagctgagccccctgagcgccaccgtcttccccaaggtggagcacagccctggcccccccctggctgatgctgagtgccaggagggcctgtctgagaacagcgcctgccgctggacagtggtgaagacagaggagggccggcaggccctggagcccctgccccagggcatccaggagagcctgaacaaccccacccctggggacctggaggagatcgtgaagatggagcctgaggaggcccgggaggagatcagcggcagccctgagcgggacatctgtgatgacatcaaggtggagcacgctgtggagctggacaccggggcccccagcgaggagctgagcagcgctggggaggtgaccaagcagacagtgctgcagaaggaggaggagaggagccagcccaccaagacccccagcagcagccaggagcccccagatgagggcaccagcggcacagatgtgaacaagggcagcagcaagaatgccctgagctccatggaccctgaggtgcggctgagcagccccccaggcaagccagaggacagcagctctgtggatggccagagcgtgggcacccctgtgggccctgagaccggcggggagaagaatggacctgaggaggaggaggaggaggactttgatgacctgacccaggatgaagaagatgagatgagcagcgccagcgaggagagcgtgctgtctgtgcctgagctgcaggtgcgggccggggagtacagccaggtgttccggggcctgagcaacatgtaccacctgctgatctgccacctgctggcctgctgcaccatggacagccccaagatcatctgcatctag

SEQ ID NO: 15608 - DNA, 726 bp, Artificial Sequence
  Description of Artificial Sequence: Synthetic coding sequence
atgtatgaccccaacacagcagatgatgaggactggaagatgtggctgggcggcctgatgaatgatgatgtgggcaatgaagatgaagcagatgatgatgatgatcctgagtacaacttcctggaggacctggatgagccagacacagaggacttcagaacagacagagctgtgcgcatcaccaagaaggaggtgaatgagctgatggaggagctgtttgagaccttccaggatgagatgggcttcagcaacatggaggatgatggccctgaggaggaggagtgtgtggccgagccccggcccaacttcaacaccccccaggccctgcgctttgaggagcccctggccaacctgctgaatgagcagcacaggacagtgaaggagctgtttgagcagctgaagatgaagaagagcagcgccaagcagctgcaggaggtggagaaggtgaagccccagagcgagaaggtgcaccagaccctcatcctggaccctgcccagaggaagaggctgcagcagcagatgcagcagaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacaggaagacggcagatgtgccagctgtag

SEQ ID NO: 15609 - DNA, 6726 bp, Artificial Sequence
  Description of Artificial Sequence: Synthetic coding sequence
atgctgccctgcaagaagaggaggaccaccgtgacagagagcctgcagcacaagggcaaccaggaggagaacaacgtggacctggagagcgctgtgaagccagagagtgaccaggtgaaggacctgagctctgtgtccctgtcctgggaccccagccacggccgggtggccggctttgaggtgcagagcctgcaggatgctggcaaccagctgggcatggaggacaccagcctgagcagcggcatgctgacccagaacaccaacgtgcccatcctggagggcgtggatgtggccatcagccagggcatcaccctgcccagcctggagagcttccaccccctgaacatccacatcggcaagggcaagctgcacgccaccggcagcaagaggggcaagaagatgaccctgcggcccggccctgtgacccaggaggacagatgtgaccacctgaccctgaaggagcccttctctggagagcccagcgaggaggtgaaggaggagggcggcaagccccagatgaacagcgagggggagatccccagcctgcccagcggcagccagagcgccaagcctgtgtcccagcccaggaagagcacccagccagatgtgtgtgccagcccccaggagaagcccctgcggaccctcttccaccagcctgaggaggagattgaagatggcggcctcttcatccccatggaggagcaggacaatgaggagagcgagaagaggaggaagaagaagaagggcaccaagaggaagagagatggccggggccaggagggcaccctggcctatgacctgaagctggatgacatgctggacaggaccctggaggatggagccaagcagcacaacctgacagctgtgaatgtgaggaacatcctgcacgaggtgatcaccaatgaacatgtggtggccatgatgaaggccgccatcagcgagacagaggacatgcccatgtttgagcccaagatgaccaggagcaagctgaaggaggtggtggagaagggcgtggtgatccccacctggaacatcagccccatcaagaaggccaatgagatcaagccaccccagtttgtggacatccacctggaggaggatgacagcagtgatgaggagtaccagccagatgatgaggaggaggatgaaacagctgaggagagcctgctggagagtgatgtggagagcacagccagcagccccaggggggccaagaagagccggctgcggcagagcagcgagatgacagaaacagatgaggagagcggcatcctgtctgaggccgagaaggtgaccaccccagccatccgccacatctctgctgaggtggtgcccatgggccccccacctccacccaagcccaagcagacccgggacagcaccttcatggagaagctgcatgctgtggatgaggagctggccagcagccctgtgtgcatggacagcttccagcccatggatgacagcctgattgccttccgcaccaggagcaagatgcccctgaaggatgtgcccctgggccagctggaggccgagctgcaggccccagacatcaccccagacatgtatgaccccaacacagcagatgatgaggactggaagatgtggctgggcggcctgatgaatgatgatgtgggcaatgaagatgaagcagatgatgatgatgatcctgagtacaacttcctggaggacctggatgagccagacacagaggacttcagaacagacagagctgtgcgcatcaccaagaaggaggtgaatgagctgatggaggagctgtttgagaccttccaggatgagatgggcttcagcaacatggaggatgatggccctgaggaggaggagtgtgtggccgagccccggcccaacttcaacaccccccaggccctgcgctttgaggagcccctggccaacctgctgaatgagcagcacaggacagtgaaggagctgtttgagcagctgaagatgaagaagagcagcgccaagcagctgcaggaggtggagaaggtgaagccccagagcgagaaggtgcaccagaccctcatcctggaccctgcccagaggaagaggctgcagcagcagatgcagcagcacgtgcagctgctgacccagatccacctgctggccacctgcaaccccaacctgaaccctgaggccaccaccacccgcatcttcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcgtgttcaccaaggccgaggacaacctgctggccctgggcctgaagcactttgagggcacagagttccccaaccccctcatcagcaagtacctgctgacctgcaagacagcccaccagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggccagcctgcccagcatccaggaggagctgcggcacatggctgatggagcccgggaggtgggcaacatgacaggcaccacagagatcaacagcgacaggagcctggagaaggacaacctggagctgggcagcgagagccgctaccccctgctgctgcccaagggcgtggtgctgaagctgaagcctgtggccacccgcttccccaggaaggcctggaggcagaagaggagctctgtgctgaagcccctgctgatccagcccagccccagcctgcagcccagcttcaaccctgggaagaccccagcccggagcacccacagcgaggccccacccagcaagatggtgctgcgcatcccccaccccatccagcctgccaccgtgctgcagacagtgcctggggtgccccccctgggcgtgtctggaggagagagctttgagagccctgctgccctgcctgctgtgcccccagaggcccggaccagcttccccctgtctgagagccagaccctgctgagcagcgcccctgtgcccaaggtgatgctgcccagcctggcccccagcaagttcaggaagccctacgtgagaagaagacccagcaagaggcggggcgtgaaggccagcccctgcatgaagccagcccctgtgatccaccacccagccagcgtcatcttcaccgtgcctgccaccaccgtgaagatcgtgtccctgggcggcggctgcaacatgatccagcctgtgaatgctgctgtggcccagagcccccagaccatccccatcaccaccctgctggtgaaccccaccagcttcccctgccccctgaaccagagcctggtggccagctctgtgagccccctgattgtgtctggcaacagcgtgaacctgcccatccccagcaccccagaggacaaggcccacgtgaatgtggacatcgcctgtgctgtggctgatggagaaaatgccttccagggcctggagcccaagctggagccccaggagctgagccccctgagcgccaccgtcttccccaaggtggagcacagccctggcccccccctggctgatgctgagtgccaggagggcctgtctgagaacagcgcctgccgctggacagtggtgaagacagaggagggccggcaggccctggagcccctgccccagggcatccaggagagcctgaacaaccccacccctggggacctggaggagatcgtgaagatggagcctgaggaggcccgggaggagatcagcggcagccctgagcgggacatctgtgatgacatcaaggtggagcacgctgtggagctggacaccggggcccccagcgaggagctgagcagcgctggggaggtgaccaagcagacagtgctgcagaaggaggaggagaggagccagcccaccaagacccccagcagcagccaggagcccccagatgagggcaccagcggcacagatgtgaacaagggcagcagcaagaatgccctgagctccatggaccctgaggtgcggctgagcagccccccaggcaagccagaggacagcagctctgtggatggccagagcgtgggcacccctgtgggccctgagaccggcggggagaagaatggacctgaggaggaggaggaggaggactttgatgacctgacccaggatgaagaagatgagatgagcagcgccagcgaggagagcgtgctgtctgtgcctgagctgcaggagaccatggagaagctgacctggctggccagcgagaggaggatgagccaggagggggagagcgaggaggagaacagccaggaggagaacagcgagcctgaggaggaggaggaggaggaggccgagggcatggagagcctgcagaaggaggatgagatgacagatgaggccgtgggggacagcgctgagaagccacccacctttgccagccctgagacagcccctgaggtggagaccagcaggaccccacctggagagagcatcaaggccgccggcaagggcaggaacaaccaccgggccaggaacaagaggggcagccgggcccgggccagcaaggacaccagcaagctgctgctgctgtatgatgaggacatcctggagcgggaccccctgcgggagcagaaggacctggcctttgcccaggcctacctgaccagggtgcgggaggccctgcagcacatccctgggaagtatgaggacttcctgcaggtgatctatgaatttgagagcagcacccagaggagaacagctgtggacctgtacaagagcctgcagatcctgctgcaggactggccccagctgctgaaggactttgctgccttcctgctgcctgagcaggccctggcctgtggcctgtttgaggagcagcaggcctttgagaagagcaggaagttcctgcggcagctggagatctgctttgctgagaaccccagccaccaccagaagatcatcaaggtgctgcagggctgtgccgactgcctgccccaggagatcacagagctgaagacccagatgtggcagctgctgaagggccatgaccacctgcaggatgagttcagcatcttctttgaccacctgcggcctgctgccagcaggatgggagactttgaggagatcaactggacagaggagaaggagtatgaatttgatggctttgaggaggtggccctgcctgatgtggaggaggaggaggagccccccaagatccccacagccagcaagaacaagaggaagaaggagattggagtgcagaaccacgacaaggagacagagtggccagatggagccaaggactgtgcctgcagctgccatgaaggaggccctgacagcaagctgaagaagagcaagaggaggagctgcagccactgcagcagcaaggtgtgtgacagcaagagctacaagagcaaggagccccatgagctggtgggcagcagcccccaccgggaggccagccccatgcctggggccaaggaggccggccagggcaaggacatgatggaggaggaggcccctgaggagcgggagagcacagaggccacccagagcaggacagtgaggaccaccaggaaaggagagatgcctgtgtctgctggcctggccgtgggcagcaccctgcccagcccccgggaggtgacagtgacagagcggctgctgctggatggccccccaccccacagccctgagaccccccagttcccccccaccactggagctgtgctgtacacagtgaagaggaaccaggtgggccctgaggtgcgcagctgccccaaggccagcccccggctgcagaaggagcgggagggccagaaggctgtgtctgagagcgaggccctgatgctggtgtgggatgccagcgagacagagaagctgcccggcaccgtggagcccccagccagcttcctgagccctgtgagcagcaagaccagagatgctggccgccgccacgtgtctgggaagccagacacccaggagcgctggctgcccagcagccgggcccgggtgaagacccgggacaggacctgccctgtgcatgagagccccagcggcatcgacaccagcgagaccagccccaaggccccccggggcggcctggccaaggacagcggcacccaggccaagggccctgagggggagcagcagcccaaggctgctgaggccaccgtgtgtgccaacaacagcaaggtgagcagcactggagagaaggtggtgctgtggacccgggaggccgacagagtcatcctgaccatgtgccaggagcagggcgcccagccccagaccttcaacatcatcagccagcagctgggcaacaagaccccagctgaggtgagccaccgcttccgggagctgatgcagctgttccacacagcctgtgaggccagcagtgaagatgaagatgatgccaccagcaccagcaatgctgaccagctgagtgaccacggggacctgctgtctgaggaggagctggatgaatag

SEQ ID NO: 15610 - DNA, 6723 bp, Artificial Sequence; identical to SEQ ID NO: 15606
  Description of Artificial Sequence: Synthetic coding sequence

SEQ ID NO: 15611 - DNA, 2913 bp, Artificial Sequence
  Description of Artificial Sequence: Synthetic coding sequence
atgctgccctgcaagaagaggaggaccaccgtgacagagagcctgcagcacaagggcaaccaggaggagaacaacgtggacctggagagcgctgtgaagccagagagtgaccaggtgaaggacctgagctctgtgtccctgtcctgggaccccagccacggccgggtggccggctttgaggtgcagagcctgcaggatgctggcaaccagctgggcatggaggacaccagcctgagcagcggcatgctgacccagaacaccaacgtgcccatcctggagggcgtggatgtggccatcagccagggcatcaccctgcccagcctggagagcttccaccccctgaacatccacatcggcaagggcaagctgcacgccaccggcagcaagaggggcaagaagatgaccctgcggcccggccctgtgacccaggaggacagatgtgaccacctgaccctgaaggagcccttctctggagagcccagcgaggaggtgaaggaggagggcggcaagccccagatgaacagcgagggggagatccccagcctgcccagcggcagccagagcgccaagcctgtgtcccagcccaggaagagcacccagccagatgtgtgtgccagcccccaggagaagcccctgcggaccctcttccaccagcctgaggaggagattgaagatggcggcctcttcatccccatggaggagcaggacaatgaggagagcgagaagaggaggaagaagaagaagggcaccaagaggaagagagatggccggggccaggagggcaccctggcctatgacctgaagctggatgacatgctggacaggaccctggaggatggagccaagcagcacaacctgacagctgtgaatgtgaggaacatcctgcacgaggtgatcaccaatgaacatgtggtggccatgatgaaggccgccatcagcgagacagaggacatgcccatgtttgagcccaagatgaccaggagcaagctgaaggaggtggtggagaagggcgtggtgatccccacctggaacatcagccccatcaagaaggccaatgagatcaagccaccccagtttgtggacatccacctggaggaggatgacagcagtgatgaggagtaccagccagatgatgaggaggaggatgaaacagctgaggagagcctgctggagagtgatgtggagagcacagccagcagccccaggggggccaagaagagccggctgcggcagagcagcgagatgacagaaacagatgaggagagcggcatcctgtctgaggccgagaaggtgaccaccccagccatccgccacatctctgctgaggtggtgcccatgggccccccacctccacccaagcccaagcagacccgggacagcaccttcatggagaagctgcatgctgtggatgaggagctggccagcagccctgtgtgcatggacagcttccagcccatggatgacagcctgattgccttccgcaccaggagcaagatgcccctgaaggatgtgcccctgggccagctggaggccgagctgcaggccccagacatcaccccagacatgtatgaccccaacacagcagatgatgaggactggaagatgtggctgggcggcctgatgaatgatgatgtgggcaatgaagatgaagcagatgatgatgatgatcctgagtacaacttcctggaggacctggatgagccagacacagaggacttcagaacagacagagctgtgcgcatcaccaagaaggaggtgaatgagctgatggaggagctgtttgagaccttccaggatgagatgggcttcagcaacatggaggatgatggccctgaggaggaggagtgtgtggccgagccccggcccaacttcaacaccccccaggccctgcgctttgaggagcccctggccaacctgctgaatgagcagcacaggacagtgaaggagctgtttgagcagctgaagatgaagaagagcagcgccaagcagctgcaggaggtggagaaggtgaagccccagagcgagaaggtgcaccagaccctcatcctggaccctgcccagaggaagaggctgcagcagcagatgcagcagcacgtgcagctgctgacccagatccacctgctggccacctgcaaccccaacctgaaccctgaggccaccaccacccgcatcttcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcgtgttcaccaaggccgaggacaacctgctggccctgggcctgaagcactttgagggcacagagttccccaaccccctcatcagcaagtacctgctgacctgcaagacagcccaccagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggccagcctgcccagcatccaggaggagctgcggcacatggctgatggagcccggcagagctacagaaggaagaggcggggcgtgtcccagctgaagcccctgcacctgctgaagagccccctgatgaaggagccccagggccagatgtag

SEQ ID NO: 15612 - DNA, 618 bp, Artificial Sequence
  Description of Artificial Sequence: Synthetic coding sequence
atggctgctgctgctggaggagctgccagcagaagaggagctggccggccctgccccttcagcattgagcacatcctgagcagcctgcctgagaggagcctgcctgcccgggccgcctgccccccccagcctgctggccggcagagccctgccaagccagaggagcccggggcccctgaggccgccccctgtgcctgctgctgctgctgcggcccccgggccgccccctgtggccccccagaggccgccgccggcctgggcgcccggctggcctggcccctgcggctgggccctgctgtgcccctgagcctgggcgccccagctgggggcagcggggccctgcctggagctgtgggccctggcagccagaggaggaccaggaggcacaggaccatcttcagcgaggagcagctgcaggccctggaggccctgtttgtgcagaaccagtacccagatgtgtccacccgggagcggctggccggccgcatccggctgcgggaggagcgggtggaggtgtggttcaagaacagaagagccaagtggaggcaccagaagagggccagcgccagcgcccggctgctgcccggggtgaagaagagccccaagggcagctgctag

SEQ ID NO: 15613 - DNA, 1824 bp, Artificial Sequence
  Description of Artificial Sequence: Synthetic coding sequence
atgtggatgaacagcatcctgcccatcttcctgttccgctctgtgcggctgctgaagaatgaccctgtgaacctgcagaagttctcctacaccagtgaagatgaggcctggaagacctacctggagaaccccctgacagctgccaccaaggccatgatgagggtgaatggagatgatgattctgtggccgccctgtccttcctgtatgactactacatgggccccaaggagaagaggatcctgagcagcagcactggaggaagaaatgaccagggcaagcgctactaccacggcatggagtatgaaacagacctgacccccctggagagccccacccacctgatgaagttcctgacagaaaatgtgtctggcaccccagagtacccagacctgctgaagaagaacaacctgatgagcctggagggcgccctgcccaccccaggcaaggccgcccccctgcctgctggccccagcaagctggaggccggctctgtggacagctacctgctgcccaccacagacatgtatgacaatggcagcctgaacagcctgtttgagagcatccatggagtgccccccacccagcgctggcagcctgacagcaccttcaaggatgacccccaggagagcatgctgttcccagacatcctgaagaccagccctgagcccccctgcccagaggactaccccagcctgaagagtgactttgagtacaccctgggcagccccaaggccatccacatcaagagcggggagagccccatggcctacctgaacaagggccagttctaccctgtgaccctgcggaccccagctgggggcaagggcctggccctgagcagcaacaaggtgaagtctgtggtgatggtggtgtttgacaatgagaaggtgcctgtggagcagctgcgcttctggaagcactggcacagccggcagcccacagccaagcagagggtgattgatgtggccgactgcaaggagaacttcaacacagtggagcacatcgaggaggtggcctacaatgccctgagctttgtgtggaatgtgaatgaggaggccaaggtgttcatcggcgtgaactgcctgagcacagacttcagcagccagaagggcgtgaagggcgtgcccctgaacctgcagattgacacctatgactgtggcctgggcacagagcggctggtgcacagagctgtgtgccagatcaagatcttctgtgacaagggagctgagaggaagatgagagatgatgagaggaagcagttccggaggaaggtgaagtgcccagacagcagcaacagcggcgtgaagggctgcctgctgagcggcttcagaggaaatgagaccacctacctgcggcctgagacagacctggagaccccacctgtgctcttcatccccaacgtgcacttcagcagcctgcagaggtctgggggcgccgcccccagcgctggccccagcagcagcaaccggctgcccctgaagaggacctgcagccccttcacagaggagtttgagcccctgcccagcaagcaggccaaggagggggacctgcagagggtgctgctgtatgtgagaagagaaacagaggaggtgtttgatgccctgatgctgaagaccccagacctgaagggcctgagaaatgccatcagcgagaagtatggcttccctgaggagaacatctacaaggtgtacaagaagtgcaagaggggcatcctggtgaacatggacaacaacatcatccagcactacagcaaccacgtggccttcctgctggacatgggagagctggatggcaagatccagatcatcctgaaggagctgtag

SEQ ID NO: 15614 - DNA, 1530 bp, Artificial Sequence
  Description of Artificial Sequence: Synthetic coding sequence
atggagtatgaaacagacctgacccccctggagagccccacccacctgatgaagttcctgacagaaaatgtgtctggcaccccagagtacccagacctgctgaagaagaacaacctgatgagcctggagggcgccctgcccaccccaggcaaggccgcccccctgcctgctggccccagcaagctggaggccggctctgtggacagctacctgctgcccaccacagacatgtatgacaatggcagcctgaacagcctgtttgagagcatccatggagtgccccccacccagcgctggcagcctgacagcaccttcaaggatgacccccaggagagcatgctgttcccagacatcctgaagaccagccctgagcccccctgcccagaggactaccccagcctgaagagtgactttgagtacaccctgggcagccccaaggccatccacatcaagagcggggagagccccatggcctacctgaacaagggccagttctaccctgtgaccctgcggaccccagctgggggcaagggcctggccctgagcagcaacaaggtgaagtctgtggtgatggtggtgtttgacaatgagaaggtgcctgtggagcagctgcgcttctggaagcactggcacagccggcagcccacagccaagcagagggtgattgatgtggccgactgcaaggagaacttcaacacagtggagcacatcgaggaggtggcctacaatgccctgagctttgtgtggaatgtgaatgaggaggccaaggtgttcatcggcgtgaactgcctgagcacagacttcagcagccagaagggcgtgaagggcgtgcccctgaacctgcagattgacacctatgactgtggcctgggcacagagcggctggtgcacagagctgtgtgccagatcaagatcttctgtgacaagggagctgagaggaagatgagagatgatgagaggaagcagttccggaggaaggtgaagtgcccagacagcagcaacagcggcgtgaagggctgcctgctgagcggcttcagaggaaatgagaccacctacctgcggcctgagacagacctggagaccccacctgtgctcttcatccccaacgtgcacttcagcagcctgcagaggtctgggggcgccgcccccagcgctggccccagcagcagcaaccggctgcccctgaagaggacctgcagccccttcacagaggagtttgagcccctgcccagcaagcaggccaaggagggggacctgcagagggtgctgctgtatgtgagaagagaaacagaggaggtgtttgatgccctgatgctgaagaccccagacctgaagggcctgagaaatgccatcagcgagaagtatggcttccctgaggagaacatctacaaggtgtacaagaagtgcaagaggggcatcctggtgaacatggacaacaacatcatccagcactacagcaaccacgtggccttcctgctggacatgggagagctggatggcaagatccagatcatcctgaaggagctgtag

SEQ ID NO: 15615 - DNA, 1881 bp, Artificial Sequence
  Description of Artificial Sequence: Synthetic coding sequence
atgagcaatgagctggacttccgctctgtgcggctgctgaagaatgaccctgtgaacctgcagaagttctcctacaccagtgaagatgaggcctggaagacctacctggagaaccccctgacagctgccaccaaggccatgatgagggtgaatggagatgatgacagcgtggccgccctgtccttcctgtatgactactacatgggccccaaggagaagaggatcctgagcagcagcactggaggaagaaatgaccagggcaagcgctactaccacggcatggagtatgaaacagacctgacccccctggagagccccacccacctgatgaagttcctgacagaaaatgtgtctggcaccccagagtacccagacctgctgaagaagaacaacctgatgagcctggagggcgccctgcccacccctgggaaggccgcccccctgcctgctggccccagcaagctggaggccggctctgtggacagctacctgctgcccaccacagacatgtatgacaatggcagcctgaacagcctgtttgagagcatccacggcgtgccccccacccagcgctggcagcctgacagcaccttcaaggatgacccccaggagagcatgctgttcccagacatcctgaagaccagccctgagcccccctgcccagaggactaccccagcctgaagagtgactttgagtacaccctgggcagccccaaggccatccacatcaagtctggagagagccccatggcctacctgaacaagggccagttctaccctgtgaccctgcggaccccagctgggggcaagggcctggccctgagcagcaacaaggtgaagtctgtggtgatggtggtgtttgacaatgagaaggtgcctgtggagcagctgcgcttctggaagcactggcacagccggcagcccacagccaagcagagggtgattgatgtggccgactgcaaggagaacttcaacacagtggagcacatcgaggaggtggcctacaatgccctgagctttgtgtggaatgtgaatgaggaggccaaggtgttcatcggcgtgaactgcctgagcacagacttcagcagccagaagggcgtgaagggcgtgcccctgaacctgcagattgacacctatgactgtggcctgggcacagagcggctggtgcacagagctgtgtgccagatcaagatcttctgtgacaagggagctgagaggaagatgagagatgatgagaggaagcagttccggaggaaggtgaagtgcccagacagcagcaacagcggcgtgaagggctgcctgctgagcggcttcagaggaaatgagaccacctacctgcggcctgagacagacctggagaccccacctgtgctcttcatccccaacgtgcacttcagcagcctgcagaggtctggaggagctgcccccagcgctggccccagcagcagcaaccggctgcccctgaagaggacctgcagccccttcacagaggagtttgagcccctgcccagcaagcaggccaaggagggggacctgcagagggtgctgctgtatgtgcggcgggagacagaggaggtgtttgatgccctgatgctgaagaccccagacctgaagggcctgagaaatgccatcagcgagaagtatggcttccctgaggagaacatctacaaggtgtacaagaagtgcaagagaggagagaccagcctgctgcacccccggctgagccgccaccccccaccagactgcctggagtgcagccaccctgtgacccaggtgaggaacatgggctttggagatggcttctggaggcagagggacctggacagcaaccccagccccaccaccgtgaacagcctgcacttcaccgtgaacagcgagtag

SEQ ID NO: 15616 - DNA, 1671 bp, Artificial Sequence
  Description of Artificial Sequence: Synthetic coding sequence
atgatgagggtgaatggagatgatgacagcgtggccgccctgtccttcctgtatgactactacatgggccccaaggagaagaggatcctgagcagcagcactggaggaagaaatgaccagggcaagcgctactaccacggcatggagtatgaaacagacctgacccccctggagagccccacccacctgatgaagttcctgacagaaaatgtgtctggcaccccagagtacccagacctgctgaagaagaacaacctgatgagcctggagggcgccctgcccacccctgggaaggccgcccccctgcctgctggccccagcaagctggaggccggctctgtggacagctacctgctgcccaccacagacatgtatgacaatggcagcctgaacagcctgtttgagagcatccacggcgtgccccccacccagcgctggcagcctgacagcaccttcaaggatgacccccaggagagcatgctgttcccagacatcctgaagaccagccctgagcccccctgcccagaggactaccccagcctgaagagtgactttgagtacaccctgggcagccccaaggccatccacatcaagtctggagagagccccatggcctacctgaacaagggccagttctaccctgtgaccctgcggaccccagctgggggcaagggcctggccctgagcagcaacaaggtgaagtctgtggtgatggtggtgtttgacaatgagaaggtgcctgtggagcagctgcgcttctggaagcactggcacagccggcagcccacagccaagcagagggtgattgatgtggccgactgcaaggagaacttcaacacagtggagcacatcgaggaggtggcctacaatgccctgagctttgtgtggaatgtgaatgaggaggccaaggtgttcatcggcgtgaactgcctgagcacagacttcagcagccagaagggcgtgaagggcgtgcccctgaacctgcagattgacacctatgactgtggcctgggcacagagcggctggtgcacagagctgtgtgccagatcaagatcttctgtgacaagggagctgagaggaagatgagagatgatgagaggaagcagttccggaggaaggtgaagtgcccagacagcagcaacagcggcgtgaagggctgcctgctgagcggcttcagaggaaatgagaccacctacctgcggcctgagacagacctggagaccccacctgtgctcttcatccccaacgtgcacttcagcagcctgcagaggtctggaggagctgcccccagcgctggccccagcagcagcaaccggctgcccctgaagaggacctgcagccccttcacagaggagtttgagcccctgcccagcaagcaggccaaggagggggacctgcagagggtgctgctgtatgtgcggcgggagacagaggaggtgtttgatgccctgatgctgaagaccccagacctgaagggcctgagaaatgccatcagcgagaagtatggcttccctgaggagaacatctacaaggtgtacaagaagtgcaagaggggcatcctggtgaacatggacaacaacatcatccagcactacagcaaccacgtggccttcctgctggacatgggagagctggatggcaagatccagatcatcctgaaggagctgtag

SEQ ID NO: 15617 - DNA, 1809 bp, Artificial Sequence
  Description of Artificial Sequence: Synthetic coding sequence
atgagcaatgagctggacttccgctctgtgcggctgctgaagaatgaccctgtgaacctgcagaagttctcctacaccagtgaagatgaggcctggaagacctacctggagaaccccctgacagctgccaccaaggccatgatgagggtgaatggagatgatgacagcgtggccgccctgtccttcctgtatgactactacatgggccccaaggagaagaggatcctgagcagcagcactggaggaagaaatgaccagggcaagcgctactaccacggcatggagtatgaaacagacctgacccccctggagagccccacccacctgatgaagttcctgacagaaaatgtgtctggcaccccagagtacccagacctgctgaagaagaacaacctgatgagcctggagggcgccctgcccacccctgggaaggccgcccccctgcctgctggccccagcaagctggaggccggctctgtggacagctacctgctgcccaccacagacatgtatgacaatggcagcctgaacagcctgtttgagagcatccacggcgtgccccccacccagcgctggcagcctgacagcaccttcaaggatgacccccaggagagcatgctgttcccagacatcctgaagaccagccctgagcccccctgcccagaggactaccccagcctgaagagtgactttgagtacaccctgggcagccccaaggccatccacatcaagtctggagagagccccatggcctacctgaacaagggccagttctaccctgtgaccctgcggaccccagctgggggcaagggcctggccctgagcagcaacaaggtgaagtctgtggtgatggtggtgtttgacaatgagaaggtgcctgtggagcagctgcgcttctggaagcactggcacagccggcagcccacagccaagcagagggtgattgatgtggccgactgcaaggagaacttcaacacagtggagcacatcgaggaggtggcctacaatgccctgagctttgtgtggaatgtgaatgaggaggccaaggtgttcatcggcgtgaactgcctgagcacagacttcagcagccagaagggcgtgaagggcgtgcccctgaacctgcagattgacacctatgactgtggcctgggcacagagcggctggtgcacagagctgtgtgccagatcaagatcttctgtgacaagggagctgagaggaagatgagagatgatgagaggaagcagttccggaggaaggtgaagtgcccagacagcagcaacagcggcgtgaagggctgcctgctgagcggcttcagaggaaatgagaccacctacctgcggcctgagacagacctggagaccccacctgtgctcttcatccccaacgtgcacttcagcagcctgcagaggtctggaggagctgcccccagcgctggccccagcagcagcaaccggctgcccctgaagaggacctgcagccccttcacagaggagtttgagcccctgcccagcaagcaggccaaggagggggacctgcagagggtgctgctgtatgtgcggcgggagacagaggaggtgtttgatgccctgatgctgaagaccccagacctgaagggcctgagaaatgccatcagcgagaagtatggcttccctgaggagaacatctacaaggtgtacaagaagtgcaagaggggcatcctggtgaacatggacaacaacatcatccagcactacagcaaccacgtggccttcctgctggacatgggagagctggatggcaagatccagatcatcctgaaggagctgtag

SEQ ID NO: 15618 - DNA, 795 bp, Artificial Sequence
  Description of Artificial Sequence: Synthetic coding sequence
atgcccaggagcttcctggtggacagcctggtgctgcgggaggccggggagaagaaggcccctgagggcagccccccacccctcttcccctatgctgtgcccccacctcatgccctgcacggcctgagccctggggcctgccacgccaggaaggccggcctgctgtgtgtgtgccccctgtgtgtgacagccagccagctgcacggccccccaggccccccagccctgcccctgctgaaggccagcttcccccccttcggcagccagtactgccacgcccccctgggccggcagcacagcgctgtgtcccctggggtggcccacggccctgctgctgctgctgctgctgctgccctgtaccagaccagctaccccctgcctgacccccggcagttccactgcatctctgtggacagcagcagcaaccagctgcccagcagcaagaggatgaggacagccttcaccagcacccagctgctggagctggagcgggagtttgccagcaacatgtacctgagccggctgcggcgcatcgagatcgccacctacctgaacctgtctgagaagcaggtgaagatctggttccagaacagaagagtgaagcacaagaaggagggcaagggcagcaaccacagaggaggcggcggcggcggggccggcggcggcggcagcgccccccagggctgcaagtgtgccagcctgagcagcgccaagtgcagtgaagatgatgatgagctgcccatgagccccagcagcagcggcaaggatgaccgggacctgactgtgaccccctag

SEQ ID NO: 15619 - DNA, 915 bp, Artificial Sequence
  Description of Artificial Sequence: Synthetic coding sequence
atgagccgctccttctacgtggacagcctcatcatcaaggacaccagcaggcctgcccccagcctgcctgagccccaccctggccctgacttcttcatccccctgggcatgcccccacccctggtgatgtctgtgtctggccctggctgccccagcaggaagagcggggccttctgtgtgtgccccctgtgtgtgaccagccacctgcacagcagccggggctctgtgggcgccggcagcggcggggccggggccggcgtgactggagctgggggcagcggcgtggccggggctgctggggccctgcccctgctgaagggccagttcagcagcgcccctggagatgcccagttctgcccccgggtgaaccacgcccaccaccaccaccaccccccccagcaccaccaccaccaccaccagccccagcagcccggcagcgctgctgctgctgctgctgctgctgctgctgctgctgctgctgctgccctgggccacccccagcaccacgcccctgtgtgcacagccaccacctacaacgtggccgacccccggcgcttccactgcctgaccatgggcggcagtgatgccagccaggtgcccaacgggaagaggatgaggacagccttcaccagcacccagctgctggagctggagcgggagttcagcagcaacatgtacctgagccggctgcggagaattgaaattgccacctacctgaacctgtctgagaagcaggtgaagatctggttccagaacagaagagtgaagcacaagaaggagggcaagggcacccagaggaacagccacgccggctgcaagtgtgtgggcagccaggtgcactacgcccggagtgaagatgaggacagcctgagccctgccagcgccaatgatgacaaggagatcagccccctgtag

SEQ ID NO: 15620 - DNA, 2850 bp, Artificial Sequence
  Description of Artificial Sequence: Synthetic coding sequence
atggcccaggtggccgtgtccaccctgcctgtggaggaggagagcagcagcgagaccaggatggtggtgaccttcctggtgtctgccctggagagcatgtgcaaggagctggccaagagcaaggccgaggtggcctgcatcgctgtgtatgaaacagatgtgtttgtggtgggcacagagcggggctgtgcctttgtgaatgccaggacagacttccagaaggactttgccaagtactgtgtggccgagggcctgtgtgaggtgaagccaccctgccctgtgaatggcatgcaggtgcacagcggggagacagagatcctgaggaaggctgtggaggactacttctgcttctgctacggcaaggccctgggcaccaccgtgatggtgcctgtgccctatgagaagatgctgcgggaccagagcgctgtggtggtgcagggcctgcctgagggcgtggccttccagcaccctgagaactatgacctggccaccctgaagtggatcctggagaacaaggccggcatctccttcatcatcaaccggcccttcctgggccctgagagccagctgggcggccctggcatggtgacagatgctgagaggagcatcgtgagccccagcgagagctgtggccccatcaacgtgaagacagagcccatggaggacagcggcatcagcctgaaggccgaggccgtgtctgtgaagaaggagagcgaggaccccaactactaccagtacaacatgcagggcagccaccccagcagcaccagcaatgaggtgattgagatggagctgcccatggaggacagcacccccctggtgcccagcgaggagcccaatgaagatcctgaggccgaggtgaagattgagggcaacaccaacagcagctctgtgaccaacagcgctgctggggtggaggacctgaacatcgtgcaggtgacagtgcctgacaatgagaaggagcggctgagcagcattgagaagatcaagcagctgcgggagcaggtgaatgacctcttcagcaggaagtttggagaggccatcggcgtggacttccctgtgaaggtgccctacaggaagatcaccttcaaccctggctgtgtggtgattgatggcatgcctcctggggtggtgttcaaggcccctggctacctggagatcagctccatgaggcgcatcctggaggccgctgagttcatcaagttcaccgtcatccggcccctgcccggcctggagctgagcaatgtgggcaagaggaagattgaccaggagggccgggtcttccaggagaagtgggagcgggcctacttctttgtggaggtgcagaacatccccacctgcctgatctgcaagcagagcatgtctgtgtccaaggagtacaacctgcggcggcactaccagaccaaccacagcaagcactatgaccagtacatggagaggatgagagatgagaagctgcacgagctgaagaagggcctgaggaagtacctgctgggcctgagtgacacagagtgcccagagcagaagcaggtgtttgcccaccccagccccacccagaagagccctgtgcagcctgtggaggacctggccggcaacctgtgggagaagctgcgggagaagatccgcagctttgtggcctacagcatcgccattgatgagatcacagacatcaacaacaccacccagctggccatcttcatccggggcgtggatgagaactttgatgtgtctgaggagctgctggacacagtgcccatgacaggcaccaagtctggaaatgagatcttcagccgggtggagaagagcctgaagaagttctgcatcgactggagcaagctggtgtctgtggccagcacaggcaccccagccatggtggatgccaacaacggcctggtgaccaagctgaagagccgggtggccaccttctgcaagggagctgagctgaagagcatctgctgcatcatccaccctgagagcctgtgtgcccagaagctgaagatggaccacgtgatggatgtggtggtgaagtctgtgaactggatctgcagccggggcctgaaccacagcgagttcaccaccctgctgtatgagctggacagccagtatggcagcctgctgtactacacagagatcaagtggctgagccggggcctggtgctgaagcgcttctttgagagcctggaggagattgacagcttcatgagcagccggggcaagcccctgccccagctgagcagcattgactggatccgggacctggccttcctggtggacatgaccatgcacctgaatgccctgaacatcagcctgcagggccacagccagatcgtgacccagatgtatgacctgatccgggccttcctggccaagctgtgcctgtgggagacccacctgaccaggaacaacctggcccacttccccaccctgaagctggccagcagaaatgaaagtgatggcctgaactacatccccaagattgctgagctgaagacagagttccagaagaggctgagtgacttcaagctgtatgaaagtgagctgaccctcttcagcagccccttcagcaccaagattgacagcgtgcatgaggagctgcagatggaggtgattgacctgcagtgcaacacagtgctgaagaccaagtatgacaaggtgggcatccctgagttctacaagtacctgtggggcagctaccccaagtacaagcaccactgtgccaagatcctgtccatgtttggcagcacctacatctgtgagcagctgttcagcatcatgaagctgagcaagaccaagtactgcagccagctgaaggacagccagtgggacagcgtgctgcacatcgccacctag

SEQ ID NO: 15621 - DNA, 1491 bp, Artificial Sequence
  Description of Artificial Sequence: Synthetic coding sequence
atgtctgtgtccaaggagtacaacctgcggcggcactaccagaccaaccacagcaagcactatgaccagtacatggagaggatgagagatgagaagctgcacgagctgaagaagggcctgaggaagtacctgctgggcctgagtgacacagaatgtcctgagcagaagcaggtgtttgcccaccccagccccacccagaagagccctgtgcagcctgtggaggacctggccggcaacctgtgggagaagctgcgggagaagatccgcagctttgtggcctacagcatcgccattgatgagatcacagacatcaacaacaccacccagctggccatcttcatccggggcgtggatgaaaattttgatgtgtctgaggagctgctggacacagtgcccatgacaggcaccaagtctggaaatgagatcttcagccgggtggagaagagcctgaagaagttctgcatcgactggagcaagctggtgtctgtggccagcacaggcaccccagccatggtggatgccaacaacggcctggtgaccaagctgaagagccgggtggccaccttctgcaagggagctgagctgaagagcatctgctgcatcatccaccctgagagcctgtgtgcccagaagctgaagatggaccacgtgatggatgtggtggtgaagtctgtgaactggatctgcagccggggcctgaaccacagcgagttcaccaccctgctgtatgagctggacagccagtatggcagcctgctgtactacacagagatcaagtggctgagccggggcctggtgctgaagcgcttctttgagagcctggaggagattgacagcttcatgagcagccggggcaagcccctgccccagctgagcagcattgactggatccgggacctggccttcctggtggacatgaccatgcacctgaatgccctgaacatcagcctgcagggccacagccagatcgtgacccagatgtatgacctgatccgggccttcctggccaagctgtgcctgtgggagacccacctgaccaggaacaacctggcccacttccccaccctgaagctggccagcagaaatgaaagtgatggcctgaactacatccccaagattgctgagctgaagacagagttccagaagaggctgagtgacttcaagctgtatgagagcgagctgaccctcttcagcagccccttcagcaccaagattgattctgtgcatgaggagctgcagatggaggtgattgacctgcagtgcaacacagtgctgaagaccaagtatgacaaggtgggcatccctgagttctacaagtacctgtggggcagctaccccaagtacaagcaccactgtgccaagatcctgtccatgtttggcagcacctacatctgtgagcagctgttcagcatcatgaagctgagcaagaccaagtactgcagccagctgaaggacagccagtgggacagcgtgctgcacatcgccacctag

SEQ ID NO: 15622 - DNA, 681 bp, Artificial Sequence
  Description of Artificial Sequence: Synthetic coding sequence
atggcccaggtggccgtgtccaccctgcctgtggaggaggagagcagcagcgagaccaggatggtggtgaccttcctggtgtctgccctggagagcatgtgcaaggagctggccaagagcaaggccgaggtggcctgcatcgctgtgtatgaaacagatgtgtttgtggtgggcacagagcggggctgtgcctttgtgaatgccaggacagacttccagaaggactttgccaagtactgtgtggccgagggcctgtgtgaggtgaagccaccctgccctgtgaatggcatgcaggtgcacagcggggagacagagatcctgaggaaggctgtggaggactacttctgcttctgctacggcaaggccctgggcaccaccgtgatggtgcctgtgccctatgagaagatgctgcgggaccagagcgctgtggtggtgcagggcctgcctgagggcgtggccttccagcaccctgagaactatgacctggccaccctgaagtggatcctggagaacaaggccggcatctccttcatcatcaaccggcccttcctgggccctgagagccagctgggcggccctggcatggtgacagatgctgagaggagcatcgtgagccccagcgagcggcacttcacagagagccgcagctgcctgagccaggagcgcatccgccgctcctag

SEQ ID NO: 15623 - DNA, 2850 bp, Artificial Sequence
  Description of Artificial Sequence: Synthetic coding sequence
atggcccaggtggccgtgtccaccctgcctgtggaggaggagagcagcagcgagaccaggatggtggtgaccttcctggtgtctgccctggagagcatgtgcaaggagctggccaagagcaaggccgaggtggcctgcatcgctgtgtatgaaacagatgtgtttgtggtgggcacagagcggggctgtgcctttgtgaatgccaggacagacttccagaaggactttgccaagtactgtgtggccgagggcctgtgtgaggtgaagccaccctgccctgtgaatggcatgcaggtgcacagcggggagacagagatcctgaggaaggctgtggaggactacttctgcttctgctacggcaaggccctgggcaccaccgtgatggtgcctgtgccctatgagaagatgctgcgggaccagagcgctgtggtggtgcagggcctgcctgagggcgtggccttccagcaccctgagaactatgacctggccaccctgaagtggatcctggagaacaaggccggcatctccttcatcatcaaccggcccttcctgggccctgagagccagctgggcggccctggcatggtgacagatgctgagaggagcatcgtgagccccagcgagagctgtggccccatcaacgtgaagacagagcccatggaggacagcggcatcagcctgaaggccgaggccgtgtctgtgaagaaggagagcgaggaccccaactactaccagtacaacatgcagggcagccaccccagcagcaccagcaatgaggtgattgagatggagctgcccatggaggacagcacccccctggtgcccagcgaggagcccaatgaagatcctgaggccgaggtgaagattgagggcaacaccaacagcagctctgtgaccaacagcgctgctggggtggaggacctgaacatcgtgcaggtgacagtgcctgacaatgagaaggagcggctgagcagcattgagaagatcaagcagctgcgggagcaggtgaatgacctcttcagcaggaagtttggagaggccatcggcgtggacttccctgtgaaggtgccctacaggaagatcaccttcaaccctggctgtgtggtgattgatggcatgcctcctggggtggtgttcaaggcccctggctacctggagatcagctccatgaggcgcatcctggaggccgctgagttcatcaagttcaccgtcatccggcccctgcccggcctggagctgagcaatgtgggcaagaggaagattgaccaggagggccgggtcttccaggagaagtgggagcgggcctacttctttgtggaggtgcagaacatccccacctgcctgatctgcaagcagagcatgtctgtgtccaaggagtacaacctgcggcggcactaccagaccaaccacagcaagcactatgaccagtacacagagaggatgagagatgagaagctgcacgagctgaagaagggcctgaggaagtacctgctgggcagcagtgacacagagtgcccagagcagaagcaggtgtttgccaaccccagccccacccagaagagccctgtgcagcctgtggaggacctggccggcaacctgtgggagaagctgcgggagaagatccgcagctttgtggcctacagcatcgccattgatgagatcacagacatcaacaacaccacccagctggccatcttcatccggggcgtggatgagaactttgatgtgtctgaggagctgctggacacagtgcccatgacaggcaccaagtctggaaatgagatcttcctgcgggtggagaagagcctgaagaagttctgcatcaactggagccggctggtgtctgtggccagcacaggcaccccagccatggtggatgccaacaacggcctggtgaccaagctgaagagccgggtggccaccttctgcaagggagctgagctgaagagcatctgctgcatcatccaccctgagagcctgtgtgcccagaagctgaagatggaccacgtgatggatgtggtggtgaagtctgtgaactggatctgcagccggggcctgaaccacagcgagttcaccaccctgctgtatgagctggacagccagtatggcagcctgctgtactacacagagatcaagtggctgagccggggcctggtgctgaagcgcttctttgagagcctggaggagattgacagcttcatgagcagccggggcaagcccctgccccagctgagcagcattgactggatccgggacctggccttcctggtggacatgaccatgcacctgaatgccctgaacatcagcctgcagggccacagccagatcgtgacccagatgtatgacctgatccgggccttcctggccaagctgtgcctgtgggagacccacctgaccaggaacaacctggcccacttccccaccctgaagctggtgtccagaaatgaaagtgatggcctgaactacatccccaagattgctgagctgaagacagagttccagaagaggctgagtgacttcaagctgtatgaaagtgagctgaccctcttcagcagccccttcagcaccaagattgacagcgtgcatgaggagctgcagatggaggtgattgacctgcagtgcaacacagtgctgaagaccaagtatgacaaggtgggcatccctgagttctacaagtacctgtggggcagctaccccaagtacaagcaccactgtgccaagatcctgtccatgtttggcagcacctacatctgtgagcagctgttcagcatcatgaagctgagcaagaccaagtactgcagccagctgaaggacagccagtgggacagcgtgctgcacatcgccacctag

SEQ ID NO: 15624 - DNA, 1095 bp, Artificial Sequence
  Description of Artificial Sequence: Synthetic coding sequence
atgacaggcaccaagtctggaaatgagatcttcctgcgggtggagaagagcctgaagaagttctgcatcaactggagccggctggtgtctgtggccagcacaggcaccccagccatggtggatgccaacaacggcctggtgaccaagctgaagagccgggtggccaccttctgcaagggagctgagctgaagagcatctgctgcatcatccaccctgagagcctgtgtgcccagaagctgaagatggaccacgtgatggatgtggtggtgaagtctgtgaactggatctgcagccggggcctgaaccacagcgagttcaccaccctgctgtatgagctggacagccagtatggcagcctgctgtactacacagagatcaagtggctgagccggggcctggtgctgaagcgcttctttgagagcctggaggagattgacagcttcatgagcagccggggcaagcccctgccccagctgagcagcattgactggatccgggacctggccttcctggtggacatgaccatgcacctgaatgccctgaacatcagcctgcagggccacagccagatcgtgacccagatgtatgacctgatccgggccttcctggccaagctgtgcctgtgggagacccacctgaccaggaacaacctggcccacttccccaccctgaagctggtgtccagaaatgaaagtgatggcctgaactacatccccaagattgctgagctgaagacagagttccagaagaggctgagtgacttcaagctgtatgagagcgagctgaccctcttcagcagccccttcagcaccaagattgattctgtgcatgaggagctgcagatggaggtgattgacctgcagtgcaacacagtgctgaagaccaagtatgacaaggtgggcatccctgagttctacaagtacctgtggggcagctaccccaagtacaagcaccactgtgccaagatcctgtccatgtttggcagcacctacatctgtgagcagctgttcagcatcatgaagctgagcaagaccaagtactgcagccagctgaaggacagccagtgggacagcgtgctgcacatcgccacctag

SEQ ID NO: 15625 - DNA, 1491 bp, Artificial Sequence
  Description of Artificial Sequence: Synthetic coding sequence
atgtctgtgtccaaggagtacaacctgcggcggcactaccagaccaaccacagcaagcactatgaccagtacacagagaggatgagagatgagaagctgcacgagctgaagaagggcctgaggaagtacctgctgggcagcagtgacacagaatgtcctgagcagaagcaggtgtttgccaaccccagccccacccagaagagccctgtgcagcctgtggaggacctggccggcaacctgtgggagaagctgcgggagaagatccgcagctttgtggcctacagcatcgccattgatgagatcacagacatcaacaacaccacccagctggccatcttcatccggggcgtggatgaaaattttgatgtgtctgaggagctgctggacacagtgcccatgacaggcaccaagtctggaaatgagatcttcctgcgggtggagaagagcctgaagaagttctgcatcaactggagccggctggtgtctgtggccagcacaggcaccccagccatggtggatgccaacaacggcctggtgaccaagctgaagagccgggtggccaccttctgcaagggagctgagctgaagagcatctgctgcatcatccaccctgagagcctgtgtgcccagaagctgaagatggaccacgtgatggatgtggtggtgaagtctgtgaactggatctgcagccggggcctgaaccacagcgagttcaccaccctgctgtatgagctggacagccagtatggcagcctgctgtactacacagagatcaagtggctgagccggggcctggtgctgaagcgcttctttgagagcctggaggagattgacagcttcatgagcagccggggcaagcccctgccccagctgagcagcattgactggatccgggacctggccttcctggtggacatgaccatgcacctgaatgccctgaacatcagcctgcagggccacagccagatcgtgacccagatgtatgacctgatccgggccttcctggccaagctgtgcctgtgggagacccacctgaccaggaacaacctggcccacttccccaccctgaagctggtgtccagaaatgaaagtgatggcctgaactacatccccaagattgctgagctgaagacagagttccagaagaggctgagtgacttcaagctgtatgagagcgagctgaccctcttcagcagccccttcagcaccaagattgattctgtgcatgaggagctgcagatggaggtgattgacctgcagtgcaacacagtgctgaagaccaagtatgacaaggtgggcatccctgagttctacaagtacctgtggggcagctaccccaagtacaagcaccactgtgccaagatcctgtccatgtttggcagcacctacatctgtgagcagctgttcagcatcatgaagctgagcaagaccaagtactgcagccagctgaaggacagccagtgggacagcgtgctgcacatcgccacctag

SEQ ID NO: 15626 - DNA, 681 bp, Artificial Sequence; identical to SEQ ID NO: 15622
  Description of Artificial Sequence: Synthetic coding sequence

SEQ ID NO: 15627 - DNA, 768 bp, Artificial Sequence
  Description of Artificial Sequence: Synthetic coding sequence
atggagcaggccctgaccggggaggcccagagccgctggcccaggagaggaggcagcggggccatggccgaggcccctggccccagcggggagagccggggccacagcgccacccagctgcctgctgagaagacagtgggcggccccagccggggctgcagcagctctgtgctgcgggtgtcccagctggtgctgcaggccatcagcacccacaagggcctgaccctggccgccctgaagaaggagctgagaaatgccggctatgaggtgcggaggaagagcggcagacatgaggccccccggggccaggccaaggccaccctgctgcgggtgtctggcagtgatgctgctggctacttccgggtgtggaaggtgcccaagcccaggaggaagccaggccgggcccggcaggaggagggcacccgggccccctggaggaccccagctgcccccaggagcagcagaagaagacggcagcccctgaggaaggccgccaggaaggcccgggaggtgtggaggagaaatgcccgggccaaggccaaggccaatgcccgggcccggaggacccggcgggcccggccccgggccaaggagcccccctgtgcccgggccaaggaggaggccggggccacagctgctgatgagggccggggccaggccgtgaaggaggacaccacccccaggtctgggaaggacaagaggaggagcagcaagccccgggaggagaagcaggagcccaagaagccagcccagaggaccatccagtag

SEQ ID NO: 15628 - DNA, 642 bp, Artificial Sequence
  Description of Artificial Sequence: Synthetic coding sequence
atgtctgtggagctggaggaggccctgcctgtgaccacagctgagggcatggccaagaaggtgaccaaggccggcggcagcgctgccctgagccccagcaagaagaggaagaacagcaagaagaagaaccagcccgggaagtacagccagctggtggtggagaccatccggcggctgggggagagaaatggcagcagcctggccaagatctacacagaggccaagaaggtgccctggtttgaccagcagaatggccgcacctacctgaagtacagcatcaaggccctggtgcagaatgacaccctgctgcaggtgaagggcaccggggccaacggcagcttcaagctgaacaggaagaagctggagggcggcggggagaggagaggagccccagctgctgccacagccccagcccccacagcccacaaggccaagaaggccgcccctggagctgctggcagcagaagagctgacaagaagccagcccggggccagaagccagagcagaggagccacaagaagggggccggggccaagaaggacaagggcggcaaggccaagaagacagctgctgctgggggcaagaaggtgaagaaggccgccaagcccagcgtgcccaaggtgcccaagggcaggaagtag

SEQ ID NO: 15629 - DNA, 1467 bp, Artificial Sequence
  Description of Artificial Sequence: Synthetic coding sequence
atgtttgctgctggcctggcccccttctacgccagcaacttcagcctgtggagcgctgcctactgcagcagcgctggccctgggggctgcagcttccccctggaccctgctgctgtgaagaagcccagcttctgcatcgctgacatcctgcacgccggcgtgggggacctgggcgccgcccctgagggcctggccggggccagcgctgctgccctgacagcccacctgggctctgtgcacccccacgccagcttccaggccgccgcccggagccccctgcggcccacccctgtggtggcccccagcgaggtgcctgctggcttcccccagaggctgagccccctgtctgctgcctaccaccaccaccacccccagcagcagcagcagcagcagcagccccagcagcagcagcccccacctccaccccgggccggggccctgcagcccccagccagcggcaccagggtggtgcccaacccccaccacagcggcagcgccccagcccccagcagcaaggacctgaagtttggcatcgaccgcatcctgtctgctgagtttgaccccaaggtgaaggagggcaacaccctgcgggacctgaccagcctgctgaccggcggccggcctgctggggtgcacctgagcggcctgcagcccagcgctggccagttctttgccagcctggaccccatcaatgaggccagcgccatcctgagccccctgaacagcaaccccagaaattctgtgcagcaccagttccaggacaccttccctggcccctatgctgtgctgaccaaggacaccatgccccagacctacaagaggaagaggtcctggagcagagctgtgttcagcaacctgcagaggaagggcctggagaagagatttgagatccagaagtatgtgaccaagccagacaggaagcagctggccgccatgctgggcctgacagatgcccaggtgaaggtgtggttccagaacagaaggatgaagtggaggcacagcaaggaggcccaggcccagaaggacaaggacaaggaggccggggagaagcccagcggcggggccccagctgctgatggagagcaggatgagaggagccccagccgctctgagggggaggccgagagcgagagcagtgacagcgagagcctggacatggcccccagcgacacagagaggacagagggcagcgagaggagcctgcaccagaccaccgtcatcaaggcccctgtgactggagccctgatcacagccagcagcgctggcagcggcggcagcagcggcggcggcggcaacagcttctccttcagcagcgccagcagcctgagcagcagcagcaccagcgctggctgtgccagcagcctgggcggcggcggggccagcgagctgctgcctgccacccagcccacagccagcagcgcccccaagagccctgagcccgcccagggcgccctgggctgcctgtag

SEQ ID NO: 15630 - DNA, 1116 bp, Artificial Sequence
  Description of Artificial Sequence: Synthetic coding sequence
atgagcagcagaggaggcaagaagaagagcaccaagaccagccgcagcgccaaggccggggtcatcttccctgtgggccgcatgctgcgctacatcaagaagggccaccccaagtacagaattggagtgggcgcccctgtgtacatggctgctgtgctggagtacctgacagctgagatcctggagctggccggaaatgctgcccgggacaacaagaagggccgggtgacccccaggcacatcctgctggccgtggccaatgatgaggagctgaaccagctgctgaagggcgtgaccatcgccagcggcggcgtgctgcccaacatccaccctgagctgctggccaagaagaggggcagcaagggcaagctggaggccatcatcaccccacctccagccaagaaggccaagagccccagccagaagaagcctgtgtccaagaaggccggcggcaagaagggggccaggaagagcaagaagcagggcgaggtgtccaaggccgccagcgctgacagcaccacagagggcaccccagcagatggcttcaccgtgctgagcaccaagagcctcttcctgggccagaagctgaacctgatccacagcgagatcagcaacctggccggctttgaggtggaggccatcatcaaccccaccaatgctgacatcgacctgaaggatgacctgggcaacaccctggagaagaagggcggcaaggagtttgtggaggccgtgctggagctgaggaagaagaatggccccctggaggtggccggggctgctgtgtctgctggccacggcctgcctgccaagtttgtgatccactgcaacagccctgtgtggggcgctgacaagtgtgaggagctgctggagaagacagtgaagaactgcctggccctggctgatgacaagaagctgaagagcatcgccttccccagcatcggcagcggcagaaatggcttccccaagcagacagctgcccagctgatcctgaaggccatcagcagctactttgtgtccaccatgagcagcagcatcaagacagtgtactttgtgctgtttgattctgagagcatcggcatctacgtgcaggagatggccaagctggatgccaactag

SEQ ID NO: 15631 - DNA, 348 bp, Artificial Sequence
  Description of Artificial Sequence: Synthetic coding sequence
atgcccaggagaagaagaagaagaggcagcagtggagctgggggccggggccgcacctgcagcaggacagtgcgggcagagctgtccttctctgtgtcccaggtggagaggagcctgcgggagggccactacgcccagaggctgagcaggacagcccctgtgtacctggccgccgtcatcgagtacctgacagccaaggtgcctgagctggccggaaatgaggcccagaacagcggggagaggaacatcacccccctgctgctggacatggtggtgcacaatgaccggctgctgagcaccctcttcaacaccaccaccatcagccaggtggcccctggagaggactag

SEQ ID NO: 15632 - DNA, 348 bp, Artificial Sequence
  Description of Artificial Sequence: Synthetic coding sequence
atgcccaggagaagaagaagaagaggcagcagtggagctgggggccggggccgcacctgcagcaggacagtgcgggcagagctgtccttctctgtgtcccaggtggagaggagcctgcgggagggccactacgcccagaggctgagcaggacagcccctgtgtacctggccgccgtcatcgagtacctgacagccaaggtgctggagctggccggaaatgaggcccagaacagcggggagaggaacatcacccccctgctgctggacatggtggtgcacaatgaccggctgctgagcaccctcttcaacaccaccaccatcagccaggtggcccctggagaggactag

SEQ ID NO: 15633 - DNA, 348 bp, Artificial Sequence; identical to SEQ ID NO: 15632
  Description of Artificial Sequence: Synthetic coding sequence

SEQ ID NO: 15634 - DNA, 3264 bp, Artificial Sequence
  Description of Artificial Sequence: Synthetic coding sequence
atggacctgtacagcaccccagctgctgccctggacagatttgtggcccggcggctgcagcccaggaaggagtttgtggagaaggcccggcgggccctgggcgccctggccgccgccctgcgggagcggggcggccgcctgggcgccgccgccccccgggtgctgaagacagtgaagggcggcagcagcggccggggcacagccctgaagggcggctgtgacagcgagctggtgatcttcctggactgcttcaagagctatgtggaccagagggccaggagagctgagatcctgtctgagatgagggccagcctggagagctggtggcagaaccctgtgcccggcctgcggctgaccttccctgagcagagcgtgcctggggccctgcagttccggctgacctctgtggacctggaggactggatggatgtgtccctggtgcctgccttcaacgtgctgggccaggccggcagcggcgtgaagcccaagccccaggtgtacagcaccctgctgaacagcggctgccagggcggggagcacgccgcctgcttcacagagctgcggaggaactttgtgaacatccggcctgccaagctgaagaacctgatcctgctggtgaagcactggtaccaccaggtgtgcctgcagggcctgtggaaggagaccctgccccctgtgtatgccctggagctgctgaccatctttgcctgggagcagggctgcaagaaggatgccttcagcctggccgagggcctgaggacagtgctgggcctcatccagcagcaccagcacctgtgtgtgttctggacagtgaactacggctttgaggaccctgctgtgggccagttcctgcagaggcagctgaagaggcccaggcctgtgatcctggaccctgctgaccccacctgggacctgggcaatggagctgcctggcactgggacctgctggcccaggaggccgccagctgctatgaccacccctgcttcctgcggggcatgggagaccctgtgcagagctggaagggccctggcctgccccgggccggctgcagcggcctgggccaccccatccagctggaccccaaccagaagaccccagagaacagcaagagcctgaatgctgtgtaccccagggctggcagcaagccacccagctgcccagcccctggccccaccggggccgccagcatcgtgcccagcgtgcccggcatggccctggacctgagccagatccccaccaaggagctggaccgcttcatccaggaccacctgaagcccagcccccagttccaggagcaggtgaagaaggccatcgacatcatcctgcgctgcctgcacgagaactgtgtgcacaaggccagccgggtgtccaagggcggcagctttggccggggcacagacctgagagatggctgtgatgtggagctgatcatcttcctgaactgcttcacagactacaaggaccagggcccccggcgggcagagatcctggatgagatgagggcccagctggagagctggtggcaggaccaggtgcccagcctgagcctgcagtttcctgagcagaatgtgcctgaggccctgcagttccagctggtgtccacagccctgaagtcctggacagatgtgtccctgctgcctgcctttgatgctgtgggccagctgagcagcggcaccaagcccaacccccaggtgtacagccggctgctgaccagcggctgccaggagggggagcacaaggcctgctttgctgagctgcggaggaacttcatgaacatccggcctgtgaagctgaagaacctgatcctgctggtgaagcactggtaccggcaggtggccgcccagaacaagggcaaaggacctgccccagccagcctgcccccagcctatgccctggagctgctgaccatctttgcctgggagcagggctgccggcaggactgcttcaacatggcccagggcttcagaacagtgctgggcctggtgcagcagcaccagcagctgtgtgtgtactggacagtgaactacagcacagaagatcctgccatgaggatgcacctgctgggccagctgaggaagccccggcccctggtgctggaccctgctgaccccacctggaatgtgggccacggctcctgggagctgctggcccaggaggccgccgccctgggcatgcaggcctgcttcctgagcagagatggcacctctgtgcagccctgggatgtgatgcctgccctgctgtaccagaccccagctggggacctggacaagttcatcagcgagttcctgcagcccaaccggcagttcctggcccaggtgaacaaggctgtggacaccatctgcagcttcctgaaggagaactgcttcaggaacagccccatcaaggtgatcaaggtggtgaagggcggcagcagcgccaagggcacagccctgcggggccgcagtgatgctgacctggtggtgttcctgagctgcttcagccagttcacagagcagggcaacaagagagctgagatcatcagcgagatccgggcccagctggaggcctgccagcaggagcggcagtttgaggtgaagtttgaggtgtccaagtgggagaacccccgggtgctgtccttcagcctgaccagccagaccatgctggaccagagcgtggactttgatgtgctgcctgcctttgatgccctgggccagctggtgtctggcagccggcccagcagccaggtgtatgtggacctgatccacagctacagcaatgctggggagtacagcacctgcttcacagagctgcagagggacttcatcatcagccggcccaccaagctgaagagcctcatccggctggtgaagcactggtaccagcagtgcaccaagatcagcaagggccggggcagcctgcccccccagcacggcctggagctgctgactgtgtatgcctgggagcagggcggcaaggacagccagttcaacatggccgagggcttcagaacagtgctggagctggtgacccagtaccggcagctgtgcatctactggaccatcaactacaatgccaaggacaagacagtgggggacttcctgaagcagcagctgcagaagccccggcccatcatcctggaccctgctgaccccactggaaacctgggccacaatgcccgctgggacctgctggccaaggaggccgccgcctgcaccagcgccctgtgctgcatgggcagaaatggcatccccatccagccctggcctgtgaaggctgctgtgtag

SEQ ID NO: 15635 - DNA, 390 bp, Artificial Sequence
  Description of Artificial Sequence: Synthetic coding sequence
atgagcggccggggcaagcagggcggcaaggtgcgggccaaggccaagagccgcagcagccgggccggcctgcagtttcctgtgggccgggtgcaccggctgctgaggaaaggaaattatgcagagcgggtgggcgctggggcccctgtgtacctggccgctgtgctggagtacctgacagctgagatcctggagctggccggaaatgctgcccgggacaacaagaagacccgcatcatccccaggcacctgcagctggccatcagaaatgatgaggagctgaacaagctgctgggcaaggtgaccatcgcccagggcggcgtgctgcccaacatccaggccgtgctgctgcccaagaagacagagagccagaagaccaagagcaagtag

SEQ ID NO: 15636 - DNA, 390 bp, Artificial Sequence; identical to SEQ ID NO: 15635
  Description of Artificial Sequence: Synthetic coding sequence

SEQ ID NO: 15637 - DNA, 591 bp, Artificial Sequence
  Description of Artificial Sequence: Synthetic coding sequence
atggagatcatcagcagcaagctgttcatcctgctgaccctggccaccagcagcctgctgaccagcaacatcttctgtgctgatgagctggtgatcagcaacctgcacagcaaagaaaattatgacaagtacagcgagccccggggctaccccaagggggagaggagcctgaactttgaggagctgaaggactggggccccaagaatgtcatcaagatgagcaccccagctgtgaacaagatgccccacagctttgccaacctgcccctgcgcttcggcagaaatgtgcaggaggagaggtctgctggggccacagccaacctgcccctgcggagcggcaggaacatggaggtgtccctggtgcggcgggtgcccaacctgccccagagatttggaagaaccaccacagccaagtctgtgtgcaggatgctgagtgacctgtgccagggctccatgcacagcccctgtgccaatgacctcttctacagcatgacctgccagcaccaggagatccagaacccagaccagaagcagagccggcggctgctcttcaagaagattgatgatgctgagctgaagcaggagaagtag

SEQ ID NO: 15638 - DNA, 387 bp, Artificial Sequence
  Description of Artificial Sequence: Synthetic coding sequence
atggccggcggcaaggccggcaaggacagcggcaaggccaaggccaaggctgtgagccgcagccagagagctggcctgcagtttcctgtgggccgcatccaccgccacctgaagaccaggaccaccagccacggccgggtgggcgccacagctgctgtgtacagcgctgccatcctggagtacctgacagctgaggtgctggagctggccggaaatgccagcaaggacctgaaggtgaagaggatcacccccaggcacctgcagctggccatcagaggagatgaggagctggacagcctcatcaaggccaccatcgccggcggcggcgtcatcccccacatccacaagagcctgattggcaagaagggccagcagaagacagcctag

SEQ ID NO: 15639 - DNA, 273 bp, Artificial Sequence
  Description of Artificial Sequence: Synthetic coding sequence
atggccggcggcaaggccggcaaggacagcggcaaggccaaggccaaggctgtgagccgcagccagagagctggcctgcaggtgctggagctggccggaaatgccagcaaggacctgaaggtgaagaggatcacccccaggcacctgcagctggccatcagaggagatgaggagctggacagcctcatcaaggccaccatcgccggcggcggcgtcatcccccacatccacaagagcctgattggcaagaagggccagcagaagacagcctag

SEQ ID NO: 15640 - DNA, 309 bp, Artificial Sequence
  Description of Artificial Sequence: Synthetic coding sequence
atgtttcctgtgggccgcatccaccgccacctgaagaccaggaccaccagccacggccgggtgggcgccacagctgctgtgtacagcgctgccatcctggagtacctgacagctgaggtgctggagctggccggaaatgccagcaaggacctgaaggtgaagaggatcacccccaggcacctgcagctggccatcagaggagatgaggagctggacagcctcatcaaggccaccatcgccggcggcggcgtcatcccccacatccacaagagcctgattggcaagaagggccagcagaagacagcctag

SEQ ID NO: 15641 - DNA, 201 bp, Artificial Sequence
  Description of Artificial Sequence: Synthetic coding sequence
atggccggcggcaaggccggcaaggacagcggcaaggccaaggccaaggctgtgagccgcagccagagagctggcctgcagtttcctgtgggccgcatccaccgccacctgaagaccaggaccaccagccacggccgggtgggcgccacagctgctgtgtacagcgctgccatcctggagtacctgacagctgaggtgtag

SEQ ID NO: 15642 - DNA, 1110 bp, Artificial Sequence
  Description of Artificial Sequence: Synthetic coding sequence
atgagcagcagaggaggcaagaagaagagcaccaagaccagccgcagcgccaaggccggggtcatcttccctgtgggccgcatgctgcgctacatcaagaagggccaccccaagtacagaattggagtgggcgcccctgtgtacatggctgctgtgctggagtacctgacagctgagatcctggagctggccggaaatgctgcccgggacaacaagaagggccgggtgacccccaggcacatcctgctggccgtggccaatgatgaggagctgaaccagctgctgaagggcgtgaccatcgccagcggcggcgtgctgcccaacatccaccctgagctgctggccaagaagaggggcagcaagggcaagctggaggccatcatcaccccacctccagccaagaaggccaagagccccagccagaagaagcctgtgtccaagaaggccggcggcaagaagggggccaggaagagcaagaagaagcagggcgaggtgtccaaggccgccagcgctgacagcaccacagagggcaccccagcagatggcttcaccgtgctgagcaccaagagcctcttcctgggccagaagctgcaggtggtgcaggccgacatcgccagcattgacagtgatgctgtggtgcaccccaccaacacagacttctacatcggcggggaggtgggcaacaccctggagaagaagggcggcaaggagtttgtggaggccgtgctggagctgaggaagaagaatggccccctggaggtggccggggctgctgtgtctgctggccacggcctgcctgccaagtttgtgatccactgcaacagccctgtgtggggcgctgacaagtgtgaggagctgctggagaagacagtgaagaactgcctggccctggctgatgacaagaagctgaagagcatcgccttccccagcatcggcagcggcagaaatggcttccccaagcagacagctgcccagctgatcctgaaggccatcagcagctactttgtgtccaccatgagcagcagcatcaagacagtgtactttgtgctgtttgattctgagagcatcggcatctacgtgcaggagatggccaagctggatgccaactag

SEQ ID NO: 15643 - DNA, 603 bp, Artificial Sequence
  Description of Artificial Sequence: Synthetic coding sequence
atgagcagcagaggaggcaagaagaagagcaccaagaccagccgcagcgccaaggccggggtcatcttccctgtgggccgcatgctgcgctacatcaagaagggccaccccaagtacagaattggagtgggcgcccctgtgtacatggctgctgtgctggagtacctgactggaaacaccctggagaagaagggcggcaaggagtttgtggaggccgtgctggagctgaggaagaagaatggccccctggaggtggccggggctgctgtgtctgctggccacggcctgcctgccaagtttgtgatccactgcaacagccctgtgtggggcgctgacaagtgtgaggagctgctggagaagacagtgaagaactgcctggccctggctgatgacaagaagctgaagagcatcgccttccccagcatcggcagcggcagaaatggcttccccaagcagacagctgcccagctgatcctgaaggccatcagcagctactttgtgtccaccatgagcagcagcatcaagacagtgtactttgtgctgtttgacagcgagagcatcggcatctacgtgcaggagatggccaagctggatgccaactag

SEQ ID NO: 15644 - DNA, 1119 bp, Artificial Sequence
  Description of Artificial Sequence: Synthetic coding sequence
atgagcagcagaggaggcaagaagaagagcaccaagaccagccgcagcgccaaggccggggtcatcttccctgtgggccgcatgctgcgctacatcaagaagggccaccccaagtacagaattggagtgggcgcccctgtgtacatggctgctgtgctggagtacctgacagctgagatcctggagctggccggaaatgctgcccgggacaacaagaagggccgggtgacccccaggcacatcctgctggccgtggccaatgatgaggagctgaaccagctgctgaagggcgtgaccatcgccagcggcggcgtgctgcccaacatccaccctgagctgctggccaagaagaggggcagcaagggcaagctggaggccatcatcaccccacctccagccaagaaggccaagagccccagccagaagaagcctgtgtccaagaaggccggcggcaagaagggggccaggaagagcaagaagaagcagggcgaggtgtccaaggccgccagcgctgacagcaccacagagggcaccccagcagatggcttcaccgtgctgagcaccaagagcctcttcctgggccagaagctgaacctgatccacagcgagatcagcaacctggccggctttgaggtggaggccatcatcaaccccaccaatgctgacatcgacctgaaggatgacctgggcaacaccctggagaagaagggcggcaaggagtttgtggaggccgtgctggagctgaggaagaagaatggccccctggaggtggccggggctgctgtgtctgctggccacggcctgcctgccaagtttgtgatccactgcaacagccctgtgtggggcgctgacaagtgtgaggagctgctggagaagacagtgaagaactgcctggccctggctgatgacaagaagctgaagagcatcgccttccccagcatcggcagcggcagaaatggcttccccaagcagacagctgcccagctgatcctgaaggccatcagcagctactttgtgtccaccatgagcagcagcatcaagacagtgtactttgtgctgtttgacagcgagagcatcggcatctacgtgcaggagatggccaagctggatgccaactag

SEQ ID NO: 15645 - DNA, 1119 bp, Artificial Sequence; identical to SEQ ID NO: 15644
  Description of Artificial Sequence: Synthetic coding sequence

SEQ ID NO: 15646 - DNA, 1119 bp, Artificial Sequence
  Description of Artificial Sequence: Synthetic coding sequence
atgagcggccgcagcggcaagaagaagatgagcaagctgagccgcagcgcccgggccggggtcatcttccctgtgggccgcctgatgagatacctgaagaagggcaccttcaagtaccgcatctctgtgggcgcccctgtgtacatggctgctgtgattgagtacctggccgctgagatcctggagctggccggaaatgctgcccgggacaacaagaaggcccgcatcgcccccaggcacatcctgctggccgtggccaatgatgaggagctgaaccagctgctgaagggcgtgaccatcgccagcggcggcgtgctgccccgcatccaccctgagctgctggccaagaagaggggcaccaagggcaagtctgagaccatcctgagccccccacctgagaagaggggcaggaaggccaccagcggcaagaagggcggcaagaagagcaaggccgccaagcccaggaccagcaagaagagcaagcccaaggacagcgacaaggagggcaccagcaacagcaccagtgaagatggccctggagatggcttcaccatcctgagcagcaagagcctggtgctgggccagaagctgagcctgacccagagcgacatcagccacatcggctccatgagggtggagggcatcgtgcaccccaccacagctgagattgacctgaaggaggacatcggcaaggccctggagaaggccggcggcaaggagttcctggagaccgtgaaggagctgaggaagagccagggccccctggaggtggccgaggccgctgtgtcccagagcagcggcctggccgccaagtttgtgatccactgccacatcccccagtggggcagtgacaagtgtgaggagcagctggaggagaccatcaagaactgcctgtctgctgctgaggacaagaagctgaagtctgtggccttcccccccttccccagcggcaggaactgcttccccaagcagacagctgcccaggtgaccctgaaggccatcagcgcccactttgatgacagcagcgccagcagcctgaagaatgtgtacttcctgctgtttgacagcgagagcatcggcatctacgtgcaggagatggccaagctggatgccaagtag

SEQ ID NO: 15647 - DNA, 732 bp, Artificial Sequence
  Description of Artificial Sequence: Synthetic coding sequence
atgagcggccgcagcggcaagaagaagatgagcaagctgagccgcagcgcccgggccggggtcatcttccctgtgggccgcctgatgagatacctgaagaagggcaccttcaagtaccgcatctctgtgggcgcccctgtgtacatggctgctgtgattgagtacctggccgctgagatcctggagctggccggaaatgctgcccgggacaacaagaaggcccgcatcgcccccaggcacatcctgctggccgtggccaatgatgaggagctgaaccagagcaagcccaaggacagcgacaaggagggcaccagcaacagcaccagtgaagatggccctggagatggcttcaccatcctgagcagcaagagcctggtgctgggccagaagctgagcctgacccagagcgacatcagccacatcggctccatgagggtggagggcatcgtgcaccccaccacagctgagattgacctgaaggaggacatcggcaaggccctggagaaggccggcggcaaggagttcctggagaccgtgaaggagctgaggaagagccagggccccctggaggtggccgaggccgctgtgtcccagagcagcggcctggccgccaagtttgtgatccactgccacatcccccagtggggcagtgacaagtgtgaggagcagctggaggagaccatcaagaactgcctgtctgctgctgaggacaagaagctgaagtctgtgtag

SEQ ID NO: 15648 - DNA, 732 bp, Artificial Sequence; identical to SEQ ID NO: 15647
  Description of Artificial Sequence: Synthetic coding sequence

SEQ ID NO: 15649 - DNA, 387 bp, Artificial Sequence
  Description of Artificial Sequence: Synthetic coding sequence
atggccggcggcaaggccggcaaggacagcggcaaggccaagaccaaggctgtgagccgcagccagagagctggcctgcagtttcctgtgggccgcatccaccgccacctgaagagcaggaccaccagccacggccgggtgggcgccacagctgctgtgtacagcgctgccatcctggagtacctgacagctgaggtgctggagctggccggaaatgccagcaaggacctgaaggtgaagaggatcacccccaggcacctgcagctggccatcagaggagatgaggagctggacagcctcatcaaggccaccatcgccggcggcggcgtcatcccccacatccacaagagcctgattggcaagaagggccagcagaagacagtgtag

SEQ ID NO: 15650 - DNA, 774 bp, Artificial Sequence
  Description of Artificial Sequence: Synthetic coding sequence
atgaagtgccacgccggcagcctgagcgccaacctgcctgccctgaaggtgacaggctggagccgctgtgtggccagccggcagcccatcaccgtgggcgtgtgtggccccaagaggcccctgtggcccagcagcgagaagcccttcaacttccacaccctggccaagctgcatgacatcggcctgggcaatgacttcctggacatgaccctgaaggcccagcagcagaagcagaagagccacgccaccatccccaagtgcccccccctgccctggagccccaccgtgaccctgtgcagctgctacctgatggccgccgccagcgccatggccgaggccagcagcgagaccaccagcgaggagggccagagcatccaggagcccaaggaggccaacagcaccaaggcccagaagcagaagagaagaggctgccggggcagcagaagaagacatgccaacagaagaggagacagctttggagacagcttcaccccctacttcccccgggtgctgaagcaggtgcaccagggcctgagcctgagccaggaggccgtgtctgtgatggacagcatgattcatgacatcctggacagaattgccacagaagctggccagctggcccactacaccaagagggtgaccatcaccagccgggacatccagatggctgtgcggctgctgctgcccgggaagatgggcaagctggccgaggcccagggcaccaatgctgccctgcggaccagcctgtgtgccatctggcagcagaggaagtag

SEQ ID NO: 15651 - DNA, 465 bp, Artificial Sequence
  Description of Artificial Sequence: Synthetic coding sequence
atggctgctgccagcgccatggccgaggccagcagcgagaccaccagcgaggagggccagagcatccaggagcccaaggaggccaacagcaccaaggcccagaagcagaagaggcggggctgccggggcagcagaagaagacatgccaacagaagaggagacagctttggagacagcttcaccccctacttcccccgggtgctgaagcaggtgcaccagggcctgagcctgagccaggaggccgtgtctgtgatggacagcatgattcatgacatcctggaccgcatcgccacagaggccggccagctggcccactacaccaagagggtgaccatcaccagccgggacatccagatggctgtgcggctgctgctgcccgggaagatgggcaagctggccgaggcccagggcaccaatgctgccctgcggaccagcctgtgtgccatctggcagcagaggaagtag

SEQ ID NO: 15652 - DNA, 1026 bp, Artificial Sequence
  Description of Artificial Sequence: Synthetic coding sequence
atggccacctggaggagagatggccgcctgactggaggccagaggctgctgtgtgccggcctggccggcaccctgagcctgagcctgacagcccccctggagctggccaccgtgctggcccaggtgggcgtggtgcggggccacgcccggggcccctgggccaccggccaccgggtgtggagggctgagggcctgcgggccctgtggaagggaaatgctgtggcctgcctgcggctcttcccctgcagcgctgtgcagctggccgcctacaggaagtttgtggtgctcttcacagatgacctgggccacatcagccagtggagcagcatcatggccggcagcctggccggcatggtgtccaccatcgtgacctaccccacagacctgatcaagaccaggctcatcatgcagaacatcctggagcccagctaccggggcctgctgcacgccttcagcaccatctaccagcaggagggcttcctggccctgtaccggggcgtgtccctgactgtggtgggcgccctgcccttctctgctggcagcctgctggtgtacatgaacctggagaagatctggaatggcccccgggaccagttcagcctgccccagaactttgccaacgtgtgcctggccgctgctgtgacccagaccctgtccttcccctttgagaccgtgaagaggaagatgcaggcccagagcccctacctgccccacagcggaggagtggatgtgcacttctctggagctgtggactgcttccggcagatcgtgaaggcccagggcgtgctgggcctgtggaatggcctgacagccaacctgctgaagatcgtgccctacttcggcatcatgttcagcacctttgagttctgcaagaggatctgcctgtaccagaatggctacatcctgagccccctgagctacaagctgaccccaggagtggaccagagcctgcagccccaggagctgcgggagctgaagaagttcttcaagaccaggaagcccaagcccaagaagcccaccctgtag

SEQ ID NO: 15653 - DNA, 408 bp, Artificial Sequence
  Description of Artificial Sequence: Synthetic coding sequence
atggcccggaccaagcagacagccaggaagagcactggaggcaaggcccccaggaagcagctggccaccaaggccgccaggaagagcacccccagcacctgtggggtgaagccccaccgctacagacctggcaccgtggccctgcgggagatccgccgctaccagaagagcacagagctgctgatcaggaagctgcccttccagaggctggtgcgggagatcgcccaggacttcaacacagacctgcgcttccagagcgctgctgtgggcgccctgcaggaggccagcgaggcctacctggtgggcctgctggaggacaccaacctgtgtgccatccacgccaagagggtgaccatcatgcccaaggacatccagctggcccggcgcatccggggggagcgggcctag

SEQ ID NO: 15654 - DNA, 363 bp, Artificial Sequence
  Description of Artificial Sequence: Synthetic coding sequence
atgaccagcctggcccagcagctgcagaggctggccctgccccagagtgatgccagcctgctgagcagagatgaggtggccagcctgctgtttgaccccaaggaggccgccaccatcgaccgggacacagcctttgccatcggctgcaccggcctggaggagctgctgggcatcgaccccagctttgagcagtttgaggcccccctcttcagccagctggccaagaccctggagaggtctgtgcagaccaaggctgtgaacaagcagctggatgagaacatcagcctcttcctgatccacctgagcccctacttcctgctgaagccagcccagaagtgcctggagtggctgatccacaggtag

SEQ ID NO: 15655 - DNA, 6192 bp, Artificial Sequence
  Description of Artificial Sequence: Synthetic coding sequence
atgaccagcctggcccagcagctgcagaggctggccctgccccagagtgatgccagcctgctgagcagagatgaggtggccagcctgctgtttgaccccaaggaggccgccaccatcgaccgggacacagcctttgccatcggctgcaccggcctggaggagctgctgggcatcgaccccagctttgagcagtttgaggcccccctcttcagccagctggccaagaccctggagaggtctgtgcagaccaaggctgtgaacaagcagctggatgagaacatcagcctcttcctgatccacctgagcccctacttcctgctgaagccagcccagaagtgcctggagtggctgatccaccgcttccacatccacctgtacaaccaggacagcctcatcgcctgtgtgctgccctaccacgagacccgcatctttgtgcgggtcatccagctgctgaagatcaacaacagcaagcaccgctggttctggctgctgcctgtgaagcagagcggcgtgcccctggccaagggcaccctcatcacccactgctacaaggacctgggcttcatggacttcatctgcagcctggtgaccaagtctgtgaaggtgtttgctgagtacccaggcagcagcgcccagctgcgggtgctgctggccttctacgccagcaccatcgtgtctgccctggtggccgcagaagatgtgtctgacaacatcatcgccaagctgttcccctacatccagaagggcctgaagagcagcctgcctgactacagagctgccacctacatgatcatctgccagatctctgtgaaggtgaccatggagaacacctttgtgaacagcctggccagccagatcatcaagaccctgaccaagatccccagcctcatcaaggatggcctgagctgcctgattgtgctgctgcagaggcagaagccagagagcctgggcaagaagcccttcccccacctgtgcaatgtgcctgacctgatcaccatcctgcacggcatcagcgagacctatgatgtgagccccctgctgcactacatgctgccccacctggtggtgtccatcatccaccacgtgactggagaggagacagagggcatggatggccagatctacaagaggcacctggaggccatcctgaccaagatcagcctgaagaacaacctggaccacctgctggccagcctgctgtttgaggagtacatctcctacagcagccaggaggagatggacagcaacaaggtgtccctgctgaatgagcagttcctgcccctcatccggctgctggagagcaagtaccccaggaccctggatgtggtgctggaggagcacctgaaggagattgctgacctgaagaagcaggagctgttccaccagtttgtgtccctgagcaccagcggcggcaagtaccagttcctggccgacagcgacaccagcctgatgctgagcctgaaccaccccctggcccctgtgcgcatcctggccatgaaccacctgaagaagatcatgaagaccagcaaggagggcgtggatgagagcttcatcaaggaggccgtgctggcccggctgggagatgacaacattgatgtggtgctgagcgccatcagcgcctttgagatcttcaaggagcacttcagcagcgaggtgaccatcagcaacctgctgaacctcttccagagagctgagctgagcaagaatggagagtggtatgaggtgctgaagattgctgctgacatcctgatcaaggaggagatcctgtctgaaaatgaccagctgagcaaccaggtggtggtgtgcctgctgcccttcatggtgatcaacaatgatgacacagagagcgctgagatgaagatcgccatctacctgagcaagagcggcatctgcagcctgcaccccctgctgcggggctgggaggaggccctggagaatgtcatcaagagcaccaagccaggcaagctgattggagtggccaaccagaagatgattgagctgctggccgacaacatcaacctgggggaccccagctccatgctgaagatggtggaggacctgatctctgtgggggaggaggagagcttcaacctgaagcagaaggtgaccttccacgtgatcctgtctgtgctggtgtcctgctgcagcagcctgaaggagacccacttcccctttgccatccgggtcttcagcctgctgcagaagaagatcaagaagctggagagcgtcatcacagctgtggagatccccagcgagtggcacatcgagctgatgctggaccggggcatccctgtggagctgtgggcccactacgtggaggagctgaacagcacccagagggtggccgtggaggacagcgtcttcctggtgttcagcctgaagaagttcatctatgccctgaaggcccccaagagcttccccaagggggacatctggtggaaccctgagcagctgaaggaggacagccgggactacctgcacctgctgattggcctgtttgagatgatgctgaatggagcagatgctgtgcacttccgggtgctgatgaagctgttcatcaaggtgcacctggaggatgtgttccagctgttcaagttctgcagcgtgctgtggacctacggcagcagcctgagcaaccccctgaactgcagcgtgaagacagtgctgcagacccaggccctgtatgtgggctgtgccatgctgagcagccagaagacccagtgcaagcaccagctggccagcatcagcagccctgtggtgaccagcctgctgatcaacctgggcagccctgtgaaggaggtgagaagagctgccatccagtgcctgcaggccctgagcggcgtggccagccccttctacctgatcatcgaccacctgatcagcaaggccgaggagatcaccagtgatgctgcctacgtgatccaggacctggccaccctgtttgaggagctgcagcgggagaagaagctgaagagccaccagaagctgtctgagaccctgaagaacctgctgagctgtgtgtacagctgccccagctacatcgccaaggacctgatgaaggtgctgcagggcgtgaatggagagatcaccaagcccttctttgctgccatcagtgatgagaaggtgcagcagaagctgctgaggatgctgtttgacctgctggtgaactgcaagaacagccactgtgcccagacagtgagcagcgtcttcaagggcatctctgtgaatgctgagcaggtgcgcatcgagctggagcccccagacaaggccaagcccctgggcaccgtgcagcagaagaggcggcagaagatgcagcagaagaagagccaggacctggagagcgtgcaggaggtgggcggcagctactggcagagggtgaccctcatcctggagctgctgcagcacaagaagaagctgcggagcccccagatcctggtgcccaccctcttcaacctgctgagccgctgcctggagcccctgccccaggagcagggcaacatggagtacaccaagcagctgatcctgagctgcctgctgaacatctgccagaagctgagcccagatggcggcaagatccccaaggacatcctggatgaggagaagttcaacgtggagctgattgtgcagtgcatccggctgtctgagatgccccagacccaccaccacgccctgctgctgctgggcaccgtggccggcatcttcccagacaaggtgctgcacaacatcatgagcatcttcaccttcatgggcgccaacgtgatgaggctggatgacacctacagcttccaggtgatcaacaagacagtgaagatggtgatcccagccctgatccagagcgacagcggggacagcattgaggtgtccagaaatgtggaggagatcgtggtgaagatcatctctgtgtttgtggatgccctgccccacgtgcctgagcaccggcggctgcccatcctggtgcagctggtggacaccctgggcgctgagaagttcctgtggatcctgctgatcctgctgtttgagcagtatgtgaccaagacagtgctggccgccgcctacggggagaaggatgccatcctggaggccgacacagagttctggttctctgtgtgctgtgagttctctgtgcagcaccagatccagagcctgatgaacatcctgcagtacctgctgaagctgcctgaggagaaggaggagaccatccccaaggctgtgtccttcaacaagtctgagagccaggaggagatgctgcaggtgttcaacgtggagacccacaccagcaagcagctgcggcacttcaagttcctgtctgtgtccttcatgagccagctgctgagcagcaacaacttcctgaagaaggtggtggagagcggcggccctgagatcctgaagggcctggaggagcggctgctggagaccgtgctgggctacatctctgctgtggcccagagcatggagagaaatgctgacaagctgactgtgaagttctggagggccctgctgagcaaggcctatgacctgctggacaaggtgaatgccctgctgcccacagagaccttcatccctgtgatccggggcctggtgggcaaccccctgcccagcgtgcggaggaaggccctggacctgctgaacaacaagctgcagcagaacatctcctggaagaagaccatcgtgacccgcttcctgaagctggtgcctgacctgctggccatcgtgcagaggaagaagaaggagggggaggaggagcaggccatcaaccggcagacagccctgtacaccctgaagctgctgtgcaagaactttggagcagaaaatccagacccctttgtgcctgtgctgaacacagctgtgaagctgattgcccctgagaggaaggaggagaagaatgtgctgggcagcgccctgctgtgcatcgccgaggtgaccagcaccctggaggccctggccatcccccagctgcccagcctgatgcccagcctgctgaccaccatgaagaacaccagcgagctggtgagcagcgaggtgtacctgctgagcgccctggccgccctgcagaaggtggtggagaccctgccccacttcatcagcccctacctggagggcatcctgagccaggtgatccacctggagaagatcaccagcgagatgggcagcgccagccaggccaacatccggctgaccagcctgaagaagaccctggccaccaccctggccccccgggtgctgctgcctgccatcaagaagacctacaagcagatcgagaagaactggaagaaccacatgggccccttcatgagcatcctgcaggagcacatcggcgtgatgaagaaggaggagctgaccagccaccagagccagctgacagccttcttcctggaggccctggacttccgggcccagcacagtgaaaatgacctggaggaggtgggcaagacagagaactgcatcatcgactgcctggtggccatggtggtgaagctgtctgaggtgaccttccggcccctcttcttcaagctgtttgactgggccaagacagaagatgcccccaaggaccggctgctgaccttctacaacctggccgactgcatcgccgagaagctgaagggcctcttcaccctgtttgctggccacctggtgaagccctttgctgacaccctgaaccaggtgaacatcagcaagacagatgaggccttctttgacagtgaaaatgaccctgagaagtgctgcctgctgctgcagttcatcctgaactgcctgtacaagatcttcctgtttgacacccagcacttcatcagcaaggagagagctgaggccctgatgatgcccctggtggaccagctggagaaccggctgggcggggaggagaagttccaggagcgggtgaccaagcacctgatcccctgcatcgcccagttctctgtggccatggctgatgacagcctgtggaagcccctgaactaccagatcctgctgaagacccgggacagcagccccaaggtgcgctttgctgccctgatcaccgtgctggccctggccgagaagctgaaggagaactacatcgtgctgctgcctgagagcatccccttcctggccgagctgatggaggatgaatgtgaggaggtggagcaccagtgccagaagaccatccagcagctggagaccgtgctgggggagcccctgcagagctacttctag

SEQ ID NO: 15656 - DNA, 6435 bp, Artificial Sequence
  Description of Artificial Sequence: Synthetic coding sequence
atgaccagcctggcccagcagctgcagaggctggccctgccccagagtgatgccagcctgctgagcagagatgaggtggccagcctgctgtttgaccccaaggaggccgccaccatcgaccgggacacagcctttgccatcggctgcaccggcctggaggagctgctgggcatcgaccccagctttgagcagtttgaggcccccctcttcagccagctggccaagaccctggagaggtctgtgcagaccaaggctgtgaacaagcagctggatgagaacatcagcctcttcctgatccacctgagcccctacttcctgctgaagccagcccagaagtgcctggagtggctgatccaccgcttccacatccacctgtacaaccaggacagcctcatcgcctgtgtgctgccctaccacgagacccgcatctttgtgcgggtcatccagctgctgaagatcaacaacagcaagcaccgctggttctggctgctgcctgtgaagcagagcggcgtgcccctggccaagggcaccctcatcacccactgctacaaggacctgggcttcatggacttcatctgcagcctggtgaccaagtctgtgaaggtgtttgctgagtacccaggcagcagcgcccagctgcgggtgctgctggccttctacgccagcaccatcgtgtctgccctggtggccgcagaagatgtgtctgacaacatcatcgccaagctgttcccctacatccagaagggcctgaagagcagcctgcctgactacagagctgccacctacatgatcatctgccagatctctgtgaaggtgaccatggagaacacctttgtgaacagcctggccagccagatcatcaagaccctgaccaagatccccagcctcatcaaggatggcctgagctgcctgattgtgctgctgcagaggcagaagccagagagcctgggcaagaagcccttcccccacctgtgcaatgtgcctgacctgatcaccatcctgcacggcatcagcgagacctatgatgtgagccccctgctgcactacatgctgccccacctggtggtgtccatcatccaccacgtgactggagaggagacagagggcatggatggccagatctacaagaggcacctggaggccatcctgaccaagatcagcctgaagaacaacctggaccacctgctggccagcctgctgtttgaggagtacatctcctacagcagccaggaggagatggacagcaacaaggtgtccctgctgaatgagcagttcctgcccctcatccggctgctggagagcaagtaccccaggaccctggatgtggtgctggaggagcacctgaaggagattgctgacctgaagaagcaggagctgttccaccagtttgtgtccctgagcaccagcggcggcaagtaccagttcctggccgacagcgacaccagcctgatgctgagcctgaaccaccccctggcccctgtgcgcatcctggccatgaaccacctgaagaagatcatgaagaccagcaaggagggcgtggatgagagcttcatcaaggaggccgtgctggcccggctgggagatgacaacattgatgtggtgctgagcgccatcagcgcctttgagatcttcaaggagcacttcagcagcgaggtgaccatcagcaacctgctgaacctcttccagagagctgagctgagcaagaatggagagtggtatgaggtgctgaagattgctgctgacatcctgatcaaggaggagatcctgtctgaaaatgaccagctgagcaaccaggtggtggtgtgcctgctgcccttcatggtgatcaacaatgatgacacagagagcgctgagatgaagatcgccatctacctgagcaagagcggcatctgcagcctgcaccccctgctgcggggctgggaggaggccctggagaatgtcatcaagagcaccaagccaggcaagctgattggagtggccaaccagaagatgattgagctgctggccgacaacatcaacctgggggaccccagctccatgctgaagatggtggaggacctgatctctgtgggggaggaggagagcttcaacctgaagcagaaggtgaccttccacgtgatcctgtctgtgctggtgtcctgctgcagcagcctgaaggagacccacttcccctttgccatccgggtcttcagcctgctgcagaagaagatcaagaagctggagagcgtcatcacagctgtggagatccccagcgagtggcacatcgagctgatgctggaccggggcatccctgtggagctgtgggcccactacgtggaggagctgaacagcacccagagggtggccgtggaggacagcgtcttcctggtgttcagcctgaagaagttcatctatgccctgaaggcccccaagagcttccccaagggggacatctggtggaaccctgagcagctgaaggaggacagccgggactacctgcacctgctgattggcctgtttgagatgatgctgaatggagcagatgctgtgcacttccgggtgctgatgaagctgttcatcaaggtgcacctggaggatgtgttccagctgttcaagttctgcagcgtgctgtggacctacggcagcagcctgagcaaccccctgaactgcagcgtgaagacagtgctgcagacccaggccctgtatgtgggctgtgccatgctgagcagccagaagacccagtgcaagcaccagctggccagcatcagcagccctgtggtgaccagcctgctgatcaacctgggcagccctgtgaaggaggtgagaagagctgccatccagtgcctgcaggccctgagcggcgtggccagccccttctacctgatcatcgaccacctgatcagcaaggccgaggagatcaccagtgatgctgcctacgtgatccaggacctggccaccctgtttgaggagctgcagcgggagaagaagctgaagagccaccagaagctgtctgagaccctgaagaacctgctgagctgtgtgtacagctgccccagctacatcgccaaggacctgatgaaggtgctgcagggcgtgaatggagagatggtgctgagccagctgctgcccatggccgagcagctgctggagaagatccagaaggagcccacagctgtgctgaaggatgaggccatggtgctgcacctgaccctgggcaagtacaatgagttctctgtgtccctgctgaatgaagaccccaagagcctggacatcttcatcaaggctgtgcacaccaccaaggagctgtatgccggcatgcccaccatccagatcacagccctggagaagatcaccaagcccttctttgctgccatcagtgatgagaaggtgcagcagaagctgctgaggatgctgtttgacctgctggtgaactgcaagaacagccactgtgcccagacagtgtcctctgtgttcaagggcatctctgtgaatgctgagcaggtgagaattgagctggagcccccagacaaggccaagcccctgggcaccgtgcagcagaagaggcggcagaagatgcagcagaagaagagccaggacctggagagcgtgcaggaggtgggcggcagctactggcagagggtgaccctcatcctggagctgctgcagcacaagaagaagctgcggagcccccagatcctggtgcccaccctcttcaacctgctgagccgctgcctggagcccctgccccaggagcagggcaacatggagtacaccaagcagctgatcctgagctgcctgctgaacatctgccagaagctgagcccagatggcggcaagatccccaaggacatcctggatgaggagaagttcaacgtggagctgattgtgcagtgcatccggctgtctgagatgccccagacccaccaccacgccctgctgctgctgggcaccgtggccggcatcttcccagacaaggtgctgcacaacatcatgagcatcttcaccttcatgggcgccaacgtgatgaggctggatgacacctacagcttccaggtgatcaacaagacagtgaagatggtgatcccagccctgatccagagcgacagcggggacagcattgaggtgtccagaaatgtggaggagatcgtggtgaagatcatctctgtgtttgtggatgccctgccccacgtgcctgagcaccggcggctgcccatcctggtgcagctggtggacaccctgggcgctgagaagttcctgtggatcctgctgatcctgctgtttgagcagtatgtgaccaagacagtgctggccgccgcctatggagagaaggatgccatcctggaggccgacacagagttctggttctctgtgtgctgtgagttctctgtgcagcaccagatccagagcctgatgaacatcctgcagtacctgctgaagctgcctgaggagaaggaggagaccatccccaaggctgtgtccttcaacaagtctgagagccaggaggagatgctgcaggtgttcaacgtggagacccacaccagcaagcagctgcggcacttcaagttcctgtctgtgtccttcatgagccagctgctgagcagcaacaacttcctgaagaaggtggtggagagcggcggccctgagatcctgaagggcctggaggagcggctgctggagaccgtgctgggctacatctctgctgtggcccagagcatggagagaaatgctgacaagctgactgtgaagttctggagggccctgctgagcaaggcctatgacctgctggacaaggtgaatgccctgctgcccacagagaccttcatccctgtgatccggggcctggtgggcaaccccctgcccagcgtgcggaggaaggccctggacctgctgaacaacaagctgcagcagaacatctcctggaagaagaccatcgtgacccgcttcctgaagctggtgcctgacctgctggccatcgtgcagaggaagaagaaggagggggaggaggagcaggccatcaaccggcagacagccctgtacaccctgaagctgctgtgcaagaactttggagctgagaacccagacccctttgtgcctgtgctgaacacagctgtgaagctgattgcccctgagaggaaggaggagaagaatgtgctgggcagcgccctgctgtgcatcgccgaggtgaccagcaccctggaggccctggccatcccccagctgcccagcctgatgcccagcctgctgaccaccatgaagaacaccagcgagctggtgtcctctgaggtgtacctgctgagcgccctggccgccctgcagaaggtggtggagaccctgccccacttcatcagcccctacctggagggcatcctgagccaggtgatccacctggagaagatcaccagcgagatgggcagcgccagccaggccaacatccggctgaccagcctgaagaagaccctggccaccaccctggccccccgggtgctgctgcctgccatcaagaagacctacaagcagatcgagaagaactggaagaaccacatgggccccttcatgagcatcctgcaggagcacatcggcgtgatgaagaaggaggagctgaccagccaccagagccagctgacagccttcttcctggaggccctggacttccgggcccagcacagtgaaaatgacctggaggaggtgggcaagacagagaactgcatcatcgactgcctggtggccatggtggtgaagctgtctgaggtgaccttccggcccctcttcttcaagctgtttgactgggccaagacagaagatgcccccaaggaccggctgctgaccttctacaacctggccgactgcatcgccgagaagctgaagggcctcttcaccctgtttgctggccacctggtgaagccctttgctgacaccctgaaccaggtgaacatcagcaagacagatgaggccttctttgattctgaaaatgaccctgagaagtgctgcctgctgctgcagttcatcctgaactgcctgtacaagatcttcctgtttgacacccagcacttcatcagcaaggagcgggcagaggccctgatgatgcccctggtggaccagctggagaaccggctgggcggggaggagaagttccaggagcgggtgaccaagcacctgatcccctgcatcgcccagttctctgtggccatggctgatgacagcctgtggaagcccctgaactaccagatcctgctgaagacccgggacagcagccccaaggtgcgctttgctgccctgatcaccgtgctggccctggccgagaagctgaaggagaactacatcgtgctgctgcctgagagcatccccttcctggccgagctgatggaggatgaatgtgaggaggtggagcaccagtgccagaagaccatccagcagctggagaccgtgctgggggagcccctgcagagctacttctag

SEQ ID NO: 15657 - DNA, 231 bp, Artificial Sequence
  Description of Artificial Sequence: Synthetic coding sequence
atggccgagacagaccccaagacagtgcaggacctgacctctgtggtgcagaccctgctgcagcagatgcaggacaagttccagaccatgtctgaccagatcatcggcagaattgatgacatgagcagcagaattgatgacctggagaagaacattgctgacctgatgacccaggccggcgtggaggagctggagagcgagaacaagatcccagccacccagaagagctag

SEQ ID NO: 15658 - DNA, 1791 bp, Artificial Sequence
  Description of Artificial Sequence: Synthetic coding sequence
atggaggccctgctgagcacccccatcaaccccaacaacttccctgccaagctgtggaggctggtgaacagcccccgctaccgcagcatccgctgggatggccgcggggagggcctgctgattgaccagcccctgtttgaggccgagctgctgagccccccaggccctgggggcggcggcggcacagctggagctggagctgagcctgagctgttcaagaccaccagcttcaccagcttcatccggcagctgaacctgtatggcttcaggaaggtggtgctgggcggccctgggggcggcaagccagctggaaatggccccctgcaccacttccacaacccccacttcagaagagaccagccccagctgctggtgcacctgaagaggctgaccagcgccaacaaggccaagctggccgccggcctggaggtgccctgccggccccccaaccgcttccagaggctgctgatcaccagcgccagcgctgccacagcccccctgcagcaccagcagcccccacctcctgctggccccaggcctgagccccacggccctgtggccgtgggccagttccacaggagcttccggcgggacagcctgagcccctacagctgtgtgtccacccccagccatgaccacagcacctaccccctgaagggcctggacaggacccctgtgccccaccgcatctggcagaacagcctgggcatgcaccctggccaggtggagaccagccccaccttcagtgacaagggcgtgcccttccctgtgctgcagcgcttccccacagaggtgacctacaccctgcagcccagcaccacctctgtgcacgtgcagcagggcccccagaccatggtgagcagcagccagaagtacagcaactacacccccagcgcccagtacagccaggcctactaccccacagctgtgctgcagtgctgcagccccacccacatggatgccctgagcagctgtgtgaccccaaatgccagcagctatgcccactgcaactacttccagaaccccagcatgcagagcagctaccctgtggagttcctgcccagcaactggccctgcagcaccacagatgagaacaccaagacagaggtgaacctggaggccgtgttccagatcgtggatgagctgcacagcagccccaagctggagatggtgaaggtggagcctgtggagaaccagtgccccaccagccccagctaccggggccagcacatcctggccaacagcaacaacagcaacccctgcagcgccagccaggccagccagctggagcccctgacccctgtgggcagtgacatcatgagctttgtggtgggcacagagcaggccgtggcctgcagcctgccccagagccctgagtacatctacaccatccacacagcccagcctgtggagaacagcaccatccaggagagcgctgccatccagcaggcccacgtgaagctgaaggagcacctgaaccacaaccccagccccagctctgtggtgtttgtgcaggagggcccccccttcagcacccaccaggtggatgccaacatcaagtgccagaccagcagccgggagaacatcctgcccagcgagcagatgggcttcctgatcagcgagatgggccctgccagcaagcccagcgaggacaccggcctggccaccccagcccgctaccgggagcacaggagcaacagccagcagggcaagagcccagacctgcacctgctggtggatgtggcctgcaagcaggagcgcttccccaaggaggaggagctgaaggagtag

SEQ ID NO: 15659 - DNA, 1491 bp, Artificial Sequence
  Description of Artificial Sequence: Synthetic coding sequence
gggggcattgaaaatggagtgggggagctgggcagcggcggggaggccccagccaggagaggagatggaggagctgccctgcacccccaccagccccagcagctgccccggcaggccgtggcccctggagagcagcctgccctgcccctgcaccccctgggccggcccaggagaggagctgcctacagatctgctgccctgcggggccgggccgcccagcccccagctggccccaggcctgagccccacggccctgtggccgtgggccagttccacaggagcttccggcgggacagcctgagcccctacagctgtgtgtccacccccagccatgaccacagcacctaccccctgaagggcctggacaggacccctgtgccccaccgcatctggcagaacagcctgggcatgcaccctggccaggtggagaccagccccaccttcagtgacaagggcgtgcccttccctgtgctgcagcgcttccccacagaggtgacctacaccctgcagcccagcaccacctctgtgcacgtgcagcagggcccccagaccatggtgagcagcagccagaagtacagcaactacacccccagcgcccagtacagccaggcctactaccccacagctgtgctgcagtgctgcagccccacccacatggatgccctgagcagctgtgtgaccccaaatgccagcagctatgcccactgcaactacttccagaaccccagcatgcagagcagctaccctgtggagttcctgcccagcaactggccctgcagcaccacagatgagaacaccaagacagaggtgaacctggaggccgtgttccagatcgtggatgagctgcacagcagccccaagctggagatggtgaaggtggagcctgtggagaaccagtgccccaccagccccagctaccggggccagcacatcctggccaacagcaacaacagcaacccctgcagcgccagccaggccagccagctggagcccctgacccctgtgggcagtgacatcatgagctttgtggtgggcacagagcaggccgtggcctgcagcctgccccagagccctgagtacatctacaccatccacacagcccagcctgtggagaacagcaccatccaggagagcgctgccatccagcaggcccacgtgaagctgaaggagcacctgaaccacaaccccagccccagctctgtggtgtttgtgcaggagggcccccccttcagcacccaccaggtggatgccaacatcaagtgccagaccagcagccgggagaacatcctgcccagcgagcagatgggcttcctgatcagcgagatgggccctgccagcaagcccagcgaggacaccggcctggccaccccagcccgctaccgggagcacaggagcaacagccagcagggcaagagcccagacctgcacctgctggtggatgtggcctgcaagcaggagcgcttccccaaggaggaggagctgaaggagtag

SEQ ID NO: 15660 - DNA, 3264 bp, Artificial Sequence
  Description of Artificial Sequence: Synthetic coding sequence
atggcccggagcagcccctacctgcggcagctgcagggccccctgctgcccccccgggacctggtggaggaggatgatgactacctgaatgatgatgtggaggaggatgaggagagcgtcttcattgatgctgaggagctgtgcagcggaggagtgaaggccggcagcctgcccggctgcctgcgggtgtccatctgtgatgagaacacccaggagacctgcaaggtgtttggccgcttccccatcactggagcctggtggagggtgaaggtgcaggtgaagcctgtggtgggcagccgcagctaccagtaccaggtgcagggcttccccagctacttcctgcagagcgacatgagcccccccaaccagaagcacatctgtgccctcttcctgaaggaatgtgaggtgtccagtgatgatgtgaacaagttcctgacctgggtgaaggaggtgagcaactacaagaacctgaactttgagaacctgcgggagaccctgcggaccttccacaaggagactggaaggaaggaccagaagcagcccacccagaatggccaggaggagctgttcctggacaatgagatgagcctgcccctggagaacaccatccccttcagaaatgtgatgacagccctgcagttccccaagatcatggagttcctgcctgtgctgctgcccaggcacttcaagtggatcatcggcagcggcagcaaggagatgctgaaggagattgaggagatcctgggcacccacccctggaagctgggcttcagcaagatcacctaccgggagtggaagctgctgcgctgtgaggcctcctggatcgccttctgccagtgtgagagcctgctgcagctgatgacagacctggagaagaatgccctgatcatgtacagccggctgaagcagatctgcagagaagatggccacacctacgtggaggtgaatgacctgaccctgaccctgagcaaccacatgtccttccacgccgccagcgagagcctgaagttcctgaaggacattggagtggtgacctatgagaagagctgtgtgttcccctatgacctgtaccacgccgagcgggccatcgccttcagcatctgtgacctgatgaagaagccaccctggcacctgtgtgtggatgtggagaaggtgctggccagcatccacaccaccaagccagagaacagcagtgatgatgccctgaatgaaagcaagccagatgaggtgcggctggagaaccctgtggatgtggtggacacccaggacaacggggaccacatctggaccaatggagaaaatgagatcaatgctgagatcagcgaggtgcagctggaccaggaccaggtggaggtgcccctggaccgggaccaggtggccgccctggagatgatctgcagcaaccctgtgaccgtcatcagcggcaagggcggctgcggcaagaccaccatcgtgtcccggctcttcaagcacatcgagcagctggaggagcgggaggtgaagaaggcctgtgaagattttgagcaggaccagaatgccagcgaggagtggatcaccttcacagagcagagccagctggaggccgacaaggccatcgaggtgctgctgacagcccccaccgggaaggccgccggcctgctgcggcagaagacaggcctgcacgcctacaccctgtgccaggtgaactacagcttctacagctggacccagaccatgatgaccaccaacaagccctggaagttcagctctgtgcgggtgctggtggtggatgagggcagcctggtgtctgtgggcatcttcaagtctgtgctgaacctgctgtgtgagcacagcaagctgagcaagctgatcatcctgggggacatccggcagctgcccagcattgagcccggcaacctgctgaaggacctgtttgagaccctgaagagcaggaactgtgccatcgagctgaagaccaaccacagagctgagagccagctgattgtggacaatgccacccgcatcagccggcggcagttccccaagtttgatgctgagctgaacatcagtgacaaccccaccctgcccatcagcatccaggacaagaccttcatctttgtgcggctgcctgaagaagatgccagcagccagagcagcaagaccaaccaccacagctgcctgtacagcgctgtgaagaccctgctgcaggagaacaacctgcagaatgccaagaccagccagttcatcgccttccggcggcaggactgtgacctgatcaatgactgctgctgcaagcactacacaggccacctgaccaaggaccaccagagccggctggtgtttggcatcggggacaagatctgctgcaccagaaatgcctacctgagtgacctgctgcctgagaacatcagcggcagccagcagaacaatgacctggatgccagcagcgaggacttcagcggcaccctgcctgactttgccaagaacaagagggactttgagagcaatgtgcggctgtgcaatggagagatcttcttcatcaccaatgatgtgacagatgtgaccttcggcaagaggaggagcctgaccatcaacaacatggccggcctggaggtgacagtggacttcaagaagctgatgaagtactgccgcatcaagcacgcctgggcccggaccatccacaccttccagggcagcgaggagcagacagtggtgtatgtggtgggcaaggccggccggcagcactggcagcacgtgtacacagctgtgacccggggccgctgccgggtgtatgtgattgctgaggagagccagctgagaaatgccatcatgaagaacagcttccccaggaagacccggctgaagcacttcctgcagagcaagctgagcagcagcggggcccctcctgctgacttccccagccccaggaagagcagcggggacagcggcggccccagcacccccagcgccagccccctgcctgtggtgacagaccacgccatgaccaatgatgtgacctggagcgaggccagcagcccagatgagaggaccctgacctttgctgagcgctggcagctgagcagcccagatggagtggacacagatgatgacctgcccaagagccgggccagcaagaggacctgtggggtgaatgatgatgagagccccagcaagatcttcatggtgggggagagcccccaggtgagcagccggctgcagaacctgcggctgaacaacctgatcccccggcagctgttcaagcccacagacaaccaggagacctag

SEQ ID NO: 15661 - DNA, 3264 bp, Artificial Sequence; identical to SEQ ID NO: 15660
  Description of Artificial Sequence: Synthetic coding sequence

SEQ ID NO: 15662 - DNA, 3030 bp, Artificial Sequence
  Description of Artificial Sequence: Synthetic coding sequence
atgtcctggatgttcaagagggaccctgtgtggaagtacctgcagacagtgcagtatggagtgcacggcaacttcccccggctgagctaccccaccttcttccccaggtttgagttccaggatgtgatccccccagatgacttcctgaccagtgatgaggaggtggacagcgtgctgtttggcagcctgcggggccacgtggtgggcctgcgctactacacaggagtggtgaacaacaatgagatggtggccctgcagagggaccccaacaacccctatgacaagaatgccatcaaggtgaacaacgtgaatggaaaccaggtgggccacctgaagaaggagctggccggggccctggcctacatcatggacaacaagctggcccagatcgagggcgtggtgccctttggagccaacaatgccttcaccatgcccctgcacatgaccttctggggcaaggaggagaacaggaaggctgtgtctgaccagctgaagaagcacggcttcaagctgggccctgcccccaagaccctgggcttcaacctggagagcggctggggcagcggccgggccggccccagctacagcatgcctgtgcatgctgctgtgcagatgaccacagagcagctgaagacagaatttgacaagctgtttgaggacctgaaggaggatgacaagacccatgagatggagcctgctgaggccatcgagacccccctgctgccccaccagaagcaggccctggcctggatggtgtcccgggagaacagcaaggagctgccccccttctgggagcagagaaatgacctgtactacaacaccatcaccaacttcagcgagaaggacagaccagaaaatgtgcacggcggcatcctggctgatgacatgggcctgggcaagaccctgacagccatcgccgtcatcctgaccaacttccatgatggccggcccctgcccatcgagcgggtgaagaagaacctgctgaagaaggagtacaacgtgaatgatgacagcatgaagctgggcggcaacaacaccagcgagaaggcagatggcctgagcaaggatgccagccgctgcagcgagcagcccagcatcagtgacatcaaggagaagagcaagttcaggatgtctgagctgagcagcagccggcccaagaggaggaagacagctgtgcagtacatcgagagcagtgacagcgaggagattgagaccagcgagctgccccagaagatgaagggcaagctgaagaatgtgcagagcgagaccaagggccgggccaaggccggcagcagcaaggtgattgaagatgtggcctttgcctgtgccctgaccagctctgtgcccaccaccaagaagaagatgctgaagaagggggcctgtgctgtggagggcagcaagaagacagatgtggaggagcggcccaggaccaccctcatcatctgccccctgtctgtgctgagcaactggattgaccagtttggccagcacatcaagagtgatgtgcacctgaacttctacgtgtactacggccctgaccgcatccgggagcccgccctgctgagcaagcaggacatcgtgctgaccacctacaacatcctgacccatgactatggcaccaagggggacagccccctgcacagcatccgctggctgcgggtcatcctggatgagggccacgccatccggaaccccaatgcccagcagaccaaggctgtgctggacctggagagcgagcggcgctgggtgctgaccggcacccccatccagaacagcctgaaggacctgtggagcctgctgtccttcctgaagctgaagcccttcatcgaccgggagtggtggcacaggaccatccagaggcctgtgaccatgggagatgagggcggcctgcggcggctgcagagcctcatcaagaacatcaccctgcggaggaccaagaccagcaagatcaagggcaagcctgtgctggagctgcctgagaggaaggtgttcatccagcacatcaccctgagtgatgaggagaggaagatctaccagagcgtgaagaatgaaggccgggccaccatcggccgctacttcaatgaaggaacagtgctggcccactatgcagatgtgctgggcctgctgctgcggctgcggcagatctgctgccacacctacctgctgaccaatgctgtgagcagcaatggccccagcggaaatgacaccccagaggagctgaggaagaagctgatcaggaagatgaagctgatcctgagcagcggcagtgatgaagaatgtgccatctgcctggacagcctgactgtgcctgtgatcacccactgtgcccacgtgttctgcaagccctgcatctgccaggtgatccagaatgagcagccccacgccaagtgccccctgtgcagaaatgacatccacgaggacaacctgctggagtgccccccagaggagctggcccgggacagcgagaagaagagtgacatggagtggaccagcagcagcaagatcaatgccctgatgcacgccctgacagacctgaggaagaagaaccccaacatcaagagcctggtggtgtcccagttcaccaccttcctgagcctgattgagatccccctgaaggccagcggctttgtgttcacccggctggatggctccatggcccagaagaagagggtggagagcatccagtgcttccagaacacagaggccggcagccccaccatcatgctgctgagcctgaaggccggcggcgtgggcctgaacctgtctgctgccagcagggtcttcctgatggaccctgcctggaacccagctgctgaggaccagtgctttgaccgctgccaccggctgggccagaagcaggaggtgatcatcaccaagttcatcgtgaaggacagcgtggaggagaacatgctgaagatccagaacaagaagcgggagctggccgccggggccttcggcaccaagaagcccaatgctgatgagatgaagcaggccaagatcaatgagatccgcaccctgattgacctgtag

SEQ ID NO: 15663 - DNA, 3030 bp, Artificial Sequence; identical to SEQ ID NO: 15662
  Description of Artificial Sequence: Synthetic coding sequence

SEQ ID NO: 15664 - DNA, 1179 bp, Artificial Sequence
  Description of Artificial Sequence: Synthetic coding sequence
atgttcaagagggaccctgtgtggaagtacctgcagacagtgcagtatggagtgcacggcaacttcccccggctgagctaccccaccttcttccccaggtttgagttccaggacgtcatccccccagatgacttcctgaccagtgatgaggaggtggacagcgtgctgtttggcagcctgcggggccacgtggtgggcctgcgctactacacaggagtggtgaacaacaatgagatggtggccctgcagagggaccccaacaacccctatgacaagaatgccatcaaggtgaacaacgtgaatggaaaccaggtgggccacctgaagaaggagctggccggggccctggcctacatcatggacaacaagctggcccagattgaaggagtggtgccctttggagccaacaatgccttcaccatgcccctgcacatgaccttctggggcaaggaggagaacaggaaggctgtgtctgaccagctgaagaagcacggcttcaagctgggccctgcccccaagaccctgggcttcaacctggagagcggctggggcagcggccgggccggccccagctacagcatgcctgtgcacgccgctgtgcagatgaccacagagcagctgaagacagaatttgacaagctgtttgaggacctgaaggaggatgacaagacccatgagatggagcctgctgaggccatcgagacccccctgctgccccaccagaagcaggccctggcctggatggtgtcccgggagaacagcaaggagctgccccccttctgggagcagagaaatgacctgtactacaacaccatcaccaacttcagcgagaaggacagaccagaaaatgtgcatggaggcatcctggctgatgacatgggcctgggcaagaccctgacagccatcgctgtgatcctgaccaacttccatgatggccggcccctgcccatcgagcgggtgaagaagaacctgctgaagaaggagtacaacgtgaatgatgacagcatgaagctgggcggcaacaacaccagcgagaaggcagatggcctgagcaaggatgccagccgctgcagcgagcagcccagcatcagtgacatcaaggagaagagcaagttcaggatgtctgagctgagcagcagccggcccaagagccagaagaagaagaagaagcgggagtag

SEQ ID NO: 15665 - DNA, 1374 bp, Artificial Sequence
  Description of Artificial Sequence: Synthetic coding sequence
atgttcaagagggaccctgtgtggaagtacctgcagacagtgcagtatggagtgcacggcaacttcccccggctgagctaccccaccttcttccccaggtttgagttccaggacgtcatccccccagatgacttcctgaccagtgatgaggaggtggacagcgtgctgtttggcagcctgcggggccacgtggtgggcctgcgctactacacaggagtggtgaacaacaatgagatggtggccctgcagagggaccccaacaacccctatgacaagaatgccatcaaggtgaacaacgtgaatggaaaccaggtgggccacctgaagaaggagctggccggggccctggcctacatcatggacaacaagctggcccagattgaaggagtggtgccctttggagccaacaatgccttcaccatgcccctgcacatgaccttctggggcaaggaggagaacaggaaggctgtgtctgaccagctgaagaagcacggcttcaagctgggccctgcccccaagaccctgggcttcaacctggagagcggctggggcagcggccgggccggccccagctacagcatgcctgtgcacgccgctgtgcagatgaccacagagcagctgaagacagaatttgacaagctgtttgaggacctgaaggaggatgacaagacccatgagatggagcctgctgaggccatcgagacccccctgctgccccaccagaagcaggccctggcctggatggtgtcccgggagaacagcaaggagctgccccccttctgggagcagagaaatgacctgtactacaacaccatcaccaacttcagcgagaaggacagaccagaaaatgtgcatggaggcatcctggctgatgacatgggcctgggcaagaccctgacagccatcgctgtgatcctgaccaacttccatgatggccggcccctgcccatcgagcgggtgaagaagaacctgctgaagaaggagtacaacgtgaatgatgacagcatgaagctgggcggcaacaacaccagcgagaaggcagatggcctgagcaaggatgccagccgctgcagcgagcagcccagcatcagtgacatcaaggagaagagcaagttcaggatgtctgagctgagcagcagccggcccaagaggaggaagacagctgtgcagtacatcgagagcagtgacagcgaggagattgagaccagcgagctgccccagaagatgaagggcaagctgaagaatgtgcagagcgagaccaagggccgggccaaggccggcagcagcaaggtgattgaagatgtggcctttgcctgtgccctgaccagctctgtgcccaccaccaagaagaagatgctgaagaaggtgaagtag

SEQ ID NO: 15666 - DNA, 3030 bp, Artificial Sequence; identical to SEQ ID NO: 15662
  Description of Artificial Sequence: Synthetic coding sequence

SEQ ID NO: 15667 - DNA, 984 bp, Artificial Sequence
  Description of Artificial Sequence: Synthetic coding sequence
atgtctgacaagctgaaggagaggaaggtgtcccggctgagccccaacggcacctgtgccctggtggtggaggccagtgacagccccaccaggcacctgggcggccccatggccggcaagtgcccccacggcaccctgtctgtggaggagagccgggtgaggacccctgtgagccacaaggtgattgagaagagaagaagagaccgcatcaaccgctgcctgaatgagctgggcaagacagtgcccatggccctggccaagcagggcgagccccaggaggccctggcccagatccgcagccgggtgcgcagcctggtgctgagcagcgccaccgtgcctgaccagcaggccctgggccgctgtgagggccccttcctgctgctgcagagcagcggcaagctggagaaggccgagatcctggagatgacagtgcagtacctgcgggccctgcacagcgctgacttcccccggggccgggagaaggccgagctgctggccgagtttgccaactacttccactacggctaccacgagtgcatgaagaacctggtgcactacctgaccaccgtggagaggatggagaccaaggacaccaagtatgcccgcatcctggccttcctgcagagcaaggcccggctgggcgctgagcccgccttcccccccctgggcagcctgcctgagccagacttctcctaccagctgcaccctgctggccctgagtttgctggccacagccctggagaggccgctgtgttcccccagggcagcggggccggccccttcccctggcccccaggagctgcccggagccctgccctgccctacctgcccagcgcccctgtgcccctggccagccctgcccagcagcacagccccttcctgacccctgtgcagggcctggacagacactacctgaacctgattggccacgcccaccccaatgccctgaacctgcacaccccccagcacccccctgtgctgtag

SEQ ID NO: 15668 - DNA, 726 bp, Artificial Sequence
  Description of Artificial Sequence: Synthetic coding sequence
atgtctgacaagctgaaggagaggaagaggacccctgtgagccacaaggtgattgagaagagaagaagagaccgcatcaaccgctgcctgaatgagctgggcaagacagtgcccatggccctggccaagcagagcagcggcaagctggagaaggccgagatcctggagatgacagtgcagtacctgcgggccctgcacagcgctgacttcccccggggccgggagaaggagctgctggccgagtttgccaactacttccactacggctaccacgagtgcatgaagaacctggtgcactacctgaccaccgtggagaggatggagaccaaggacaccaagtatgcccgcatcctggccttcctgcagagcaaggcccggctgggcgctgagcccgccttcccccccctgggcagcctgcctgagccagacttctcctaccagctgcaccctgctggccctgagtttgctggccacagccctggagaggccgctgtgttcccccagggcagcggggccggccccttcccctggcccccaggagctgcccggagccctgccctgccctacctgcccagcgcccctgtgcccctggccagccctgcccagcagcacagccccttcctgacccctgtgcagggcctggacagacactacctgaacctgattggccacgcccaccccaatgccctgaacctgcacaccccccagcacccccctgtgctgtag

SEQ ID NO: 15669 - DNA, 729 bp, Artificial Sequence
  Description of Artificial Sequence: Synthetic coding sequence
atgtctgacaagctgaaggagaggaagaggacccctgtgagccacaaggtgattgagaagagaagaagagaccgcatcaaccgctgcctgaatgagctgggcaagacagtgcccatggccctggccaagcagagcagcggcaagctggagaaggccgagatcctggagatgacagtgcagtacctgcgggccctgcacagcgctgacttcccccggggccgggagaaggccgagctgctggccgagtttgccaactacttccactacggctaccacgagtgcatgaagaacctggtgcactacctgaccaccgtggagaggatggagaccaaggacaccaagtatgcccgcatcctggccttcctgcagagcaaggcccggctgggcgctgagcccgccttcccccccctgggcagcctgcctgagccagacttctcctaccagctgcaccctgctggccctgagtttgctggccacagccctggagaggccgctgtgttcccccagggcagcggggccggccccttcccctggcccccaggggccgcccggagccctgccctgccctacctgcccagcgcccctgtgcccctggccagccctgcccagcagcacagccccttcctgacccctgtgcagggcctggacagacactacctgaacctgattggacatgcccaccccaatgccctgaacctgcacaccccccagcacccccctgtgctgtag

SEQ ID NO: 15670 - DNA, 2031 bp, Artificial Sequence
  Description of Artificial Sequence: Synthetic coding sequence
atgcctcatgccttcaagccaggggacctggtgtttgccaagatgaagggctacccccactggccagccagaattgatgacattgctgatggagctgtgaagcccccacccaacaagtaccccatcttcttcttcggcacccatgaaacagccttcctgggccccaaggacctcttcccctatgacaagtgcaaggacaagtatggcaagcccaacaagaggaagggcttcaatgaaggcctgtgggagatccagaacaacccccacgccagctacagcgcccctcctcctgtgagcagcagtgacagcgaggcccctgaggccaacccagcagatggcagtgatgctgatgaagatgatgaagatcggggcgtgatggctgtgacagctgtgacagccacagctgccagtgacaggatggagagtgacagcgacagcgacaagagcagtgacaacagcggcctgaagaggaagaccccagccctgaagatgtctgtgtccaagagggccaggaaggccagcagtgacctggaccaggcctctgtgagccccagcgaggaggagaacagcgagagcagcagcgagagcgagaagaccagtgaccaggacttcaccccagagaagaaggctgctgtgcgggccccccggcggggccccctgggcggcaggaagaagaagaaggcccccagcgccagtgacagcgacagcaaggctgacagtgatggagccaagccagagcctgtggccatggcccggagcgccagcagcagcagcagcagcagcagcagcagtgacagtgatgtgtctgtgaagaagccaccccggggcaggaagccagctgagaagcccctgcccaagccccggggcaggaagcccaagccagagaggcctcccagcagcagcagcagtgacagcgacagtgatgaggtggaccgcatcagcgagtggaagagaagagatgaggcccggcggcgggagctggaggccaggagaagaagagagcaggaggaggagctgcggcggctgcgggagcaggagaaggaggagaaggagaggagaagagaaagagctgacagaggagaggccgagcggggcagcggcggcagcagtggagatgagctgcgggaggatgatgagcctgtgaagaagaggggcaggaagggccggggccggggcccccccagcagcagtgacagcgagcctgaggccgagctggagcgggaggccaagaagagcgccaagaagccccagagcagcagcacagagcccgccaggaagccaggccagaaggagaagagggtgcggcctgaggagaagcagcaggccaagcctgtgaaggtggagaggaccaggaagaggtctgagggcttctccatggacaggaaggtggagaagaagaaggagcccagcgtggaggagaagctgcagaagctgcacagcgagatcaagtttgccctgaaggtggacagcccagatgtgaagcgctgcctgaatgccctggaggagctgggcaccctgcaggtgaccagccagatcctgcagaagaacacagatgtggtggccaccctgaagaagatccgccgctacaaggccaacaaggatgtgatggagaaggctgctgaggtgtacacccggctgaagagccgggtgctgggccccaagattgaagctgtgcagaaggtgaacaaggccggcatggagaaggagaaggccgaggagaagctggccggggaggagctggccggggaggagctggccggggaggaggccccccaggagaaggccgaggacaagcccagcacagacctgagcgcccctgtgaatggagaggccaccagccagaagggggagagcgctgaggacaaggagcacgaggagggccgggacagcgaggagggcccccgctgtggcagcagcgaggacctgcatgattctgtgcgggagggccctgacctggacaggcctggcagtgaccggcaggagcgggagcgggcccggggggacagcgaggccctggatgaggagagctag

SEQ ID NO: 15671 - DNA, 1524 bp, Artificial Sequence
  Description of Artificial Sequence: Synthetic coding sequence
atgaagggctacccccactggccagccagaattgatgacattgctgatggagctgtgaagcccccacccaacaagtaccccatcttcttcttcggcacccatgaaacagccttcctgggccccaaggacctcttcccctatgacaagtgcaaggacaagtatggcaagcccaacaagaggaagggcttcaatgaaggcctgtgggagatccagaacaacccccacgccagctacagcgcccctcctcctgtgagcagcagtgacagcgaggcccctgaggccaacccagcagatggcagtgatgctgatgaagatgatgaagatcggggcgtgatggctgtgacagctgtgacagccacagctgccagtgacaggatggagagtgacagcgacagcgacaagagcagtgacaacagcggcctgaagaggaagaccccagccctgaagatgtctgtgtccaagagggccaggaaggccagcagtgacctggaccaggcctctgtgagccccagcgaggaggagaacagcgagagcagcagcgagagcgagaagaccagtgaccaggacttcaccccagagaagaaggctgctgtgcgggccccccggcggggccccctgggcggcaggaagaagaagaaggcccccagcgccagtgacagcgacagcaaggctgacagtgatggagccaagccagagcctgtggccatggcccggagcgccagcagcagcagcagcagcagcagcagcagtgacagtgatgtgtctgtgaagaagccaccccggggcaggaagccagctgagaagcccctgcccaagccccggggcaggaagcccaagccagagaggcctcccagcagcagcagcagtgacagcgacagtgatgaggtggaccgcatcagcgagtggaagagaagagatgaggcccggcggcgggagctggaggccaggagaagaagagagcaggaggaggagctgcggcggctgcgggagcaggagaaggaggagaaggagaggagaagagaaagagctgacagaggagaggccgagcggggcagcggcggcagcagtggagatgagctgcgggaggatgatgagcctgtgaagaagaggggcaggaagggccggggccggggcccccccagcagcagtgacagcgagcctgaggccgagctggagcgggaggccaagaagagcgccaagaagccccagagcagcagcacagagcccgccaggaagccaggccagaaggagaagagggtgcggcctgaggagaagcagcaggccaagctggagtgcaatggagtcatcagcgcccactgcaacctgcggctgcccggcagcagtgacagccctgccagcgccctgcccagctcctgggactaccgccaccccccaccccggctggccaacttctgctgcttcagcagacatggagtgagcagctgctggccaggctggagccgcagcccagaccccgtcatctgccccccccagccccccaaggtgctgggcctgcaggtgtag

SEQ ID NO: 15672 - DNA, 1662 bp, Artificial Sequence
  Description of Artificial Sequence: Synthetic coding sequence
atggccacagacaccagccagggcgagctggtgcaccccaaggccctgcccctgattgtgggcgcccagctgattcatgctgacaagctgggggagaaggtggaggacagcaccatgcccatccggaggacagtgaacagcacccgggagaccccacccaagagcaagctggccgagggggaggaggagaagccagagccagacatcagcagcgaggagagcgtgtccacagtggaggagcaggagaatgagaccccaccagccaccagcagcgaggccgagcagcccaagggggagccagaaaatgaggagaaggaggagaacaagagcagcgaggagaccaagaaggatgagaaggaccagagcaaggagaaggagaagaaggtgaagaagaccatccccagctgggccaccctgagcgccagccagctggcccgggcccagaagcagacccccatggccagcagcccccggcccaagatggatgccatcctgacagaggccatcaaggcctgcttccagaagagcggggcctctgtggtggccatcaggaagtacatcatccacaagtaccccagcctggagctggagcggcggggctacctgctgaagcaggccctgaagcgggagctgaacagaggagtcatcaagcaggtgaagggcaagggggccagcggcagctttgtggtggtgcagaagagcaggaagaccccccagaagagcaggaacaggaagaacagaagcagcgctgtggaccctgagccccaggtgaagctggaggatgtgctgcccctggccttcacccggctgtgtgagcccaaggaggccagctacagcctcatcagaaaatatgtgtcccagtactaccccaagctgcgggtggacatccggccccagctgctgaagaatgccctgcagagagctgtggagcggggccagctggagcagatcaccgggaagggggccagcggcaccttccagctgaagaagtctggagagaagcccctgctgggcggcagcctgatggagtatgccatcctgagcgccatcgccgccatgaatgagcccaagacctgcagcaccacagccctgaagaagtatgtgctggagaaccaccctggcaccaacagcaactaccagatgcacctgctgaagaagaccctgcagaagtgtgagaagaatggctggatggagcagatcagcggcaagggcttcagcggcaccttccagctgtgcttcccctactaccccagccctggggtgctcttccccaagaaggagccagatgacagcagagatgaagatgaagatgaagatgagagcagcgaggaggacagtgaagatgaggagcccccacccaagaggcggctgcagaagaagaccccagccaagagccctgggaaggccgcctctgtgaagcagaggggcagcaagccagcccccaaggtgtctgctgcccagaggggcaaggcccggcccctgcccaagaaggccccacccaaggccaagaccccagccaagaagacccggcccagcagcaccgtcatcaagaagcccagcggcggcagcagcaagaagccagccaccagcgccaggaaggaggtgaagctgcccgggaagggcaagagcaccatgaagaagagcttccgggtgaagaagtag

SEQ ID NO: 15673 - DNA, 402 bp, Artificial Sequence
  Description of Artificial Sequence: Synthetic coding sequence
atggccacagacaccagccagggcgagctggtgcaccccaaggccctgcccctgattgtgggcgcccagctgattcatgctgacaagctgggggagaaggtggaggacagcaccatgcccatccggaggacagtgaacagcacccgggagaccccacccaagagcaagctggccgagggggaggaggagaagccagagccagacatcagcagcgaggagagcgtgtccacagtggaggagcaggagaatgagaccccaccagccaccagcagcgaggccgagcagcccaagggggagccagaaaatgaggagaaggaggagaacaagagcagcgaggagaccaagaaggagagagctgacagcatccacagcaccctcttcatcatcggccagaacagctag

SEQ ID NO: 15674 - DNA, 1206 bp, Artificial Sequence
  Description of Artificial Sequence: Synthetic coding sequence
atggccagcagcccccggcccaagatggatgccatcctgacagaggccatcaaggcctgcttccagaagagcggggcctctgtggtggccatcaggaagtacatcatccacaagtaccccagcctggagctggagcggcggggctacctgctgaagcaggccctgaagcgggagctgaacagaggagtcatcaagcaggtgaagggcaagggggccagcggcagctttgtggtggtgcagaagagcaggaagaccccccagaagagcaggaacaggaagaacagaagcagcgctgtggaccctgagccccaggtgaagctggaggatgtgctgcccctggccttcacccggctgtgtgagcccaaggaggccagctacagcctcatcagaaaatatgtgtcccagtactaccccaagctgcgggtggacatccggccccagctgctgaagaatgccctgcagagagctgtggagcggggccagctggagcagatcaccgggaagggggccagcggcaccttccagctgaagaagtctggagagaagcccctgctgggcggcagcctgatggagtatgccatcctgagcgccatcgccgccatgaatgagcccaagacctgcagcaccacagccctgaagaagtatgtgctggagaaccaccctggcaccaacagcaactaccagatgcacctgctgaagaagaccctgcagaagtgtgagaagaatggctggatggagcagatcagcggcaagggcttcagcggcaccttccagctgtgcttcccctactaccccagccctggggtgctcttccccaagaaggagccagatgacagcagagatgaagatgaagatgaagatgagagcagcgaggaggacagtgaagatgaggagcccccacccaagaggcggctgcagaagaagaccccagccaagagccctgggaaggccgcctctgtgaagcagaggggcagcaagccagcccccaaggtgtctgctgcccagaggggcaaggcccggcccctgcccaagaaggccccacccaaggccaagaccccagccaagaagacccggcccagcagcaccgtcatcaagaagcccagcggcggcagcagcaagaagccagccaccagcgccaggaaggaggtgaagctgcccgggaagggcaagagcaccatgaagaagagcttccgggtgaagaagtag

SEQ ID NO: 15675 - DNA, 1548 bp, Artificial Sequence
  Description of Artificial Sequence: Synthetic coding sequence
atgcccatccggaggacagtgaacagcacccgggagaccccacccaagagcaagctggccgagggggaggaggagaagccagagccagacatcagcagcgaggagagcgtgtccacagtggaggagcaggagaatgagaccccaccagccaccagcagcgaggccgagcagcccaagggggagccagaaaatgaggagaaggaggagaacaagagcagcgaggagaccaagaaggatgagaaggaccagagcaaggagaaggagaagaaggtgaagaagaccatccccagctgggccaccctgagcgccagccagctggcccgggcccagaagcagacccccatggccagcagcccccggcccaagatggatgccatcctgacagaggccatcaaggcctgcttccagaagagcggggcctctgtggtggccatcaggaagtacatcatccacaagtaccccagcctggagctggagcggcggggctacctgctgaagcaggccctgaagcgggagctgaacagaggagtcatcaagcaggtgaagggcaagggggccagcggcagctttgtggtggtgcagaagagcaggaagaccccccagaagagcaggaacaggaagaacagaagcagcgctgtggaccctgagccccaggtgaagctggaggatgtgctgcccctggccttcacccggctgtgtgagcccaaggaggccagctacagcctcatcagaaaatatgtgtcccagtactaccccaagctgcgggtggacatccggccccagctgctgaagaatgccctgcagagagctgtggagcggggccagctggagcagatcaccgggaagggggccagcggcaccttccagctgaagaagtctggagagaagcccctgctgggcggcagcctgatggagtatgccatcctgagcgccatcgccgccatgaatgagcccaagacctgcagcaccacagccctgaagaagtatgtgctggagaaccaccctggcaccaacagcaactaccagatgcacctgctgaagaagaccctgcagaagtgtgagaagaatggctggatggagcagatcagcggcaagggcttcagcggcaccttccagctgtgcttcccctactaccccagccctggggtgctcttccccaagaaggagccagatgacagcagagatgaagatgaagatgaagatgagagcagcgaggaggacagtgaagatgaggagcccccacccaagaggcggctgcagaagaagaccccagccaagagccctgggaaggccgcctctgtgaagcagaggggcagcaagccagcccccaaggtgtctgctgcccagaggggcaaggcccggcccctgcccaagaaggccccacccaaggccaagaccccagccaagaagacccggcccagcagcaccgtcatcaagaagcccagcggcggcagcagcaagaagccagccaccagcgccaggaaggaggtgaagctgcccgggaagggcaagagcaccatgaagaagagcttccgggtgaagaagtag

SEQ ID NO: 15676 - DNA, 231 bp, Artificial Sequence
  Description of Artificial Sequence: Synthetic coding sequence
atggccacagacaccagccagggcgagctggtgcaccccaaggccctgcccctgattgtgggcgcccagctgattcatgctgacaagctgggggagaaggtggaggacagcaccatgcccatccggaggacagtgaacagcacccgggagaccccacccaagagcaagctggccgagggggaggaggagaagccagagccagacatcagcagcgaggagagcgtgtcctag

SEQ ID NO: 15677 - DNA, 375 bp, Artificial Sequence
  Description of Artificial Sequence: Synthetic coding sequence
atggccacagacaccagccagggcgagctggtgcaccccaaggccctgcccctgattgtgggcgcccagctgattcatgctgacaagctgggggagaaggtggaggacagcaccatgcccatccggaggacagtgaacagcacccgggagaccccacccaagagcaagctggccgagggggaggaggagaagccagagccagacatcagcagcgaggagagcgtgtccacagtggaggagcaggagaatgagaccccaccagccaccagcagcgaggccgagcagcccaagggggagccagaaaatgaggagaaggaggagaacaagagcagcgaggagaccaagaaggatgagaaggaccagagcaaggagtag

SEQ ID NO: 15678 - DNA, 123 bp, Artificial Sequence
  Description of Artificial Sequence: Synthetic coding sequence
atgcccatccggaggacagtgaacagcacccgggagaccccacccaagagcaagctggccgagggggaggaggagaagccagagccagacatcagcagcgaggagagcgtgtccacagtgtag

SEQ ID NO: 15679 - DNA, 762 bp, Artificial Sequence
  Description of Artificial Sequence: Synthetic coding sequence
aagaaggatgagaaggaccagagcaaggagaaggagaagaaggtgaagaagaccatccccagctgggccaccctgagcgccagccagctggcccgggcccagaagcagacccccatggccagcagcccccggcccaagatggatgccatcctgacagaggccatcaaggcctgcttccagaagagcggggcctctgtggtggccatcaggaagtacatcatccacaagtaccccagcctggagctggagcggcggggctacctgctgaagcaggccctgaagcgggagctgaacagaggagtcatcaagcagaacagaagcagcgctgtggaccctgagccccaggtgaagctggaggatgtgctgcccctggccttcacccggctgtgtgagcccaaggaggccagctacagcctcatcagaaaatatgtgtcccagtactaccccaagctgcgggtggacatccggccccagctgctgaagaatgccctgcagagagctgtggagcggggccagctggagcagatcactggaaaaggagccagcggcaccttccagctgaagaagagcggggagaagcccctgctgggcggcagcctgatggagtatgccatcctgagcgccatcgccgccatgaatgagcccaagacctgcagcaccacagccctgaagaagtatgtgctggagaaccaccctggcaccaacagcaactaccagatgcacctgctgaagaagaccctgcagaagtgtgagaagaactag

SEQ ID NO: 15680 - DNA, 837 bp, Artificial Sequence
  Description of Artificial Sequence: Synthetic coding sequence
atgcccatccggaggacagtgaacagcacccgggagaccccacccaagagcaagctggccgagggggaggaggagaagccagagccagacatcagcagcgaggagagcgtgtccacagtggaggagcaggagaatgagaccccaccagccaccagcagcgaggccgagcagcccaagggggagccagaaaatgaggagaaggaggagaacaagagcagcgaggagaccaagaaggatgagaaggaccagagcaaggagaaggagaagaaggtgaagaagaccatccccagctgggccaccctgagcgccagccagctggcccgggcccagaagcagacccccatggccagcagcccccggcccaagatggatgccatcctgacagaggccatcaaggcctgcttccagaagagcggggcctctgtggtggccatcaggaagtacatcatccacaagtaccccagcctggagctggagcggcggggctacctgctgaagcaggccctgaagcgggagctgaacagaggagtcatcaagcaggtgaagggcaagggggccagcggcagctttgtggtggtgcagaagagcaggaagaccccccagaagagcaggaacaggaagaacagaagcagcgctgtggaccctgagccccaggtgaagctggaggatgtgctgcccctggccttcacccggctgtgtgagcccaaggaggccagctacagcctcatcagaaaatatgtgtcccagtactaccccaagctgcgggtggacatccggccccagctgctgaagaatgccctgcagagagctgtggagcggggccagctggagcagtag

SEQ ID NO: 15681 - DNA, 138 bp, Artificial Sequence
  Description of Artificial Sequence: Synthetic coding sequence
atgcccatccggaggacagtgaacagcacccgggagaccccacccaagagcaagctggccgagggggaggaggagaagccagagccagacatcagcagcgaggagagcgtgtccacagtggaggagcaggagaactag

SEQ ID NO: 15682 - DNA, 984 bp, Artificial Sequence
  Description of Artificial Sequence: Synthetic coding sequence
atggccacagacaccagccagggcgagctggtgcaccccaaggccctgcccctgattgtgggcgcccagctgattcatgctgacaagctgggggagaaggtggaggacagcaccatgcccatccggaggacagtgaacagcacccgggagaccccacccaagagcaagctggccgagggggaggaggagaagccagagccagacatcagcagcgaggagagcgtgtccacagtggaggagcaggagaatgagaccccaccagccaccagcagcgaggccgagcagcccaagggggagccagaaaatgaggagaaggaggagaacaagagcagcgaggagaccaagaaggatgagaaggaccagagcaaggagaaggagaagaaggtgaagaagaccatccccagctgggccaccctgagcgccagccagctggcccgggcccagaagcagacccccatggccagcagcccccggcccaagatggatgccatcctgacagaggccatcaaggcctgcttccagaagagcggggcctctgtggtggccatcaggaagtacatcatccacaagtaccccagcctggagctggagcggcggggctacctgctgaagcaggccctgaagcgggagctgaacagaggagtcatcaagcaggtgaagggcaagggggccagcggcagctttgtggtggtgcagaagagcaggaagaccccccagaagagcaggaacaggaagaacagaagcagcgctgtggaccctgagccccaggtgaagctggaggatgtgctgcccctggccttcacccggctgtgtgagcccaaggaggccagctacagcctcatcagaaaatatgtgtcccagtactaccccaagctgcgggtggacatccggccccagctgctgaagaatgccctgcagagagctgtggagcggggccagctggagcagatcaccgggaagggggccagcggcaccttccagtag

SEQ ID NO: 15683 - DNA, 60 bp, Artificial Sequence
  Description of Artificial Sequence: Synthetic coding sequence
atgcccatccggaggacagtgaacagcacccgggagaccccacccaagagcaagctgtag

SEQ ID NO: 15684 - DNA, 918 bp, Artificial Sequence
  Description of Artificial Sequence: Synthetic coding sequence
atggagaacagccagctgtgcaagctgttcatcggcggcctgaatgtgcagaccagcgagagcggcctgcggggccactttgaggccttcggcaccctgacagactgtgtggtggtggtgaacccccagaccaagaggagccgctgcttcggctttgtgacctacagcaatgtggaggaggctgatgctgccatggccgccagcccccatgctgtggatggcaacacagtggagctgaagagagctgtgtcccgggaggacagcgcccggcctggggcccacgccaaggtgaagaagctgtttgtgggcggcctgaagggagatgtggccgagggggacctgattgagcacttcagccagtttggaacagtggagaaggccgagatcatcgctgacaagcagagcggcaagaagaggggctttggatttgtgtacttccagaaccatgatgctgctgacaaggctgctgtggtgaagttccaccccatccagggccaccgggtggaggtgaagaaggctgtgcccaaggaggacatctacagcggcggcggcggcggcggcagccgcagcagcagaggaggccggggcggccggggccggggcggcggccgggaccagaatggcctgagcaaaggaggcggcggcggctacaacagctatggaggctatggaggcggcggcggcggcggctacaatgcctacggcggcggcggcggcggcagcagctatggaggcagtgactatggaaatggatttggaggcttcggcagctacagccagcaccagagcagctatggccccatgaagagcggcggcggcggcggcggcggcggcagctcctggggcggccgcagcaacagcggcccctaccggggcggctacggcggcggcggcggctacggcggcagcagcttctag

SEQ ID NO: 15685 - DNA, 1107 bp, Artificial Sequence
  Description of Artificial Sequence: Synthetic coding sequence
atgggcaccccacctggcctgcagacagactgtgaggccctgctgagccgcttccaggagacagattctgtgcgctttgaggacttcacagagctgtggaggaacatgaagtttggcaccatcttctgtggccgcatgaggaacctggagaagaacatgttcaccaaggaggccctggccctggcctggagatacttcctgcccccctacaccttccagatccgggtgggcgccctgtacctgctgtatggcctgtacaacacccagctgtgccagcccaagcagaagatccgggtggccctgaaggactgggatgaggtgctgaagttccagcaggacctggtgaatgcccagcactttgatgctgcctacatcttcaggaagctgcggctggaccgggccttccacttcaccgccatgcccaagctgctgagctacaggatgaagaagaagatccacagagctgaggtgacagaggagttcaaggaccccagcgacagagtgatgaagctgatcaccagtgatgtgctggaggagatgctgaatgtgcatgaccactaccagaacatgaagcacgtgatctctgtggacaagagcaagccagacaaggccctgagcctcatcaaggatgacttctttgacaacatcaagaacatcgtgctggagcaccagcagtggcacaaggacaggaagaaccccagcctgaagagcaagaccaatgatggagaggagaagatggagggcaacagccaggagacagagcgctgtgaaagagctgagagcctggccaagatcaagagcaaggccttctctgtggtgatccaggccagcaagagccgccgccaccggcaggtgaagctggacagcagtgacagcgacagcgccagcggccagggccaggtgaaggccaccaggaagaaggagaagaaggagcggctgaagccagctggcaggaagatgagcctgagaaataaaggaaatgtgcagaacatccacaaggaggacaagcccctgagcctgtccatgcctgtgatcacagaggaggaggagaatgaaagcctgtctggaacagagttcaccgccagcaagaagaggaggaagcactag

SEQ ID NO: 15686 - DNA, 921 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgcctttgtgcagtatgtgaatgaaagaaatgcccgggctgctgtggccggggaggatggccgcatgattgctggccaggtgctggacatcaacctggccgctgagcccaaggtgaacagaggcaaggccggcgtgaagaggtctgctgctgagatgtatggctctgtgacagagcaccccagccccagccccctgctgagcagcagctttgacctggactatgacttccagagggactactatgacaggatgtacagctacccagcccgggtgcccccacctccacccatcgcccgggctgtggtgcccagcaagaggcagagggtgtctggcaacaccagcagaagaggcaagagcggcttcaacagcaagagcggccagaggggcagcagcaagagcggcaagctgaagggagatgacctgcaggccatcaagaaggagctgacccagatcaagcagaaggtggacagcctgctggagaacctggagaagattgagaaggagcagagcaagcaggccgtggagatgaagaatgacaagtctgaggaggagcagagcagcagctctgtgaagaaggatgagaccaacgtgaagatggagagcgagggcggcgcagatgacagcgctgaggagggggacctgctggatgatgatgacaatgaagatagaggagatgaccagctggagctgatcaaggatgatgagaaggaggccgaggagggggaggatgaccgggacagcgccaatggagaagatgacagctag

SEQ ID NO: 15687 - DNA, 309 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaagaaggatgagaccaacgtgaagatggagagcgagggcggcgcagatgacagcgctgaggagggggacctgctggatgatgatgacaatgaagatagaggagatgaccagctggagctgatcaaggatgatgagaaggaggccgaggagggggaggatgaccgggacagcgccaatggagaagatgacagctag

SEQ ID NO: 15688 - DNA, 921 bp, Artificial Sequence; identical to SEQ ID NO: 15686
  Description of Artificial Sequence: Synthetic coding sequence

SEQ ID NO: 15689 - DNA, 882 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgcctttgtgcagtatgtgaatgaaagaaatgcccgggctgctgtggccggggaggatggccgcatgattgctggccaggtgctggacatcaacctggccgctgagcccaaggtgaacagaggcaaggccggcgtgaagaggtctgctgctgagatgtatggcagcagctttgacctggactatgacttccagagggactactatgacaggatgtacagctacccagcccgggtgcccccacctccacccatcgcccgggctgtggtgcccagcaagaggcagagggtgtctggcaacaccagccggcggggcaagagcggcttcaacagcaagagcggccagaggggcagcagcaagagcggcaagctgaagggagatgacctgcaggccatcaagaaggagctgacccagatcaagcagaaggtggacagcctgctggagaacctggagaagattgagaaggagcagagcaagcaggccgtggagatgaagaatgacaagtctgaggaggagcagagcagcagctctgtgaagaaggatgagaccaacgtgaagatggagagcgagggcggcgcagatgattctgctgaggagggggacctgctggatgatgatgacaatgaagatagaggagatgaccagctggagctgatcaaggatgatgagaaggaggccgaggagggagaagatgaccgggacagcgccaacggggaggatgacagctag

SEQ ID NO: 15690 - DNA, 912 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgcctttgtgcagtatgtgaatgaaagaaatgcccgggctgctgtggccggggaggatggccgcatgattgctggccaggtgctggacatcaacctggccgctgagcccaaggtgaacagaggcaaggccggcgtgaagaggtctgctgctgagatgtatggctctgtgacagagcaccccagccccagccccctgctgagcagcagctttgacctggactatgacttccagagggactactatgacaggatgtacagctacccagcccgggtgcccccacctccacccatcgcccgggctgtggtgcccagcaagaggcagagggtgtctggcaacaccagcagaagaggcaagagcggcttcaacagcaagagcggccagaggggcagcagcaagagcggcaagctgaagggagatgacctgcaggccatcaagaaggagctgacccagatcaagcagaaggtggacagcctgctggagaacctggagaagattgagaaggagcagagcaagcaggccgtggagatgaagaatgacaagtctgaggaggagcagagcagcagctctgtgaagaaggatgagaccaacgtgaagatggagagcgagggcggcgcagatgacagcgctgaggagggggacctgctggatgatgatgacaatgaagatagaggagatgaccagctggagctgatcaaggatgatgagaaggaggccgaggagggggaggatgaccgggacagcgccaatggaggatag

SEQ ID NO: 15691 - DNA, 882 bp, Artificial Sequence; identical to SEQ ID NO: 15689
  Description of Artificial Sequence: Synthetic coding sequence

SEQ ID NO: 15692 - DNA, 444 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgcctttgtgcagtatgtgaatgaaagaaatgcccgggctgctgtggccggggaggatggccgcatgattgctggccaggtgctggacatcaacctggccgctgagcccaaggtgaacagaggcaaggccggcgtgaagaggtctgctgctgagatgtatggctctgtgacagagcaccccagccccagccccctgctgtctgtgtaccaggagaccctgcacgagggcgccaaggtggccagcatcctgcgggtggacagcggggacctgcccagcctggagagctag

SEQ ID NO: 15693 - DNA, 882 bp, Artificial Sequence; identical to SEQ ID NO: 15689
  Description of Artificial Sequence: Synthetic coding sequence

SEQ ID NO: 15694 - DNA, 789 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgcctttgtgcagtatgtgaatgaaagaaatgcccgggctgctgtggccggggaggatggccgcatgattgctggccaggtgctggacatcaacctggccgctgagcccaaggtgaacagaggcaaggccggcgtgaagaggtctgctgctgagatgtatggcagcagctttgacctggactatgacttccagagggactactatgacaggatgtacagctacccagcccgggtgcccccacctccacccatcgcccgggctgtggtgcccagcaagaggcagagggtgtctggcaacaccagccggcggggcaagagcggcttcaacagcaagagcggccagaggggcagcagcaagagcggcaagctgaagggagatgacctgcaggccatcaagaaggagctgacccagatcaagcagaaggtggacagcctgctggagaacctggagaagattgagaaggagcagagcaagcaggccgtggagatgaagaatgacaagtctgaggaggagcagagcagcagctctgtgaagaaggatgagaccaacgtgaagatggagagcgagggcggcgcagatgattctgctgaggagggggacctgctggatgatgatgacaatgaagatagatag

SEQ ID NO: 15695 - DNA, 921 bp, Artificial Sequence; identical to SEQ ID NO: 15686
  Description of Artificial Sequence: Synthetic coding sequence

SEQ ID NO: 15696 - DNA, 381 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgcctttgtgcagtatgtgaatgaaagaaatgcccgggctgctgtggccggggaggatggccgcatgattgctggccaggtgctggacatcaacctggccgctgagcccaaggtgaacagaggcaaggccggcgtgaagaggtctgctgctgagatgtatggcagcagctttgacctggactatgacttccagagggactactatgacaggatgtacagctactag

SEQ ID NO: 15697 - DNA, 882 bp, Artificial Sequence; identical to SEQ ID NO: 15689
  Description of Artificial Sequence: Synthetic coding sequence

SEQ ID NO: 15698 - DNA, 528 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgcctttgtgcagtatgtgaatgaaagaaatgcccgggctgctgtggccggggaggatggccgcatgattgctggccaggtgctggacatcaacctggccgctgagcccaaggtgaacagaggcaaggccggcgtgaagaggtctgctgctgagatgtatggctctgtgacagagcaccccagccccagccccctgctgagcagcagctttgacctggactatgacttccagagggactactatgacaggatgtacagctacccagcccgggtgcccccacctccacccatcgcccgggctgtggtgcccagcaagaggcagagggtgtctggcaacaccagcagaagaggcaagagcggcttcaacagctag

SEQ ID NO: 15699 - DNA, 354 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgcctttgtgcagtatgtgaatgaaagaaatgcccgggctgctgtggccggggaggatggccgcatgattgctggccaggtgctggacatcaacctggccgctgagcccaaggtgaacagaggcaaggccggcgtgaagaggtctgctgctgagatgtatggcagcagctttgacctggactatgacttccagaggtag

SEQ ID NO: 15700 - DNA, 564 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgcctttgtgcagtatgtgaatgaaagaaatgcccgggctgctgtggccggggaggatggccgcatgattgctggccaggtgctggacatcaacctggccgctgagcccaaggtgaacagaggcaaggccggcgtgaagaggtctgctgctgagatgtatggctctgtgacagagcaccccagccccagccccctgctgagcagcagctttgacctggactatgacttccagagggactactatgacaggatgtacagctacccagcccgggtgcccccacctccacccatcgcccgggctgtggtgcccagcaagaggcagagggtgtctggcaacaccagcagaagaggcaagagcggcttcaacagcaagagcggccagaggggcagcagcaagagcggcaagtag

SEQ ID NO: 15701 - DNA, 753 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgcctttgtgcagtatgtgaatgaaagaaatgcccgggctgctgtggccggggaggatggccgcatgattgctggccaggtgctggacatcaacctggccgctgagcccaaggtgaacagaggcaaggccggcgtgaagaggtctgctgctgagatgtatggcagcagctttgacctggactatgacttccagagggactactatgacaggatgtacagctacccagcccgggtgcccccacctccacccatcgcccgggccatcaagaaggagctgacccagatcaagcagaaggtggacagcctgctggagaacctggagaagattgagaaggagcagagcaagcaggccgtggagatgaagaatgacaagtctgaggaggagcagagcagcagctctgtgaagaaggatgagaccaacgtgaagatggagagcgagggcggcgcagatgacagcgctgaggagggggacctgctggatgatgatgacaatgaagatagaggagatgaccagctggagctgatcaaggatgatgagaaggaggccgaggagggggaggatgaccgggacagcgccaatggagaagatgacagctag

SEQ ID NO: 15702 - DNA, 366 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgcctttgtgcagtatgtgaatgaaagaaatgcccgggctgctgtggccggggaggatggccgcatgattgctggccaggtgctggacatcaacctggccgctgagcccaaggtgaacagaggcaaggccggcgtgaagaggtctgctgctgagatgtatggcagcagctttgacctggactatgacttccagagggactactatgactag

SEQ ID NO: 15703 - DNA, 681 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaacagcagctttgacctggactatgacttccagagggactactatgacaggatgtacagctacccagcccgggtgcccccacctccacccatcgcccgggctgtggtgcccagcaagaggcagagggtgtctggcaacaccagcagaagaggcaagagcggcttcaacagcaagagcggccagaggggcagcagcaagagcggcaagctgaagggagatgacctgcaggccatcaagaaggagctgacccagatcaagcagaaggtggacagcctgctggagaacctggagaagattgagaaggagcagagcaagcaggccgtggagatgaagaatgacaagtctgaggaggagcagagcagcagctctgtgaagaaggatgagaccaacgtgaagatggagagcgagggcggcgcagatgacagcgctgaggagggggacctgctggatgatgatgacaatgaagatagaggagatgaccagctggagctgatcaaggatgatgagaaggaggccgaggagggggaggatgaccgggacagcgccaatggagaagatgacagctag

SEQ ID NO: 15704 - DNA, 882 bp, Artificial Sequence; identical to SEQ ID NO: 15689
  Description of Artificial Sequence: Synthetic coding sequence

SEQ ID NO: 15705 - DNA, 921 bp, Artificial Sequence; identical to SEQ ID NO: 15686
  Description of Artificial Sequence: Synthetic coding sequence

SEQ ID NO: 15706 - DNA, 201 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgcctttgtgcagtatgtgaatgaaagaaatgcccgggccgcctag

SEQ ID NO: 15707 - DNA, 444 bp, Artificial Sequence; identical to SEQ ID NO: 15692
  Description of Artificial Sequence: Synthetic coding sequence

SEQ ID NO: 15708 - DNA, 165 bp, Artificial Sequence
  Description of Artificial Sequence: Synthetic coding sequence
atggccagcaatgtgaccaacaagacagaccccaggtccatgaacagcagggtcttcatcggcaacctgaacaccctggtggtgaagaagagtgatgtggaggccatcttcagcaaatatggcaagatcgtgggctgcagcgtgcacaagggctttgccttctag

SEQ ID NO: 15709 - DNA, 882 bp, Artificial Sequence
  Description of Artificial Sequence: Synthetic coding sequence
atggccagcaatgtgaccaacaagatggacccccacagcatgaacagcagggtcttcatcggcaacctgaacaccctggtggtgaagaagagtgatgtggaggccatcttcagcaaatatggcaagattgctggctgcagcgtgcacaagggctttgcctttgtgcagtatgacaaggagaagaatgcccgggctgctgtggccggggaggatggccgcatgattgccagccaggtggtggacatcaacctggccgctgagcccaaggtgaacagaggaaatgccggcgtgaagaggtctgctgctgagatgtatggcagcagctttgacctggactatggcttccagagggactactatgatggcatgtacagcttccctgcccgggtgcccccacctccacccatcgccctggccgtggtgcccagcaagaggcagaggctgagcggcaacaccagccggcggggcaagagcggcttcaacagcaagagcggcaagaggggcagcagcaagagcggcaagctgaagggagatgacctgcaggccatcaagcaggagctgacccagatcaagcagaaggtggacagcctgctggagaacctggagaagattgagaaggagcagagcaagcaggaggtggaggtgaagaatgccaagtctgaggaggagcagagcagcagctccatgaagaaggatgagacccacgtgaagatggagagcgagggcggcgcagaagattctgctgaggagggggaccccctggatgatgatgtgaatgaagaccagggagatgaccagctggagctgatcaaggatgatgagaaggaggccgaggagggagaagatgaccgggacagcaccaacggccaggatgacagctag

SEQ ID NO: 15710 - DNA, 1041 bp, Artificial Sequence
  Description of Artificial Sequence: Synthetic coding sequence
atggactgggtgatgaagcacaacggccccaatgatgccagtgatggcaccgtgcggctgcggggcctgcccttcggctgcagcaaggaggagatcgtgcagttcttccagggcctggagatcgtgcccaacggcatcaccctgaccatggactaccagggccgcagcactggagaggcctttgtgcagtttgccagcaaggagattgctgaaaatgccctgggcaagcacaaggagagaattggccaccgctacatcgagatcttccgcagcagccgctctgagatcaagggcttctatgaccccccccggcggctgctgggccagaggcctggcccctatgaccggcccatcggcggccggggcggctactatggagctggccggggctccatgtatgacaggatgagaagaggaggagatggctatgatggcggctatggaggctttgatgattatggaggctacaacaactacggctatggaaatgatggctttgatgacaggatgagagatggccggggcatgggcggccacggctatggaggagctggagatgccagcagcggcttccacggcggccactttgtgcacatgaggggcctgcccttccgggccacagaaaatgacatcgccaacttcttcagccccctgaaccccatccgggtgcacattgatattggagcagatggccgggccaccggggaggctgatgtggagtttgtgacccatgaagatgctgtggccgccatgagcaaggacaagaacaacatgcagcaccgctacatcgagctgttcctgaacagcaccccaggcggcggcagcggcatgggcggcagcggcatgggcggctacggcagagatggcatggacaaccagggcggctacggctctgtgggccgcatgggcatgggcaacaactacagcggcggctacggcaccccagatggcctgggcggctacggccggggcggcggcggcagcggcggctactacggccagggcggcatgtctgggggcggctggaggggcatgtactag

SEQ ID NO: 15711 - DNA, 996 bp, Artificial Sequence
  Description of Artificial Sequence: Synthetic coding sequence
atggactgggtgatgaagcacaacggccccaatgatgccagtgatggcaccgtgcggctgcggggcctgcccttcggctgcagcaaggaggagatcgtgcagttcttccagggcctggagatcgtgcccaacggcatcaccctgaccatggactaccagggccgcagcactggagaggcctttgtgcagtttgccagcaaggagattgctgaaaatgccctgggcaagcacaaggagagaattggccaccgctacatcgagatcttccgcagcagccgctctgagatcaagggcttctatgaccccccccggcggctgctgggccagaggcctggcccctatgaccggcccatcggcggccggggcggctactatggagctggccggggcagctatggaggctttgatgattatggaggctacaacaactacggctatggaaatgatggctttgatgacaggatgagagatggccggggcatgggcggccacggctacggcggcgctggagatgccagcagcggcttccatggaggccactttgtgcacatgaggggcctgcccttccgggccacagaaaatgacatcgccaacttcttcagccccctgaaccccatccgggtgcacatcgacatcggggctgatggccgggccactggagaggctgatgtggagtttgtgacccatgaagatgctgtggccgccatgagcaaggacaagaacaacatgcagcaccgctacatcgagctgttcctgaacagcacccctgggggcggcagcggcatgggcggcagcggcatgggcggctacggcagagatggcatggacaaccagggcggctacggctctgtgggccgcatgggcatgggcaacaactacagcggcggctacggcaccccagatggcctgggcggctacggccggggcggcggcggcagcggcggctactacggccagggcggcatgtctgggggcggctggaggggcatgtactag

SEQ ID NO: 15712 - DNA, 717 bp, Artificial Sequence
  Description of Artificial Sequence: Synthetic coding sequence
atggactgggtgatgaagcacaacggccccaatgatgccagtgatggcaccgtgcggctgcggggcctgcccttcggctgcagcaaggaggagatcgtgcagttcttccagggctatggaggctttgatgattatggaggctacaacaactacggctatggaaatgatggctttgatgacaggatgagagatggccggggcatgggcggccacggctatggaggagctggagatgccagcagcggcttccacggcggccactttgtgcacatgaggggcctgcccttccgggccacagaaaatgacatcgccaacttcttcagccccctgaaccccatccgggtgcacattgatattggagcagatggccgggccaccggggaggctgatgtggagtttgtgacccatgaagatgctgtggccgccatgagcaaggacaagaacaacatgcagcaccgctacatcgagctgttcctgaacagcaccccaggcggcggcagcggcatgggcggcagcggcatgggcggctacggcagagatggcatggacaaccagggcggctacggctctgtgggccgcatgggcatgggcaacaactacagcggcggctacggcaccccagatggcctgggcggctacggccggggcggcggcggcagcggcggctactacggccagggcggcatgtctgggggcggctggaggggcatgtactag

SEQ ID NO: 15713 - DNA, 1392 bp, Artificial Sequence
  Description of Artificial Sequence: Synthetic coding sequence
atggagacagagcagcctgaggagaccttccccaacacagagaccaacggggagtttgggaagaggcctgctgaggacatggaggaggagcaggccttcaagaggagcaggaacacagatgagatggtggagctgcgcatcctgctgcagagcaagaatgctggggccgtcatcggcaagggcggcaagaacatcaaggccctgaggacagactacaatgcctctgtgtctgtgcctgacagcagcggccctgagcgcatcctgagcatctctgctgacatcgagaccatcggggagatcctgaagaagatcatccccaccctggaggagggcctgcagctgcccagccccacagccaccagccagctgcccctggagagtgatgctgtggagtgcctgaactaccagcactacaagggcagtgactttgactgtgagctgcggctgctgatccaccagagcctggccggcggcatcatcggcgtgaagggggccaagatcaaggagctgcgggagaacacccagaccaccatcaagctgttccaggagtgctgcccccacagcacagacagagtggtgctgattggaggcaagccagacagagtggtggagtgcatcaagatcatcctggacctgatcagcgagagccccatcaagggccgggcccagccctatgaccccaacttctatgatgagacctatgactatggaggcttcaccatgatgtttgatgaccggcggggccggcctgtgggcttccccatgaggggccggggcggctttgacaggatgcctcctggccggggcggccggcccatgccacccagcagaagagattatgatgacatgagcccccggcggggccccccacctcctcctcctggccggggcggccggggcggcagccgggccaggaacctgcccctgcccccacctcctccaccccggggcggggacctgatggcctatgacagaagaggccggcctggggacagatatgatggcatggtgggcttcagcgcagatgagacctgggacagcgccatcgacacctggagccccagcgagtggcagatggcctatgagccccagggcggcagcggctatgactacagctatgctgggggccggggcagctatggagacctgggcggccccatcatcaccacccaggtgaccatccccaaggacctggccggcagcatcattggaaaaggaggccagaggatcaagcagatcagacatgaaagtggggccagcatcaagattgatgagcccctggagggctctgaagatcgcatcatcaccatcaccggcacccaggaccagatccagaatgcccagtacctgctgcagaacagcgtgaagcagtacagcggcaagttcttctag

SEQ ID NO: 15714 - DNA, 1392 bp, Artificial Sequence; identical to SEQ ID NO: 15713
  Description of Artificial Sequence: Synthetic coding sequence

SEQ ID NO: 15715 - DNA, 921 bp, Artificial Sequence
  Description of Artificial Sequence: Synthetic coding sequence
atgcagtacaatgcctctgtgtctgtgcctgacagcagcggccctgagcgcatcctgagcatctctgctgacatcgagaccatcggggagatcctgaagaagatcatccccaccctggaggagggcctgcagctgcccagccccacagccaccagccagctgcccctggagagtgatgctgtggagtgcctgaactaccagcactacaagggcagtgactttgactgtgagctgcggctgctgatccaccagagcctggccggcggcatcattggagtgaagggggccaagatcaaggagctgcgggagaacacccagaccaccatcaagctgttccaggagtgctgcccccacagcacagacagagtggtgctgattggaggcaagccagacagagtggtggagtgcatcaagatcatcctggacctgatcagcgagagccccatcaagggccgggcccagccctatgaccccaacttctatgatgagacctatgactatggaggcttcaccatgatgtttgatgacagaagaggccggcctgtgggcttccccatgaggggccggggcggctttgacaggatgcctcctggccggggcggccggcccatgccacccagccggcgggactatgatgacatgagcccccggcggggccccccacctcctcctcctggccggggcggccggggcggcagccgggccaggaacctgcccctgcccccacctcctccaccccggggcggggacctgatggcctatgaccggcggggccggcctggggacagatatgatggcatggtgggcttcagcgcagatgagacctgggacagcgccatcgacacctggagccccagcgagtggcagatggcctatgagccccaggtggagtaccacagctgcagctgtgtgtaccagtag

SEQ ID NO: 15716 - DNA, 1380 bp, Artificial Sequence
  Description of Artificial Sequence: Synthetic coding sequence
atggagacagagcagcctgaggagaccttccccaacacagagaccaacggggagtttgggaagaggcctgctgaggacatggaggaggagcaggccttcaagaggagcaggaacacagatgagatggtggagctgcgcatcctgctgcagagcaagaatgctggggccgtcatcggcaagggcggcaagaacatcaaggccctgaggacagactactacctggtgtttgtggtgtttgacagcatcctgagcatctctgctgacatcgagaccatcggggagatcctgaagaagatcatccccaccctggaggagggcctgcagctgcccagccccacagccaccagccagctgcccctggagagtgatgctgtggagtgcctgaactaccagcactacaagggcagtgactttgactgtgagctgcggctgctgatccaccagagcctggccggcggcatcattggagtgaagggggccaagatcaaggagctgcgggagaacacccagaccaccatcaagctgttccaggagtgctgcccccacagcacagacagagtggtgctgattggaggcaagccagacagagtggtggagtgcatcaagatcatcctggacctgatcagcgagagccccatcaagggccgggcccagccctatgaccccaacttctatgatgagacctatgactatggaggcttcaccatgatgtttgatgacagaagaggccggcctgtgggcttccccatgaggggccggggcggctttgacaggatgcctcctggccggggcggccggcccatgccacccagccggcgggactatgatgacatgagcccccggcggggccccccacctcctcctcctggccggggcggccggggcggcagccgggccaggaacctgcccctgcccccacctcctccaccccggggcggggacctgatggcctatgaccggcggggccggcctggggacagatatgatggcatggtgggcttcagcgcagatgagacctgggacagcgccatcgacacctggagccccagcgagtggcagatggcctatgagccccagggcggcagcggctatgactacagctatgccggcggccggggcagctatggagacctgggcggccccatcatcaccacccaggtgaccatccccaaggacctggccggcagcatcatcggcaagggcggccagaggatcaagcagatcagacatgagagcggggccagcatcaagattgatgagcccctggagggcagcgaggaccgcatcatcaccatcaccggcacccaggaccagatccagaatgcccagtacctgctgcagaacagcgtgaagcagtatgcagatgtggagggcttctag

SEQ ID NO: 15717 - DNA, 1395 bp, Artificial Sequence
  Description of Artificial Sequence: Synthetic coding sequence
atggagacagagcagcctgaggagaccttccccaacacagagaccaacggggagtttgggaagaggcctgctgaggacatggaggaggagcaggccttcaagaggagcaggaacacagatgagatggtggagctgcgcatcctgctgcagagcaagaatgctggggccgtcatcggcaagggcggcaagaacatcaaggccctgaggacagactacaatgcctctgtgtctgtgcctgacagcagcggccctgagcgcatcctgagcatctctgctgacatcgagaccatcggggagatcctgaagaagatcatccccaccctggaggagggcctgcagctgcccagccccacagccaccagccagctgcccctggagagtgatgctgtggagtgcctgaactaccagcactacaagggcagtgactttgactgtgagctgcggctgctgatccaccagagcctggccggcggcatcatcggcgtgaagggggccaagatcaaggagctgcgggagaacacccagaccaccatcaagctgttccaggagtgctgcccccacagcacagacagagtggtgctgattggaggcaagccagacagagtggtggagtgcatcaagatcatcctggacctgatcagcgagagccccatcaagggccgggcccagccctatgaccccaacttctatgatgagacctatgactatggaggcttcaccatgatgtttgatgaccggcggggccggcctgtgggcttccccatgaggggccggggcggctttgacaggatgcctcctggccggggcggccggcccatgccacccagcagaagagattatgatgacatgagcccccggcggggccccccacctcctcctcctggccggggcggccggggcggcagccgggccaggaacctgcccctgcccccacctcctccaccccggggcggggacctgatggcctatgacagaagaggccggcctggggacagatatgatggcatggtgggcttcagcgcagatgagacctgggacagcgccatcgacacctggagccccagcgagtggcagatggcctatgagccccagggcggcagcggctatgactacagctatgctgggggccggggcagctatggagacctgggcggccccatcatcaccacccaggtgaccatccccaaggacctggccggcagcatcattggaaaaggaggccagaggatcaagcagatcagacatgaaagtggggccagcatcaagattgatgagcccctggagggctctgaagatcgcatcatcaccatcaccggcacccaggaccagatccagaatgcccagtacctgctgcagaacagcgtgaagcagtatgcagatgtggagggcttctag

SEQ ID NO: 15718 - DNA, 1392 bp, Artificial Sequence; identical to SEQ ID NO: 15713
  Description of Artificial Sequence: Synthetic coding sequence

SEQ ID NO: 15719 - DNA, 1395 bp, Artificial Sequence; identical to SEQ ID NO: 15717
  Description of Artificial Sequence: Synthetic coding sequence

SEQ ID NO: 15720 - DNA, 1395 bp, Artificial Sequence; identical to SEQ ID NO: 15717
  Description of Artificial Sequence: Synthetic coding sequence

SEQ ID NO: 15721 - DNA, 1287 bp, Artificial Sequence
  Description of Artificial Sequence: Synthetic coding sequence
atggagacagagcagcctgaggagaccttccccaacacagagaccaacggggagtttgggaagaggcctgctgaggacatggaggaggagcaggccttcaagaggagcaggaacacagatgagatggtggagctgcgcatcctgctgcagagcaagaacatcaaggccctgaggacagactacaatgcctctgtgtctgtgcctgacagcagcggccctgagcgcatcctgagcatctctgctgacatcgagaccatcggggagatcctgaagaagatcatccccaccctggaggagtaccagcactacaagggcagtgactttgactgtgagctgcggctgctgatccaccagagcctggccggcggcatcattggagtgaagggggccaagatcaaggagctgcgggagaacacccagaccaccatcaagctgttccaggagtgctgcccccacagcacagacagagtggtgctgattggaggcaagccagacagagtggtggagtgcatcaagatcatcctggacctgatcagcgagagccccatcaagggccgggcccagccctatgaccccaacttctatgatgagacctatgactatggaggcttcaccatgatgtttgatgacagaagaggccggcctgtgggcttccccatgaggggccggggcggctttgacaggatgcctcctggccggggcggccggcccatgccacccagccggcgggactatgatgacatgagcccccggcggggccccccacctcctcctcctggccggggcggccggggcggcagccgggccaggaacctgcccctgcccccacctcctccaccccggggcggggacctgatggcctatgaccggcggggccggcctggggacagatatgatggcatggtgggcttcagcgcagatgagacctgggacagcgccatcgacacctggagccccagcgagtggcagatggcctatgagccccagggcggcagcggctatgactacagctatgccggcggccggggcagctatggagacctgggcggccccatcatcaccacccaggtgaccatccccaaggacctggccggcagcatcatcggcaagggcggccagaggatcaagcagatcagacatgagagcggggccagcatcaagattgatgagcccctggagggcagcgaggaccgcatcatcaccatcaccggcacccaggaccagatccagaatgcccagtacctgctgcagaacagcgtgaagcagtacagcggcaagttcttctag

SEQ ID NO: 15722 - DNA, 1140 bp, Artificial Sequence
  Description of Artificial Sequence: Synthetic coding sequence
atggagacagagcagcctgaggagaccttccccaacacagagaccaacggggagtttgggaagaggcctgctgaggacatggaggaggagcaggccttcaagaggagcaggaacacagatgagatggtggagctgcgcatcctgctgcagagcaagaatgctggggccgtcatcggcaagggcggcaagaacatcaaggccctgaggacagactacaatgcctctgtgtctgtgcctgacagcagcggccctgagcgcatcctgagcatctctgctgacatcgagaccatcggggagatcctgaagaagatcatccccaccctggaggagtaccagcactacaagggcagtgactttgactgtgagctgcggctgctgatccaccagagcctggccggcggcatcatcggcgtgaagggggccaagatcaaggagctgcgggagaacacccagaccaccatcaagctgttccaggagtgctgcccccacagcacagacagagtggtgctgattggaggcaagccagacagagtggtggagtgcatcaagatcatcctggacctgatcagcgagagccccatcaagggccgggcccagccctatgaccccaacttctatgatgagacctatgactatggaggcttcaccatgatgtttgatgaccggcggggccggcctgtgggcttccccatgaggggccggggcggctttgacaggatgcctcctggccggggcggccggcccatgccacccagcagaagagattatgatgacatgagcccccggcggggccccccacctcctcctcctggccggggcggccggggcggcagccgggccaggaacctgcccctgcccccacctcctccaccccggggcggggacctgatggcctatgacagaagaggccggcctggggacagatatgatggcatggtgggcttcagcgcagatgagacctgggacagcgccatcgacacctggagccccagcgagtggcagatggcctatgagccccagggcggcagcggctatgactacagctatgctgggggccggggcagctatggagacctgggcggccccatcatcaccacccaggtgaccatccccaaggacctggccggcagcatcatctag

SEQ ID NO: 15723 - DNA, 987 bp, Artificial Sequence
  Description of Artificial Sequence: Synthetic coding sequence
atggctgctggcatcgtggccagccggcggctgcgggacctgctgacccggcggctgaccggcagcaactacccaggcctgagcatcagcctgcggctgaccggcagcagcgcccaggaggaggccagcggcgtggccctgggggaggccccagaccacagctatgagagcctgcgggtgaccagcgcccagaagcacgtgctgcacgtgcagctgaaccggcccaacaagagaaatgccatgaacaaggtgttctggagggagatggtggagtgcttcaacaagatcagcagagatgctgactgcagagctgtggtgatcagcggggccggcaagatgttcaccgctggcatcgacctgatggacatggccagtgacatcctgcagcccaagggagatgatgtggcccgcatctcctggtacctgcgggacatcatcacccgctaccaggagaccttcaacgtcatcgagcgctgccccaagcctgtgattgctgctgtgcacggcggctgcatcggcggcggcgtggacctggtgacagcctgtgacatccgctactgtgcccaggatgccttcttccaggtgaaggaggtggatgtgggcctggccgcagatgtgggcaccctgcagaggctgcccaaggtgattggcaaccagagcctggtgaatgagctggccttcaccgccaggaagatgatggctgatgaggccctgggcagcggcctggtgtccagggtcttcccagacaaggaggtgatgctggatgctgccctggccctggccgctgagatcagcagcaagagccctgtggccgtgcagagcaccaaggtgaacctgctgtacagccgggaccacagcgtggccgagagcctgaactacgtggcctcctggaacatgtccatgctgcagacccaggacctggtgaagtctgtgcaggccaccacagagaacaaggagctgaagacagtgaccttcagcaagctgtag

SEQ ID NO: 15724 - DNA, 1371 bp, Artificial Sequence
  Description of Artificial Sequence: Synthetic coding sequence
atgcccaagaagaggcaggccctggtggagtttgaagatgtgctgggcgcctgcaatgctgtgaactatgctgctgacaaccagatctacatcgccggccacccagcctttgtgaactacagcaccagccagaagatcagcaggcctggggacagtgatgacagccgctctgtgaacagcgtgctgctcttcaccatcctgaaccccatctacagcatcaccacagatgtgctgtacaccatctgcaacccctgtggccctgtgcagagaattgtcatcttcaggaagaatggagtgcaggccatggtggagtttgattctgtgcagagcgcccagagggccaaggccagcctgaatggagctgacatctacagcggctgctgcaccctgaagattgaatatgccaagcccacccggctgaatgtgttcaagaatgaccaggacacctgggactacaccaaccccaacctgagcggccagggcgaccccggcagcaaccccaacaagaggcagaggcagccccccctgctgggggaccacccagcagaatatggaggcccccacggcggctaccacagccactaccatgatgagggctacggccccccaccaccccactatgagggccgcaggatgggcccccctgtgggcggccaccggcggggccccagccgctatggcccccagtatggccaccccccacctcctcctcctcctccagaatatggcccccacgccgacagccctgtgctgatggtgtatggcctggaccagagcaagatgaactgtgacagagtcttcaacgtgttctgcctgtatggaaatgtggagaaggtgaagttcatgaagagcaagccaggggccgccatggtggagatggctgatggctatgctgtggaccgggccatcacccacctgaacaacaacttcatgtttggccagaagctgaatgtgtgtgtgtccaagcagcctgccatcatgcctggccagagctatggcctggaggatggcagctgcagctacaaggacttcagcgagagcaggaacaaccgcttcagcaccccagagcaggccgccaagaaccgcatccagcaccccagcaatgtgctgcacttcttcaatgcccccctggaggtgacagaggagaacttctttgagatctgtgatgagctgggcgtgaagaggcccagctctgtgaaggtgttttctgggaagtctgagaggagcagcagcggcctgctggagtgggagagcaagagtgatgccctggagaccctgggcttcctgaaccactaccagatgaagaaccccaacggcccctacccctacaccctgaagctgtgcttcagcacagcccagcacgccagctag

SEQ ID NO: 15725 - DNA, 1371 bp, Artificial Sequence; identical to SEQ ID NO: 15724
  Description of Artificial Sequence: Synthetic coding sequence

SEQ ID NO: 15726 - DNA, 540 bp, Artificial Sequence
  Description of Artificial Sequence: Synthetic coding sequence
atgcccaagaagaggcaggccctggtggagtttgaagatgtgctgggcgcctgcaatgctgtgaactatgctgctgacaaccagatctacatcgccggccacccagcctttgtgaactacagcaccagccagaagatcagcaggcctggggacagtgatgacagccgctctgtgaacagcgtgctgctcttcaccatcctgaaccccatctacagcatcaccacagatgtgctgtacaccatctgcaacccctgtggccctgtgcagagaattgtcatcttcaggaagaatggagtgcaggccatggtggagtttgattctgtgcagagcgcccagagggccaaggccagcctgaatggagctgacatctacagcggctgctgcaccctgaagattgaatatgccaagcccacccggctgaatgtgttcaagaatgaccaggacacctgggactacaccaaccccaacctgagcggccagggcagccagtgcatgtttgatggcacccccagcttcagaacagtgctgacccactgctag

SEQ ID NO: 15727 - DNA, 723 bp, Artificial Sequence
  Description of Artificial Sequence: Synthetic coding sequence
atggtgaagatggctgctgctgggggcggcggcggcggcggccgctactatggaggcggcagcgagggcggccgggccccagccagccctgtggtgcacatccggggcctgattgatggagtggtggaggccgacctggtggaggccctgcaggagtttggccccatctcctatgtggtggtgatgcccaagaagaggcaggccctggtggagtttgaagatgtgctgggcgcctgcaatgctgtgaactatgctgctgacaaccagatctacatcgccggccacccagcctttgtgaactacagcaccagccagaagatcagcaggcctggggacagtgatgacagccgctctgtgaacagcgtgctgctcttcaccatcctgaaccccatctacagcatcaccacagatgtgctgtacaccatctgcaacccctgtggccctgtgcagagaattgtcatcttcaggaagaatggagtgcaggccatggtggagtttgacagcgtgcagagcgcccagagggccaaggccagcctgaatggagctgacatctacagcggctgctgcaccctgaagattgaatatgccaagcccacccggctgaatgtgttcaagaatgaccaggacacctgggactacaccaaccccaacctgagcggccagggcagccagtgcatgtttgatggcacccccagcttcagaacagtgctgacccactgctag

SEQ ID NO: 15728 - DNA, 849 bp, Artificial Sequence
  Description of Artificial Sequence: Synthetic coding sequence
atgagcagcagcagcagcagcccccgggagacctatgaggaggaccgggagtatgagagccaggccaagaggctgaagacagaggagggggagattgactacagcgctgaggagggggagaacagaagagaggccaccccccggggcggcggagatggcggcggcggcggccgctccttcagccagcctgaggccggcggcagccaccacaaggtgtctgtgtcccctgtggtgcacgtgcggggcctgtgtgagagcgtggtggaggccgacctggtggaggccctggagaagtttggcaccatctgctacgtgatgatgatgcccttcaagaggcaggccctggtggagtttgaaaatattgattctgccaaggaatgtgtgacctttgctgctgatgagcctgtgtacatcgccggccagcaggccttcttcaactacagcaccagcaagaggatcacccggcccggcaacacagatgaccccagcggcggcaacaaggtgctgctgctgagcatccagaaccccctgtaccccatcaccgtggatgtgctgtacacagtgtgcaaccctgtgggcaaggtgcagagaattgtcatcttcaagagaaatggcatccaggccatgctgatgtttgagagcgtgctgtgtgcccagaaggccaaggccgccctgaatggagctgacatctatgccggctgctgcaccctgaagattgaatatgcccggcccacccggctgaatgtcatcagaaatgacaatgacagctgggactacaccaagccctacctgggccggcggggctgctgctggctgatgctgaagctgctggagaggagccccctgtag

SEQ ID NO: 15729 - DNA, 1527 bp, Artificial Sequence
  Description of Artificial Sequence: Synthetic coding sequence
atgagcagcagcagcagcagcccccgggagacctatgaggaggaccgggagtatgagagccaggccaagaggctgaagacagaggagggggagattgactacagcgctgaggagggggagaacagaagagaggccaccccccggggcggcggagatggcggcggcggcggccgctccttcagccagcctgaggccggcggcagccaccacaaggtgtctgtgtcccctgtggtgcacgtgcggggcctgtgtgagagcgtggtggaggccgacctggtggaggccctggagaagtttggcaccatctgctacgtgatgatgatgcccttcaagaggcaggccctggtggagtttgaaaatattgattctgccaaggaatgtgtgacctttgctgctgatgagcctgtgtacatcgccggccagcaggccttcttcaactacagcaccagcaagaggatcacccggcccggcaacacagatgaccccagcggcggcaacaaggtgctgctgctgagcatccagaaccccctgtaccccatcaccgtggatgtgctgtacacagtgtgcaaccctgtgggcaaggtgcagagaattgtcatcttcaagagaaatggcatccaggccatgcccacccggctgaatgtcatcagaaatgacaatgacagctgggactacaccaagccctacctgggccggcgggaccggggcaagggccggcagaggcaggccatcctgggggagcaccccagcagcttcagacatgatggctacggcagccacggccccctgctgcccctgcccagccgctacaggatgggcagccgggacaccccagagctggtggcctaccccctgccccaggccagcagcagctacatgcacggcggcaaccccagcggctctgtggtgatggtgtctggcctgcaccagctgaagatgaactgcagcagggtcttcaacctcttctgcctgtatggcaacatcgagaaggtgaagttcatgaagaccatccctggaacagccctggtggagatgggagatgaatatgctgtggagagagctgtgacccacctgaacaacgtgaagctgtttgggaagaggctgaatgtgtgtgtgtccaagcagcacagcgtggtgcccagccagatctttgagctggaggatggcaccagcagctacaaggactttgccatgagcaagaacaaccgcttcaccagcgctggccaggccagcaagaacatcatccagccccccagctgtgtgctgcactactacaacgtgcccctgtgtgtgacagaggagaccttcaccaagctgtgcaatgaccacgaggtgctgaccttcatcaagtacaaggtgtttgatgccaagcccagcgccaagaccctgagcggcctgctggagtgggagtgcaagacagatgctgtggaggccctgacagccctgaaccactaccagatccgggtgcccaacggcagcaacccctacaccctgaagctgtgcttcagcaccagcagccacctgtag

SEQ ID NO: 15730 - DNA, 1527 bp, Artificial Sequence
  Description of Artificial Sequence: Synthetic coding sequence
atgagcagcagcagcagcagcccccgggagacctatgaggaggaccgggagtatgagagccaggccaagaggctgaagacagaggagggggagattgactacagcgctgaggagggggagaacagaagagaggccaccccccggggcggcggagatggcggcggcggcggccgctccttcagccagcctgaggccggcggcagccaccacaaggtgtctgtgtcccctgtggtgcacgtgcggggcctgtgtgagagcgtggtggaggccgacctggtggaggccctggagaagtttggcaccatctgctacgtgatgatgatgcccttcaagaggcaggccctggtggagtttgaaaatattgattctgccaaggaatgtgtgacctttgctgctgatgagcctgtgtacatcgccggccagcaggccttcttcaactacagcaccagcaagaggatcacccggcccggcaacacagatgaccccagcggcggcaacaaggtgctgctgctgagcatccagaaccccctgtaccccatcaccgtggatgtgctgtacacagtgtgcaaccctgtgggcaaggtgcagagaattgtcatcttcaagagaaatggcatccaggccatggtggaccggctgaatgtcatcagaaatgacaatgacagctgggactacaccaagccctacctgggccggcgggaccggggcaagggccggcagaggcaggccatcctgggggagcaccccagcagcttcagacatgatggctacggcagccacggccccctgctgcccctgcccagccgctacaggatgggcagccgggacaccccagagctggtggcctaccccctgccccaggccagcagcagctacatgcacggcggcaaccccagcggctctgtggtgatggtgtctggcctgcaccagctgaagatgaactgcagcagggtcttcaacctcttctgcctgtatggcaacatcgagaaggtgaagttcatgaagaccatccctggaacagccctggtggagatgggagatgaatatgctgtggagagagctgtgacccacctgaacaacgtgaagctgtttgggaagaggctgaatgtgtgtgtgtccaagcagcacagcgtggtgcccagccagatctttgagctggaggatggcaccagcagctacaaggactttgccatgagcaagaacaaccgcttcaccagcgctggccaggccagcaagaacatcatccagccccccagctgtgtgctgcactactacaacgtgcccctgtgtgtgacagaggagaccttcaccaagctgtgcaatgaccacgaggtgctgaccttcatcaagtacaaggtgtttgatgccaagcccagcgccaagaccctgagcggcctgctggagtgggagtgcaagacagatgctgtggaggccctgacagccctgaaccactaccagatccgggtgcccaacggcagcaacccctacaccctgaagctgtgcttcagcaccagcagccacctgtag

SEQ ID NO: 15731 - DNA, 1614 bp, Artificial Sequence
  Description of Artificial Sequence: Synthetic coding sequence
atgctggcccgggagacctatgaagaagatcgggagtatgagagccaggccaagaggctgaagacagaggagggggagattgactacagcgctgaggagggagaaaatagaagagaggccaccccccggggcggcggagatggcggcggcggcggccgctccttcagccagcctgaggccggcggcagccaccacaaggtgtctgtgtcccctgtggtgcacgtgcggggcctgtgtgagagcgtggtggaggccgacctggtggaggccctggagaagtttggcaccatctgctacgtgatgatgatgcccttcaagaggcaggccctggtggagtttgagaacatcgacagcgccaaggaatgtgtgacctttgctgctgatgagcctgtgtacatcgccggccagcaggccttcttcaactacagcaccagcaagaggatcaccaggcctggcaacacagatgaccccagcggcggcaacaaggtgctgctgctgagcatccagaaccccctgtaccccatcaccgtggatgtgctgtacacagtgtgcaaccctgtgggcaaggtgcagagaattgtcatcttcaagagaaatggcatccaggccatggtggagtttgaatctgtgctgtgtgcccagaaggccaaggccgccctgaatggagctgacatctatgccggctgctgcaccctgaagattgaatatgcccggcccacccggctgaatgtcatcagaaatgacaatgacagctgggactacaccaagccctacctgggcagaagagaccggggcaagggccggcagaggcaggccatcctgggggagcaccccagcagcttcagacatgatggctacggcagccacggccccctgctgcccctgcccagccgctacaggatgggcagccgggacaccccagagctggtggcctaccccctgccccaggccagcagcagctacatgcatggaggcaaccccagcggctctgtggtgatggtgtctggcctgcaccagctgaagatgaactgcagcagggtcttcaacctcttctgcctgtatggcaacatcgagaaggtgaagttcatgaagaccatccctggaacagccctggtggagatgggagatgaatatgctgtggagagagctgtgacccacctgaacaacgtgaagctgtttgggaagaggctgaatgtgtgtgtgtccaagcagcacagcgtggtgcccagccagatctttgagctggaggatggcaccagcagctacaaggactttgccatgagcaagaacaaccgcttcaccagcgctggccaggccagcaagaacatcatccagccccccagctgtgtgctgcactactacaacgtgcccctgtgtgtgacagaggagaccttcaccaagctgtgcaatgaccacgaggtgctgaccttcatcaagtacaaggtgtttgatgccaagcccagcgccaagaccctgagcggcctgctggagtgggagtgcaagacagatgctgtggaggccctgacagccctgaaccactaccagatccgggtgcccaacggcagcaacccctacaccctgaagctgtgcttcagcaccagcagccacctgtag

SEQ ID NO: 15732 - DNA, 828 bp, Artificial Sequence
  Description of Artificial Sequence: Synthetic coding sequence
atgctggcccgggagacctatgaagaagatcgggagtatgagagccaggccaagaggctgaagacagaggagggggagattgactacagcgctgaggagggagaaaatagaagagaggccaccccccggggcggcggagatggcggcggcggcggccgctccttcagccagcctgaggccggcggcagccaccacaaggtgtctgtgtcccctgtggtgcacgtgcggggcctgtgtgagagcgtggtggaggccgacctggtggaggccctggagaagtttggcaccatctgctacgtgatgatgatgcccttcaagaggcaggccctggtggagtttgagaacatcgacagcgccaaggaatgtgtgacctttgctgctgatgagcctgtgtacatcgccggccagcaggccttcttcaactacagcaccagcaagaggatcaccaggcctggcaacacagatgaccccagcggcggcaacaaggtgctgctgctgagcatccagaaccccctgtaccccatcaccgtggatgtgctgtacacagtgtgcaaccctgtgggcaaggtgcagagaattgtcatcttcaagagaaatggcatccaggccatggtggagtttgaatctgtgctgtgtgcccagaaggccaaggccgccctgaatggagctgacatctatgccggctgctgcaccctgaagattgaatatgcccggcccacccggctgaatgtcatcagaaatgacaatgacagctgggactacaccaagccctacctgggcagaagaggccgctacttcatccacttcaggatgtacctgatctgctag

SEQ ID NO: 15733 - DNA, 1629 bp, Artificial Sequence
  Description of Artificial Sequence: Synthetic coding sequence
atgagcagcagcagcagcagcccccgggagacctatgaggaggaccgggagtatgagagccaggccaagaggctgaagacagaggagggggagattgactacagcgctgaggagggggagaacagaagagaggccaccccccggggcggcggagatggcggcggcggcggccgctccttcagccagcctgaggccggcggcagccaccacaaggtgtctgtgtcccctgtggtgcacgtgcggggcctgtgtgagagcgtggtggaggccgacctggtggaggccctggagaagtttggcaccatctgctacgtgatgatgatgcccttcaagaggcaggccctggtggagtttgaaaatattgattctgccaaggaatgtgtgacctttgctgctgatgagcctgtgtacatcgccggccagcaggccttcttcaactacagcaccagcaagaggatcacccggcccggcaacacagatgaccccagcggcggcaacaaggtgctgctgctgagcatccagaaccccctgtaccccatcaccgtggatgtgctgtacacagtgtgcaaccctgtgggcaaggtgcagagaattgtcatcttcaagagaaatggcatccaggccatgctgatgtttgagagcgtgctgtgtgcccagaaggccaaggccgccctgaatggagctgacatctatgccggctgctgcaccctgaagattgaatatgcccggcccacccggctgaatgtcatcagaaatgacaatgacagctgggactacaccaagccctacctgggccggcgggaccggggcaagggccggcagaggcaggccatcctgggggagcaccccagcagcttcagacatgatggctacggcagccacggccccctgctgcccctgcccagccgctacaggatgggcagccgggacaccccagagctggtggcctaccccctgccccaggccagcagcagctacatgcacggcggcaaccccagcggctctgtggtgatggtgtctggcctgcaccagctgaagatgaactgcagcagggtcttcaacctcttctgcctgtatggcaacatcgagaaggtgaagttcatgaagaccatccctggaacagccctggtggagatgggagatgaatatgctgtggagagagctgtgacccacctgaacaacgtgaagctgtttgggaagaggctgaatgtgtgtgtgtccaagcagcacagcgtggtgcccagccagatctttgagctggaggatggcaccagcagctacaaggactttgccatgagcaagaacaaccgcttcaccagcgctggccaggccagcaagaacatcatccagccccccagctgtgtgctgcactactacaacgtgcccctgtgtgtgacagaggagaccttcaccaagctgtgcaatgaccacgaggtgctgaccttcatcaagtacaaggtgtttgatgccaagcccagcgccaagaccctgagcggcctgctggagtgggagtgcaagacagatgctgtggaggccctgacagccctgaaccactaccagatccgggtgcccaacggcagcaacccctacaccctgaagctgtgcttcagcaccagcagccacctgtag

SEQ ID NO: 15734 - DNA, 2244 bp, Artificial Sequence
  Description of Artificial Sequence: Synthetic coding sequence
atggaggtgaagaggctgaaggtgacagagctgcggtctgagctgcagaggcggggcctggacagccggggcctgaaggtggacctggcccagaggctgcaggaggccctggatgctgagatgctggaggatgaggccggcggcggcggggccggccctggaggagcctgcaaggccgagcccaggcctgtggccgccagcggcggcggccctggaggagatgaggaggaggatgaggaggaggaggaggaggatgaggaggccctgctggaggatgaagatgaggagcccccaccagcccaggccctgggccaggccgcccagcccccacctgagcccccagaggccgccgccatggaggccgctgctgagccagatgccagcgagaagccagctgaggccacagctggcagcggcggcgtgaatggaggagaggagcagggcctgggcaagcgggaggaggatgagcctgaggagaggtctggagatgagaccccaggcagcgaggtgcctggggacaaggctgctgaggagcagggagatgaccaggacagcgagaagagcaagccagctggcagtgatggagagaggagaggagtgaagaggcagagagatgagaaggatgagcacggccgggcctactatgagttccgggaggaggcctaccacagccgcagcaagagccccctgcccccagaggaggaggccaaggatgaggaggaggaccagaccctggtgaacctggacacctacaccagtgacctgcacttccaggtgtccaaggacagatatggaggccagcccctcttcagcgagaagttccccaccctgtggagcggggcccggagcacctatggagtgaccaagggcaaggtgtgctttgaggccaaggtgacccagaacctgcccatgaaggagggctgcacagaggtgtccctgctgcgggtgggctggagcgtggacttcagccggccccagctgggagaagatgagttctcctatggctttgatggccggggcctgaaggccgagaatggccagtttgaggagtttggccagacctttggagaaaatgatgtgattggctgctttgccaactttgaaacagaggaggtggagctgtccttcagcaagaatggagaggacctgggcgtggccttctggatcagcaaggacagcctggccgaccgggccctgctgccccacgtgctgtgcaagaactgtgtggtggagctgaactttggccagaaggaggagcccttcttccccccacctgaggagtttgtgttcatccatgctgtgcctgtggaggagcgggtgaggacagctgtgccccccaagaccattgaagaatgtgaggtgatcctgatggtgggcctgcccggcagcggcaagacccagtgggccctgaagtatgccaaggaaaatcctgagaagcgctacaacgtgctgggcgctgagaccgtgctgaaccagatgaggatgaagggcctggaggagcctgagatggaccccaagagccgggacctgctggtgcagcaggccagccagtgcctgagcaagctggtgcagatcgccagcaggaccaagaggaacttcatcctggaccagtgcaatgtgtacaacagcggccagaggaggaagctgctgctcttcaagaccttcagcaggaaggtggtggtggtggtgcccaatgaggaggactggaagaagaggctggagctgaggaaggaggtggagggagatgatgtgcctgagagcatcatgctggagatgaaggccaacttcagcctgcctgagaagtgtgactacatggatgaggtgacctacggggagctggagaaggaggaggcccagcccatcgtgaccaagtacaaggaggaggccaggaagctgctgccccccagcgagaagaggaccaacagaagaaacaacagaaacaagaggaaccggcagaacagaagccggggccagggctacgtgggcggccagaggcggggctatgacaacagagcctacggccagcagtactggggccagcccggcaacagaggaggctacagaaacttctatgaccgctacagaggagactatgaccgcttctacggccgggactatgagtacaaccgctacagagactactaccggcagtacaacagagactggcagagctactactaccaccacccccaggaccgggaccgctactacagaaactactacggctaccagggctacagatag

SEQ ID NO: 15735 - DNA, 561 bp, Artificial Sequence
  Description of Artificial Sequence: Synthetic coding sequence
atgggcaaggagatccagctgaagcccaaggccaacgtgtcctcctatgtgcacttcctgctgaactacagaaacaagttcaaggagcagcagcccaacacctacgtgggcttcaaggagttcagcaggaagtgcagcgagaagtggaggagcatcagcaagcatgagaaggccaagtatgaggccctggccaagctggacaaggcccgctaccaggaggagatgatgaactacgtgggcaagaggaagaagaggaggaagagggacccccaggagccccggcggccccccagcagcttcctgctcttctgccaggaccactacgcccagctgaagcgggagaaccccaactggagcgtggtgcaggtggccaaggccaccgggaagatgtggagcacagccacagacctggagaagcacccctatgagcagagggtggccctgctgcgggccaagtactttgaggagctggagctgtacaggaagcagtgcaatgccaggaagaagtacaggatgtctgccaggaaccgctgccggggcaagagggtgcggcagagctag

SEQ ID NO: 15736 - DNA, 561 bp, Artificial Sequence; identical to SEQ ID NO: 15735
  Description of Artificial Sequence: Synthetic coding sequence

SEQ ID NO: 15737 - DNA, 273 bp, Artificial Sequence
  Description of Artificial Sequence: Synthetic coding sequence
atgcccaagaggaaggccaagggagatgccaagggggacaaggccaaggtgaaggatgagccccagaggagaagtgcccggctgagcgccaagccagccccacccaagccagagccccggcccaagaaggccagcgccaagaagggggagaagctgcccaagggcaggaagggcaaggcagatgctgggaaggatggcaacaacccagccaagaacagagatgccagcaccctgcagagccagaaggccgagggcactggagatgccaagtag

SEQ ID NO: 15738 - DNA, 273 bp, Artificial Sequence; identical to SEQ ID NO: 15737
  Description of Artificial Sequence: Synthetic coding sequence

SEQ ID NO: 15739 - DNA, 849 bp, Artificial Sequence
  Description of Artificial Sequence: Synthetic coding sequence
atgcccaagaggaaggctgctggccagggcgacatgaggcaggagcccaagagaagaagtgcccggctgagcgccatgctggtgcctgtgaccccagaggtgaagcccaagaggaccagcagcagcaggaagatgaagaccaagagtgacatgatggaggagaacatcgacaccagcgcccaggccgtggccgagaccaagcaggaggccgtggtggaggaggactacaatgaaaatgccaagaatggagaggccaagatcacagaggccccagccagcgagaaggagatcgtggaggtgaaggaggagaacattgaagatgccacagagaagggcggggagaagaaggaggccgtggccgctgaggtgaagaatgaggaggaggaccagaaggaggatgaggaggaccagaatgaggagaagggggaggccggcaaggaggacaaggatgagaagggggaggaggatggcaaggaggacaagaatggaaatgagaagggggaggatgccaaggagaaggaggatggcaagaagggggaggatggaaaaggaaatggagaagatggcaaggagaagggggaggatgagaaggaggaggaggacaggaaggagactggagatggcaaggaaaatgaagatggcaaggagaagggggacaagaaggagggcaaggatgtgaaggtgaaggaggatgagaaggagcgggaggatggcaaggaggatgaaggaggaaatgaggaggaggccggcaaggagaaggaggacctgaaggaggaggaggagggcaaggaggaggatgagatcaaggaggatgatggcaagaaggaggagccccagagcatcgtgtag

SEQ ID NO: 15740 - DNA, 486 bp, Artificial Sequence
  Description of Artificial Sequence: Synthetic coding sequence
atgcccaagaggaagcccaagagaagaagtgcccggctgagcgccatgctggtgcctgtgaccccagaggtgaagcccaagaggaccagcagcagcaggaagatgaagaccaagagtgacatgatggaggagaacatcgacaccagcgcccaggccgtggccgagaccaagcaggaggccgtggtggaggaggactacaatgaaaatgccaagaatggagaggccaagatcacagaggccccagccagcgagaaggagatcgtggaggtgaaggaggagaacattgaagatgccacagagaagggcggggagaagaaggaggccgtggccgctgaggtgaagaatgaggaggaggaccagaaggaggatgaggaggaccagaatgaggagaagggggaggccggcaaggaggacaaggatgagaagggggaggaggatggcaaggaggacaagaatggaaatgagaagggggaggatgccaagtag

SEQ ID NO: 15741 - DNA, 447 bp, Artificial Sequence
  Description of Artificial Sequence: Synthetic coding sequence
atgcccaagaggaaggctgctggccagggcgacatgaggcaggagcccaagagaagaagtgcccggctgagcgccatgctggtgcctgtgaccccagaggtgaagcccaagaggaccagcagcagcaggaagatgaagaccaagagtgacatgatggaggagaacatcgacaccagcgcccaggccgtggccgagaccaagcaggaggccgtggtggaggaggactacaatgaaaatgccaagaatggagaggccaagatcacagaggccccagccagcgagaaggagatcgtggaggtgaaggaggagaacattgaagatgccacagagaagggcggggagaagaaggaggccgtggccgctgaggtgaagaatgaggaggaggaccagaaggaggatgaggaggaccagaatgaggagaagggggaggccggcaaggaggactag

SEQ ID NO: 15742 - DNA, 309 bp, Artificial Sequence
  Description of Artificial Sequence: Synthetic coding sequence
atgcccaagaggaaggctgctggccagggcgacatgaggcaggagcccaagagaagaagtgcccggctgagcgccatgctggtgcctgtgaccccagaggtgaagcccaagaggaccagcagcagcaggaagatgaagaccaagagtgacatgatggaggagaacatcgacaccagcgcccaggccgtggccgagaccaagcaggaggccgtggtggaggaggactacaatgaaaatgccaagaatggagaggccaagatcacagaggccccagccagcgagaaggagatcgtggaggtgaaggagtag

SEQ ID NO: 15743 - DNA, 606 bp, Artificial Sequence
  Description of Artificial Sequence: Synthetic coding sequence
atgcccaagaggaagatgctggtgcctgtgaccccagaggtgaagcccaagaggaccagcagcagcaggaagatgaagaccaagagtgacatgatggaggagaacatcgacaccagcgcccaggccgtggccgagaccaagcaggaggccgtggtggaggaggactacaatgaaaatgccaagaatggagaggccaagatcacagaggccccagccagcgagaaggagatcgtggaggtgaaggaggagaacattgaagatgccacagagaagggcggggagaagaaggaggccgtggccgctgaggtgaagaatgaggaggaggaccagaaggaggatgaggaggaccagaatgaggagaagggggaggccggcaaggaggacaaggatgagaagggggaggaggatggcaaggaggacaagaatggaaatgagaagggggaggatgccaaggagaaggaggatggcaagaagggggaggatggaaaaggaaatggagaagatggcaaggagaagggggaggatgagaaggaggaggaggacaggaaggagactggagatggcaaggaaaatgaagatggcaaggagaagggggacaagaagtag

SEQ ID NO: 15744 - DNA, 270 bp, Artificial Sequence
  Description of Artificial Sequence: Synthetic coding sequence
atgcccaagaggaaggctgctggccagggcgacatgaggcaggagcccaagagaagaagtgcccggctgagcgccatgctggtgcctgtgaccccagaggtgaagcccaagaggaccagcagcagcaggaagatgaagaccaagagtgacatgatggaggagaacatcgacaccagcgcccaggccgtggccgagaccaagcaggaggccgtggtggaggaggactacaatgaaaatgccaagaatggagaggccaagatcacagaatag

SEQ ID NO: 15745 - DNA, 2073 bp, Artificial Sequence
  Description of Artificial Sequence: Synthetic coding sequence
atgaacctgcggtctgtgttcaccgtggagcagcagaggatcctgcagcgctactatgaaaatggcatgaccaaccagagcaagaactgcttccagctgatcctgcagtgtgcccaggagaccaagctggacttctctgtggtgaggacctgggtgggcaacaagaggaggaagatgagcagcaagaacagcgagagcggcacagccaccaccggcaccagcctgagcgccccagacatcaccgtgagaaatgtggtgaacatcgcccggcccagcagccagcagagctcctggaccagcgccaacaatgatgtgattgtgacaggcatctacagccctgccagcagcagcagccggcagggcaccaacaagcacacagacacccagatcacagaggcccacaagatccccatccagaagacagccaccaagaatgacacagagttccagctgcacatccctgtgcagaggcaggtggcccactgcaagaatgccagcctgctgctgggggagaagaccatcatcctgagccggcagacctctgtgctgaatgccggcaacagcgtcttcaaccacgccaagaagaactacggcaacagctctgtgcaggccagcgagatgacagtgccccagaagcccagcgtgtgccaccggccctgcaagattgagcctgtgggcatccagaggagctacaagccagagcacacaggccctgccctgcacaacctgtgtggccagaagcccaccatccgggacccctactgcaggacccagaacctggagatccgggaggtgttcagcctggccgtgtctgactacccccagaggatcctgggcggcaatgccccccagaagcccagcagcgctgagggcaactgcctgagcatcgccatggagactggagatgctgaagatgaatatgcccgggaggaggagctggcctccatgagggcccagatccccagctacagccgcttctatgaaagtggcagcagcctgcgggcagagaaccagagcaccaccctgcccggccctggaagaaacatgcccaacagccagatggtgaacatccgggacatgtctgacaacgtgctgtaccagaacagaaactaccacctgacccccaggaccagcctgcacacagccagcagcaccatgtacagcaacaccaaccccctgcggagcaacttcagcccccactttgccagcagcaaccagctgcggctgagccagaaccagaacaactaccagatcagcggcaacctgactgtgccctggatcaccggctgcagcaggaagagggccctgcaggacaggacccagttcagtgaccgggacctggccaccctgaagaagtactgggacaatggcatgaccagcctgggctctgtgtgccgggagaagattgaagctgtggccacagagctgaatgtggactgtgagatcgtgaggacctggattggcaacagaagaaggaagtaccgcctgatgggcatcgaggtgcccccaccccggggcggccctgctgacttcagcgagcagcctgagagcggcagcctgagcgccctgaccccaggagaggaggccggccctgaggtgggagaagataatgacagaaatgatgaggtgtccatctgcctgtctgagggcagcagccaggaggagcccaatgaggtggtgcccaatgatgcccgggcccacaaggaggaggaccaccacgctgtgaccacagacaacgtgaagattgagatcattgatgatgaggagagtgacatgatcagcaacagcgaggtggagcaggtgaacagcttcctggactacaagaatgaggaggtgaagttcattgaaaatgagctggagatccagaagcagaagtacttcaagctgcagacctttgtgcgcagcctcatcctggccatgaaggcagatgacaaggagcagcagcaggccctgctgagtgacctgcccccagagctggaggagatggacttcaaccacgccagcctggagccagatgacaccagcttctctgtgagcagcctgtctgagaagaatgtgtctgagagcctgtag

SEQ ID NO: 15746 - DNA, 1899 bp, Artificial Sequence
  Description of Artificial Sequence: Synthetic coding sequence
atgagcagcaagaacagcgagagcggcacagccaccaccggcaccagcctgagcgccccagacatcaccgtgagaaatgtggtgaacatcgcccggcccagcagccagcagagctcctggaccagcgccaacaatgatgtgattgtgacaggcatctacagccctgccagcagcagcagccggcagggcaccaacaagcacacagacacccagatcacagaggcccacaagatccccatccagaagacagccaccaagaatgacacagagttccagctgcacatccctgtgcagaggcaggtggcccactgcaagaatgccagcctgctgctgggggagaagaccatcatcctgagccggcagacctctgtgctgaatgccggcaacagcgtcttcaaccacgccaagaagaactacggcaacagctctgtgcaggccagcgagatgacagtgccccagaagcccagcgtgtgccaccggccctgcaagattgagcctgtgggcatccagaggagctacaagccagagcacacaggccctgccctgcacaacctgtgtggccagaagcccaccatccgggacccctactgcaggacccagaacctggagatccgggaggtgttcagcctggccgtgtctgactacccccagaggatcctgggcggcaatgccccccagaagcccagcagcgctgagggcaactgcctgagcatcgccatggagactggagatgctgaagatgaatatgcccgggaggaggagctggcctccatgagggcccagatccccagctacagccgcttctatgaaagtggcagcagcctgcgggcagagaaccagagcaccaccctgcccggccctggaagaaacatgcccaacagccagatggtgaacatccgggacatgtctgacaacgtgctgtaccagaacagaaactaccacctgacccccaggaccagcctgcacacagccagcagcaccatgtacagcaacaccaaccccctgcggagcaacttcagcccccactttgccagcagcaaccagctgcggctgagccagaaccagaacaactaccagatcagcggcaacctgactgtgccctggatcaccggctgcagcaggaagagggccctgcaggacaggacccagttcagtgaccgggacctggccaccctgaagaagtactgggacaatggcatgaccagcctgggctctgtgtgccgggagaagattgaagctgtggccacagagctgaatgtggactgtgagatcgtgaggacctggattggcaacagaagaaggaagtaccgcctgatgggcatcgaggtgcccccaccccggggcggccctgctgacttcagcgagcagcctgagagcggcagcctgagcgccctgaccccaggagaggaggccggccctgaggtgggagaagataatgacagaaatgatgaggtgtccatctgcctgtctgagggcagcagccaggaggagcccaatgaggtggtgcccaatgatgcccgggcccacaaggaggaggaccaccacgctgtgaccacagacaacgtgaagattgagatcattgatgatgaggagagtgacatgatcagcaacagcgaggtggagcaggtgaacagcttcctggactacaagaatgaggaggtgaagttcattgaaaatgagctggagatccagaagcagaagtacttcaagctgcagacctttgtgcgcagcctcatcctggccatgaaggcagatgacaaggagcagcagcaggccctgctgagtgacctgcccccagagctggaggagatggacttcaaccacgccagcctggagccagatgacaccagcttctctgtgagcagcctgtctgagaagaatgtgtctgagagcctgtag

SEQ ID NO: 15747 - DNA, 624 bp, Artificial Sequence
  Description of Artificial Sequence: Synthetic coding sequence
atgagcagcaagaacagcgagagcggcacagccaccaccggcaccagcctgagcgccccagacatcaccgtgagaaatgtggtgaacatcgcccggcccagcagccagcagagctcctggaccagcgccaacaatgatgtgattgtgacaggcatctacagccctgccagcagcagcagccggcagggcaccaacaagcacacagacacccagatcacagaggcccacaagatccccatccagaagacagccaccaagaatgacacagagttccagctgcacatccctgtgcagaggcaggtggcccactgcaagaatgccagcctgctgctgggggagaagaccatcatcctgagccggcagacctctgtgctgaatgccggcaacagcgtcttcaaccacgccaagaagaactacggcaacagctctgtgcaggccagcgagatgacagtgccccagaagcccagcgtgtgccaccggccctgcaagattgagcctgtgggcatccagaggagctacaagccagagcacacaggccctgccctgcacaacctgtgtggccagaagcccaccatccgggacccctactgcaggacccagaacctggagatccgggaggtgtag

SEQ ID NO: 15748 - DNA, 2073 bp, Artificial Sequence; identical to SEQ ID NO: 15745
  Description of Artificial Sequence: Synthetic coding sequence

SEQ ID NO: 15749 - DNA, 1671 bp, Artificial Sequence
  Description of Artificial Sequence: Synthetic coding sequence
atggcccgggagaaggagatgcaggagttcaccaggagcttcttccggggccgcccagacctgagcaccctgacccacagcatcgtgagaagacgctacctggcccacagcggccgcagccacctggagcctgaggagaagcaggccctgaagaggctggtggaggaggagctgctgaagatgcaggtggatgaggccgccagccgggaggacaagctggacctgaccaagaagggcaagaggcctcccaccccctgcagcgaccctgagaggaagcgcttccgcttcaacagcgagagcgagagcggcagcgaggccagcagcccagactacttcggccccccagccaagaatggagtggccgctgaggtgtccccagccaaggaggagaacccccggcgggccagcaaggctgtggaggagagcagtgatgaggagcggcagagggacctgcctgcccagagaggagaggagagcagcgaggaggaggagaagggctacaagggcaagaccaggaagaagcctgtggtgaagaagcaggcccctgggaaggcctctgtgtccaggaagcaggcccgggaggagagcgaggagagcgaggccgagcctgtgcagaggacagccaagaaggtggagggcaacaagggcaccaagagcctgaaggagagcgagcaggagagcgaggaggagatcctggcccagaagaaggagcagcgggaggaggaggtggaggaggaggagaaggaggaggatgaggagaagggggactggaagcccaggaccaggagcaatggccgcaggaagagcgcccgggaggagaggagctgcaagcagaagagccaggccaagaggctgctgggggacagcgacagcgaggaggagcagaaggaggccgccagcagtggagatgattctggccgggaccgggagccccctgtgcagaggaagtctgaggacaggacccagctgaagggcggcaagaggctgagcggcagcagtgaagatgaagaagattctggaaaaggagagcccacagccaagggcagcaggaagatggcccggctgggcagcaccagcggggaggagagtgacctggagcgggaggtgtctgacagcgaggccggcggcggcccccagggcgagaggaagaacagaagcagcaagaagagcagcaggaaaggaagaaccaggagcagcagcagcagcagtgatggcagccctgaggccaagggcggcaaggccggcagcggcagaagaggagaggaccaccctgctgtgatgaggctgaagcgctacatccgggcctgtggggcccacaggaactacaagaagctgctgggcagctgctgcagccacaaggagcggctgagcatcctgcgggcagagctggaggccctgggcatgaagggcacccccagcctgggcaagtgccgggccctgaaggagcagcgggaggaggccgctgaggtggccagcctggatgtggccaacatcatcagcggcagcggccggcccaggagaagaacagcctggaaccccctgggggaggccgcccctcctggagagctgtacagaaggaccctggacagtgatgaggagcggcccaggcctgcccccccagactggagccacatgaggggcatcatcagcagtgatggagagagcaactag

SEQ ID NO: 15750 - DNA, 732 bp, Artificial Sequence
  Description of Artificial Sequence: Synthetic coding sequence
atggcccgggagaaggagatgcaggagttcaccaggagcttcttccggggccgcccagacctgagcaccctgacccacagcatcgtgagaagacgctacctggcccacagcggccgcagccacctggagcctgaggagaagcaggccctgaagaggctggtggaggaggagctgctgaagatgcaggtggatgaggccgccagccgggaggacaagctggacctgaccaagaagggcaagaggcctcccaccccctgcagcgaccctgagaggaagcgcttccgcttcaacagcgagagcgctggcagcggcagaagaggagaggaccaccctgctgtgatgaggctgaagcgctacatccgggcctgtggggcccacaggaactacaagaagctgctgggcagctgctgcagccacaaggagcggctgagcatcctgcgggcagagctggaggccctgggcatgaagggcacccccagcctgggcaaatgtcgggccctgaaggagcagcgggaggaggccgctgaggtggccagcctggatgtggccaacatcatcagcggcagcggccggcccaggagaagaacagcctggaaccccctgggggaggccgcccctcctggagagctgtacagaaggaccctggacagtgatgaggagcggcccaggcctgcccccccagactggagccacatgaggggcatcatcagcagtgatggagagagcaactag

SEQ ID NO: 15751 - DNA, 1362 bp, Artificial Sequence
  Description of Artificial Sequence: Synthetic coding sequence
atggagcgggcccccccagatggccccctgaatgccagcggggccctggccggggaggccgctgctgctggaggagcccggggcttctctgctgcctggacagctgtgctggccgccctgatggccctgctgattgtggccaccgtgctgggcaatgccctggtgatgctggcctttgtggccgacagcagcctgcggacccagaacaacttcttcctgctgaacctggccatcagtgacttcctggtgggcgccttctgcatccccctgtatgtgccctacgtgctgaccggccgctggaccttcggccggggcctgtgcaagctgtggctggtggtggactacctgctgtgcaccagcagcgccttcaacatcgtgctgatctcctatgaccgcttcctgtctgtgaccagggctgtgtcctaccgggcccagcagggcgacacccggcgggctgtgaggaagatgctgctggtgtgggtgctggccttcctgctgtatggccctgccatcctgtcctgggagtacctgagcggcggcagcagcatccctgagggccactgctacgccgagttcttctacaactggtacttcctgatcacagccagcaccctggagttcttcacccccttcctgtctgtgaccttcttcaacctgagcatctacctgaacatccagaggaggacccggctgcggctggatggagcccgggaggccgccggccctgagcccccacctgaggcccagcccagccccccacctcctcctggctgctggggctgctggcagaagggccacggggaggccatgcccctgcacagatatggagtgggggaggccgctgtgggcgctgaggccggggaggccaccctgggcggcggcggcggcggcggctctgtggccagccccaccagcagcagcggcagcagcagccggggcacagagcggcccaggagcctgaagaggggcagcaagcccagcgccagcagcgccagcctggagaagaggatgaagatggtgtcccagagcttcacccagcgcttccggctgagccgggacaggaaggtggccaagagcctggccgtgattgtgtccatcttcggcctgtgctgggccccctacaccctgctgatgatcatccgggccgcctgccacggccactgtgtgcctgactactggtatgagaccagcttctggctgctgtgggccaacagcgctgtgaaccctgtgctgtaccccctgtgccaccacagcttccggcgggccttcaccaagctgctgtgcccccagaagctgaagatccagccccacagcagcctggagcactgctggaagaagatgaagaagaagacctgcctgtag

SEQ ID NO: 15752 - DNA, 1338 bp, Artificial Sequence
  Description of Artificial Sequence: Synthetic coding sequence
atggagcgggcccccccagatggccccctgaatgccagcggggccctggccggggaggccgctgctgctggaggagcccggggcttctctgctgcctggacagctgtgctggccgccctgatggccctgctgattgtggccaccgtgctgggcaatgccctggtgatgctggcctttgtggccgacagcagcctgcggacccagaacaacttcttcctgctgaacctggccatcagtgacttcctggtgggcgccttctgcatccccctgtatgtgccctacgtgctgaccggccgctggaccttcggccggggcctgtgcaagctgtggctggtggtggactacctgctgtgcaccagcagcgccttcaacatcgtgctgatctcctatgaccgcttcctgtctgtgaccagggctgtgtcctaccgggcccagcagggcgacacccggcgggctgtgaggaagatgctgctggtgtgggtgctggccttcctgctgtatggccctgccatcctgtcctgggagtacctgagcggcggcagcagcatccctgagggccactgctacgccgagttcttctacaactggtacttcctgatcacagccagcaccctggagttcttcacccccttcctgtctgtgaccttcttcaacctgagcatctacctgaacatccagaggaggacccggctgcggctggatggagcccgggaggccgccggccctgagcccccacctgaggcccagcccagccccccacctcctcctggctgctggggctgctggcagaagggccacggggaggccatgcccctgcacagatatggagtgggggaggccgctgtgggcgctgaggccggggaggccaccctgggcggcggcggcggcggcggctctgtggccagccccaccagcagcagcggcagcagcagccggggcacagagcggcccaggagcctgaagaggggcagcaagcccagcgccagcagcgccagcctggagaagaggatgaagatggtgtcccagagcttcacccagcgcttccggctgagccgggacaggaaggtggccaagagcctggccgtgattgtgtccatcttcggcctgtgctgggccccctacaccctgctgatgatcatccgggccgcctgccacggccactgtgtgcctgactactggtatgagaccagcttctggctgctgtgggccaacagcgctgtgaaccctgtgctgtaccccctgtgccaccacagcttccggcgggccttcaccaagctgctgtgcccccagaagctgaagatccagccccacagcagcctggagcactgctggaagtag

SEQ ID NO: 15753 - DNA, 1248 bp, Artificial Sequence
  Description of Artificial Sequence: Synthetic coding sequence
atggagcgggcccccccagatggccccctgaatgccagcggggccctggccggggaggccgctgctgctggaggagcccggggcttctctgctgcctggacagctgtgctggccgccctgatggccctgctgattgtggccaccgtgctgggcaatgccctggtgatgctggcctttgtggccgacagcagcctgcggacccagaacaacttcttcctgctgaacctggccatcagtgacttcctggtgggcgccttctgcatccccctgtatgtgccctacgtgctgaccggccgctggaccttcggccggggcctgtgcaagctgtggctggtggtggactacctgctgtgcaccagcagcgccttcaacatcgtgctgatctcctatgaccgcttcctgtctgtgaccagggctgtgtcctaccgggcccagcagggcgacacccggcgggctgtgaggaagatgctgctggtgtgggtgctggccttcctgctgtatggccctgccatcctgtcctgggagtacctgagcggcggcagcagcatccctgagggccactgctacgccgagttcttctacaactggtacttcctgatcacagccagcaccctggagttcttcacccccttcctgtctgtgaccttcttcaacctgagcatctacctgaacatccagaggaggacccggctgcggctgaagggccacggggaggccatgcccctgcacagatatggagtgggggaggccgctgtgggcgctgaggccggggaggccaccctgggcggcggcggcggcggcggctctgtggccagccccaccagcagcagcggcagcagcagccggggcacagagcggcccaggagcctgaagaggggcagcaagcccagcgccagcagcgccagcctggagaagaggatgaagatggtgtcccagagcttcacccagcgcttccggctgagccgggacaggaaggtggccaagagcctggccgtgattgtgtccatcttcggcctgtgctgggccccctacaccctgctgatgatcatccgggccgcctgccacggccactgtgtgcctgactactggtatgagaccagcttctggctgctgtgggccaacagcgctgtgaaccctgtgctgtaccccctgtgccaccacagcttccggcgggccttcaccaagctgctgtgcccccagaagctgaagatccagccccacagcagcctggagcactgctggaagtag

SEQ ID NO: 15754 - DNA, 396 bp, Artificial Sequence
  Description of Artificial Sequence: Synthetic coding sequence
atgagcggccggggcaagcagggcggcaaggcccgggccaagagcaagagccgcagcagccgggccggcctgcagtttcctgtgggccgcatccaccggctgctgaggaaaggaaattatgcagagcgcatcggggccggggcccctgtgtacctggccgctgtgctggagtacctgacagctgagatcctggagctggccggaaatgccagccgggacaacaagaagacccgcatcatccccaggcacctgcagctggccatcagaaatgatgaggagctgaacaagctgctgggcggcgtgaccatcgcccagggcggcgtgctgcccaacatccaggccgtgctgctgcccaagaagacagagagccaccaccacaaggcccagagcaagtag

SEQ ID NO: 15755 - DNA, 393 bp, Artificial Sequence
  Description of Artificial Sequence: Synthetic coding sequence
atgagcggccggggcaagcagggcggcaaggcccgggccaaggccaagaccaggagcagccgggccggcctgcagtttcctgtgggccgggtgcaccggctgctgaggaaaggaaattatgcagagcgggtgggcgctggggcccctgtgtacctggccgctgtgctggagtacctgacagctgagatcctggagctggccggaaatgctgcccgggacaacaagaagacccgcatcatccccaggcacctgcagctggccatcagaaatgatgaggagctgaacaagctgctgggcaaggtgaccatcgcccagggcggcgtgctgcccaacatccaggccgtgctgctgcccaagaagacagagagccaccacaaggccaagggcaagtag

SEQ ID NO: 15756 - DNA, 387 bp, Artificial Sequence
  Description of Artificial Sequence: Synthetic coding sequence
atgagcggccggggcaagcagggcggcaaggcccgggccaaggccaagaccaggagcagccgggccggcctgcagtttcctgtgggccgggtgcaccggctgctgaggaaaggaaattatgcagagcgggtgggcgctggggcccctgtgtacctggccgctgtgctggagtacctgacagctgagatcctggagctggccggaaatgctgcccgggacaacaagaagacccgcatcatccccaggcacctgcagctggccatcagaaatgatgaggagctgaacaagctgctgggcaaggtgaccatcgcccagggcggcgtgctgcccaacatccaggccgtgctgctgcccaagaagacagagagccaccacaaggccaagtag

SEQ ID NO: 15757 - DNA, 381 bp, Artificial Sequence
  Description of Artificial Sequence: Synthetic coding sequence
atgcctgagcccgccaagagcgccccagcccccaagaagggcagcaagaaggctgtgaccaaggcccagaagaaggatggcaagaagaggaagaggagcaggaaggagagctacagcatctacgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcgccaagtag

SEQ ID NO: 15758 - DNA, 381 bp, Artificial Sequence; identical to SEQ ID NO: 15757
  Description of Artificial Sequence: Synthetic coding sequence

SEQ ID NO: 15759 - DNA, 381 bp, Artificial Sequence
  Description of Artificial Sequence: Synthetic coding sequence
atgcctgagcccgccaagagcgccccagcccccaagaagggcagcaagaaggctgtgaccaaggcccagaagaaggatggcaagaagaggaagaggagcaggaaggagagctacagcgtgtatgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcgccaagtag

SEQ ID NO: 15760 - DNA, 381 bp, Artificial Sequence; identical to SEQ ID NO: 15759
  Description of Artificial Sequence: Synthetic coding sequence

SEQ ID NO: 15761 - DNA, 393 bp, Artificial Sequence
  Description of Artificial Sequence: Synthetic coding sequence
atgagcggccggggcaagcagggcggcaaggcccgggccaaggccaagagccgcagcagccgggccggcctgcagtttcctgtgggccgggtgcaccggctgctgaggaaaggaaattatgcagagcgggtgggcgctggggcccctgtgtacatggctgctgtgctggagtacctgacagctgagatcctggagctggccggaaatgctgcccgggacaacaagaagacccgcatcatccccaggcacctgcagctggccatcagaaatgatgaggagctgaacaagctgctgggcaaggtgaccatcgcccagggcggcgtgctgcccaacatccaggccgtgctgctgcccaagaagacagagagccaccacaaggccaagggcaagtag

SEQ ID NO: 15762 - DNA, 393 bp, Artificial Sequence; identical to SEQ ID NO: 15761
  Description of Artificial Sequence: Synthetic coding sequence

SEQ ID NO: 15763 - DNA, 393 bp, Artificial Sequence
  Description of Artificial Sequence: Synthetic coding sequence
atgagcggccggggcaagcagggcggcaaggcccgggccaaggccaagagccgcagcagccgggccggcctgcagtttcctgtgggccgggtgcaccggctgctgaggaaaggaaattatgcagagcgggtgggcgctggggcccctgtgtacctggccgctgtgctggagtacctgacagctgagatcctggagctggccggaaatgctgcccgggacaacaagaagacccgcatcatccccaggcacctgcagctggccgtgagaaatgatgaggagctgaacaagctgctgggcggcgtgaccatcgcccagggcggcgtgctgcccaacatccaggccgtgctgctgcccaagaagacagagagccacaagccaggcaagaacaagtag

SEQ ID NO: 15764 - DNA, 381 bp, Artificial Sequence
  Description of Artificial Sequence: Synthetic coding sequence
atgccagaccctgccaagagcgccccagcccccaagaagggcagcaagaaggctgtgaccaaggtgcagaagaaggatggcaagaagaggaagaggagcaggaaggagagctacagcgtgtatgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcagcaagtag

SEQ ID NO: 15765 - DNA, 501 bp, Artificial Sequence
  Description of Artificial Sequence: Synthetic coding sequence
atgccagaccctgccaagagcgccccagcccccaagaagggcagcaagaaggctgtgaccaaggtgcagaagaaggatggcaagaagaggaagaggagcaggaaggagagctacagcgtgtatgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcagcaaccccaggaacctgagccccaccaagccaggcggctctgaagatcggcagcccccacccagccagctgagcgccatcccccccttctgcctggtgctgcgggccggcattgctggccaggtgtag

SEQ ID NO: 15766 - DNA, 405 bp, Artificial Sequence
  Description of Artificial Sequence: Synthetic coding sequence
atgccagaccctgccaagagcgccccagcccccaagaagggcagcaagaaggctgtgaccaaggtgcagaagaaggatggcaagaagaggaagaggagcaggaaggagagctacagcgtgtatgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcagcaagctgattggccccatcctgtggaagtag

SEQ ID NO: 15767 - DNA, 411 bp, Artificial Sequence
  Description of Artificial Sequence: Synthetic coding sequence
atggcccggaccaagcagacagccaggaagagcactggaggcaaggcccccaggaagcagctggccaccaaggccgccaggaagagcgccccagccactggaggagtgaagaagccccaccgctaccggcccggcaccgtggccctgcgggagatccgccgctaccagaagagcacagagctgctgatcaggaagctgcccttccagaggctggtgcgggagatcgcccaggagttcaagacagacctgcgcttccagagcagcgctgtgatggccctgcaggaggcccgggaggcctacctggtgggcctgtttgaggacaccaacctgtgtgccatccacgccaagagggtgaccatcatgcccaaggacatccagctggtgagccgcatccggggggagcgggcctag

SEQ ID NO: 15768 - DNA, 393 bp, Artificial Sequence
  Description of Artificial Sequence: Synthetic coding sequence
atgagcggccggggcaagcagggcggcaaggcccgggccaaggccaagagccgcagcagccgggccggcctgcagtttcctgtgggccgggtgcaccggctgctgaggaaaggaaactacagcgagcgggtgggcgctggggcccctgtgtacctggccgctgtgctggagtacctgacagctgagatcctggagctggccggaaatgctgcccgggacaacaagaagacccgcatcatccccaggcacctgcagctggccatcagaaatgatgaggagctgaacaagctgctgggccgggtgaccatcgcccagggcggcgtgctgcccaacatccaggccgtgctgctgcccaagaagacagagagccaccacaaggccaagggcaagtag

SEQ ID NO: 15769 - DNA, 381 bp, Artificial Sequence
  Description of Artificial Sequence: Synthetic coding sequence
atgccagaccccagcaagagcgccccagcccccaagaagggcagcaagaaggctgtgaccaaggcccagaagaaggatggcaagaagaggaagaggggcaggaaggagagctacagcatctacgtgtacaaggtgctgaagcaggtgcacccagacaccggcatcagcagcaaggccatgggcatcatgaacagctttgtgaatgacatctttgagcgcatcgccagcgaggccagccggctggcccactacaacaagaggagcaccatcaccagccgggaggtgcagacagctgtgcggctgctgctgcccggggagctggccaagcatgctgtgtctgagggcaccaaggctgtgaccaagtacaccagcagcaagtag

SEQ ID NO: 15770 - DNA, 1554 bp, Artificial Sequence
  Description of Artificial Sequence: Synthetic coding sequence
atgcctcctcctgggaaggtgcccaggaaagaaaacctgtggctgcagtgtgagtggggcagctgcagctttgtgtgcagcaccatggagaagttctttgaacatgtgacccagcacctgcagcagcacctgcacggcagcggggaggaggaggaggaggaggaggaggatgaccccctggaggaggagttcagctgcctgtggcaggagtgtggcttctgcagcctggacagcagcgctgacctgatcagacatgtgtacttccactgctaccacaccaagctgaagcagtggggcctgcaggccctgcagagccaggccgacctgggcccctgcatcctggacttccagagcagaaatgtcatcccagacatcccagaccacttcctgtgcctgtgggagcactgtgaaaattcctttgacaaccctgagtggttctacagacatgtggaggcccacagcctgtgctgtgaatatgaagctgtgggcaaggacaaccctgtggtgctgtgtggctggaagggctgcacctgcaccttcaaggacaggagcaagctgcgggagcacctgcggagccacacccaggagaaggtggtggcctgccccacctgtggcggcatgtttgccaacaacaccaagttcctggaccacatccggcggcagaccagcctggaccagcagcacttccagtgcagccactgcagcaagagatttgccacagagcggctgctgcgggaccacatgagaaatcatgtgaaccactacaagtgccccctgtgtgacatgacctgccccctgcccagcagcctgaggaaccacatgaggttccgccacagcgaggaccggcccttcaagtgtgactgctgtgactacagctgcaagaacctgattgacctgcagaagcacctggacacccacagcgaggagcccgcctaccgctgtgactttgagaactgcaccttcagcgcccggagcctgtgcagcatcaagagccactacaggaaggtgcatgaaggagacagcgagccccgctacaagtgccacgtgtgtgacaagtgcttcacccggggcaacaacctgactgtgcacctgaggaagaagcaccagttcaagtggcccagcggccacccccgcttccgctacaaggagcatgaagatggctacatgaggctgcagctggtgcgctatgagagcgtggagctgacccagcagctgctgcggcagccccaggagggcagcggcctgggcaccagcctgaatgaaagcagcctgcagggcatcatcctggagaccgtgcctggagagcccggcaggaaggaggaggaggaggagggcaagggcagcgagggcacagccctgagcgccagccaggacaaccccagcagcgtcatccacgtggtgaaccagaccaatgcccagggccagcaggagatcgtgtactacgtgctgtctgaggcccctggagagcccccaccagcccctgagccccccagcggcggcatcatggagaagctgcagggcattgctgaggagcctgagatccagatggtgtag

SEQ ID NO: 15771 - DNA, 1260 bp, Artificial Sequence
  Description of Artificial Sequence: Synthetic coding sequence
atgcctcctcctgggaaggtgcccaggaaagaaaacctgtggctgcagtgtgagtggggcagctgcagctttgtgtgcagcaccatggagaagttctttgaacatgtgacccagcacctgcagcagcacctgcacggcagcggggaggaggaggaggaggaggaggaggatgaccccctggaggaggagttcagctgcctgtggcaggagtgtggcttctgcagcctggacagcagcgctgacctgatcagacatgtgtacttccactgctaccacaccaagctgaagcagtggggcctgcaggccctgcagagccaggccgacctgggcccctgcatcctggacttccagagcagaaatgtcatcccagacatcccagaccacttcctgtgcctgtgggagcactgtgaaaattcctttgacaaccctgagtggttctacagacatgtggaggcccacagcctgtgctgtgaatatgaagctgtgggcaaggacaaccctgtggtgctgtgtggctggaagggctgcacctgcaccttcaaggacaggagcaagctgcgggagcacctgcggagccacacccaggagaaggtggtggcctgccccacctgtggcggcatgtttgccaacaacaccaagttcctggaccacatccggcggcagaccagcctggaccagcagcacttccagtgcagccactgcagcaagagatttgccacagagcggctgctgcgggaccacatgagaaatcatgtgaaccactacaagtgccccctgtgtgacatgacctgccccctgcccagcagcctgaggaaccacatgaggttccgccacagcgaggaccggcccttcaagtgtgactgctgtgactacagctgcaagaacctgattgacctgcagaagcacctggacacccacagcgaggagcccgcctaccgctgtgactttgagaactgcaccttcagcgcccggagcctgtgcagcatcaagagccactacaggaaggtgcatgaaggagacagcgagccccgctacaagtgccacgtgtgtgacaagtgcttcacccggggcaacaacctgactgtgcacctgaggaagaagcaccagttcaagtggcccagcggccacccccgcttccggctgggccacttctgcatccccctgcccggctttgctgccctgtatgcccccaccagccctggcaccaggaacatgaagatggccatctgtggctgctcctggtttgccaccagggtgtag

SEQ ID NO: 15772 - DNA, 306 bp, Artificial Sequence
  Description of Artificial Sequence: Synthetic coding sequence
atgaacctggagcgggtgtccaatgaggagaagctgaacctgtgcaggaagtactacctgggcggctttgccttcctgcccttcctgtggctggtgaacatcttctggttcttccgggaggccttcctggtgcctgcctacacagagcagagccagatcaagggctacgtgtggaggtctgctgtgggcttcctgttctgggtgattgtgctgacctcctggatcaccatcttccagatctaccggccccgctggggcgccctgggggactacctgtccttcaccatccccctgggcaccccctag

SEQ ID NO: 15773 - DNA, 1749 bp, Artificial Sequence
  Description of Artificial Sequence: Synthetic coding sequence
atggctgctgctgctgggggcggcagctgccccggccctggcagcgcccggggccgcttccctggccggcccagaggagctgggggcggcggcggccggggcggcagaggaaatggagctgagcgggtgcgggtggccctgcggcggggcggcggggccaccggccctgggggcgctgagcctggagaggacacagccctgctgcggctgctgggcctgcggcggggcctgcggcggctgcggcggctgtgggccggcccccgggtgcagaggggccggggccggggccggggccggggctggggccccagccggggctgtgtgcctgaggaggagagcagtgatggagagagtgatgaggaggagttccagggcttccacagtgatgaagatgtggcccccagcagcctgcggagcgccctgcggagccagaggggccgggccccccggggccggggcaggaagcacaagaccacccccctgcccccaccccggctggctgatgtggcccccaccccacccaagaccccagccaggaagagaggagaggagggcacagagaggatggtgcaggccctgacagagctgctgcggcgggcccaggccccccaggcccccaggagccgggcctgtgagcccagcaccccaagaagaagccggggccggcccccaggccggcctgctggcccctgcaggaggaagcagcaggccgtggtggtggccgaggccgctgtgaccatccccaagccagagcccccacctcctgtggtgcctgtgaagcaccagacaggctcctggaagtgcaaggagggccctggccctggccctggcaccccccggcggggcggccagagcagccggggcggccggggcggccggggccggggccggggcggcggcctgccctttgtgatcaagtttgtgtcccgggccaagaaggtgaagatgggccagctgagcctgggcctggagagcggccagggccagggccagcacgaggagagctggcaggatgtgccccagaggagagtgggcagcggccagggcggcagcccctgctggaagaagcaggagcagaagctggatgatgaggaggaggagaagaaggaggaggaggagaaggacaaggagggggaggagaaggaggagagagctgtggccgaggagatgatgcctgctgctgagaaggaggaggccaagctgcccccaccacccctgaccccaccagcccccagccccccaccacccctgcccccacccagcaccagccccccaccacccctgtgccccccacctcctcctcctgtgagccccccacccctgcccagccccccacctcctccagcccaggaggagcaggaggagagccccccacctgtggtgcctgccacctgcagcaggaagaggggccggccccccctgacccccagccagagagctgagcgggaggccgcccgggccggccctgagggcaccagcccccccacccccacccccagcacagccactggaggccccccagaggacagccccaccgtggcccccaagagcaccaccttcctgaagaacatccggcagttcatcatgcctgtgcccctgagccagagcctgctgctgcccatgaccctgcagctgagcctgagcctgggccagtgggccgcccccaccaccagcgcctgcctggacagccccctgtggagccccctgctgctgcggccccgctgccccctgaccggcctgcagctgtag

SEQ ID NO: 15774 - DNA, 8148 bp, Artificial Sequence
  Description of Artificial Sequence: Synthetic coding sequence
atggctgctgctgctgggggcggcagctgccccggccctggcagcgcccggggccgcttccctggccggcccagaggagctgggggcggcggcggccggggcggcagaggaaatggagctgagcgggtgcgggtggccctgcggcggggcggcggggccaccggccctgggggcgctgagcctggagaggacacagccctgctgcggctgctgggcctgcggcggggcctgcggcggctgcggcggctgtgggccggcccccgggtgcagaggggccggggccggggccggggccggggctggggccccagccggggctgtgtgcctgaggaggagagcagtgatggagagagtgatgaggaggagttccagggcttccacagtgatgaagatgtggcccccagcagcctgcggagcgccctgcggagccagaggggccgggccccccggggccggggcaggaagcacaagaccacccccctgcccccaccccggctggctgatgtggcccccaccccacccaagaccccagccaggaagagaggagaggagggcacagagaggatggtgcaggccctgacagagctgctgcggcgggcccaggccccccaggcccccaggagccgggcctgtgagcccagcaccccaagaagaagccggggccggcccccaggccggcctgctggcccctgcaggaggaagcagcaggccgtggtggtggccgaggccgctgtgaccatccccaagccagagcccccacctcctgtggtgcctgtgaagcaccagacaggctcctggaagtgcaaggagggccctggccctggccctggcaccccccggcggggcggccagagcagccggggcggccggggcggccggggccggggccggggcggcggcctgccctttgtgatcaagtttgtgtcccgggccaagaaggtgaagatgggccagctgagcctgggcctggagagcggccagggccagggccagcacgaggagagctggcaggatgtgccccagaggagagtgggcagcggccagggcggcagcccctgctggaagaagcaggagcagaagctggatgatgaggaggaggagaagaaggaggaggaggagaaggacaaggagggggaggagaaggaggagagagctgtggccgaggagatgatgcctgctgctgagaaggaggaggccaagctgcccccaccacccctgaccccaccagcccccagccccccaccacccctgcccccacccagcaccagccccccaccacccctgtgccccccacctcctcctcctgtgagccccccacccctgcccagccccccacctcctccagcccaggaggagcaggaggagagccccccacctgtggtgcctgccacctgcagcaggaagaggggccggccccccctgacccccagccagagagctgagcgggaggccgcccgggccggccctgagggcaccagcccccccacccccacccccagcacagccactggaggccccccagaggacagccccaccgtggcccccaagagcaccaccttcctgaagaacatccggcagttcatcatgcctgtggtgtctgcccggagcagcagggtcatcaagaccccccggcgcttcatggatgaagatcctcccaagccacccaaggtggaggtgtcccctgtgctgcggccccccatcaccaccagcccccctgtgccccaggagcccgcccctgtgcccagccccccccgggcccccaccccacccagcacccctgtgcccctgcctgagaagaggaggagcatcctgcgggagcccaccttccgctggaccagcctgacccgggagctgcccccacctcctccagcccctcctcctcctccagcccccagccccccaccagccccagccaccagcagccggcggcccctgctgctgcgggccccccagttcaccccatctgaggcccacctgaagatctatgagagcgtgctgaccccaccacccctgggcgcccctgaggcccctgagcctgagcccccaccagcagatgacagccctgctgagcctgagcccagggctgtgggccgcaccaaccacctgagcctgcccaggtttgcccctgtggtgaccacccctgtgaaggccgaggtgagcccccacggggccccagccctgagcaatggcccccagacccaggcccagctgctgcagcccctgcaggccctgcagacccagctgctgccccaggccctgcccccaccccagccccagctgcagcccccacccagcccccagcagatgccacccctggagaaggccagaattgctggggtgggcagcctgcccctgagcggcgtggaggagaagatgttcagcctgctgaagagggccaaggtgcagctgttcaagattgaccagcagcagcagcagaaggtggccgcctccatgcccctgagccctgggggccagatggaggaggtggccggggctgtgaagcagatcagtgaccggggccctgtgcgctcagaagatgagagcgtggaggccaagcgggagcggcccagcggccctgagagccctgtgcagggcccccgcatcaagcacgtgtgcagacatgctgctgtggccctgggccaggcccgggccatggtgcctgaagatgtgccccggctgagcgccctgcccctgcgggaccggcaggacctggccacagaggacaccagcagcgccagcgagacagaatctgtgcccagccgcagcagaagaggcaaggtggaggccgccggccctggaggagagagcgagcccactggaagtggcggcaccctggcccacaccccccggcgcagcctgcccagccaccacggcaagaagatgaggatggcccgctgtggccactgccggggctgcctgcgggtgcaggactgtggcagctgtgtgaactgcctggacaagcccaagtttggaggccccaacaccaagaagcagtgctgcgtgtacagaaaatgtgacaagattgaggccaggaagatggagcggctggccaagaagggccgcaccatcgtgaagaccctgctgccctgggacagtgatgagagccctgaggccagccctggccccccaggccccaggagaggagctggagctgggggcccccgggaggaggtggtggcccaccctggccctgaggagcaggacagcctgctgcagaggaagagcgcccggcgctgtgtgaagcagaggcccagctatgacatctttgaggacagtgatgattctgagcccggcggccccccagcccccaggaggaggaccccccgggagaatgagctgcccctgcctgagcctgaggagcagagccggcccaggaagcccaccctgcagcctgtgctgcagctgaaggcccggcggcggctggacaaggatgccctggcccctggcccctttgccagcttccccaacggctggacaggcaagcagaagagcccagatggagtgcaccgggtgcgggtggacttcaaggaggactgtgacctggagaatgtgtggctgatgggcggcctgtctgtgctgacctctgtgcctgggggcccccccatggtgtgcctgctgtgtgccagcaagggcctgcacgagctggtgttctgccaggtgtgctgtgaccccttccaccccttctgcctggaggaggccgagcggcccctgccccagcaccacgacacctggtgctgccgccgctgcaagttctgccacgtgtgtggcaggaagggccggggcagcaagcacctgctggagtgtgagcgctgcagacatgcctaccacccagcctgcctgggccccagctaccccacccgggccaccaggaagaggaggcactggatctgcagcgcctgtgtgcgctgcaagagctgtggggccacccctgggaagaactgggatgtggagtggagcggggactacagcctgtgcccccgctgcacccagctgtatgagaagggcaactactgccccatctgcacccgctgctatgaggacaatgactatgagagcaagatgatgcagtgtgcccagtgtgaccactgggtgcacgccaagtgtgagggcctgagtgatgaggactatgagatcctgagcggcctgcctgattctgtgctgtacacctgtggcccctgtgccggggccgcccagccccgctggagggaggccctgagcggggccctgcagggcggcctgcggcaggtgctgcagggcctgctgagcagcaaggtggtgggccccctgctgctgtgcacccagtgtggcccagatggcaagcagctgcaccctggcccctgtggcctgcaggccgtgtcccagagatttgaagatggccactacaagtctgtgcacagcttcatggaggacatggtgggcatcctgatgaggcacagcgaggagggggagaccccagacagaagagctgggggccagatgaagggcctgctgctgaagctgctggagagcgccttcggctggtttgatgcccatgaccccaagtactggaggaggagcacccggctgcccaacggggtgctgcccaatgctgtgctgccccccagcctggaccacgtgtatgcccagtggaggcagcaggagcctgagaccccagagagcggccagcccccaggggaccccagcgctgccttccagggcaaggaccctgctgccttcagccacctggaggacccccggcagtgtgccctgtgcctgaagtatggagatgctgacagcaaggaggccggccgcctgctgtacatcggccagaatgagtggacccacgtgaactgtgccatctggagcgctgaggtgtttgaagaaaatgatggcagcctgaagaatgtgcatgctgctgtggcccggggccggcagatgagatgtgagctgtgcctgaagccaggggccaccgtgggctgctgcctgagcagctgcctgagcaacttccacttcatgtgtgcccgggccagctactgcatcttccaggatgacaagaaggtgttctgccagaagcacacagacctgctggatggcaaggagatcgtgaacccagatggctttgatgtgctgcggcgggtgtatgtggactttgagggcatcaacttcaagaggaagttcctgaccggcctggagccagatgccatcaacgtgctgattggcagcatcagaattgacagcctgggcaccctgagtgacctgagtgactgtgagggccgcctcttccccatcggctaccagtgcagccggctgtactggagcacagtggatgcccggcggcgctgctggtaccgctgccgcatcctggagtaccggccctggggcccccgggaggagcccgcccacctggaggccgctgaggagaaccagaccatcgtgcacagccctgcccccagcagcgagcccccaggaggagaggacccccccctggacacagatgtgctggtgcctggggcccctgagcggcacagccccatccagaacctggacccccccctgcggccagattctggcagcgcccctcctccagcccccaggagcttcagcggggcccgcatcaaggtgcccaactacagccccagccggcggcccctgggcggcgtgtcctttggccccctgcccagccctggcagccccagcagcctgacccaccacatccccaccgtgggggaccctgacttccctgcccccccaagaagaagccggcggcccagccccctggccccccggcccccacccagccgctgggccagcccccccctgaagaccagcccccagctgcgggtgcccccacccacctctgtggtgacagccctgacccccaccagcggggagctggcccctcctggccctgcccccagccccccacctcctgaggacctgggccctgactttgaggacatggaggtggtgtctggcctgtctgctgctgacctggactttgctgccagcctgctgggcacagagcccttccaggaggagatcgtggccgccggggccatgggcagcagccatggaggccctggggacagcagcgaggaggagagcagccccaccagccgctacatccacttccctgtgacagtggtgtctgcccctggcctggcccccagcgccacccctggggccccccgcatcgagcagctggatggagtggatgatggaacagacagcgaggccgaggccgtgcagcagccccggggccagggcaccccacccagcggccctggggtggtgcgggccggcgtgctgggcgctgctggggaccgggcccggcccccagaggacctgcccagcgagatcgtggactttgtgctgaagaacctgggcggccctggagatggaggagctggcccccgggaggagagcctgcccccagccccacccctggccaacggcagccagcccagccagggcctgacagccagccctgctgaccccaccaggacctttgcctggctgcccggggcccctggggtgcgggtgctgagcctgggccctgcccctgagccccccaagccagccaccagcaagatcatcctggtgaacaagctgggccaggtgtttgtgaagatggccggggagggggagcctgtgcccccacctgtgaagcagccccccctgccccccaccatcagccccacagcccccacctcctggaccctgcccccaggccccctgctgggcgtgctgcctgtggtgggcgtggtgcggcctgcccctcctcctcctcctccacccctgaccctggtgctgagcagcggccctgccagccccccccggcaggccatccgggtgaagagggtgtccaccttcagcggccgcagccccccagcccccccaccctacaaggccccccggctggatgaagatggagaggccagcgaggacaccccccaggtgcccggcctgggcagcggcggcttcagccgggtgaggatgaagacccccaccgtgcggggcgtgctggacctggacaggcctggagagcctgctggggaggagagccctggccccctgcaggagaggagccccctgctgcccctgcctgaagatggccccccccaggtgcctgatggccccccagacctgctgctggagagccagtggcaccactacagcggggaggccagcagcagcgaggaggagccccccagcccagatgacaaggagaaccaggcccccaagaggacaggcccccacctgcgctttgagatcagcagtgaagatggcttctctgtggaggccgagagcctggagggcgcctggaggaccctgattgagaaggtgcaggaggcccggggccacgcccggctgcggcacctgtccttcagcggcatgtctggggcccggctgctgggcatccaccatgatgctgtgatcttcctggccgagcagctgcccggggcccagcgctgccagcactacaagttccgctaccaccagcagggcgagggccaggaggagccccccctgaacccccatggagctgcccgggcagaggtgtacctgaggaagtgcacctttgacatgttcaacttcctggccagccagcaccgggtgctgcctgagggcgccacctgtgatgaggaggaggatgaggtgcagctgcggagcacccggcgggccaccagcctggagctgcccatggccatgaggttccgccacctgaagaagaccagcaaggaggccgtgggcgtgtaccgcagcgccatccacggccggggcctcttctgcaagagaaatattgatgctggggagatggtgattgagtacagcggcatcgtcatccgctctgtgctgacagacaagcgggagaagttctatgatggcaagggcatcggctgctacatgttcaggatggatgactttgatgtggtggatgccaccatgcacggcaatgctgcccgcttcatcaaccacagctgtgagcccaactgcttcagcagggtcatccacgtggagggccagaagcacatcgtcatctttgccctgcggcgcatcctgcggggggaggagctgacctatgactacaagttccccattgaagatgccagcaacaagctgccctgcaactgtggggccaagcgctgccgccgcttcctgaactag

SEQ ID NO: 15775 - DNA, 2892 bp, Artificial Sequence
  Description of Artificial Sequence: Synthetic coding sequence
atggctgtggccccccggctgtttggaggcctgtgcttccgcttccgggaccagaaccctgaggtggccgtggagggccgcctgcccatcagccacagctgtgtgggctgccggcgggagaggacagccatggccaccgtggccgccaacccagctgctgctgctgctgctgtggccgctgctgctgctgtgacagaggaccgggagccccagcacgaggagctgcccggcctggacagccagtggaggcagattgaaaatggagagagcggccgggagcggcccctgcgggccggggagagctggttcctggtggagaagcactggtacaagcagtgggaggcctacgtgcagggcggggaccaggacagcagcaccttccctggctgcatcaacaatgccaccctcttccaggatgagatcaactggaggctgaaggagggcctggtggagggagaagattatgtgctgctgcctgctgctgcctggcactacctggtgtcctggtacggcctggagcacggccagccccccattgaaaggaaggtgattgagctgcccaacatccagaaggtggaggtgtaccctgtggagctgctgctggtgcgccacaatgacctgggcaagagccacacagtgcagttcagccacacagacagcatcggcctggtgctgaggacagcccgggagcgcttcctggtggagccccaggaggacacccggctgtgggccaagaacagcgagggcagcctggaccggctgtatgacacccacatcaccgtgctggatgctgccctggagaccggccagctgatcatcatggagaccaggaagaaggatggcacctggcccagcgcccagctgcacgtgatgaacaacaacatgtctgaggaggatgaggacttcaagggccagcccggcatctgtggcctgaccaacctgggcaacacctgcttcatgaacagcgccctgcagtgcctgagcaatgtgccccagctgacagagtacttcctgaacaactgctacctggaggagctgaacttcaggaaccccctgggcatgaagggggagattgctgaggcctatgctgacctggtgaagcaggcctggagcggccaccacaggagcatcgtgccccacgtgttcaagaacaaggtgggccactttgccagccagttcctgggctaccagcagcacgacagccaggagctgctgtccttcctgctggatggcctgcacgaggacctgaacagagtgaagaagaaggagtatgtggagctgtgtgatgctgctggccgcccagaccaggaggtggcccaggaggcctggcagaaccacaagagaagaaatgacagcgtcatcgtggacaccttccacggcctcttcaagagcaccctggtgtgcccagactgtggaaatgtgtctgtgacctttgaccccttctgctacctgtctgtgcccctgcccatcagccacaagagggtgctggaggtgttcttcatccccatggaccccaggaggaagccagagcagcaccggctggtggtgcccaagaagggcaagatcagtgacctgtgtgtggccctgagcaagcacacaggcatcagccctgagaggatgatggtggctgatgtgttcagccaccgcttctacaagctgtaccagctggaggagcccctgagcagcatcctggacagagatgacatctttgtgtatgaggtgtctggccgcatcgaggccatcgagggcagccgggaggacatcgtggtgcctgtgtacctgcgggagaggaccccagcccgggactacaacaacagctactacggcctgatgctgtttggccaccccctgctggtgtctgtgccccgggaccgcttcacctgggagggcctgtacaacgtgctgatgtaccgcctgagccgctacgtgaccaagcccaacagtgatgatgaagatgatggagatgagaaggaggatgatgaggaggacaaggatgatgtgcccggccccagcactggaggcagcctgcgggaccctgagcctgagcaggccggccccagcagcggcgtgaccaaccgctgccccttcctgctggacaactgcctgggcaccagccagtggccacccaggagaagaaggaagcagctgttcaccctgcagacagtgaacagcaatggcaccagtgacaggaccaccagccctgaggaggtgcacgcccagccctacatcgccatcgactgggagcctgagatgaagaagcgctactatgatgaggtggaggccgagggctacgtgaagcatgactgtgtgggctacgtgatgaagaaggcccctgtgcggctgcaggagtgcatcgagctgttcaccaccgtggagaccctggagaaggagaacccctggtactgccccagctgcaagcagcaccagctggccaccaagaagctggacctgtggatgctgcctgagatcctgatcatccacctgaagcgcttctcctacaccaagttcagccgggagaagctggacaccctggtggagttccccatccgggacctggacttcagcgagtttgtgatccagccccagaatgaaagcaaccctgagctgtacaagtatgacctgattgctgtgagcaaccactatggaggcatgagagatggccactacaccacctttgcctgcaacaaggacagcggccagtggcactactttgatgacaacagcgtgtcccctgtgaatgaaaaccagatcgagagcaaggccgcctacgtgctcttctaccagaggcaggatgtggcccggcggctgctgagccctgctggcagcagcggggccccagccagccctgcctgcagcagcccccccagcagcgagttcatggatgtgaactag

SEQ ID NO: 15776 - DNA, 2166 bp, Artificial Sequence
  Description of Artificial Sequence: Synthetic coding sequence
atgagcggcaccaacctggatggaaatgatgaatttgatgagcagctgaggatgcaggagctgtatggagatggcaaggatggagacacccagacagatgctggaggagagccagacagcctgggccagcagcccacagacaccccctatgagtgggacctggacaagaaggcctggttccccaagatcacagaggacttcatcgccacctaccaggccaactacggcttcagcaatgatggagccagcagcagcacagccaacgtggaggatgtgcacgccaggacagctgaggagcccccccaggagaaggcccctgagcccacagatgccaggaagaagggggagaagaggaaggccgagagcggctggttccacgtggaggaggacaggaacaccaacgtgtatgtgtctggcctgcccccagacatcaccgtggatgagttcatccagctgatgagcaagtttggcatcatcatgagggacccccagacagaggagttcaaggtgaagctgtacaaggacaaccagggcaacctgaagggagatggcctgtgctgctacctgaagcgggagagcgtggagctggccctgaagctgctggatgaagatgagatccggggctacaagctgcacgtggaggtggccaagttccagctgaagggggagtatgatgccagcaagaagaagaagaagtgcaaggactacaagaagaagctgtccatgcagcagaagcagctggactggaggcctgagaggagagctggccccagcaggatgagacatgagcgggtggtgatcatcaagaacatgttccaccccatggactttgaagatgaccccctggtgctgaatgagatccgggaggacctgcgggtggagtgcagcaagtttggccagatcaggaagctgctgctgtttgacagacacccagatggagtggcctctgtgtccttccgggaccctgaggaggccgactactgcatccagaccctggatggccgctggtttggaggccggcagatcacagcccaggcctgggatggcaccacagactaccaggtggaggagaccagccgggagcgggaggagcggctgcggggctgggaggccttcctgaatgcccctgaggccaacagaggcctgcggcggagtgacagcgtgtctgccagcgagcgggccggccccagccgggcccggcacttcagcgagcaccccagcaccagcaagatgaatgcccaggagacagccaccggcatggcctttgaggagcccattgatgagaagaagtttgagaagacagaagatggaggagaatttgaggagggcgccagcgagaacaatgccaaggagagcagccctgagaaggaggccgaggagggctgcccagagaaggagagcgaggagggctgccccaagaggggctttgagggcagctgcagccagaaggagagcgaggagggcaaccctgtgcggggcagcgaggaggacagccccaagaaggagagcaagaagaagaccctgaagaatgactgtgaggagaatggcctggccaaggagagtgaagatgacctgaacaaggagagcgaggaggaggtgggccccaccaaggagagtgaagaagatgacagcgagaaggagagtgatgaggactgcagcgagaagcagagtgaagatggcagcgagcgggagtttgaagaaaatggcctggagaaggacctggatgaggagggcagcgagaaggagctgcatgaaaatgtgctggacaaggagctggaggagaatgattctgagaacagcgagtttgaagatgatggcagcgagaaggtgctggatgaggagggcagcgagcgggagtttgatgaggacagtgatgagaaggaggaggaggaggacacctatgagaaggtgtttgatgatgaaagtgatgagaaggaggatgaagatgctgatggcaaggaggtggaggatgctgatgagaagctgtttgaagatgatgacagcaatgagaagctgtttgatgaggaggaggacagcagcgagaagctgtttgatgacagtgatgagcggggcaccctgggcggcttcggctctgtggaggagggccccctgagcacaggcagcagcttcatcctgagcagtgatgatgatgatgatgacatctag

SEQ ID NO: 15777 - DNA, 672 bp, Artificial Sequence
  Description of Artificial Sequence: Synthetic coding sequence
atgagcggcaccaacctggatggaaatgatgaatttgatgagcagctgaggatgcaggagctgtatggagatggcaaggatggagacacccagacagatgctggaggagagccagacagcctgggccagcagcccacagacaccccctatgagtgggacctggacaagaaggcctggttccccaagatcacagaggacttcatcgccacctaccaggccaactacggcttcagcaatgatggagccagcagcagcacagccaacgtggaggatgtgcacgccaggacagctgaggagcccccccaggagaaggcccctgagcccacagatgccaggaagaagggggagaagaggaaggccgagagcggctggttccacgtggaggaggacaggaacaccaacgtgtatgtgtctggcctgcccccagacatcaccgtggatgagttcatccagctgatgagcaagtttggcatcatcatgagggacccccagacagaggagttcaaggtgaagctgtacaaggacaaccagggcaacctgaagggagatggcctgtgctgctacctgaagcgggagagcgtggagctggccctgaagctgctggatgaagatgagatccggggctacaagctgcacgtggaggtggccaagttccagctgaagggggagtag

SEQ ID NO: 15778 - DNA, 735 bp, Artificial Sequence
  Description of Artificial Sequence: Synthetic coding sequence
atgagcggcaccaacctggatggaaatgatgaatttgatgagcagctgaggatgcaggagctgtatggagatggcaaggatggagacacccagacagatgctggaggagagccagacagcctgggccagcagcccacagacaccccctatgagtgggacctggacaagaaggcctggttccccaagatcacagaggacttcatcgccacctaccaggccaactacggcttcagcaatgatggagccagcagcagcacagccaacgtggaggatgtgcacgccaggacagctgaggagcccccccaggagaaggcccctgagcccacagatgccaggaagaagggggagaagaggaaggccgagagcggctggttccacgtggaggaggacaggaacaccaacgtgtatgtgtctggcctgcccccagacatcaccgtggatgagttcatccagctgatgagcaagtttggcatcatcatgagggacccccagacagaggagttcaaggtgaagctgtacaaggacaaccagggcaacctgaagggagatggcctgtgctgctacctgaagcgggagagcgtggagctggccctgaagctgctggatgaagatgagatccggggctacaagctgcacgtggaggtggccaagttccagctgaagggggagtatgatgccagcaagaagaagaagaagtgcaaggactacaagaagaagctgtccatgcagcagtag

SEQ ID NO: 15779 - DNA, 2268 bp, Artificial Sequence
  Description of Artificial Sequence: Synthetic coding sequence
atgagcggcaccaacctggatggaaatgatgaatttgatgagcagctgaggatgcaggagctgtatggagatggcaaggatggagacacccagacagatgctggaggagagccagacagcctgggccagcagcccacagacaccccctatgagtgggacctggacaagaaggcctggttccccaagatcacagaggacttcatcgccacctaccaggccaactacggcttcagcaatgatggagccagcagcagcacagccaacgtggaggatgtgcacgccaggacagctgaggagcccccccaggagaaggcccctgagcccacagatgccaggaagaagggggagaagaggaaggccgagagcggctggttccacgtggaggaggacaggaacaccaacgtgtatgtgtctggcctgcccccagacatcaccgtggatgagttcatccagctgatgagcaagtttggcatcatcatgagggacccccagacagaggagttcaaggtgaagctgtacaaggacaaccagggcaacctgaagggagatggcctgtgctgctacctgaagcgggagagcgtggagctggccctgaagctgctggatgaagatgagatccggggctacaagctgcacgtggaggtggccaagttccagctgaagggggagtatgatgccagcaagaagaagaagaagtgcaaggactacaagaagaagctgtccatgcagcagaagcagctggactggaggcctgagaggagagctggccccagcaggatgagacatgagcgggtggtgatcatcaagaacatgttccaccccatggactttgaagatgaccccctggtgctgaatgagatccgggaggacctgcgggtggagtgcagcaagtttggccagatcaggaagctgctgctgtttgacagacacccagatggagtggcctctgtgtccttccgggaccctgaggaggccgactactgcatccagaccctggatggccgctggtttggaggccggcagatcacagcccaggcctgggatggcaccacagactaccaggtggaggagaccagccgggagcgggaggagcggctgcggggctgggaggccttcctgaatgcccctgaggccaacagaggcctgcggcggagtgacagcgtgtctgccagcgagcgggccggccccagccgggcccggcacttcagcgagcaccccagcaccagcaagatgaatgcccaggagacagccaccggcatggcctttgaggagcccattgatgagaagaagtttgagaagacagaagatggaggagaatttgaggagggcgccagcgagaacaatgccaaggagagcagccctgagaaggaggccgaggagggctgcccagagaaggagagcgaggagggctgccccaagaggggctttgagggcagctgcagccagaaggagagcgaggagggcaaccctgtgcggggcagcgaggaggacagccccaagaaggagagcaagaagaagaccctgaagaatgactgtgaggagaatggcctggccaaggagagtgaagatgacctgaacaaggagagcgaggaggaggtgggccccaccaaggagagtgaagaagatgacagcgagaaggagagtgatgaggactgcagcgagaagcagagtgaagatggcagcgagcgggagtttgaagaaaatggcctggagaaggacctggatgaggagggcagcgagaaggagctgcatgaaaatgtgctggacaaggagctggaggagaatgattctgagaacagcgagtttgaagatgatggcagcgagaaggtgctggatgaggagggcagcgagcgggagtttgatgaggacagtgatgagaaggaggaggaggaggacacctatgagaaggtgtttgatgatgaaagtgatgagaaggaggatgaggagtatgcagatgagaagggcctggaggccgctgacaagaaggccgaggagggagatgctgatgagaagctgtttgaggagagtgatgacaaggaggatgaagatgctgatggcaaggaggtggaggatgctgatgagaagctgtttgaagatgatgacagcaatgagaagctgtttgatgaggaggaggacagcagcgagaagctgtttgatgacagtgatgagcggggcaccctgggcggcttcggctctgtggaggagggccccctgagcacaggcagcagcttcatcctgagcagtgatgatgatgatgatgacatctag

SEQ ID NO: 15780 - DNA, 3879 bp, Artificial Sequence
  Description of Artificial Sequence: Synthetic coding sequence
atggatgccagctatgatggaacagaggtgacagtggtgatggaggagattgaggaggcctactgctacaccagccctggcccccccaagaagaagaagaagtacaagatccacggggagaagaccaagaagcccaggtctgcctacctgctgtactactatgacatctacctgaaggtgcagcaggagctgccccacctgccccagagcgagatcaacaagaagatcagcgagagctggaggctgctgtctgtggccgagaggagctactacctggagaaggccaagctggagaaggagggcctggaccccaacagcaagctgagcgccctgacagctgtggtgcctgacatccctggcttcaggaagatcctgcccaggagtgactacatcatcatccccaagagcagcctgcaggaggacaggagctgcccccagctggagctgtgtgtggcccagaaccagatgagccccaagggcccccccctggtgagcaacacagcccctgagaccgtgcccagccacgccggcatggccgagcagtgcctggccgtggaggccctggccgaggaggtgggcgccctgacccagagcggggctgtgcaggagatcgccaccagcgagatcctgagccaggatgtgctgctggaggatgccagcctggaggtgggggagagccaccagccctaccagaccagcctggtgattgaggagaccctggtgaatggcagcccagacctgcccaccggcagcctggccgtgccccacccccaggtgggggagagcgtgtctgtggtgacagtgatgagggacagcagcgagagcagcagcagcgccccagccacccagttcatcatgctgcccctgcctgcctacagcgtggtggagaaccccaccagcatcaagctgaccaccacctacacccggcggggccacggcacctgcaccagccctggctgcagcttcacctacgtgaccaggcacaagccacccaagtgccccacctgtggcaacttcctgggcggcaagtggatccccaaggagaagccagccaaggtgaaggtggagctggccagcggcgtgagcagcaagggctctgtggtgaagaggaaccagcagcctgtgaccacagagcagaacagcagcaaagaaaatgccagcaagctgaccctggagaacagcgaggccgtgtcccagctgctgaatgtggccccaccccgggaggtgggggaggagagcgagtgggaggaggtgatcatcagtgatgcccacgtgctggtgaaggaggcccctggcaactgtggcacagctgtgaccaagacccctgtggtgaagagcggcgtgcagcctgaggtgaccctgggcaccacagacaatgacagccctggagcagatgtgcccacccccagcgagggcaccagcaccagcagccccctgcctgcccccaagaagcccaccggggctgacctgctgaccccaggcagccgggcccctgagctgaagggccgggcccggggcaagcccagcctgctggccgccgcccggcccatgagggccatcctgcctgcccctgtgaatgtgggccggggcagctccatgggcctgccccgggcccggcaggccttcagcctgagtgacaagacccccagcgtgaggacctgtggcctgaagcccagcaccctgaagcagctgggccagcccatccagcagcccagcggccctggagaggtgaagctgcccagcggccccagcaacagaaccagccaggtgaaggtggtggaggtgaagccagacatgtttcctccctacaagtacagctgcaccgtgaccctggacctgggcctggccaccagccggggccggggcaagtgcaagaaccccagctgcagctatgtgtacaccaacagacacaagccccgcatctgccccagctgtggggtgaacctggccaaggacagaacagagaagaccaccaaggccatcgaggtgagcagccccctgcctgatgtgctgaatgccacagagcccctgagcacagcccagcgggagatccagaggcagagcaccctgcagctgctgaggaaggtgctgcagatcccagaaaatgaaagtgagctggccgaggtgtttgccctgatccacgagctgaacagcagccgcctcatcctgagcaatgtgtctgaggagaccgtgaccatcgagcagacctcctggagcaactactatgagagccccagcacccagtgcctgctgtgcagcagccccctcttcaagggcggccagaacagcctggccggcccccaggagtgctggctgctgacagccagccggctgcagacagtgacagcccaggtgaagatgtgcctgaacccccactgcctggccctgcacagcttcatcgacatctacacaggcctcttcaacgtgggcaacaagctgctggtgtccctggacctgctgtttgccatccggaaccagatcaagctgggggaggacccccgggtgtccatcaacgtggtgctgaagtctgtgcaggagcagacagagaagaccctgaccagcgaggagctgagccagctgcaggagctgctgtgcaatggctactgggcctttgagtgcctgactgtgcgggactacaatgacatgatctgtggcatctgtggggtggcccccaaggtggagatggcccagaggagtgaagaaaatgtgctggccctgaagtctgtggagttcacctggccagagttcctgggcagcaatgaggtgaatgtggaggacttctgggccaccatggagacagaggtgattgagcaggtggccttccctgccagcatccccatcaccaagtttgatgcctctgtgattgcccccttcttcccccccctgatgagaggagctgtggtggtgaacacagagaaggacaagaacctggatgtgcagcctgtgcccggcagcggcagcgccctggtgcggctgctgcaggagggcacctgcaagctggatgaaattggcagctacagcgaggagaagctgcagcacctgctgcggcagtgtggcatcccctttggagctgaggacagcaaggaccagctgtgcttcagcctgctggccctgtatgaatctgtgcagaatggagcccgggccatccggcccccaagacacttcaccggcggcaagatctacaaggtgtgcccccaccaggtggtgtgtggcagcaagtacctggtgcggggggagagcgcccgggaccacgtggacctgctggccagcagccgccactggccccctgtgtatgtggtggacatggccacctctgtggccctgtgtgccgacctgtgctacccagagctgaccaaccagatgtggggcaggaaccagggctgcttcagcagccccacagagccccctgtgtctgtgtcctgcccagagctgctggaccagcactacacagtggacatgacagaaacagagcacagcatccagcaccctgtgaccaagacagccacccggcgcatcgtgcatgctggcctgcagcccaaccctggggaccccagcgctggccaccacagcctggccctgtgcccagagctggccccctatgccaccatcctggccagcatcgtggacagcaagcccaatggagtgcggcagaggcccatcgcctttgacaatgccacccactactacctgtacaaccggctgatggacttcctgaccagccgggagatcgtgaaccggcagatccatgacatcgtgcagagctgccagcctggagaggtggtgatccgggacaccctgtaccgcctgggcgtggcccagatcaagacagaaacagaggaggagggggaggaggaggaggtggccgctgtggccgagtag

SEQ ID NO: 15781 - DNA, 2310 bp, Artificial Sequence
  Description of Artificial Sequence: Synthetic coding sequence
atgtgtggcagcgccctggccttcttcaccgctgcctttgtgtgcctgcagaatgaccggcggggccctgccagcttcctgtgggccgcctgggtgttcagcctggtgctgggcctgggccagggcgaggacaacagatgtgccagcagcaatgctgccagctgtgcccgctgcctggccctgggcccagaatgtggctggtgtgtgcaggaggacttcatcagcggcggcagccgctctgagcgctgtgacatcgtgagcaacctgatcagcaagggctgcagcgtggacagcattgagtaccccagcgtgcacgtgatcatccccacagaaaatgagatcaacacccaggtgaccccaggagaggtgtccatccagctgcggcctggagctgaggccaacttcatgctgaaggtgcaccccctgaagaagtaccctgtggacctgtactacctggtggatgtgtctgcctccatgcacaacaacatcgagaagctgaacagcgtgggcaatgacctgagcaggaagatggccttcttcagccgggacttccggctgggcttcggcagctatgtggacaagacagtgagcccctacatcagcatccaccctgagcgcatccacaaccagtgcagcgactacaacctggactgcatgccaccccacggctacatccacgtgctgagcctgacagagaacatcacagaatttgagaaggctgtgcaccggcagaagatcagcggcaacatcgacaccccagagggcggctttgatgccatgctgcaggccgctgtgtgtgagagccacatcggctggaggaaggaggccaagaggctgctgctggtgatgacagaccagaccagccacctggccctggacagcaagctggccggcatcgtggtgcccaatgatggcaactgccacctgaagaacaacgtgtatgtgaagagcaccaccatggagcaccccagcctgggccagctgtctgagaagctgattgacaacaacatcaacgtcatctttgctgtgcagggcaagcagttccactggtacaaggacctgctgcccctgctgcccggcaccatcgccggggagattgagagcaaggccgccaacctgaacaacctggtggtggaggcctaccagaagctgatcagcgaggtgaaggtgcaggtggagaaccaggtgcagggcatctacttcaacatcacagccatctgcccagatggcagcaggaagccaggcatggagggctgcagaaatgtgaccagcaatgatgaggtgctcttcaacgtgacagtgaccatgaagaagtgtgatgtgactggaggcaagaactatgccatcatcaagcccatcggcttcaatgaaacagccaagatccacatccacaggaactgcagctgccagtgtgaggacaacagaggccccaagggcaaatgtgtggatgagaccttcctggacagcaagtgcttccagtgtgatgagaacaagtgccactttgatgaggaccagttcagcagcgagagctgcaagagccacaaggaccagcctgtgtgcagcggccggggcgtgtgtgtgtgtgggaagtgcagctgccacaagatcaagctgggcaaggtgtatggcaagtactgtgagaaggatgacttcagctgcccctaccaccacggcaacctgtgtgccggccacggggagtgtgaggccggccgctgccagtgcttcagcggctgggagggggaccgctgccagtgccccagcgctgctgcccagcactgtgtgaacagcaagggccaggtgtgcagcggccggggcacctgtgtgtgtggccgctgtgaatgtacagaccccaggagcatcggccgcttctgtgagcactgccccacctgctacacagcctgcaaggagaactggaactgcatgcagtgcctgcacccccacaacctgagccaggccatcctggaccagtgcaagaccagctgtgccctgatggagcagcagcactacgtggaccagaccagcgagtgcttcagcagccccagctacctgcgcatcttcttcatcatcttcatcgtgaccttcctgattggcctgctgaaggtgctgatcatccggcaggtgatcctgcagtggaacagcaacaagatcaagagcagcagtgactacagagtgtctgccagcaagaaggacaagctgatcctgcagagcgtgtgcaccagggctgtgacctacagaagagagaagccagaggagatcaagatggacatcagcaagctgaatgcccacgagaccttccgctgcaacttctag

SEQ ID NO: 15782 - DNA, 375 bp, Artificial Sequence
  Description of Artificial Sequence: Synthetic coding sequence
atggtgtgggaggtgaagaccaaccagatgcccaatgctgtgcagaagctgctgctggtgatggacaagagggccagcggcatgaatgacagcctggagctgctgcagtgcaatgaaaacctgcccagcagccctggctacaacagctgtgatgagcacatggagctggatgacctgcctgagctgcaggccgtgcagagcgaccccacccagagcggcatgtaccagctgagcagtgatgtgagccaccaggagtaccccaggagctcctggaaccagaacaccagtgacatccctgagaccacctacagagaaaatgaggtggactggctgacagagctggccaacatcgccaccagcccccagagcccctag

SEQ ID NO: 15783 - DNA, 87 bp, Artificial Sequence
  Description of Artificial Sequence: Synthetic coding sequence
atggtgtgggaggtgaagaccaaccagatgcccaatgctgtgcagaagctgctgctggtgatggacaagagggccagcggcatgtag

SEQ ID NO: 15784 - DNA, 1545 bp, Artificial Sequence
  Description of Artificial Sequence: Synthetic coding sequence
atggtgtgggaggtgaagaccaaccagatgcccaatgctgtgcagaagctgctgctggtgatggacaagagggccagcggcatgaatgacagcctggagctgctgcagtgcaatgaaaacctgcccagcagccctggctacaacagctgtgatgagcacatggagctggatgacctgcctgagctgcaggccgtgcagagcgaccccacccagagcggcatgtaccagctgagcagtgatgtgagccaccaggagtaccccaggagctcctggaaccagaacaccagtgacatccctgagaccacctacagagaaaatgaggtggactggctgacagagctggccaacatcgccaccagcccccagagccccctgatgcagtgcagcttctacaacagaagcagccctgtgcacatcatcgccaccagcaagagcctgcacagctatgcccggcccccacctgtgagcagcagcagcaagtctgagcccgccttcccccaccaccactggaaggaggagacccctgtgagacatgagcgggccaacagcgagagcgagagcggcatcttctgcatgagcagcctgagtgatgatgatgacctgggctggtgcaacagctggcccagcacagtgtggcactgcttcctgaagggcacccggctgtgcttccacaagggcagcaacaaggagtggcaggatgtggaggactttgcccgggcagagggctgtgacaatgaggaggacctgcagatgggcatccacaagggctacggcagtgatggcctgaagctgctgagccatgaggagagcgtgtcctttggagagagcgtgctgaagctgacctttgaccccggcaccgtggaggatggcctgctgactgtggagtgcaagctggaccaccccttctacgtgaagaacaagggctggagcagcttctaccccagcctgactgtggtgcagcacggcatcccctgctgtgaggtgcacatcggagatgtgtgcctgcccccaggccacccagatgccatcaactttgatgacagcggcgtgtttgacaccttcaagagctatgacttcacccccatggacagcagcgctgtgtatgtgctgagctccatggcccggcagaggcgggccagcctgagctgtggcggccctgggggccaggactttgcccggagcggcttcagcaagaactgtggcagccctggcagcagccagctgagcagcaacagcctgtatgccaaggctgtgaagaaccacagcagcggcaccgtgtctgccaccagccccaacaagtgcaagaggcccatgaatgccttcatgctgtttgccaagaagtacagagtggagtacacccagatgtacccaggcaaggacaacagagccatcagcgtcatcctgggggaccgctggaagaagatgaagaatgaggagaggaggatgtacaccctggaggccaaggccctggccgaggagcagaagaggctgaacccagactgctggaagaggaagaggaccaacagcggcagccagcagcactag

SEQ ID NO: 15785 - DNA, 213 bp, Artificial Sequence
  Description of Artificial Sequence: Synthetic coding sequence
atggtgtgggaggtgaagaccaaccagatgcccaatgctgtgcagaagctgctgctggtgatggacaagagggccagcggcatgaatgacagcctggagctgctgcagtgcaatgaaaacctgcccagcagccctggctacaacagctgtgatgagcacatggagctggatgacctgcctgagctgcaggccgtgcagagcgaccccacctag

SEQ ID NO: 15786 - DNA, 336 bp, Artificial Sequence
  Description of Artificial Sequence: Synthetic coding sequence
atggtgtgggaggtgaagaccaaccagatgcccaatgctgtgcagaagctgctgctggtgatggacaagagggccagcggcatgaatgacagcctggagctgctgcagtgcaatgaaaacctgcccagcagccctggctacaacagctgtgatgagcacatggagctggatgacctgcctgagctgcaggccgtgcagagcgaccccacccagagcggcatgtaccagctgagcagtgatgtgagccaccaggagtaccccaggagctcctggaaccagaacaccagtgacatccctgagaccacctacagagaaaatgaggtggactggctgtag

SEQ ID NO: 15787 - DNA, 1545 bp, Artificial Sequence; identical to SEQ ID NO: 15784
  Description of Artificial Sequence: Synthetic coding sequence

SEQ ID NO: 15788 - DNA, 327 bp, Artificial Sequence
  Description of Artificial Sequence: Synthetic coding sequence
atggtgtgggaggtgaagaccaaccagatgcccaatgctgtgcagaagctgctgctggtgatggacaagagggccagcggcatgaatgacagcctggagctgctgcagtgcaatgaaaacctgcccagcagccctggctacaacagctgtgatgagcacatggagctggatgacctgcctgagctgcaggccgtgcagagcgaccccacccagagcggcatgtaccagctgagcagtgatgtgagccaccaggagtaccccaggagctcctggaaccagaacaccagtgacatccctgagaccacctacagagaaaatgaggtgtag

SEQ ID NO: 15789 - DNA, 1365 bp, Artificial Sequence
  Description of Artificial Sequence: Synthetic coding sequence
cagatgcccaatgctgtgcagaagctgctgctggtgatggacaagagggccagcggcatgaatgacagcctggagctgctgcagtgcaatgaaaacctgcccagcagccctggctacaacagctgtgatgagcacatggagctggatgacctgcctgagctgcaggccgtgcagagcgaccccacccagagcggcatgtaccagctgagcagtgatgtgagccaccaggagtaccccaggagctcctggaaccagaacaccagtgacatccctgagaccacctacagagaaaatgaggtggactggctgacagagctggccaacatcgccaccagcccccagagccccctgatgcagtgcagcttctacaacagaagcagccctgtgcacatcatcgccaccagcaagagcctgcacagctatgcccggcccccacctgtgagcagcagcagcaagtctgagcccgccttcccccaccaccactggaaggaggagacccctgtgagacatgagcgggccaacagcgagagcgagagcggcatcttctgcatgagcagcctgagtgatgatgatgacctgggctggtgcaacagctggcccagcacagtgtggcactgcttcctgaagggcacccggctgtgcttccacaagggcagcaacaaggagtggcaggatgtggaggactttgcccgggcagagggctgtgacaatgaggaggacctgcagatgggcatccacaagggctacggcagtgatggcctgaagctgctgagccatgaggagagcgtgtcctttggagagagcgtgctgaagctgacctttgaccccggcaccgtggaggatggcctgctgactgtggagtgcaagctggaccaccccttctacgtgaagaacaagggctggagcagcttctaccccagcctgactgtggtgcagcacggcatcccctgctgtgaggtgcacatcggagatgtgtgcctgcccccaggccacccagatgccatcaactttgatgacagcggcgtgtttgacaccttcaagagctatgacttcacccccatggacagcagcgctgtgtatgtgctgagctccatggcccggcagaggcgggccagcctgagctgtggcggccctgggggccaggactttgcccggagcggcttcagcaagaactgtggcagccctggcagcagccagctgagcagcaacagcctgtatgccaaggctgtgaagaaccacagcagcggcaccgtgtctgccaccagccccaacaagtgcaagaggcccatgaatgccttcatgctgtttgccaagaagtacagagtggagtacacccagatgtacccaggcaaggacaacagatag

SEQ ID NO: 15790 - DNA, 1332 bp, Artificial Sequence
  Description of Artificial Sequence: Synthetic coding sequence
atgcagaaggccacctactatgacagcagcgccatctatggaggctacccctaccaggccgccaacggctttgcctacaatgccaaccagcagccctacccagccagcgctgccctgggcgcagatggagagtaccacaggcctgcctgcagcctgcagagccccagcagcgctgggggccaccccaaggcccacgagctgtctgaggcctgcctgcggaccctgagcgccccacccagccagccccccagcctgggggagccccccctgcaccccccaccaccccaggccgcccccccagccccccagcccccccagcctgccccccagcccccagcccccaccccagctgcccctcctccacccagcagcgccagccccccccagaatgccagcaacaaccccaccccagccaatgctgccaagagccccctgctgaacagccccaccgtggccaagcagatcttcccctggatgaaggagagccggcagaacaccaagcagaagaccagcagcagcagcagtggagagagctgtgccggggacaagagccccccaggccaggccagcagcaagagggccaggacagcctacaccagcgcccagctggtggagctggagaaggagttccacttcaaccgctacctgtgccggccccggcgggtggagatggccaacctgctgaacctgacagagcggcagatcaagatctggttccagaacagaaggatgaagtacaagaaggaccagaagggcaagggcatgctgaccagcagcggcggccagagccccagccgcagccctgtgcccccaggagctgggggctacctgaacagcatgcacagcctggtgaacagcgtgccctatgagccccagagccccccacccttcagcaagccaccccagggcacctacggcctgcccccagccagctacccagccagcctgcccagctgtgcccctcctcctccaccccagaagcgctacacagctgctggggccggggccggcggcaccccagactatgacccccacgcccacggcctgcagggcaatggcagctatggcaccccccacatccagggcagccctgtgtttgtgggcggcagctatgtggagcccatgagcaacagcggccctgccctgtttggcctgacccacctgccccatgctgccagcggggccatggactatggaggagctggccccctgggcagcggccaccaccacggccctggccctggagagccccaccccacctacacagacctgaccggccaccaccccagccagggccgcatccaggaggcccccaagctgacccacctgtag

SEQ ID NO: 15791 - DNA, 858 bp, Artificial Sequence
  Description of Artificial Sequence: Synthetic coding sequence
atgaaggagagccggcagaacaccaagcagaagaccagcagcagcagcagtggagagagctgtgccggggacaagagccccccaggccaggccagcagcaagagggccaggacagcctacaccagcgcccagctggtggagctggagaaggagttccacttcaaccgctacctgtgccggccccggcgggtggagatggccaacctgctgaacctgacagagcggcagatcaagatctggttccagaacagaaggatgaagtacaagaaggaccagaagggcaagggcatgctgaccagcagcggcggccagagccccagccgcagccctgtgcccccaggagctgggggctacctgaacagcatgcacagcctggtgaacagcgtgccctatgagccccagagccccccacccttcagcaagccaccccagggcacctacggcctgcccccagccagctacccagccagcctgcccagctgtgcccctcctcctccaccccagaagcgctacacagctgctggggccggggccggcggcaccccagactatgacccccacgcccacggcctgcagggcaatggcagctatggcaccccccacatccagggcagccctgtgtttgtgggcggcagctatgtggagcccatgagcaacagcggccctgccctgtttggcctgacccacctgccccatgctgccagcggggccatggactatggaggagctggccccctgggcagcggccaccaccacggccctggccctggagagccccaccccacctacacagacctgaccggccaccaccccagccagggccgcatccaggaggcccccaagctgacccacctgtag

SEQ ID NO: 15792 - DNA, 1332 bp, Artificial Sequence; identical to SEQ ID NO: 15790
  Description of Artificial Sequence: Synthetic coding sequence

SEQ ID NO: 15793 - DNA, 39 bp, Artificial Sequence
  Description of Artificial Sequence: Synthetic coding sequence
atgcagaaggccacctactatgacagcagcgccatctag

SEQ ID NO: 15794 - DNA, 165 bp, Artificial Sequence
  Description of Artificial Sequence: Synthetic coding sequence
atgcagaaggccacctactatgacagcagcgccatctatggaggctacccctaccaggccgccaacggctttgcctacaatgccaaccagcagccctacccagccagcgctgccctgggcgcagatggagagtaccacaggcctgcctgcagcctgcagagctag

SEQ ID NO: 15795 - DNA, 255 bp, Artificial Sequence
  Description of Artificial Sequence: Synthetic coding sequence
atgcagaaggccacctactatgacagcagcgccatctatggaggctacccctaccaggccgccaacggctttgcctacaatgccaaccagcagccctacccagccagcgctgccctgggcgcagatggagagtaccacaggcctgcctgcagcctgcagagccccagcagcgctgggggccaccccaaggcccacgagctgtctgaggcctgcctgcggaccctgagcgccccacccagccagccccccagctag

SEQ ID NO: 15796 - DNA, 1653 bp, Artificial Sequence
  Description of Artificial Sequence: Synthetic coding sequence
atggtgcggggctgggagcccccacctggcctggactgtgccatcagcgagggccacaagtctgagggcaccatgccacccaacaaggaggccagcggcctgagcagcagccctgctggcctcatctgcctgccccccatcagcgaggagctgcagctggtgtggacccaggccgcccagaccagcgagctggacagcaatgagcacctgctgaagaccttctcctacttcccctaccccagcctggccgacatcgccctgctgtgcctgcgctatggcctgcagatggagaaggtgaagacctggttcatggcccagaggctgcgctgtggcatctcctggagcagcgaggagattgaggagacccgggcccgggtggtgtacagaagagaccagctgcacttcaagagcctgctgtccttcacccaccacgccggccggcccccagaggaggtgcccccacctcctgtgcctgcccctgagcaggtgggcattggaattggcccccccaccctgagcaagcccacccagaccaagggcctgaaggtggagcctgaggagcccagccagatgccacccctgccccagagccaccagaagctgaaggagagcctgatgaccccaggcagcggggccttcccctaccagagcgacttctggcagcacctgcagagcagcggcctgagcaaggagcaggccggccggggccccaaccagagccatggaattggaacagcctcctggaaccacagcaccaccgtgccccagccccaggcccgggacaagcccccacccatcgccctgattgccagcagctgcaaggaggagagcgccagctctgtgacccccagcagcagcagcaccagcagcagcttccaggtgctggccaatggagccacagctgccagcaagcccctgcagcccctgggctgtgtgccccagagcgtgagccccagcgagcaggccctgcccccccacctggagcccgcctggccccagggcctgcggcacaacagcgtgcccggccgggtgggccccacagagtacctgagcccagacatgcagaggcagaggaagaccaagaggaagaccaaggagcagctggccatcctgaagagcttcttcctgcagtgccagtgggcccggcgggaggactaccagaagctggagcagatcaccggcctgcccaggcctgagatcatccagtggtttggagacaccaggtatgccctgaagcacggccagctgaagtggttccgggacaatgctgtgcctggggcccccagcttccaggaccctgccatccccaccccaccacccagcaccaggagcctgaatgaaagagctgagaccccacccctgcccatccccccacctcctccagacatccagcccctggagcgctactgggccgcccaccagcagctgcgggagacagacatcccccagctgagccaggccagccggctgagcacccagcaggtgctggactggtttgacagccggctgccccagcctgctgaggtggtggtgtgcctggatgaggaggaggaggaggaggaggaggagctgcctgaagatgatgaggaggaggaggaggaggaggaggaggatgatgatgatgatgatgatgatgtgatcatccaggactag

SEQ ID NO: 15797 - DNA, 1032 bp, Artificial Sequence
  Description of Artificial Sequence: Synthetic coding sequence
atgagccgggccggctcctgggacatggatggcctgcgggcagatggcggcggggccggcggggccccagccagcagcagcagcagctctgtggccgctgctgctgccagcggccagtgccggggcttcctgagcgcccctgtgtttgctggcacccacagcggccgggctgctgctgctgctgctgctgctgctgctgctgctgctgctgccagcggctttgcctacccaggcaccagcgagaggacaggcagcagcagcagcagcagcagcagcgctgtggtggccgcccggcctgaggcccccccagccaaggagtgcccagcccccaccccagctgctgctgctgctgcccctccttctgccccagccctgggctacggctaccactttggaaatggctactacagctgcaggatgagccacggcgtgggcctgcagcagaatgccctgaagagcagcccccacgccagcctgggcggcttccctgtggagaagtacatggatgtgtctggcctggccagcagctctgtgcctgccaatgaggtgcctgcccgggccaaggaggtgtccttctaccagggctacaccagcccctaccagcacgtgcccggctacatcgacatggtgtccacctttggaagtggagagcccaggcatgaggcctacatctccatggagggctaccagagctggaccctggccaacggctggaacagccaggtgtactgcaccaaggaccagccccagggcagccacttctggaagagcagcttccctggagatgtggccctgaaccagcctgacatgtgtgtgtaccgccggggcaggaagaagagggtgccctacaccaagctgcagctgaaggagctggagaatgaatatgccatcaacaagttcatcaacaaggacaagagaagacgcatctctgctgccaccaacctgtctgagcggcaggtgaccatctggttccagaacagaagagtgaaggacaagaagatcgtgtccaagctgaaggacacagtgtcctag

SEQ ID NO: 15798 - DNA, 924 bp, Artificial Sequence
  Description of Artificial Sequence: Synthetic coding sequence
atggccacagcccagctgagccactgcatcaccatccacaaggccagcaaggagaccgtcttccccagccagatcaccaatgaacatgagagcctgaagatggtgaagaagctgtttgccaccagcatcagctgcatcacctacctgcggggcctcttccctgagagcagctatggagagcggcacctggatgacctgagcctgaagatcctgcgggaggacaagaagtgccccggcagcctgcacatcatccgctggatccagggctgctttgatgccctggagaagcgctacctgaggatggctgtgctgaccctgtacacagaccccatgggcagcgagaaggtgacagagatgtaccagttcaagttcaagtacaccaaggagggcgccaccatggactttgacagccacagcagcagcaccagctttgagagcggcaccaacaatgaagacatcaagaaggcctctgtgctgctgatcaggaagctgtacatcctgatgcaggacctggagcccctgcccaacaacgtggtgctgaccatgaagctgcactactacaatgctgtgacccctcatgactaccagcccctgggcttcaaggagggcgtgaacagccacttcctgctgtttgacaaggagcccatcaacgtgcaggtgggctttgtgtccacaggcttccacagcatgaaggtgaaggtgatgacagaggccaccaaggtgattgacctggagaacaacctcttccgggagaacagcaccacagaaattgcccaccagggcctggactgtgatgaggaggaggagtgcaatgaccacatccagaggatgaactttgtgtgcagccagcagagcagtgaatgttccaggaagaagaggaaggtgtctgagcctgtgaaggtgttcatccccaacaggaagtag

SEQ ID NO: 15799 - DNA, 924 bp, Artificial Sequence; identical to SEQ ID NO: 15798
  Description of Artificial Sequence: Synthetic coding sequence

SEQ ID NO: 15800 - DNA, 1074 bp, Artificial Sequence
  Description of Artificial Sequence: Synthetic coding sequence
atgcaggcccgggccctgctgctggccgccctggccgccctggccctggcccgggagcccccagctgccccctgcccagcccgctgtgatgtgagccgctgccccagcccccgctgccctgggggctacgtgcctgacctgtgcaactgctgcctggtgtgtgccgccagcgagggggagccctgtggcggccccctggacagcccctgtggggagagcctggagtgtgtgcggggcctgtgccgctgccgctggagccatgctgtgtgtggcacagatggccacacctacgccaacgtgtgtgccctgcaggccgccagccggcgggccctgcagctgagcggcacccctgtgcggcagctgcagaagggggcctgccccctgggcctgcaccagctgagcagcccccgctacaagttcaacttcatcgcagatgtggtggagaagatcgccccagctgtggtgcacatcgagctgttcctgcggcaccccctgtttggaagaaatgtgcccctgagcagcggcagcggcttcatcatgtctgaggccggcctcatcatcaccaatgcccacgtggtgagcagcaacagcgctgcccctggccggcagcagctgaaggtgcagctgcagaatggagacagctatgaggccaccatcaaggacatcgacaagaagagtgacatcgccaccatcaagatccaccccaagaagaagctgcctgtgctgctgctgggccacagcgctgacctgcggcctggagaatttgtggtggccatcggcagcccctttgccctgcagaacacagtgaccactggaattgtgtccacagcccagcgggagggccgggagctgggcctgcgggacagcgacatggactacatccagacagatgccatcatcaactacggcaacagcggcggccccctggtgaacctggatggagaggtgattggcatcaacaccctgaaggtgacagctggcatcagctttgccatccccagcgaccgcatcacccgcttcctgacagagttccaggacaagcagatcaaggcccccagcctggccgtgcactag

SEQ ID NO: 15801 - DNA, 1599 bp, Artificial Sequence
  Description of Artificial Sequence: Synthetic coding sequence
atgcactgcaccctgaccatggagacagaggccattgatggctacatcacctgtgacaatgagctgagccctgagcgggagcacagcaacatggccatcgacctgaccagcagcaccccaaatggccagcacgccagccccagccacatgaccagcaccaacagcgtgaagctggagatgcagagtgatgaagaatgtgacaggaagcccctgagccgggaggatgagatccggggccatgatgagggcagcagcctggaggagcccctgattgagagcagcgaggtggccgacaacaggaaggtgcaggagctgcagggcgagggcggcatccggctgcccaacgggaagctgaagtgtgatgtgtgtggcatggtgtgcatcggccccaacgtgctgatggtgcacaagaggagccacactggagagcggcccttccactgcaaccagtgtggggccagcttcacccagaagggcaacctgctgcggcacatcaagctgcacagcggggagaagcccttcaagtgccccttctgcagctatgcctgcagaagaagagatgccctgaccggccacctgcggacccacagcgtgggcaagccccacaagtgcaactactgcggccgcagctacaagcagaggagcagcctggaggagcacaaggagcgctgccacaactacctgcagaatgtgtccatggaggccgccggccaggtgatgagccaccacgtgccccccatggaggactgcaaggagcaggagcccatcatggacaacaacatcagcctggtgccctttgagaggcctgctgtgattgagaagctgaccggcaacatgggcaagaggaagagcagcaccccccagaagtttgtgggggagaagctgatgaggttctcctacccagacatccactttgacatgaacctgacctatgagaaggaggccgagctgatgcagagccacatgatggaccaggccatcaacaatgccatcacctacctgggcgctgaggccctgcaccccctgatgcagcacccccccagcaccatcgccgaggtggcccctgtgatcagcagcgcctacagccaggtgtaccaccccaaccgcatcgagcggcccatcagccgggagacagctgacagccatgagaacaacatggatggccccatcagcctcatccggcccaagagccggccccaggagcgggaggccagccccagcaacagctgcctggacagcacagacagcgagagcagccatgatgaccaccagagctaccagggccacccagccctgaaccccaagaggaagcagagccctgcctacatgaaggaggatgtgaaggccctggacaccaccaaggcccccaagggcagcctgaaggacatctacaaggtgttcaacggggagggggagcagatccgggccttcaagtgtgagcactgccgggtgctcttcctggaccacgtgatgtacaccatccacatgggctgccacggctacagagaccccctggagtgcaacatctgtggctaccgcagccaggacagatatgagttcagcagccacatcgtgcggggggagcacaccttccactag

SEQ ID NO: 15802 - DNA, 1503 bp, Artificial Sequence
  Description of Artificial Sequence: Synthetic coding sequence
atggagacagaggccattgatggctacatcacctgtgacaatgagctgagccctgagcgggagcacagcaacatggccatcgacctgaccagcagcaccccaaatggccagcacgccagccccagccacatgaccagcaccaacagcgtgaagctggagatgcagagtgatgaagaatgtgacaggaagcccctgagccgggaggatgagatccggggccatgatgagggcagcagcctggaggagcccctgattgagagcagcgaggtggccgacaacaggaaggtgcaggagctgcagggcgagggcggcatccggctgcccaatggagagcggcccttccactgcaaccagtgtggggccagcttcacccagaagggcaacctgctgcggcacatcaagctgcacagcggggagaagcccttcaagtgccccttctgcagctatgcctgcagaagaagagatgccctgaccggccacctgcggacccacagcgtgggcaagccccacaagtgcaactactgcggccgcagctacaagcagaggagcagcctggaggagcacaaggagcgctgccacaactacctgcagaatgtgtccatggaggccgccggccaggtgatgagccaccacgtgccccccatggaggactgcaaggagcaggagcccatcatggacaacaacatcagcctggtgccctttgagaggcctgctgtgattgagaagctgaccggcaacatgggcaagaggaagagcagcaccccccagaagtttgtgggggagaagctgatgaggttctcctacccagacatccactttgacatgaacctgacctatgagaaggaggccgagctgatgcagagccacatgatggaccaggccatcaacaatgccatcacctacctgggcgctgaggccctgcaccccctgatgcagcacccccccagcaccatcgccgaggtggcccctgtgatcagcagcgcctacagccaggtgtaccaccccaaccgcatcgagcggcccatcagccgggagacagctgacagccatgagaacaacatggatggccccatcagcctcatccggcccaagagccggccccaggagcgggaggccagccccagcaacagctgcctggacagcacagacagcgagagcagccatgatgaccaccagagctaccagggccacccagccctgaaccccaagaggaagcagagccctgcctacatgaaggaggatgtgaaggccctggacaccaccaaggcccccaagggcagcctgaaggacatctacaaggtgttcaacggggagggggagcagatccgggccttcaagtgtgagcactgccgggtgctcttcctggaccacgtgatgtacaccatccacatgggctgccacggctacagagaccccctggagtgcaacatctgtggctaccgcagccaggacagatatgagttcagcagccacatcgtgcggggggagcacaccttccactag

SEQ ID NO: 15803 - DNA, 1146 bp, Artificial Sequence
  Description of Artificial Sequence: Synthetic coding sequence
atggagacagaggccattgatggctacatcacctgtgacaatgagctgagccctgagcgggagcacagcaacatggccatcgacctgaccagcagcaccccaaatggccagcacgccagccccagccacatgacctccatgggcaagccccacaagtgcaactactgcggccgcagctacaagcagaggagcagcctggaggagcacaaggagcgctgccacaactacctgcagaatgtgtccatggaggccgccggccaggtgatgagccaccacgtgccccccatggaggactgcaaggagcaggagcccatcatggacaacaacatcagcctggtgccctttgagaggcctgctgtgattgagaagctgactggaaacatgggcaagaggaagagcagcaccccccagaagtttgtgggggagaagctgatgaggttctcctacccagacatccactttgacatgaacctgacctatgagaaggaggccgagctgatgcagagccacatgatggaccaggccatcaacaatgccatcacctacctgggcgctgaggccctgcaccccctgatgcagcacccccccagcaccatcgccgaggtggcccctgtgatcagcagcgcctacagccaggtgtaccaccccaacagaattgagcggcccatcagccgggagacagctgacagccatgagaacaacatggatggccccatcagcctcatccggcccaagagccggccccaggagcgggaggccagccccagcaacagctgcctggacagcacagattctgagagcagccatgatgaccaccagagctaccagggccacccagccctgaaccccaagaggaagcagagccctgcctacatgaaggaggatgtgaaggccctggacaccaccaaggcccccaagggcagcctgaaggacatctacaaggtgttcaatggagagggggagcagatccgggccttcaagtgtgagcactgccgggtgctcttcctggaccacgtgatgtacaccatccacatgggctgccacggctacagagaccccctggagtgcaacatctgtggctaccgcagccaggacagatatgagttcagcagccacatcgtgcggggggagcacaccttccactag

SEQ ID NO: 15804 - DNA, 720 bp, Artificial Sequence
  Description of Artificial Sequence: Synthetic coding sequence
atggagacagaggccattgatggctacatcacctgtgacaatgagctgagccctgagcgggagcacagcaacatggccatcgacctgaccagcagcaccccaaatggccagcacgccagccccagccacatgaccagcaccaacagcgtgaagctggagatgcagagtgatgaagaatgtgacaggaagcccctgagccgggaggatgagatccggggccatgatgagggcagcagcctggaggagcccctgattgagagcagcgaggtggccgacaacaggaaggtgcaggagctgcagggcgagggcggcatccggctgcccaacgggaagctgaagtgtgatgtgtgtggcatggtgtgcatcggccccaacgtgctgatggtgcacaagaggagccacactggagagcggcccttccactgcaaccagtgtggggccagcttcacccagaagggcaacctgctgcggcacatcaagctgcacagcggggagaagcccttcaagtgccccttctgcagctatgcctgcagaagaagagatgccctgaccggccacctgcggacccacagcgtgggcaagccccacaagtgcaactactgcggccgcagctacaagcagaggagcagcctggaggagcacaaggagcgctgccacaactacctgcagaatgtgtccatggaggccgccggccaggtgatgagccaccacgacagctag

SEQ ID NO: 15805 - DNA, 1359 bp, Artificial Sequence
  Description of Artificial Sequence: Synthetic coding sequence
atggagacagaggccattgatggctacatcacctgtgacaatgagctgagccctgagcgggagcacagcaacatggccatcgacctgaccagcagcaccccaaatggccagcacgccagccccagccacatgaccagcaccaacagcgtgaagctggagatgcagagtgatgaagaatgtgacaggaagcccctgagccgggaggatgagatccggggccatgatgagggcagcagcctggaggagcccctgattgagagcagcgaggtggccgacaacaggaaggtgcaggagctgcagggcgagggcggcatccggctgcccaatggagagcggcccttccactgcaaccagtgtggggccagcttcacccagaagggcaacctgctgcggcacatcaagctgcacagcggggagaagcccttcaagtgccccttctgcagctatgcctgcagaagaagagatgccctgaccggccacctgcggacccacagcgtgggcaagccccacaagtgcaactactgcggccgcagctacaagcagaggagcagcctggaggagcacaaggagcgctgccacaactacctgcagaatgtgtccatggaggccgccggccaggtgatgagccaccacggggagaagctgatgaggttctcctacccagacatccactttgacatgaacctgacctatgagaaggaggccgagctgatgcagagccacatgatggaccaggccatcaacaatgccatcacctacctgggcgctgaggccctgcaccccctgatgcagcacccccccagcaccatcgccgaggtggcccctgtgatcagcagcgcctacagccaggtgtaccaccccaaccgcatcgagcggcccatcagccgggagacagctgacagccatgagaacaacatggatggccccatcagcctcatccggcccaagagccggccccaggagcgggaggccagccccagcaacagctgcctggacagcacagacagcgagagcagccatgatgaccaccagagctaccagggccacccagccctgaaccccaagaggaagcagagccctgcctacatgaaggaggatgtgaaggccctggacaccaccaaggcccccaagggcagcctgaaggacatctacaaggtgttcaacggggagggggagcagatccgggccttcaagtgtgagcactgccgggtgctcttcctggaccacgtgatgtacaccatccacatgggctgccacggctacagagaccccctggagtgcaacatctgtggctaccgcagccaggacagatatgagttcagcagccacatcgtgcggggggagcacaccttccactag

SEQ ID NO: 15806 - DNA, 720 bp, Artificial Sequence; identical to SEQ ID NO: 15804
  Description of Artificial Sequence: Synthetic coding sequence

SEQ ID NO: 15807 - DNA, 381 bp, Artificial Sequence
  Description of Artificial Sequence: Synthetic coding sequence
atgcactgcaccctgaccatggagacagaggccattgatggctacatcacctgtgacaatgagctgagccctgagcgggagcacagcaacatggccatcgacctgaccagcagcaccccaaatggccagcacgccagccccagccacatgaccagcaccaacagcgtgaagctggagatgcagagtgatgaagaatgtgacaggaagcccctgagccgggaggatgagatccggggccatgatgagggcagcagcctggaggagcccctgattgagagcagcgaggtggccgacaacaggaaggtgcaggagctgcagggcgagggcggcatccggctgcccaatggagagcggcccttccactgcaaccagtgtggctag

SEQ ID NO: 15808 - DNA, 1581 bp, Artificial Sequence
  Description of Artificial Sequence: Synthetic coding sequence
atggagacagaggccattgatggctacatcacctgtgacaatgagctgagccctgagcgggagcacagcaacatggccatcgacctgaccagcagcaccccaaatggccagcacgccagccccagccacatgaccagcaccaacagcgtgaagctggagatgcagagtgatgaagaatgtgacaggaagcccctgagccgggaggatgagatccggggccatgatgagggcagcagcctggaggagcccctgattgagagcagcgaggtggccgacaacaggaaggtgcaggagctgcagggcgagggcggcatccggctgcccaacgggaagctgaagtgtgatgtgtgtggcatggtgtgcatcggccccaacgtgctgatggtgcacaagaggagccacactggagagcggcccttccactgcaaccagtgtggggccagcttcacccagaagggcaacctgctgcggcacatcaagctgcacagcggggagaagcccttcaagtgccccttctgcagctatgcctgcagaagaagagatgccctgaccggccacctgcggacccacagcgtgggcaagccccacaagtgcaactactgcggccgcagctacaagcagaggagcagcctggaggagcacaaggagcgctgccacaactacctgcagaatgtgtccatggaggccgccggccaggtgatgagccaccacgtgccccccatggaggactgcaaggagcaggagcccatcatggacaacaacatcagcctggtgccctttgagaggcctgctgtgattgagaagctgaccggcaacatgggcaagaggaagagcagcaccccccagaagtttgtgggggagaagctgatgaggttctcctacccagacatccactttgacatgaacctgacctatgagaaggaggccgagctgatgcagagccacatgatggaccaggccatcaacaatgccatcacctacctgggcgctgaggccctgcaccccctgatgcagcacccccccagcaccatcgccgaggtggcccctgtgatcagcagcgcctacagccaggtgtaccaccccaaccgcatcgagcggcccatcagccgggagacagctgacagccatgagaacaacatggatggccccatcagcctcatccggcccaagagccggccccaggagcgggaggccagccccagcaacagctgcctggacagcacagacagcgagagcagccatgatgaccaccagagctaccagggccacccagccctgaaccccaagaggaagcagagccctgcctacatgaaggaggatgtgaaggccctggacaccaccaaggcccccaagggcagcctgaaggacatctacaaggtgttcaacggggagggggagcagatccgggccttcaagtgtgagcactgccgggtgctcttcctggaccacgtgatgtacaccatccacatgggctgccacggctacagagaccccctggagtgcaacatctgtggctaccgcagccaggacagatatgagttcagcagccacatcgtgcggggggagcacaccttccactag

SEQ ID NO: 15809 - DNA, 447 bp, Artificial Sequence
  Description of Artificial Sequence: Synthetic coding sequence
atggagacagaggccattgatggctacatcacctgtgacaatgagctgagccctgagcgggagcacagcaacatggccatcgacctgaccagcagcaccccaaatggccagcacgccagccccagccacatgaccagcaccaacagcgtgaagctggagatgcagagtgatgaagaatgtgacaggaagcccctgagccgggaggatgagatccggggccatgatgagggcagcagcctggaggagcccctgattgagagcagcgaggtggccgacaacaggaaggtgcaggagctgcagggcgagggcggcatccggctgcccaacgggaagctgaagtgtgatgtgtgtggcatggtgtgcatcggccccaacgtgctgatggtgcacaagaggagccacactggagtggccgtggtgaagaccaccttcagcgagttctgctag

SEQ ID NO: 15810 - DNA, 1365 bp, Artificial Sequence
  Description of Artificial Sequence: Synthetic coding sequence
atggagacagaggccattgatggctacatcacctgtgacaatgagctgagccctgagcgggagcacagcaacatggccatcgacctgaccagcagcaccccaaatggccagcacgccagccccagccacatgaccagcaccaacagcgtgaagctggagatgcagagtgatgaagaatgtgacaggaagcccctgagccgggaggatgagatccggggccatgatgagggcagcagcctggaggagcccctgattgagagcagcgaggtggccgacaacaggaaggtgcaggagctgcagggcgagggcggcatccggctgcccaatggagagcggcccttccactgcaaccagtgtggggccagcttcacccagaagggcaacctgctgcggcacatcaagctgcacagcggggagaagcccttcaagtgccccttctgcagctatgcctgcagaagaagagatgccctgaccggccacctgcggacccacagcgtgccccccatggaggactgcaaggagcaggagcccatcatggacaacaacatcagcctggtgccctttgagaggcctgctgtgattgagaagctgaccggcaacatgggcaagaggaagagcagcaccccccagaagtttgtgggggagaagctgatgaggttctcctacccagacatccactttgacatgaacctgacctatgagaaggaggccgagctgatgcagagccacatgatggaccaggccatcaacaatgccatcacctacctgggcgctgaggccctgcaccccctgatgcagcacccccccagcaccatcgccgaggtggcccctgtgatcagcagcgcctacagccaggtgtaccaccccaaccgcatcgagcggcccatcagccgggagacagctgacagccatgagaacaacatggatggccccatcagcctcatccggcccaagagccggccccaggagcgggaggccagccccagcaacagctgcctggacagcacagacagcgagagcagccatgatgaccaccagagctaccagggccacccagccctgaaccccaagaggaagcagagccctgcctacatgaaggaggatgtgaaggccctggacaccaccaaggcccccaagggcagcctgaaggacatctacaaggtgttcaacggggagggggagcagatccgggccttcaagtgtgagcactgccgggtgctcttcctggaccacgtgatgtacaccatccacatgggctgccacggctacagagaccccctggagtgcaacatctgtggctaccgcagccaggacagatatgagttcagcagccacatcgtgcggggggagcacaccttccactag

SEQ ID NO: 15811 - DNA, 252 bp, Artificial Sequence
  Description of Artificial Sequence: Synthetic coding sequence
atggagacagaggccattgatggctacatcacctgtgacaatgagctgagccctgagcgggagcacagcaacatggccatcgacctgaccagcagcaccccaaatggccagcacgccagccccagccacatgaccagcaccaacagcgtgaagctggagatgcagagtgatgaagaatgtgacaggaagcccctgagccgggaggatgagatccggggccatgatgagggcagcagcctggaggagccctag

SEQ ID NO: 15812 - DNA, 1581 bp, Artificial Sequence; identical to SEQ ID NO: 15808
  Description of Artificial Sequence: Synthetic coding sequence

SEQ ID NO: 15813 - DNA, 693 bp, Artificial Sequence
  Description of Artificial Sequence: Synthetic coding sequence
atggagacagaggccattgatggctacatcacctgtgacaatgagctgagccctgagcgggagcacagcaacatggccatcgacctgaccagcagcaccccaaatggccagcacgccagccccagccacatgaccagcaccatcgccgaggtggcccctgtgatcagcagcgcctacagccaggtgtaccaccccaaccgcatcgagcggcccatcagccgggagacagctgacagccatgagaacaacatggatggccccatcagcctcatccggcccaagagccggccccaggagcgggaggccagccccagcaacagctgcctggacagcacagacagcgagagcagccatgatgaccaccagagctaccagggccacccagccctgaaccccaagaggaagcagagccctgcctacatgaaggaggatgtgaaggccctggacaccaccaaggcccccaagggcagcctgaaggacatctacaaggtgttcaacggggagggggagcagatccgggccttcaagtgtgagcactgccgggtgctcttcctggaccacgtgatgtacaccatccacatgggctgccacggctacagagaccccctggagtgcaacatctgtggctaccgcagccaggacagatatgagttcagcagccacatcgtgcggggggagcacaccttccactag

SEQ ID NO: 15814 - DNA, 1260 bp, Artificial Sequence
  Description of Artificial Sequence: Synthetic coding sequence
atgggagagaagaagccagagcccctggactttgtgaaggacttccaggagtacctgacccagcagacccaccacgtgaacatgatcagcggctctgtgtctggggacaaggaggccgaggccctgcagggcgccggcacagatggagaccagaatggcctggaccaccccagcgtggaggtgtccctggatgaaaattctggcatgctggtggatggctttgagaggacctttgatggcaagctgaagtgccgctactgcaactatgccagcaagggcacagcccggctcatcgagcacatccgcatccacactggagagaagccccaccgctgccacctgtgcccctttgccagcgcctatgagcggcacctggaggcccacatgaggagccacactggagagaagccctacaagtgtgagctgtgcagcttccgctgcagcgacaggagcaacctgagccaccacagaagaaggaagcacaagatggtgcccatcaagggcaccaggagcagcctgagcagcaagaagatgtggggcgtgctgcagaagaagaccagcaacctgggctacagcagaagagccctgatcaacctgagccccccatccatggtggtgcagaagccagactacctgaatgacttcacccatgagatccccaacatccagacagacagctatgaatccatggccaagaccacccccaccggcggcctgccccgggacccccaggagctgatggtggacaaccccctgaaccagctgagcaccctggccggccagctgagcagcctgcccccagagaaccagaacccagccagcccagatgtggtgccctgcccagatgagaagcccttcatgatccagcagcccagcacccaggccgtggtgtctgctgtgtctgccagcatcccccagagcagcagccccaccagccctgagccccggcccagccacagccagaggaactacagccctgtggccggccccagcagcgagcccagcgcccacaccagcacccccagcatcggcaacagccagcccagcaccccagccccagccctgcctgtgcaggacccccagctgctgcaccactgccagcactgtgacatgtactttgctgacaacatcctgtacaccatccacatgggctgccacggctatgagaaccccttccagtgcaacatctgtggctgcaagtgcaagaacaagtatgactttgcctgccactttgcccggggccagcacaaccagcactag

SEQ ID NO: 15815 - DNA, 1542 bp, Artificial Sequence
  Description of Artificial Sequence: Synthetic coding sequence
atgagggagggcgcctgcaagctgctggccgcctgcagccagcgggagcaggccctggaggccaccaagagcctgctggtgtgcaacagccgcatcctgagctacatgggagagctgcagaggaggaaggaggcccaggtgctgggcaagaccagcagaagacccagcgacagcggccccccagctgagaggagcccctgccggggccgggtgtgcatcagtgacctgcgcatccccctgatgtggaaggacacagagtacttcaagaacaagggggacctgcaccgctgggccgtgttcctgctgctgcagctgggggagcacatccaggacacagagatgatcctggtggacaggaccctgacagacatctccttccagagcaatgtgctgtttgctgaggccggccctgactttgagctgcggctggagctgtatggagcctgtgtggaggaggagggcgccctgactggaggccccaagaggctggccaccaagctgagcagcagcctgggccgcagcagtggaagaagagtgcgggccagcctggacagcgctgggggcagcggcagcagccccatcctgctgcccacccctgtggtgggcggcccccgctaccacctgctggcccacaccaccctgaccctggccgctgtgcaggacggcttccgcacccatgacctgaccctggccagccatgaagaaaatcctgcctggctgcccctgtatggctctgtgtgctgccgcctggccgcccagcccctgtgcatgacccagcccacagccagcggcaccctgcgggtgcagcaggccggggagatgcagaactgggcccaggtgcatggagtgctgaagggcaccaacctcttctgctaccggcagccagaagatgctgacaccggggaggagcccctgctgaccatcgctgtgaacaaggagaccagggtgcgggccggggagctggaccaggccctgggccggcccttcaccctgagcatcagcaaccagtatggagatgatgaggtgacccacaccctgcagacagagagccgggaggccctgcagagctggatggaggccctgtggcagctgttctttgacatgagccagtggaagcagtgctgtgatgagatcatgaagattgagaccccagcccccaggaagccaccccaggccctggccaagcagggcagcctgtaccacgagatggccatcgagcccctggatgacattgctgctgtgacagacatcctgacccagcgggagggcgcccggctggagaccccaccaccctggctggccatgttcacagaccagcctgccctgcccaacccctgcagccctgcctctgtggccccagccccagactggacccaccccctgccctggggccggcccaggaccttcagcctggatgctgtgcccccagaccacagcccccgggcccggtctgtggcccccctgcccccccagaggagccccaggacccggggcctgtgcagcaagggccagcccaggacctggctgcagagccctgtgtag

SEQ ID NO: 15816 - DNA, 1092 bp, Artificial Sequence
  Description of Artificial Sequence: Synthetic coding sequence
atgagcaagctgtggaggcggggcagcaccagcggggccatggaggcccctgagcctggagaggccctggagctgagcctggccggggcccacggccatggagtgcacaagaagaagcacaagaagcacaagaagaagcacaagaagaagcaccaccaggaggaggatgctggccccacccagcccagccctgccaagccccagctgaagctgaagatcaagctgggcggccaggtgctgggcaccaagtctgtgcccaccttcaccgtcatccctgagggccccaggagccccagccccctgatggtggtggacaatgaggaggagcccatggagggcgtgcccctggagcagtaccgggcctggctggatgaggacagcaacctgagccccagccccctgcgggacctgagcggcggcctgggcggccaggaggaggaggaggagcagcgctggctggatgccctggagaagggggagctggatgacaacggggacctgaagaaggagatcaatgaaaggctgctgacagcccggcagagggccctgctgcagaaggcccggagccagcccagccccatgctgcccctgcctgtggccgagggctgccccccaccagccctgacagaggagatgctgctgaagcgggaggagcgggccaggaagaggcggctgcaggccgccaggagagctgaggagcacaagaaccagaccatcgagcggctgaccaagacagctgccaccagcggccggggcggccggggcggggcccggggggagaggagaggaggccgggctgctgccccagcccccatggtgcgctactgcagcggggcccagggcagcaccctgtccttccccccaggagtgcctgcccccacagctgtgtcccagaggcccagccccagcggccccccaccccgctgcagcgtgcccggctgcccccacccccggcgctatgcctgcagcaggacaggccaggccctgtgcagcctgcagtgctaccgcatcaacctgcagatgaggctgggcggccctgagggccctggcagccccctgctggccacctttgagagctgtgcccaggagtag

SEQ ID NO: 15817 - DNA, 594 bp, Artificial Sequence
  Description of Artificial Sequence: Synthetic coding sequence
atggccgcccagatccccatcgtggccaccaccagcaccccaggcatcgtgaggaacagcaagaagaggcctgccagccccagccacaacggcagcagcggcggcggctatggagccagcaagaagaagaaggccagcgccagcagctttgcccagggcatctccatggaggccatgtctgagaacaagatggtgcccagcgagttcagcactggacctgtggagaaggccgccaagcccctgcccttcaaggaccccaactttgtgcacagcggccatggaggagctgtggccggcaagaagaacagaacctggaagaacctgaagcagatcctggccagcgagcgggccctgccctggcagctgaatgaccccaactacttcagcattgatgcccctccttccttcaagccagccaagaagtacagtgatgtgtctggcctgctggagccccccaactgcttcccccagaggctgcaccagctgaccttccccctggccatggatgagggcagcaacttcagccgctgcagccccaccctggtgaactttggatttgtgttcatcatggccatcctggtgggcgtgaagtag

SEQ ID NO: 15818 - DNA, 579 bp, Artificial Sequence
  Description of Artificial Sequence: Synthetic coding sequence
atggccgcccagatccccatcgtggccaccaccagcaccccaggcatcgtgaggaacagcaagaagaggcctgccagccccagccacaacggcagcagcggcggcggctatggagccagcaagaagaagaaggccagcgccagcagctttgcccagggcatctccatggaggccatgtctgagaacaagatggtgcccagcgagttcagcactggacctgtggagaaggccgccaagcccctgcccttcaaggaccccaactttgtgcacagcggccatggaggagctgtggccggcaagaagaacagaacctggaagaacctgaagcagatcctggccagcgagcgggccctgccctggcagctgaatgaccccaactacttcagcattgatgcccctccttccttcaagccagccaagaagtacagtgatgtgtctggcctgctggccaactacacagacccccagagcaagctgcgcttcagcaccatcgaggagttctcctacatccggcggctgcccagtgatgtggtgacaggctacctggccctgaggaaggccaccagcatcgtgccctag

SEQ ID NO: 15819 - DNA, 687 bp, Artificial Sequence
  Description of Artificial Sequence: Synthetic coding sequence
atggccgcccagatccccatcgtggccaccaccagcaccccaggcatcgtgaggaacagcaagaagaggcctgccagccccagccacaacggcagcagcggcggcggctatggagccagcaagaagaagaaggccagcgccagcagctttgcccagacctgcctgagccccagcaccatgattgtgcggcccccccagccccggggcaccacctgcctgctgcccagcgccatgattgtgcggcccccccagcccagaggaaatggcatctccatggaggccatgtctgagaacaagatggtgcccagcgagttcagcactggacctgtggagaaggccgccaagcccctgcccttcaaggaccccaactttgtgcacagcggccatggaggagctgtggccggcaagaagaacagaacctggaagaacctgaagcagatcctggccagcgagcgggccctgccctggcagctgaatgaccccaactacttcagcattgatgcccctccttccttcaagccagccaagaagtacagtgatgtgtctggcctgctggccaactacacagacccccagagcaagctgcgcttcagcaccatcgaggagttctcctacatccggcggctgcccagtgatgtggtgacaggctacctggccctgaggaaggccaccagcatcgtgccctag

SEQ ID NO: 15820 - DNA, 13692 bp, Artificial Sequence
  Description of Artificial Sequence: Synthetic coding sequence
atggacccccccaggcctgccctgctggccctgctggccctgcctgccctgctgctgctgctgctggccggggcccgggcagaggaggagatgctggagaatgtgtccctggtgtgccccaaggatgccacccgcttcaagcacctgaggaagtacacctacaactatgaggccgagagcagcagcggcgtgcctggaacagctgacagccgcagcgccacccgcatcaactgcaaggtggagctggaggtgccccagctgtgcagcttcatcctgaagaccagccagtgcaccctgaaggaggtgtatggcttcaaccctgagggcaaggccctgctgaagaagaccaagaacagcgaggagtttgctgctgccatgagccgctatgagctgaagctggccatccctgagggcaagcaggtgttcctgtacccagagaaggatgagcccacctacatcctgaacatcaagaggggcatcatcagcgccctgctggtgcccccagagacagaggaggccaagcaggtgctcttcctggacacagtgtatggcaactgcagcacccacttcaccgtgaagaccaggaaaggaaatgtggccacagagatcagcacagagcgggacctgggccagtgtgaccgcttcaagcccatcagaacaggcatcagccccctggccctgatcaagggcatgacccggcccctgagcaccctcatcagcagcagccagagctgccagtacaccctggatgccaagaggaagcacgtggccgaggccatctgcaaggagcagcacctgttcctgcccttctcctacaagaacaagtatggcatggtggcccaggtgacccagaccctgaagctggaggacacccccaagatcaacagccgcttctttggagagggcaccaagaagatgggcctggcctttgagagcaccaagagcaccagcccccccaagcaggccgaggccgtgctgaagaccctgcaggagctgaagaagctgaccatcagcgagcagaacatccagagggccaacctcttcaacaagctggtgacagagctgcggggcctgagtgatgaggccgtgaccagcctgctgccccagctgattgaggtgagcagccccatcaccctgcaggccctggtgcagtgtggccagccccagtgcagcacccacatcctgcagtggctgaagagggtgcacgccaaccccctgctgattgatgtggtgacctacctggtggccctgatccctgagcccagcgcccagcagctgcgggagatcttcaacatggcccgggaccagaggagccgggccaccctgtatgccctgagccatgctgtgaacaactaccacaagaccaaccccaccggcacccaggagctgctggacatcgccaactacctgatggagcagatccaggatgactgcacaggagatgaggactacacctacctgatcctgcgggtcatcggcaacatgggccagaccatggagcagctgaccccagagctgaagagcagcatcctgaagtgtgtgcagagcaccaagcccagcctgatgatccagaaggccgccatccaggccctgaggaagatggagcccaaggacaaggaccaggaggtgctgctgcagaccttcctggatgatgccagccctggggacaagaggctggccgcctacctgatgctgatgaggagccccagccaggccgacatcaacaagatcgtgcagatcctgccctgggagcagaatgagcaggtgaagaactttgtggccagccacatcgccaacatcctgaacagcgaggagctggacatccaggacctgaagaagctggtgaaggaggccctgaaggagagccagctgcccaccgtgatggacttcaggaagttcagcaggaactaccagctgtacaagtctgtgtccctgcccagcctggaccctgccagcgccaagattgagggcaacctgatctttgaccccaacaactacctgcccaaggagagcatgctgaagaccaccctgacagccttcggctttgccagcgctgacctgattgagatcggcctggagggcaaaggatttgagcccaccctggaggccctgtttgggaagcagggcttcttcccagacagcgtgaacaaggccctgtactgggtgaatggccaggtgcctgatggagtgtccaaggtgctggtggaccacttcggctacaccaaggatgacaagcatgagcaggacatggtgaatggcatcatgctgtctgtggagaagctgatcaaggacctgaagagcaaggaggtgcctgaggcccgggcctacctgcgcatcctgggggaggagctgggctttgccagcctgcatgacctgcagctgctgggcaagctgctgctgatgggcgcccggaccctgcagggcatcccccagatgattggagaggtgatcaggaagggcagcaagaatgacttcttcctgcactacatcttcatggagaatgcctttgagctgcccaccggggccggcctgcagctgcagatcagcagcagtggagtcatcgcccctggggccaaggccggcgtgaagctggaggtggccaacatgcaggccgagctggtggccaagcccagcgtgtctgtggagtttgtgaccaacatgggcatcatcatcccagactttgcccggtctggagtgcagatgaacaccaacttcttccatgaaagtggcctggaggcccacgtggccctgaaggccggcaagctgaagttcatcatccccagccccaagaggcctgtgaagctgctgagcggcggcaacaccctgcacctggtgtccaccaccaagacagaggtgatcccccccctgattgagaaccggcagagctggagcgtgtgcaagcaggtgtttcctggcctgaactactgcaccagcggggcctacagcaatgccagcagcacagattctgccagctactaccccctgaccggggacacccggctggagctggagctgcggcccaccggggagattgagcagtacagcgtgtctgccacctatgagctgcagagagaagatcgggccctggtggacaccctgaagtttgtgacccaggccgagggcgccaagcagacagaggccaccatgaccttcaagtacaaccggcagagcatgaccctgagcagcgaggtgcagatcccagactttgatgtggacctgggcaccatcctgcgggtgaatgatgagagcacagagggcaagaccagctaccgcctgaccctggacatccagaacaagaagatcacagaggtggccctgatgggccacctgagctgtgacaccaaggaggagaggaagatcaagggcgtcatcagcatcccccggctgcaggccgaggcccggtctgagatcctggcccactggagccctgccaagctgctgctgcagatggacagcagcgccacagcctacggcagcacagtgtccaagagggtggcctggcactatgatgaggagaagattgaatttgagtggaacacaggcaccaacgtggacaccaagaagatgaccagcaacttccctgtggacctgagtgactaccccaagagcctgcacatgtatgccaaccggctgctggaccaccgggtgccccagacagacatgaccttcagacatgtgggcagcaagctgattgtggccatgagctcctggctgcagaaggccagcggcagcctgccctacacccagaccctgcaggaccacctgaacagcctgaaggagttcaacctgcagaacatgggcctgcctgacttccacatcccagaaaatctcttcctgaagagtgatggccgggtgaagtacaccctgaacaagaacagcctgaagattgagatccccctgccctttggaggcaagagcagccgggacctgaagatgctggagaccgtgaggaccccagccctgcacttcaagtctgtgggcttccacctgcccagccgggagttccaggtgcccaccttcaccatccccaagctgtaccagctgcaggtgcccctgctgggcgtgctggacctgagcaccaacgtgtacagcaacctgtacaactggagcgccagctacagcggcggcaacaccagcacagaccacttcagcctgcgggcccgctaccacatgaaggctgacagcgtggtggacctgctgagctacaacgtgcagggcagcggggagaccacctatgaccacaagaacaccttcaccctgtcctatgatggcagcctgcggcacaagttcctggacagcaacatcaagttcagccacgtggagaagctgggcaacaaccctgtgtccaagggcctgctgatctttgatgccagcagctcctggggcccccagatgtctgcctctgtgcacctggacagcaagaagaagcagcacctgtttgtgaaggaggtgaagattgatggccagttccgggtgagcagcttctacgccaagggcacctacggcctgagctgccagagggaccccaacacaggccgcctgaatggagagagcaacctgcgcttcaacagcagctacctgcagggcaccaaccagatcaccggccgctatgaagatggcaccctgagcctgaccagcaccagtgacctgcagagcggcatcatcaagaacacagccagcctgaagtatgagaactatgagctgaccctgaagagtgacaccaacgggaagtacaagaactttgccaccagcaacaagatggacatgaccttcagcaagcagaatgccctgctgcggtctgagtaccaggccgactatgagagcctgcgcttcttcagcctgctgagcggcagcctgaacagccacggcctggagctgaatgctgacatcctgggcacagacaagatcaacagcggggcccacaaggccaccctgagaattggccaggacggcatcagcaccagcgccaccaccaacctgaagtgcagcctgctggtgctggagaatgagctgaatgctgagctgggcctgagcggggcctccatgaagctgaccaccaacggccgcttccgggagcacaatgccaagttcagcctggatggcaaggccgccctgacagagctgagcctgggcagcgcctaccaggccatgatcctgggcgtggacagcaagaacatcttcaacttcaaggtgtcccaggagggcctgaagctgagcaatgacatgatgggcagctatgcagagatgaagtttgaccacaccaacagcctgaacattgctggcctgagcctggacttcagcagcaagctggacaacatctacagcagtgacaagttctacaagcagacagtgaacctgcagctgcagccctacagcctggtgaccaccctgaacagcgacctgaagtacaatgccctggacctgaccaacaacgggaagctgcggctggagcccctgaagctgcacgtggccggcaacctgaagggggcctaccagaacaatgagatcaagcacatctatgccatcagcagcgctgccctgagcgccagctacaaggctgacacagtggccaaggtgcagggcgtggagttcagccaccggctgaacacagacattgctggcctggccagcgccatcgacatgagcaccaactacaacagcgacagcctgcacttcagcaatgtgttccgctctgtgatggcccccttcaccatgaccattgatgcccacaccaatggaaatggcaagctggccctgtggggcgagcacacaggccagctgtacagcaagttcctgctgaaggccgagcccctggccttcaccttcagccatgactacaagggcagcaccagccaccacctggtgtccaggaagagcatctctgctgccctggagcacaaggtgtctgccctgctgaccccagctgagcagacaggcacctggaagctgaagacccagttcaacaacaatgagtacagccaggacctggatgcctacaacaccaaggacaagattggagtggagctgaccggccgcaccctggccgacctgaccctgctggacagccccatcaaggtgcccctgctgctgtctgagcccatcaacatcattgatgccctggagatgagagatgctgtggagaagccccaggagttcaccatcgtggcctttgtgaagtatgacaagaaccaggatgtgcacagcatcaacctgcccttctttgagaccctgcaggagtactttgaaagaaaccggcagaccatcatcgtggtgctggagaatgtgcagaggaacctgaagcacatcaacatcgaccagtttgtgaggaagtacagagctgccctgggcaagctgccccagcaggccaatgactacctgaacagcttcaactgggagcggcaggtgtcccatgccaaggagaagctgacagccctgaccaagaagtaccgcatcacagaaaatgacatccagatcgccctggatgatgccaagatcaacttcaatgagaagctgagccagctgcagacctacatgatccagtttgaccagtacatcaaggacagctatgacctgcatgacctgaagatcgccatcgccaacatcattgatgagatcatcgagaagctgaagagcctggatgagcactaccacatccgggtgaacctggtgaagaccatccatgacctgcacctgttcatcgagaacatcgacttcaacaagagcggcagcagcacagcctcctggatccagaatgtggacaccaagtaccagatccgcatccagatccaggagaagctgcagcagctgaagaggcacatccagaacatcgacatccagcacctggccggcaagctgaagcagcacatcgaggccattgatgtgcgggtgctgctggaccagctgggcaccaccatcagctttgagcgcatcaatgacatcctggagcacgtgaagcacttcgtcatcaacctgattggagactttgaggtggccgagaagatcaatgccttccgggccaaggtgcatgagctgattgaaagatatgaggtggaccagcagatccaggtgctgatggacaagctggtggagctggcccaccagtacaagctgaaggagaccatccagaagctgagcaatgtgctgcagcaggtgaagatcaaggactactttgagaagctggtgggcttcattgatgatgctgtgaagaagctgaatgagctgtccttcaagaccttcattgaagatgtgaacaagttcctggacatgctgatcaagaagctgaagagctttgactaccaccagtttgtggatgagaccaatgacaagatccgggaggtgacccagaggctgaatggagagatccaggccctggagctgccccagaaggccgaggccctgaagctgttcctggaggagaccaaggccaccgtggccgtgtacctggagagcctgcaggacaccaagatcaccctcatcatcaactggctgcaggaggccctgagcagcgccagcctggcccacatgaaggccaagttccgggagaccctggaggacacccgggacaggatgtaccagatggacatccagcaggagctgcagcgctacctgagcctggtgggccaggtgtacagcaccctggtgacctacatcagtgactggtggaccctggccgccaagaacctgacagactttgctgagcagtacagcatccaggactgggccaagaggatgaaggccctggtggagcagggcttcaccgtgcctgagatcaagaccatcctgggcaccatgcctgcctttgaggtgtccctgcaggccctgcagaaggccaccttccagaccccagacttcatcgtgcccctgacagacctgcgcatccccagcgtgcagatcaacttcaaggacctgaagaacatcaagatccccagccgcttcagcaccccagagttcaccatcctgaacaccttccacatccccagcttcaccatcgactttgtggagatgaaggtgaagatcatccgcaccatcgaccagatgctgaacagcgagctgcagtggcctgtgcctgacatctacctgcgggacctgaaggtggaggacatccccctggcccgcatcaccctgcctgacttccggctgcctgagatcgccatccctgagttcatcatccccaccctgaacctgaatgacttccaggtgcctgacctgcacatccctgagttccagctgccccacatcagccacaccatcgaggtgcccaccttcggcaagctgtacagcatcctgaagatccagagccccctcttcaccctggatgccaatgctgacattggaaatggcaccaccagcgccaatgaagctggcattgctgccagcatcacagccaagggggagagcaagctggaggtgctgaactttgacttccaggccaatgcccagctgagcaaccccaagatcaaccccctggccctgaaggagagcgtgaagttcagcagcaagtacctgaggacagaacatggcagcgagatgctgttctttggaaatgccatcgagggcaagagcaacacagtggccagcctgcacacagagaagaacaccctggagctgagcaatggagtcatcgtgaagatcaacaaccagctgaccctggacagcaacaccaagtacttccacaagctgaacatccccaagctggacttcagcagccaggccgacctgagaaatgagatcaagaccctgctgaaggccggccacatcgcctggaccagcagcggcaagggctcctggaagtgggcctgcccccgcttcagtgatgagggcacccatgagagccagatctccttcaccatcgagggccccctgaccagctttggcctgagcaacaagatcaacagcaagcacctgcgggtgaaccagaacctggtgtatgagagcggcagcctgaacttcagcaagctggagatccagagccaggtggacagccagcacgtgggccacagcgtgctgacagccaagggcatggccctgtttggagagggcaaggccgagttcaccggcagacatgatgcccacctgaatggcaaggtgattggcaccctgaagaacagcctcttcttcagcgcccagccctttgagatcacagccagcaccaacaatgaaggcaacctgaaggtgcgcttccccctgcggctgaccgggaagattgacttcctgaacaactatgccctcttcctgagccccagcgcccagcaggcctcctggcaggtgtctgcccgcttcaaccagtacaagtacaaccagaacttctctgctggcaacaatgaaaacatcatggaggcccacgtgggcatcaacggggaggccaacctggacttcctgaacatccccctgaccatccctgagatgaggctgccctacaccatcatcaccaccccacccctgaaggacttcagcctgtgggagaagacaggcctgaaggagttcctgaagaccaccaagcagagctttgacctgtctgtgaaggcccagtacaagaagaacaagcaccgccacagcatcaccaaccccctggccgtgctgtgtgagttcatcagccagagcatcaagagctttgacagacactttgagaagaacagaaataatgccctggactttgtgaccaagagctacaatgagaccaagatcaagtttgacaagtacaaggccgagaagagccatgatgagctgcccaggaccttccagatccctggctacacagtgcctgtggtgaatgtggaggtgagccccttcaccatcgagatgtctgccttcggctacgtgttccccaaggctgtgtccatgcccagcttcagcatcctgggcagtgatgtgcgggtgcccagctacaccctcatcctgcccagcctggagctgcctgtgctgcacgtgcccaggaacctgaagctgagcctgcctgacttcaaggagctgtgcaccatcagccacatcttcatcccagccatgggcaacatcacctatgacttctccttcaagagcagcgtcatcaccctgaacaccaatgctgagctgttcaaccagagcgacatcgtggcccacctgctgagcagcagcagctctgtgattgatgccctgcagtacaagctggagggcaccacccggctgaccaggaagaggggcctgaagctggccacagccctgagcctgagcaacaagtttgtggagggcagccacaacagcacagtgtccctgaccaccaagaacatggaggtgtctgtggccaccaccaccaaggcccagatccccatcctgaggatgaacttcaagcaggagctgaatggaaacaccaagagcaagcccaccgtgagcagctccatggagttcaagtatgacttcaacagctccatgctgtacagcacagccaagggagctgtggaccacaagctgagcctggagagcctgaccagctacttcagcattgagagcagcaccaagggagatgtgaagggctctgtgctgagccgggagtacagcggcaccatcgccagcgaggccaacacctacctgaacagcaagagcaccaggagctctgtgaagctgcagggcaccagcaagattgatgacatctggaacctggaggtgaaggagaactttgctggggaggccaccctgcagaggatctacagcctgtgggagcacagcaccaagaaccacctgcagctggagggcctcttcttcaccaacggggagcacaccagcaaggccaccctggagctgagcccctggcagatgtctgccctggtgcaggtgcacgccagccagcccagcagcttccatgacttcccagacctgggccaggaggtggccctgaatgccaacaccaagaaccagaagatccgctggaagaatgaggtgcgcatccacagcggcagcttccagagccaggtggagctgagcaatgaccaggagaaggcccacctggacattgctggcagcctggagggccacctgcgcttcctgaagaacatcatcctgcctgtgtatgacaagagcctgtgggacttcctgaagctggatgtgaccaccagcatcggccggcggcagcacctgcgggtgtccacagcctttgtgtacaccaagaaccccaacggctacagcttcagcatccctgtgaaggtgctggccgacaagttcatcatccctggcctgaagctgaatgacctgaacagcgtgctggtgatgcccaccttccacgtgcccttcacagacctgcaggtgcccagctgcaagctggacttccgggagatccagatctacaagaagctgcggaccagcagctttgccctgaacctgcccaccctgcctgaggtgaagtttcctgaggtggatgtgctgaccaagtacagccagcctgaggacagcctcatccccttctttgagatcaccgtgcctgagagccagctgactgtgtcccagttcaccctgcccaagtctgtgtctgatggcattgctgccctggacctgaatgctgtggccaacaagattgctgactttgagctgcccaccatcatcgtgcctgagcagaccatcgagatccccagcatcaagttctctgtgcctgctggcatcgtcatccccagcttccaggccctgacagccaggtttgaggtggacagccctgtgtacaatgccacctggagcgccagcctgaagaacaaggctgactatgtggagaccgtgctggacagcacctgcagcagcacagtgcagttcctggagtatgagctgaatgtgctgggcacccacaagattgaagatggcaccctggccagcaagaccaagggcacctttgcccaccgggacttcagcgcagaatatgaggaggatggcaagtatgagggcctgcaggagtgggagggcaaggcccacctgaacatcaagagccctgccttcacagacctgcacctgcgctaccagaaggacaagaagggcatcagcaccagcgctgccagccctgctgtgggcaccgtgggcatggacatggatgaagatgatgacttcagcaagtggaacttctactacagcccccagagcagcccagacaagaagctgaccatcttcaagacagagctgcgggtgcgggagagtgatgaggagacccagatcaaggtgaactgggaggaggaggccgccagcggcctgctgaccagcctgaaggacaacgtgcccaaggccaccggggtgctgtatgactatgtgaacaagtaccactgggagcacacaggcctgaccctgcgggaggtgagcagcaagctgcggaggaacctgcagaacaatgctgagtgggtgtaccagggcgccatccggcagattgatgacattgatgtgcgcttccagaaggccgccagcggcaccaccggcacctaccaggagtggaaggacaaggcccagaacctgtaccaggagctgctgacccaggagggccaggccagcttccagggcctgaaggacaacgtgtttgatggcctggtgcgggtgacccaggagttccacatgaaggtgaagcacctgattgacagcctgattgacttcctgaacttcccccgcttccagtttcctgggaagccaggcatctacacccgggaggagctgtgcaccatgttcatccgggaggtgggcaccgtgctgagccaggtgtacagcaaggtgcacaatggaagtgagatcctcttctcctacttccaggacctggtgatcaccctgccctttgagctgaggaagcacaagctgattgatgtgatctccatgtaccgggagctgctgaaggacctgagcaaggaggcccaggaggtgttcaaggccatccagagcctgaagaccacagaggtgctgaggaacctgcaggacctgctgcagttcatcttccagctgattgaggacaacatcaagcagctgaaggagatgaagttcacctacctgatcaactacatccaggatgagatcaacaccatcttcagtgactacatcccctacgtgttcaagctgctgaaggagaacctgtgcctgaacctgcacaagttcaatgagttcatccagaatgagctgcaggaggccagccaggagctgcagcagatccaccagtacatcatggccctgcgggaggagtactttgaccccagcatcgtgggctggacagtgaagtactatgagctggaggagaagatcgtgtccctcatcaagaacctgctggtggccctgaaggacttccacagcgagtacatcgtgtctgccagcaacttcaccagccagctgagcagccaggtggagcagttcctgcacaggaacatccaggagtacctgagcatcctgacagatcctgatggcaagggcaaggagaagattgctgagctgagcgccacagcccaggagatcatcaagagccaggccatcgccaccaagaagatcatcagtgactaccaccagcagttccgctacaagctgcaggacttcagtgaccagctgagtgactactatgagaagttcatcgccgagagcaagaggctgattgacctgagcatccagaactaccacaccttcctgatctacatcacagagctgctgaagaagctgcagagcaccaccgtgatgaacccctacatgaagctggcccctggagagctgaccatcatcctgtag

SEQ ID NO: 15821 - DNA, 3084 bp, Artificial Sequence
  Description of Artificial Sequence: Synthetic coding sequence
atgtatgagggcaagcacatccacttcagcgaggtggacaacaagcccctgtgcagctacagccccaagctgtgcaagcagaggcggctgaatggctacgccttctgcatcagacatgtgctggaggacaagacagcccccttcaagcagtgtgaatatgtggccaagtacaacagccagcgctgcaccaaccccatccccaagtctgaggaccggcgctactgcaacagccacctgcaggtgctgggcttcatccccaagaaggagaggaagaagaagaatgaccccattgatgaggtgaaggtgcgccaccagatggacaccatggccttcagcctgactgtgcccaccctggccctgaagatgcccaacggcctggatggcatgagcctgagccccccaggggcccgggtgcccctgcactacctggagacagagctggaggacccctttgccttcaatgaggaggatgatgacctgaagaagggggccaccgtgaggaagaagctgcagagcaagctggcccagaaccggcagaggcagcgggagacagagatcctgaaggtgcggcaggagcacttcagccccccaccagcccccagccagcagcagcccccccagcagcacagccacctgagccccctgagcaccagcctgaagcccccagccccaccccagggctctgtgtgcaagagcccccagccccagaacaccagcctgcccatgcagggcgtggcccccaccacccacaccatcgcccaggcccggcagctgagccacaagaggcccctgcccctgctgcccagcagccgggcccccaccgtggacccccccaggacagaccgcatcctgatgaaggccacagccttcagcccccacttcagctgcatcagccggctgcagaggctggtgaagctgtgcacccagaagcaccagctggacacagacctcttcccccacctgggcctggactggagcgaggagagcggggaggagcctgaggacagcgagcaggccagcccctaccaggtggcctggagcatccgggagaccctgcgctaccagagacatgccagtgatgatgatgatgctgagagccgcagcagccgggtgacccagctgtgcacctacttccagcagaagtacaagcacctgtgccgcctggagagagctgagagccggcagaagaagtgccgccacaccttcaggaaggccctgctgcaggccgccagcaaggagccagaatgtacaggccagctgatccaggagctgcggcgggccgcctgcagcaggaccagcatcagcaggaccaagctgcgggaggtggagcctgctgcctgcagcggcaccgtgaagggggagcagtgtgccaacaaggccctgcccttcaccaggcactgcttccagcacatcctgctgaaccacagccagcagctgttcagcagctgcacagccaagtttgctgatggccagcagtgcagcgtgcctgtgtttgacatcacccaccagacccccctgtgtgaggagcacgccaagaagatggacaacttcctgcggggggacaacagcaggaaggtgcagcaccagcagcagaggaagcccaggaagaagaccaagcccccagccctgaccaagaagcacaagaagaagagaagaagaggcccccggcggccccagaagcccatccccccagctgtgccccagggcaacctgtccatgcctgcctctgtgtccctgcctgtggaggccagccacatccgcagccccagcaccccagagctgtctgcagatgagctgcctgatgacatcgccaatgagatcacagacatcccccatgacctggagctgaaccaggaggacttcagtgatgtgctgccccggctgcctgatgacctgcaggactttgacttctttgagggcaagaatggagacctgctgcccaccacagaggaggccgaggagctggagcgggccctgcaggccgtgaccagcctggagtgcctgagcaccatcggcgtgctggcccagagtgatggagtgcctgtgcaggagctgagtgaccggggcatcggggtcttcagcactggaactggagccagcggcatccagagcctgagccgggaggtgaacacagacctgggggagctgctgaatggaagaattgtgcatgacaacttcagcagcctggagctggatgagaacctgctgcggagcgccaccctgagcaacccccccacccccctggccggccagatccagggccagttcagcgccccagccaacgtgggcctgaccagcgccaccctcatcagccagagcgccctgggggagcgggccttccctggccagttccacggcctgcatgatggcagccacgccagccagaggccccacccagcccagctgctgagcaaggcagatgacctgatcaccagccggcagcagtacagcagtgaccacagccacagcagcccccacggcagccactatgacagcgagcacgtgcccagcccctacagcgaccacatcaccagcccccacaccaccagctacagcggggacaacatggccgccaccttctctgctgagatgcccatcatggcccagcacctgctgcccacccagctggaggtgcccctgggcggcgtggtgaaccccaggacccactggggcaacctgcctgtgaacctgggggaccccagccccttcagcaacctgctgggcgcagatggccacctgctgagcaccagcctgagcaccccacccaccaccagcaacagcgagaccacccagcctgcctttgccaccgtgacccccagcagcagctctgtgctgcccggcctgccccagaccagcttcagcggcatgggccccagcgctgagctgatggccagcaccagccccaagcagcagctgccccagttctctgctgccttcggccaccagctgagcagccacagcggcatccccaaggacctgcagcccagccacagcagcatcgccccacccaccggcttcaccgtgactggagccacagccaccagcaccaacaatgccagcagccccttccccagccccaactag

SEQ ID NO: 15822 - DNA, 114 bp, Artificial Sequence
  Description of Artificial Sequence: Synthetic coding sequence
atgtatgagggcaagcacatccacttcagcgaggtggacaacaagcccctgtgcagctacagccccaagctgtgcaagcagaggcggctgaatggctacgccttctgcatctag

SEQ ID NO: 15823 - DNA, 735 bp, Artificial Sequence
  Description of Artificial Sequence: Synthetic coding sequence
atgaatggaccagcagatggagaggtggactacaagaagaagtacagaaacctgaagaggaagctgaagttcctgatctatgaacatgagtgcttccaggaggagctgaggaaggcccagaggaagctgctgaaggtgtcccgggacaagagcttcctgctggaccggctgctgcagtatgaaaatgtggatgaggacagcagtgacagtgatgccacagccagcagtgacaacagcgagacagagggcacccccaagctgagtgacaccccagcccccaagaggaagaggagcccccccctgggcggggcccccagccccagcagcctgagcctgccccccagcacaggcttccccctgcaggccagcggcgtgcccagcccctacctgagcagcctggccagcagccgctacccacccttccccagcgactacctggccctgcagctgcctgagcccagccccctgcggcccaagcgggagaagaggccccggctgcccaggaagctgaagatggctgtgggccccccagactgccctgtgggcggccccctgaccttccctggccggggcagcggggccggcgtgggcaccaccctgacccccctgcccccacccaagatgcccccacccaccatcctgagcacagtgccccggcagatgttcagtgatgctggcagcggagatgatgccctggatggagatgatgacctggtgattgacatccctgagtag

SEQ ID NO: 15824 - DNA, 486 bp, Artificial Sequence
  Description of Artificial Sequence: Synthetic coding sequence
gctggagctgcccggcagcccctgctgggcgtggccggcggccagaccctgggcgccaccccaggccctgtgatgaatggaccagcagatggagaggtggactacaagaagaagtacagaaacctgaagaggaagctgaagttcctgatctatgaacatgagtgcttccaggaggagctgaggaaggcccagaggaagctgctgaaggtgtcccgggacaagagcttcctgctggaccggctgctgcagtatgaaaatgtggatgaggacagcagtgacagtgatgccacagccagcagtgacaacagcgagacagagggcacccccaagctgagtgacaccccagcccccaagaggaagaggagcccccccctgggcggggcccccagccccagcagcctgagcctgccccccagcacaggcttccccctgcaggccagcggcgtgcccagcccctacctgagcagcgagcggggccaggcctag

SEQ ID NO: 15825 - DNA, 414 bp, Artificial Sequence
  Description of Artificial Sequence: Synthetic coding sequence
atgaatggaccagcagatggagaggtggactacaagaagaagtacagaaacctgaagaggaagctgaagttcctgatctatgaacatgagtgcttccaggaggagctgaggaaggcccagaggaagctgctgaaggtgtcccgggacaagagcttcctgctggaccggctgctgcagtatgaaaatgtggatgaggacagcagtgacagtgatgccacagccagcagtgacaacagcgagacagagggcacccccaagctgagtgacaccccagcccccaagaggaagaggagcccccccctgggcggggcccccagccccagcagcctgagcctgccccccagcacaggcttccccctgcaggccagcggcgtgcccagcccctacctgagcagcgagcggggccaggcctag

SEQ ID NO: 15826 - DNA, 735 bp, Artificial Sequence; identical to SEQ ID NO: 15823
  Description of Artificial Sequence: Synthetic coding sequence

SEQ ID NO: 15827 - DNA, 2133 bp, Artificial Sequence
  Description of Artificial Sequence: Synthetic coding sequence
atgtctgcccagggcgactgtgagttcctggtgcagagggcccgggagctggtgccccaggacctgtgggccgccaaggcctggctgatcacagcccggagcctgtacccagctgacttcaacatccagtatgagatgtacaccattgaaagaaatgctgagaggacagccacagctggccgcctgctgtatgacatgtttgtgaacttcccagaccagcctgtggtgtggagggagatcagcatcatcaccagcgccctgagaaatgacagccaggacaagcagacccagttcctgcggagcctgtttgagaccctgcccggccgggtgcagtgtgagatgctgctgaaggtgacagagcagtgcttcaacaccctggagaggtctgagatgctgctgctgctgctgcggcgcttccctgagaccgtggtgcagcacggcgtgggcctgggggaggccctgctggaggccgagaccatcgaggagcaggagagccctgtgaactgcttcaggaagctgtttgtgtgtgatgtgctgcccctcatcatcaacaaccatgatgtgcggctgcctgccaacctgctgtacaagtacctgaacaaggctgctgagttctacatcaactacgtgaccaggagcacccagatcgagaaccagcaccagggcgcccaggacaccagtgacctgatgagccccagcaagaggagcagccagaagtacatcatcgagggcctgacagagaagagcagccagatcgtggacccctgggagcggctcttcaagatcctgaatgtggtgggcatgagatgtgagtggcagatggacaagggccgccgctcctatggagacatcctgcacaggatgaaggacctgtgccgctacatgaacaactttgacagcgaggcccacgccaagtacaagaaccaggtggtgtacagcaccatgctggtgttcttcaagaatgccttccagtatgtgaacagcatccagcccagcctcttccagggccccaatgcccccagccaggtgcccctggtgctgctggaggatgtgtccaatgtgtatggagatgtggagattgacaggaacaagcacatccacaagaagaggaagctggccgagggccgggagaagaccatgagcagtgatgatgaggactgcagcgccaagggcaggaacagacacatcgtggtgaacaaggccgagctggccaacagcacagaggtgctggagagcttcaagctggcccgggagagctgggagctgctgtacagcctggagttcctggacaaggagttcacccgcatctgcctggcctggaagacagacacctggctgtggctgcgcatcttcctgacagacatgatcatctaccagggccagtacaagaaggccatcgccagcctgcaccacctggccgccctgcagggcagcatcagccagccccagatcaccggccagggcaccctggagcaccagagggccctgatccagctggccacctgccactttgccctgggggagtacaggatgacctgtgagaaggtgctggacctgatgtgctacatggtgctgcccatccaggacggcggcaagagccaggaggagcccagcaaggtgaagcccaagttcaggaagggcagtgacctgaagctgctgccctgcaccagcaaggccatcatgccctactgcctgcacctgatgctggcctgcttcaagctgcgggccttcacagacaacagagatgacatggccctgggccacgtgattgtgctgctgcagcaggagtggcccagaggagaaaatctcttcctgaaggctgtgaacaagatctgccagcagggcaacttccagtatgagaacttcttcaactacgtgaccaacatcgacatgctggaggagtttgcctacctgcggacccaggagggcggcaagatccacctggagctgctgcccaaccagggcatgctgatcaagcaccacacagtgacccggggcatcaccaagggcgtgaaggaggacttccggctggccatggagcggcaggtgagccgctgtggggagaacctgatggtggtgctgcaccgcttctgcatcaatgagaagatcctgctgctgcagaccctgacctag

SEQ ID NO: 15828 - DNA, 1389 bp, Artificial Sequence
  Description of Artificial Sequence: Synthetic coding sequence
atggccgccaccgtgaacctggagctggaccccatcttcctgaaggccctgggcttcctgcacagcaagagcaaggacagcgctgagaagctgaaggccctgctggatgagagcctggcccggggcatcgacagcagctaccggcccagccagaaggatgtggagccccccaagatcagcagcaccaagaacatcagcatcaagcaggagcccaagatcagcagcagcctgcccagcggcaacaacaacgggaaggtgctgaccacagagaaggtgaagaaggaggccgagaagaggcctgctgacaagatgaagagtgacatcacagaaggagtggacatccccaagaagccccggctggagaagccagagacccagagcagccccatcaccgtgcagagcagcaaggacctgcccatggctgacctgagcagctttgaggagaccagcgcagatgactttgccatggagatgggcctggcctgtgtggtgtgccggcagatgatggtggccagcggcaaccagctggtggagtgccaggagtgccacaacctgtaccaccgggactgccacaagccccaggtgacagacaaggaggccaatgacccccggctggtgtggtactgtgcccgctgcacccggcagatgaagaggatggcccagaagacccagaagccaccccagaagccagccccagctgtggtgtctgtgaccccagctgtgaaggaccccctggtgaagaagccagagaccaagctgaagcaggagaccaccttcctggccttcaagaggacagaggtgaagaccagcaccgtcatcagcggcaacagcagcagcgcctctgtgagcagctctgtgaccagcggcctgaccggctgggccgcctttgctgccaagaccagcagcgctggccccagcacagccaagctgagcagcaccacccagaacaacacaggcaagccagccaccagcagcgccaaccagaagcctgtgggcctgaccggcctggccaccagcagcaaaggaggcatcggcagcaagattggcagcaacaacagcaccacccccaccgtgcccctgaagcccccaccacccctgaccctgggcaagacaggcctgagccgctctgtgtcctgtgacaacgtgtccaaggtgggcctgcccagccccagcagcctggtgcccggcagcagcagccagctgtctggaaatggaaattctggcaccagcggccccagcggcagcaccaccagcaagaccaccagcgagagcagcagcagccccagcgccagcctgaagggccccaccagccaggagagccagctgaatgccatgaagaggctgcagatggtgaagaagaaggccgcccagaagaagctgaagaagtag

SEQ ID NO: 15829 - DNA, 1389 bp, Artificial Sequence; identical to SEQ ID NO: 15828
  Description of Artificial Sequence: Synthetic coding sequence

SEQ ID NO: 15830 - DNA, 267 bp, Artificial Sequence
  Description of Artificial Sequence: Synthetic coding sequence
atggccgccaccgtgaacctggagctggaccccatcttcctgaaggccctgggcttcctgcacagcaagagcaaggacagcgctgagaagctgaaggccctgctggatgagagcctggcccggggcatcgacagcagctaccggcccagccagaaggatgtggagccccccaagatcagcagcaccaagaacatcagcatcaagcaggagcccaagatcagcagcagcctgcccagcggcaacaacaacgggaaggtgctgacctag

SEQ ID NO: 15831 - DNA, 399 bp, Artificial Sequence
  Description of Artificial Sequence: Synthetic coding sequence
atggccgccaccgtgaacctggagctggaccccatcttcctgaaggccctgggcttcctgcacagcaagagcaaggacagcgctgagaagctgaaggccctgctggatgagagcctggcccggggcatcgacagcagctaccggcccagccagaaggatgtggagccccccaagatcagcagcaccaagaacatcagcatcaagcaggagcccaagatcagcagcagcctgcccagcggcaacaacaacgggaaggtgctgaccacagagaaggtgaagaaggaggccgagaagaggcctgctgacaagatgaagagtgacatcacagaaggagtggacatccccaagaagccccggctggagaagccagagacccagagcagccccatcaccgtgtag

SEQ ID NO: 15832 - DNA, 267 bp, Artificial Sequence; identical to SEQ ID NO: 15830
  Description of Artificial Sequence: Synthetic coding sequence

SEQ ID NO: 15833 - DNA, 1389 bp, Artificial Sequence; identical to SEQ ID NO: 15828
  Description of Artificial Sequence: Synthetic coding sequence

SEQ ID NO: 15834 - DNA, 480 bp, Artificial Sequence
  Description of Artificial Sequence: Synthetic coding sequence
atggccgccaccgtgaacctggagctggaccccatcttcctgaaggccctgggcttcctgcacagcaagagcaaggacagcgctgagaagctgaaggccctgctggatgagagcctggcccggggcatcgacagcagctaccggcccagccagaaggatgtggagccccccaagatcagcagcaccaagaacatcagcatcaagcaggagcccaagatcagcagcagcctgcccagcggcaacaacaacgggaaggtgctgaccacagagaaggtgaagaaggaggccgagaagaggcctgctgacaagatgaagagtgacatcacagaaggagtggacatccccaagaagccccggctggagaagccagagacccagagcagccccatcaccgtgcagagcagcaaggacctgcccatggctgacctgagcagctttgaggagaccagcgcagatgactttgccatggagatgggctag

SEQ ID NO: 15835 - DNA, 57 bp, Artificial Sequence; identical to SEQ ID NO: 8431
  Description of Artificial Sequence: Synthetic coding sequence

SEQ ID NO: 15836 - DNA, 3129 bp, Artificial Sequence
  Description of Artificial Sequence: Synthetic coding sequence
atggagctgcagaagggcaaaggagctgctgctgctgctgctgccagcggggctgctgggggcggcggcggcggggccggggccggggcccctgggggcggccgcctgctgctgagcaccagcctggatgccaaggatgagctggaggagcggctggagcgctgcatgagcatcgtgacctccatgacagctggggtgtctgagcgggaggccaatgatgccctgaatgcctacgtgtgcaagggcctgccccagcacgaggagatctgcctgggcctcttcaccctcatcctgacagagcccgcccaggcccagaagtgctacagagacctggccctggtgtccagagatggcatgaacatcgtgctgaacaagatcaaccagatcctgatggagaagtacctgaagctgcaggacacctgcaggacccagctggtgtggctggtgcgggagctggtgaagtctggagtgctgggcgcagatggagtgtgcatgaccttcatgaagcagattgctggaggagatgtgacagccaagaacatctggctggccgagagcgtgctggacatcctgacagagcagcgggagtgggtgctgaagagcagcatcctgattgccatggctgtgtacacctacctgcggctcatcgtggaccaccacggcacagcccagctgcaggccctgcggcagaaggaggtggacttctgcatcagcctgctgcgggagcgcttcatggagtgcctgatgattggccgggacctggtgcggctgctgcagaatgtggcccgcatccctgagtttgagctgctgtggaaggacatcatccacaacccccaggccctgagcccccagttcaccggcatcctgcagctgctgcagagcaggaccagcaggaagttcctggcctgccgcctgaccccagacatggagaccaagctgctcttcatgaccagccgggtgcgcttcggccagcagaagcgctaccaggactggttccagaggcagtacctgagcaccccagacagccagagcctgcgctgtgacctgatccgctacatctgtggggtggtgcaccccagcaatgaggtgctgagcagtgacatcctgccccgctgggccatcatcggctggctgctgaccacctgcaccagcaatgtggccgccagcaatgccaagctggccctcttctatgactggctgttcttctccccagacaaggacagcatcatgaacatcgagcccgccatcctggtgatgcaccacagcatgaagccccacccagccatcacagccaccctgctggacttcatgtgccgcatcatccccaacttctacccacccctggagggccacgtgcggcagggcgtcttcagcagcctgaaccacatcgtggagaagagggtgctggcccacctggcccccctgtttgacaaccccaagctggacaaggagctgcgggccatgctgcgggagaagtttcctgagttctgcagcagccccagcccccctgtggaggtgaagattgaggagcctgtgtccatggagatggacaaccacatgtctgacaaggatgagagctgctatgacaatgctgaggccgccttcagtgatgatgaggaggacctgaacagcaagggcaagaagcgggagttccgcttccaccccatcaaggagaccgtggtggaggagcctgtggacatcaccccctacctggaccagctggatgagagcctgcgggacaaggtgctgcagctgcagaagggcagtgacacagaggcccagtgtgaggtgatgcaggagatcgtggaccaggtgctggaggaggactttgacagcgagcagctgtctgtgctggccagctgcctgcaggagctgttcaaggcccacttccggggggaggtgctgcctgaggagatcacagaggagagcctggaggagagcgtgggcaagcccctgtacctgatcttcaggaacctgtgccagatgcaggaggacaacagcagcttcagcctgctgctggacctgctgtctgagctgtaccagaagcagcccaagattggctaccacctgctgtactacctgcgggccagcaaggctgctgctgggaagatgaacctgtatgagagctttgcccaggccacccagctgggggacctgcacacctgcctgatgatggacatgaaggcctgccaggaggatgatgtgcggctgctgtgccacctgacccccagcatctacacagagttcccagatgagaccctgcggagcggggagctgctgaacatgattgtggccgtgattgattctgcccagctgcaggagctggtgtgccacgtgatgatgggcaacctggtgatgttcaggaaggacagcgtgctgaacatcctgatccagagcctggactgggagacctttgagcagtactgtgcctggcagctgttcctggcccacaacatccccctggagaccatcatccccatcctgcagcacctgaagtacaaggagcaccctgaggccctgagctgcctgctgctgcagctgcggcgggagaagcccagcgaggagatggtgaagatggtgctgagccggccctgccacccagatgaccagttcaccaccagcatcctgcggcactggtgcatgaagcatgatgagctgctggccgagcacatcaagagcctgctgatcaagaacaacagcctgcccaggaagaggcagagcctgcggagcagcagcagcaagctggcccagctgaccctggagcagatcctggagcacctggacaacctgcggctgaacctgaccaacaccaagcagaacttcttcagccagacccccatcctgcaggccctgcagcacgtgcaggccagctgtgatgaggcccacaagatgaagttcagtgacctcttcagcctggccgaggagtatgaggacagcagcaccaagccacccaagagcaggaggaaggccgccctgagcagccccaggagcaggaagaatgccacccagcccccaaatgctgaggaggagagcggcagcagcagcgccagcgaggaggaggacaccaagcccaagcccaccaagaggaagaggaagggcagcagcgctgtgggcagtgacagcgactag

SEQ ID NO: 15837 - DNA, 3129 bp, Artificial Sequence; identical to SEQ ID NO: 15836
  Description of Artificial Sequence: Synthetic coding sequence

SEQ ID NO: 15838 - DNA, 2709 bp, Artificial Sequence
  Description of Artificial Sequence: Synthetic coding sequence
atggctgtgtacacctacctgcggctcatcgtggaccaccacggcacagcccagctgcaggccctgcggcagaaggaggtggacttctgcatcagcctgctgcgggagcgcttcatggagtgcctgatgattggccgggacctggtgcggctgctgcagaatgtggcccgcatccctgagtttgagctgctgtggaaggacatcatccacaacccccaggccctgagcccccagttcaccggcatcctgcagctgctgcagagcaggaccagcaggaagttcctggcctgccgcctgaccccagacatggagaccaagctgctcttcatgaccagccgggtgcgcttcggccagcagaagcgctaccaggactggttccagaggcagtacctgagcaccccagacagccagagcctgcgctgtgacctgatccgctacatctgtggggtggtgcaccccagcaatgaggtgctgagcagtgacatcctgccccgctgggccatcatcggctggctgctgaccacctgcaccagcaatgtggccgccagcaatgccaagctggccctcttctatgactggctgttcttctccccagacaaggacagcatcatgaacatcgagcccgccatcctggtgatgcaccacagcatgaagccccacccagccatcacagccaccctgctggacttcatgtgccgcatcatccccaacttctacccacccctggagggccacgtgcggcagggcgtcttcagcagcctgaaccacatcgtggagaagagggtgctggcccacctggcccccctgtttgacaaccccaagctggacaaggagctgcgggccatgctgcgggagaagtttcctgagttctgcagcagccccagcccccctgtggaggtgaagattgaggagcctgtgtccatggagatggacaaccacatgtctgacaaggatgagagctgctatgacaatgctgaggccgccttcagtgatgatgaggaggacctgaacagcaagggcaagaagcgggagttccgcttccaccccatcaaggagaccgtggtggaggagcctgtggacatcaccccctacctggaccagctggatgagagcctgcgggacaaggtgctgcagctgcagaagggcagtgacacagaggcccagtgtgaggtgatgcaggagatcgtggaccaggtgctggaggaggactttgacagcgagcagctgtctgtgctggccagctgcctgcaggagctgttcaaggcccacttccggggggaggtgctgcctgaggagatcacagaggagagcctggaggagagcgtgggcaagcccctgtacctgatcttcaggaacctgtgccagatgcaggaggacaacagcagcttcagcctgctgctggacctgctgtctgagctgtaccagaagcagcccaagattggctaccacctgctgtactacctgcgggccagcaaggctgctgctgggaagatgaacctgtatgagagctttgcccaggccacccagctgggggacctgcacacctgcctgatgatggacatgaaggcctgccaggaggatgatgtgcggctgctgtgccacctgacccccagcatctacacagagttcccagatgagaccctgcggagcggggagctgctgaacatgattgtggccgtgattgattctgcccagctgcaggagctggtgtgccacgtgatgatgggcaacctggtgatgttcaggaaggacagcgtgctgaacatcctgatccagagcctggactgggagacctttgagcagtactgtgcctggcagctgttcctggcccacaacatccccctggagaccatcatccccatcctgcagcacctgaagtacaaggagcaccctgaggccctgagctgcctgctgctgcagctgcggcgggagaagcccagcgaggagatggtgaagatggtgctgagccggccctgccacccagatgaccagttcaccaccagcatcctgcggcactggtgcatgaagcatgatgagctgctggccgagcacatcaagagcctgctgatcaagaacaacagcctgcccaggaagaggcagagcctgcggagcagcagcagcaagctggcccagctgaccctggagcagatcctggagcacctggacaacctgcggctgaacctgaccaacaccaagcagaactgcatgcccagcaccctgggcgtgcagtgccgccgctgctgccccggccctgactatgcctggagccaggccggcggccggggccgcacccctggggccaccacccacacccgggacaagaccacctgtgcctgctgcctgatcagcagccagaccagtgactgcttctccttccctgccctgcccttcctgcccctggtgttcagccagacccccatcctgcaggccctgcagcacgtgcaggccagctgtgatgaggcccacaagatgaagttcagtgacctcttcagcctggccgaggagtatgaggacagcagcaccaagccacccaagagcaggaggaaggccgccctgagcagccccaggagcaggaagaatgccacccagcccccaaatgctgaggaggagagcggcagcagcagcgccagcgaggaggaggacaccaagcccaagcccaccaagaggaagaggaagggcagcagcgctgtgggcagtgacagcgactag

SEQ ID NO: 15839 - DNA, 2709 bp, Artificial Sequence; identical to SEQ ID NO: 15838
  Description of Artificial Sequence: Synthetic coding sequence

SEQ ID NO: 15840 - DNA, 1530 bp, Artificial Sequence
  Description of Artificial Sequence: Synthetic coding sequence
cccaacagcatctgccgccacctgcacctgacagacaccagccatggagtgaggaacaagtgcctgcagctgctgggcaacctgggcagcctggagaagtctgtgaccaaggatgctgagggcctggccgccagagatgtgcagaagatcattggagactacttcagtgaccaggacccccgggtgaggacagctgccatcaaggccatgctgcagctgcacgagcggggcctgaagctgcaccagaccatctacaaccaggcctgcaagctgctgagtgatgattatgagcaggtgcgctctgctgctgtgcagctgatctgggtggtgtcccagctgtacccagagagcatcgtgcccatccccagcagcaatgaggagatccggctggtggatgatgccttcggcaagatctgccacatggtgtctgatggctcctgggtggtgcgggtgcaggccgccaagctgctgggctccatggagcaggtgagcagccacttcctggagcagaccctggacaagaagctgatgtctgacctgcggaggaagaggacagcccacgagcgggccaaggagctgtacagcagcggggagttcagcagcggcaggaagtggggagatgatgcccccaaggaggaggtggacaccggggctgtgaacctgattgagagcggggcctgtggggcctttgtgcacggcctggaggatgagatgtatgaggtgagaattgctgctgtggaggccctgtgcatgctggcccagagcagccccagctttgctgagaagtgcctggacttcctggtggacatgtttaatgatgaaattgaggaggtgcggctgcagagcatccacaccatgaggaagatcagcaacaacatcaccctgcgggaggaccagctggacacagtgctggccgtgctggaggacagcagccgggacatccgggaggccctgcacgagctgctgtgctgcaccaacgtgtccaccaaggagggcatccacctggccctggtggagctgctgaagaacctgaccaagtaccccacagaccgggacagcatctggaagtgcctgaagttcctgggcagccgccaccccaccctggtgctgcccctggtgcctgagctgctgagcacccaccccttctttgacacagctgagccagacatggatgatcctgcctacatcgctgtgctggtgctgatcttcaatgctgccaagacctgccccaccatgcctgccctcttcagtgaccacaccttccgccactacgcctacctgcgggacagcctgagccacctggtgcctgccctgcggctgcccggcaggaagctggtgagcagcgctgtgagccccagcatcatcccccaggaggaccccagccagcagttcctgcagcagagcctggagcgggtgtacagcctgcagcacctggacccccagggcgcccaggagctgctggagttcaccatccgggtggaggtgagcccctggtggccaggctggagccagaccccagagctgaagtag

SEQ ID NO: 15841 - DNA, 2892 bp, Artificial Sequence
  Description of Artificial Sequence: Synthetic coding sequence
atggccgcccacctgaagaagagggtgtatgaggagttcaccaaggtggtgcagccccaggaggagatcgccaccaagaagctgcggctgaccaagcccagcaagtctgctgccctgcacatcgacctgtgcaaggccaccagccctgcagatgccctgcagtacctgctgcagtttgccaggaagcctgtggaggccgagagcgtggagggcgtggtgcgcatcctgctggagcactactacaaggaaaatgaccccagcgtgcggctgaagatcgccagcctgctgggcctgctgagcaagacagctggcttctccccagactgcatcatggatgatgccatcaacatcctgcagaatgagaagagccaccaggtgctggcccagctgctggacaccctgctggccatcggcaccaagctgcctgagaaccaggccatccagatgaggctggtggatgtggcctgcaagcacctgacagacaccagccacggcgtgaggaacaagtgcctgcagctgctgggcaacctgggcagcctggagaagtctgtgaccaaggatgctgagggcctggccgccagagatgtgcagaagatcatcggggactacttcagtgaccaggacccccgggtgaggacagctgccatcaaggccatgctgcagctgcacgagcggggcctgaagctgcaccagaccatctacaaccaggcctgcaagctgctgagtgatgattatgagcaggtgcgctctgctgctgtgcagctgatctgggtggtgtcccagctgtacccagagagcatcgtgcccatccccagcagcaatgaggagatccggctggtggatgatgccttcggcaagatctgccacatggtgtctgatggctcctgggtggtgcgggtgcaggccgccaagctgctgggctccatggagcaggtgagcagccacttcctggagcagaccctggacaagaagctgatgtctgacctgcggaggaagaggacagcccacgagcgggccaaggagctgtacagcagtggagagttcagcagcggcaggaagtggggagatgatgcccccaaggaggaggtggacacaggagctgtgaacctgattgaaagtggggcctgtggggcctttgtgcacggcctggaggatgagatgtatgaggtgagaattgctgctgtggaggccctgtgcatgctggcccagagcagccccagctttgctgagaagtgcctggacttcctggtggacatgtttaatgatgaaattgaggaggtgcggctgcagagcatccacaccatgaggaagatcagcaacaacatcaccctgcgggaggaccagctggacacagtgctggccgtgctggaggacagcagccgggacatccgggaggccctgcacgagctgctgtgctgcaccaacgtgtccaccaaggagggcatccacctggccctggtggagctgctgaagaacctgaccaagtaccccacagaccgggacagcatctggaagtgcctgaagttcctgggcagccgccaccccaccctggtgctgcccctggtgcctgagctgctgagcacccaccccttctttgacacagctgagccagacatggatgatcctgcctacatcgctgtgctggtgctgatcttcaatgctgccaagacctgccccaccatgcctgccctcttcagtgaccacaccttccgccactacgcctacctgcgggacagcctgagccacctggtgcctgccctgcggctgcccggcaggaagctggtgtcctctgctgtgagccccagcatcatcccccaggaggaccccagccagcagttcctgcagcagagcctggagcgggtgtacagcctgcagcacctggacccccagggcgcccaggagctgctggagttcaccatccgggacctgcagaggctgggggagctgcagagcgagctggccggcgtggccgacttcagcgccacctacctgcgctgccagctgctgctgatcaaggccctgcaggagaagctgtggaatgtggccgcccccctgtacctgaagcagagcgacctggccagcgctgctgccaagcagatcatggaggagacctacaagatggagttcatgtacagcggcgtggagaacaagcaggtggtgatcatccaccacatgaggctgcaggccaaggccctgcagctgattgtgacagcccggaccacccggggcctggaccccctgtttggcatgtgtgagaagttcctgcaggaggtggacttcttccagcgctacttcatcgctgacctgccccacctgcaggacagctttgtggacaagctgctggacctgatgccccggctgatgaccagcaagccagctgaggtggtgaagatcctgcagaccatgctgcggcagagcgccttcctgcacctgcccctgcctgagcagatccacaaggccagcgccaccatcatcgagcctgctggggagagtgacaaccccctgcgcttcaccagcggcctggtggtggccctggatgtggatgccaccctggagcacgtgcaggacccccagaacacagtgaaggtgcaggtgctgtacccagatggccaggcccagatgatccaccccaagccagctgacttcagaaatcctggccctggccgccacaggctcatcacccaggtgtacctgagccacacagcctggacagaggcctgccaggtggaggtgcggctgctgctggcctacaacagcagcgcccgcatccccaagtgcccctggatggagggcggggagatgagcccccaggtggagaccagcattgagggcaccatccccttcagcaagcctgtgaaggtgtacatcatgcccaagccagcccggaggtag

SEQ ID NO: 15842 - DNA, 1017 bp, Artificial Sequence
  Description of Artificial Sequence: Synthetic coding sequence
atgcctgccctgaagcagacagccagccaggtgacccagaccctgcgggacctgcagaggctgggggagctgcagagcgagctggccggcgtggccgacttcagcgccacctacctgcgctgccagctgctgctgatcaaggccctgcaggagaagctgtggaatgtggccgcccccctgtacctgaagcagagcgacctggccagcgctgctgccaagcagatcatggaggagacctacaagatggagttcatgtacagcggcgtggagaacaagcaggtggtgatcatccaccacatgaggctgcaggccaaggccctgcagctgattgtgacagcccggaccacccggggcctggaccccctgtttggcatgtgtgagaagttcctgcaggaggtggacttcttccagcgctacttcatcgctgacctgccccacctgcaggacagctttgtggacaagctgctggacctgatgccccggctgatgaccagcaagccagctgaggtggtgaagatcctgcagaccatgctgcggcagagcgccttcctgcacctgcccctgcctgagcagatccacaaggccagcgccaccatcatcgagcctgctggggagagtgacaaccccctgcgcttcaccagcggcctggtggtggccctggatgtggatgccaccctggagcacgtgcaggacccccagaacacagtgaaggtgcaggtgctgtacccagatggccaggcccagatgatccaccccaagccagctgacttcaggaaccctggccctggccgccacaggctcatcacccaggtgtacctgagccacacagcctggacagaggcctgccaggtggaggtgcggctgctgctggcctacaacagcagcgcccgcatccccaagtgcccctggatggagggcggggagatgagcccccaggtggagaccagcattgagggcaccatccccttcagcaagcctgtgaaggtgtacatcatgcccaagccagcccggaggtag

SEQ ID NO: 15843 - DNA, 2829 bp, Artificial Sequence
  Description of Artificial Sequence: Synthetic coding sequence
atggccagcaacagcaccaagagcttcctggctgatgctggctatggagagcaggagctggatgccaacagcgccctgatggagctggacaagggcctgcggagcggcaagctgggggagcagtgtgaggccgtggtgcgcttccccaggctcttccagaagtaccccttccccatcctgatcaacagcgccttcctgaagctggctgatgtgttccgggtgggcaacaacttcctgcggctgtgtgtgctgaaggtgacccagcagagcgagaagcacctggagaagatcctgaatgtggatgaatttgtgaagaggatcttcagcgtcatccacagcaatgaccctgtggcccgggccatcaccctgaggatgctgggcagcctggccagcatcatccctgagaggaagaatgcccaccacagcatccggcagagcctggacagccatgacaacgtggaggtggaggccgctgtgtttgctgctgccaacttcagcgcccagagcaaggactttgctgtgggcatctgcaacaagatcagcgagatgatccagggcctggccacccctgtggacctgaagctgaagctgatccccatcctgcagcacatgcaccatgatgccatcctggccagcagcgcccggcagctgctgcagcagctggtgaccagctaccccagcaccaagatggtgattgtgtccctgcacaccttcaccctgctggccgccagcagcctggtggacacccccaagcagatccagctgctgctgcagtacctgaagaatgaccccaggaaggctgtgaagaggctggccatccaggacctgaagctgctggccaacaagaccccccacacctggagccgggagaacatccaggccctgtgtgaatgtgccctgcagaccccctatgacagcctgaagctgggcatgctgtctgtgctgagcaccctgagcggcaccatcgccatcaagcactacttcagcatcgtgcctggaaatgtgagcagcagccccaggagcagtgacctggtgaagctggcccaggagtgctgctaccacaacaacagaggaattgctgcccacggcgtgcgggtgctgaccaacatcaccgtgtcctgccaggagaaggacctgctggccctggagcaggatgctgtgtttggcctggagagcctgctggtgctgtgcagccaggatgacagccctggggcccaggccaccctgaagatcgccctgaactgcatggtgaagctggccaagggccggccccacctgagccagagcgtggtggagaccctgctgacccagctgcacagcgcccaggatgctgcccgcatcctgatgtgccactgcctggccgccatcgccatgcagctgcctgtgctgggagatggcatgctgggggacctgatggagctgtacaaggtgattggccgcagcgccacagacaagcagcaggagctgctggtgtccctggccaccgtcatctttgtggccagccagaaggccctgtctgtggagagcaaggctgtgatcaagcagcagctggagagcgtgtccaatggctggacagtgtacagaattgcccggcaggccagcaggatgggcaaccacgacatggccaaggagctgtaccagagcctgctgacccaggtggccagcgagcacttctacttctggctgaacagcctgaaggagttcagccatgctgagcagtgcctgaccggcctgcaggaggagaactacagcagcgccctgagctgcatcgccgagagcctgaagttctaccacaagggcatcgccagcctgacagctgccagcacccccctgaaccccctgtccttccagtgtgaatttgtgaagctgagaattgacctgctgcaggccttcagccagctgatctgcacctgcaacagcctgaagaccagccccccaccagccatcgccaccaccatcgccatgaccctgggcaatgacctgcagagatgtggccgcatcagcaaccagatgaagcagagcatggaggagttccgcagcctggccagccgctatggagacctgtaccaggccagctttgatgctgacagcgccaccctgagaaatgtggagctgcagcagcagagctgcctgctgatcagccacgccatcgaggccctgatcctggaccctgagagcgccagcttccaggagtatggcagcactggaacagcccacgccgacagtgaatatgaaagaaggatgatgtctgtgtacaaccacgtgctggaggaggtggagagcctgaacaggaagtacacccctgtgtcctacatgagatacttcttccagaagctgcagagcaccagcatcaagctggccctgagccccagccccagaaatcctgctgagcccatcgctgtgcagaacaaccagcagctggccctgaaggtggagggcgtggtgcagcacggcagcaagccaggcctcttcaggaagatccagagcgtgtgcctgaatgtgagcagcaccctgcagagcaagagcggccaggactacaagatccccatcgacaacatgaccaatgagatggagcagagggtggagccccacaatgactacttcagcacccagttcctgctgaactttgccatcctgggcacccacaacatcaccgtggagagctctgtgaaggatgccaacggcatcgtgtggaagacaggccccaggaccaccatctttgtgaagagcctggaggacccctacagccagcagatccggctgcagcagcagcaggcccagcagcccctgcagcagcagcagcagagaaatgcctacacccgcttctag

SEQ ID NO: 15844 - DNA, 2847 bp, Artificial Sequence
  Description of Artificial Sequence: Synthetic coding sequence
atggccagcaacagcaccaagagcttcctggctgatgctggctatggagagcaggagctggatgccaacagcgccctgatggagctggacaagggcctgcggagcggcaagctgggggagcagtgtgaggccgtggtgcgcttccccaggctcttccagaagtaccccttccccatcctgatcaacagcgccttcctgaagctggctgatgtgttccgggtgggcaacaacttcctgcggctgtgtgtgctgaaggtgacccagcagagcgagaagcacctggagaagatcctgaatgtggatgaatttgtgaagaggatcttcagcgtcatccacagcaatgaccctgtggcccgggccatcaccctgaggatgctgggcagcctggccagcatcatccctgagaggaagaatgcccaccacagcatccggcagagcctggacagccatgacaacgtggaggtggaggccgctgtgtttgctgctgccaacttcagcgcccagagcaaggactttgctgtgggcatctgcaacaagatcagcgagatgatccagggcctggccacccctgtggacctgaagctgaagctgatccccatcctgcagcacatgcaccatgatgccatcctggccagcagcgcccggcagctgctgcagcagctggtgaccagctaccccagcaccaagatggtgattgtgtccctgcacaccttcaccctgctggccgccagcagcctggtggacacccccaagcagatccagctgctgctgcagtacctgaagaatgaccccaggaaggctgtgaagaggctggccatccaggacctgaagctgctggccaacaagaccccccacacctggagccgggagaacatccaggccctgtgtgaatgtgccctgcagaccccctatgacagcctgaagctgggcatgctgtctgtgctgagcaccctgagcggcaccatcgccatcaagcactacttcagcatcgtgcctggaaatgtgagcagcagccccaggagcagtgacctggtgaagctggcccaggagtgctgctaccacaacaacagaggaattgctgcccacggcgtgcgggtgctgaccaacatcaccgtgtcctgccaggagaaggacctgctggccctggagcaggatgctgtgtttggcctggagagcctgctggtgctgtgcagccaggatgacagccctggggcccaggccaccctgaagatcgccctgaactgcatggtgaagctggccaagggccggccccacctgagccagagcgtggtggagaccctgctgacccagctgcacagcgcccaggatgctgcccgcatcctgatgtgccactgcctggccgccatcgccatgcagctgcctgtgctgggagatggcatgctgggggacctgatggagctgtacaaggtgattggccgcagcgccacagacaagcagcaggagctgctggtgtccctggccaccgtcatctttgtggccagccagaaggccctgtctgtggagagcaaggctgtgatcaagcagcagctggagagcgtgtccaatggctggacagtgtacagaattgcccggcaggccagcaggatgggcaaccacgacatggccaaggagctgtaccagagcctgctgacccaggtggccagcgagcacttctacttctggctgaacagcctgaaggagttcagccatgctgagcagtgcctgaccggcctgcaggaggagaactacagcagcgccctgagctgcatcgccgagagcctgaagttctaccacaagggcatcgccagcctgacagctgccagcacccccctgaaccccctgtccttccagtgtgaatttgtgaagctgagaattgacctgctgcaggccttcagccagctgatctgcacctgcaacagcctgaagaccagccccccaccagccatcgccaccaccatcgccatgaccctgggcaatgacctgcagagatgtggccgcatcagcaaccagatgaagcagagcatggaggagttccgcagcctggccagccgctatggagacctgtaccaggccagctttgatgctgacagcgccaccctgagaaatgtggagctgcagcagcagagctgcctgctgatcagccacgccatcgaggccctgatcctggaccctgagagcgccagcttccaggagtatggcagcactggaacagcccacgccgacagtgaatatgaaagaaggatgatgtctgtgtacaaccacgtgctggaggagcacacagcctgcctgtgcaatgccatcatcgccctgctgaaggtgcccctgtccttccagcgctacttcttccagaagctgcagagcaccagcatcaagctggccctgagccccagccccagaaatcctgctgagcccatcgctgtgcagaacaaccagcagctggccctgaaggtggagggcgtggtgcagcacggcagcaagccaggcctcttcaggaagatccagagcgtgtgcctgaatgtgagcagcaccctgcagagcaagagcggccaggactacaagatccccatcgacaacatgaccaatgagatggagcagagggtggagccccacaatgactacttcagcacccagttcctgctgaactttgccatcctgggcacccacaacatcaccgtggagagctctgtgaaggatgccaacggcatcgtgtggaagacaggccccaggaccaccatctttgtgaagagcctggaggacccctacagccagcagatccggctgcagcagcagcaggcccagcagcccctgcagcagcagcagcagagaaatgcctacacccgcttctag

SEQ ID NO: 15845 - DNA, 2889 bp, Artificial Sequence
  Description of Artificial Sequence: Synthetic coding sequence
atggccagcaacagcaccaagagcttcctggctgatgctggctatggagagcaggagctggatgccaacagcgccctgatggagctggacaagggcctgcggagcggcaagctgggggagcagtgtgaggccgtggtgcgcttccccaggctcttccagaagtaccccttccccatcctgatcaacagcgccttcctgaagctggctgatgtgttccgggtgggcaacaacttcctgcggctgtgtgtgctgaaggtgacccagcagagcgagaagcacctggagaagatcctgaatgtggatgaatttgtgaagaggatcttcagcgtcatccacagcaatgaccctgtggcccgggccatcaccctgaggatgctgggcagcctggccagcatcatccctgagaggaagaatgcccaccacagcatccggcagagcctggacagccatgacaacgtggaggtggaggccgctgtgtttgctgctgccaacttcagcgcccagagcaaggactttgctgtgggcatctgcaacaagatcagcgagatgatccagggcctggccacccctgtggacctgaagctgaagctgatccccatcctgcagcacatgcaccatgatgccatcctggccagcagcgcccggcagctgctgcagcagctggtgaccagctaccccagcaccaagatggtgattgtgtccctgcacaccttcaccctgctggccgccagcagcctggtggacacccccaagcagatccagctgctgctgcagtacctgaagaatgaccccaggaaggctgtgaagaggctggccatccaggacctgaagctgctggccaacaagaccccccacacctggagccgggagaacatccaggccctgtgtgaatgtgccctgcagaccccctatgacagcctgaagctgggcatgctgtctgtgctgagcaccctgagcggcaccatcgccatcaagcactacttcagcatcgtgcctggaaatgtgagcagcagccccaggagcagtgacctggtgaagctggcccaggagtgctgctaccacaacaacagaggaattgctgcccacggcgtgcgggtgctgaccaacatcaccgtgtcctgccaggagaaggacctgctggccctggagcaggatgctgtgtttggcctggagagcctgctggtgctgtgcagccaggatgacagccctggggcccaggccaccctgaagatcgccctgaactgcatggtgaagctggccaagggccggccccacctgagccagagcgtggtggagaccctgctgacccagctgcacagcgcccaggatgctgcccgcatcctgatgtgccactgcctggccgccatcgccatgcagctgcctgtgctgggagatggcatgctgggggacctgatggagctgtacaaggtgattggccgcagcgccacagacaagcagcaggagctgctggtgtccctggccaccgtcatctttgtggccagccagaaggccctgtctgtggagagcaaggctgtgatcaagcagcagctggagagcgtgtccaatggctggacagtgtacagaattgcccggcaggccagcaggatgggcaaccacgacatggccaaggagctgtaccagagcctgctgacccaggtggccagcgagcacttctacttctggctgaacagcctgaaggagttcagccatgctgagcagtgcctgaccggcctgcaggaggagaactacagcagcgccctgagctgcatcgccgagagcctgaagttctaccacaagggcatcgccagcctgacagctgccagcacccccctgaaccccctgtccttccagtgtgaatttgtgaagctgagaattgacctgctgcaggccttcagccagctgatctgcacctgcaacagcctgaagaccagccccccaccagccatcgccaccaccatcgccatgaccctgggcaatgacctgcagagatgtggccgcatcagcaaccagatgaagcagagcatggaggagttccgcagcctggccagccgctatggagacctgtaccaggccagctttgatgctgacagcgccaccctgagaaatgtggagctgcagcagcagagctgcctgctgatcagccacgccatcgaggccctgatcctggaccctgagagcgccagcttccaggagtatggcagcactggaacagcccacgccgacagtgaatatgaaagaaggatgatgtctgtgtacaaccacgtgctggaggaggtggagagcctgaacaggaagtacacccctgtgtcctacatgcacacagcctgcctgtgcaatgccatcatcgccctgctgaaggtgcccctgtccttccagcgctacttcttccagaagctgcagagcaccagcatcaagctggccctgagccccagccccagaaatcctgctgagcccatcgctgtgcagaacaaccagcagctggccctgaaggtggagggcgtggtgcagcacggcagcaagccaggcctcttcaggaagatccagagcgtgtgcctgaatgtgagcagcaccctgcagagcaagagcggccaggactacaagatccccatcgacaacatgaccaatgagatggagcagagggtggagccccacaatgactacttcagcacccagttcctgctgaactttgccatcctgggcacccacaacatcaccgtggagagctctgtgaaggatgccaacggcatcgtgtggaagacaggccccaggaccaccatctttgtgaagagcctggaggacccctacagccagcagatccggctgcagcagcagcaggcccagcagcccctgcagcagcagcagcagagaaatgcctacacccgcttctag

SEQ ID NO: 15846 - DNA, 2742 bp, Artificial Sequence
  Description of Artificial Sequence: Synthetic coding sequence
atggccagcaacagcaccaagagcttcctggctgatgctggctatggagagcaggagctggatgccaacagcgccctgatggagctggacaagggcctgcggagcggcaagctgggggagcagtgtgaggccgtggtgcgcttccccaggctcttccagaagtaccccttccccatcctgatcaacagcgccttcctgaagctggctgatgtgttccgggtgggcatgctgggcagcctggccagcatcatccctgagaggaagaatgcccaccacagcatccggcagagcctggacagccatgacaacgtggaggtggaggccgctgtgtttgctgctgccaacttcagcgcccagagcaaggactttgctgtgggcatctgcaacaagatcagcgagatgatccagggcctggccacccctgtggacctgaagctgaagctgatccccatcctgcagcacatgcaccatgatgccatcctggccagcagcgcccggcagctgctgcagcagctggtgaccagctaccccagcaccaagatggtgattgtgtccctgcacaccttcaccctgctggccgccagcagcctggtggacacccccaagcagatccagctgctgctgcagtacctgaagaatgaccccaggaaggctgtgaagaggctggccatccaggacctgaagctgctggccaacaagaccccccacacctggagccgggagaacatccaggccctgtgtgaatgtgccctgcagaccccctatgacagcctgaagctgggcatgctgtctgtgctgagcaccctgagcggcaccatcgccatcaagcactacttcagcatcgtgcctggaaatgtgagcagcagccccaggagcagtgacctggtgaagctggcccaggagtgctgctaccacaacaacagaggaattgctgcccatggagtgcgggtgctgaccaacatcaccgtgtcctgccaggagaaggacctgctggccctggagcaggatgctgtgtttggcctggagagcctgctggtgctgtgcagccaggatgacagccctggggcccaggccaccctgaagatcgccctgaactgcatggtgaagctggccaagggccggccccacctgagccagagcgtggtggagaccctgctgacccagctgcacagcgcccaggatgctgcccgcatcctgatgtgccactgcctggccgccatcgccatgcagctgcctgtgctgggagatggcatgctgggggacctgatggagctgtacaaggtgattggccgcagcgccacagacaagcagcaggagctgctggtgtccctggccaccgtcatctttgtggccagccagaaggccctgtctgtggagagcaaggccgtcatcaagcagcagctggagagcgtgtccaatggctggacagtgtaccgcatcgcccggcaggccagcaggatgggcaaccacgacatggccaaggagctgtaccagagcctgctgacccaggtggccagcgagcacttctacttctggctgaacagcctgaaggagttcagccacgccgagcagtgcctgaccggcctgcaggaggagaactacagcagcgccctgagctgcatcgccgagagcctgaagttctaccacaagggcatcgccagcctgacagctgccagcacccccctgaaccccctgtccttccagtgtgaatttgtgaagctgagaattgacctgctgcaggccttcagccagctgatctgcacctgcaacagcctgaagaccagccccccaccagccatcgccaccaccatcgccatgaccctgggcaatgacctgcagagatgtggccgcatcagcaaccagatgaagcagagcatggaggagttccgcagcctggccagccgctacggggacctgtaccaggccagctttgatgctgacagcgccaccctgagaaatgtggagctgcagcagcagagctgcctgctgatcagccacgccatcgaggccctgatcctggaccctgagagcgccagcttccaggagtatggcagcactggaacagcccatgctgacagtgaatatgaaagaaggatgatgtctgtgtacaaccacgtgctggaggaggtggagagcctgaacaggaagtacacccctgtgtcctacatgcacacagcctgcctgtgcaatgccatcatcgccctgctgaaggtgcccctgtccttccagcgctacttcttccagaagctgcagagcaccagcatcaagctggccctgagccccagccccaggaacccagctgagcccatcgctgtgcagaacaaccagcagctggccctgaaggtggagggcgtggtgcagcacggcagcaagccaggcctcttcaggaagatccagagcgtgtgcctgaatgtgagcagcaccctgcagagcaagagcggccaggactacaagatccccatcgacaacatgaccaatgagatggagcagagggtggagccccacaatgactacttcagcacccagttcctgctgaactttgccatcctgggcacccacaacatcaccgtggagagctctgtgaaggatgccaatggaattgtgtggaagacaggccccaggaccaccatctttgtgaagagcctggaggacccctacagccagcagatccggctgcagcagcagcaggcccagcagcccctgcagcagcagcagcagagaaatgcctacacccgcttctag

SEQ ID NO: 15847 - DNA, 2937 bp, Artificial Sequence
  Description of Artificial Sequence: Synthetic coding sequence
atgtctgctgaggccgctgaccgggaggccgccaccagcagccggccctgcaccccaccccagacctgctggtttgagttcctgctggaggagagcctgctggagaagcacctgaggaagccctgcccagaccctgcccctgtgcagctgattgtgcagttcctggagcaggccagcaagcccagcgtgaatgagcagaaccaggtgcagcccccaccagacaacaagaggaaccgcatcctgaagctgctggccctgaaggtggccgcccacctgaagtgggacctggacatcctggagaagagcctgtctgtgcctgtgctgaacatgctgctgaatgagctgctgtgcatcagcaaggtgcccccaggcaccaagcacgtggacatggacctggccaccctgccccccaccacagccatggctgtgctgctgtacaaccgctgggccatccgcaccatcgtgcagagcagcttccctgtgaagcaggccaagccaggccccccccagctgtctgtgatgaaccagatgcagcaggagaaggagctgacagagaacatcctgaaggtgctgaaggagcaggccgctgacagcatcctggtgctggaggccgccctgaagctgaacaaggacctgtatgtgcacaccatgaggaccctggacctgctggccatggagcccggcatggtgaatggagaaacagagagcagcacagctggcctgaaggtgaagacagaggagatgcagtgccaggtgtgctatgacctgggcgccgcctacttccagcagggcagcaccaacagcgctgtgtatgaaaatgcccgggagaagttcttccgcaccaaggagctgattgctgagatcggcagcctgagcctgcactgcaccattgatgagaagaggctggccggctactgccaggcctgtgatgtgctggtgcccagcagtgacagcaccagccagcagctgaccccctacagccaggtgcacatctgcctgcggagcggcaactaccaggaggtgatccagatcttcatcgaggacaacctgaccctgagcctgcctgtgcagttccggcagagcgtgctgcgggagctgttcaagaaggcccagcagggcaatgaggccctggatgagatctgcttcaaggtgtgtgcctgcaacacagtgcgggacatcctggagggccgcaccatctctgtgcagttcaaccagctgttcctgcggcccaacaaggagaagattgacttcctgctggaggtgtgcagccgctctgtgaacctggagaaggccagcgagagcctgaagggcaacatggccgccttcctgaagaatgtgtgcctgggcctggaggacctgcagtatgtgttcatgatcagcagccatgagctgttcatcaccctgctgaaggatgaggagaggaagctgctggtggaccagatgaggaagaggagcccccgggtgaacctgtgcatcaagcctgtgaccagcttctatgacatcccagccagcgcctctgtgaacatcggccagctggagcaccagctgatcctgtctgtggacccctggaggatccggcagatcctgattgagctgcacggcatgaccagcgagcggcagttctggacagtgagcaacaagtgggaggtgcccagcgtgtacagcggggtcatcctgggcatcaaggacaacctgacccgggacctggtgtacatcctgatggccaagggcctgcactgcagcacagtgaaggacttcagccacgccaagcagctgtttgctgcctgcctggagctggtgacagagttcagccccaagctgcggcaggtgatgctgaatgagatgctgctgctggacatccacacccatgaagctggcaccggccaggccggggagcggccccccagcgacctgatcagccgggtgcggggctacctggagatgaggctgcctgacatccccctgcggcaggtgattgctgaggagtgtgtggccttcatgctgaactggagagaaaatgagtacctgaccctgcaggtgcctgccttcctgctgcagagcaacccctacgtgaagctgggccagctgctggccgccacctgcaaggagctgcccggccccaaggagagcagaagaacagccaaggacctgtgggaggtggtggtgcagatctgcagcgtgagcagccagcacaagagaggaaatgatggccgggtgtccctcatcaagcagcgggagagcaccctgggcatcatgtacagaagtgagctgctgtccttcatcaagaagctgcgggagcccctggtgctgaccatcatcctgagcctgtttgtgaagctgcacaacgtgagagaagatattgtgaatgacatcacagctgagcacatcagcatctggcccagcagcatccccaacctgcagagcgtggactttgaagctgtggccatcaccgtgaaggagctggtgcgctacaccctgagcatcaaccccaacaaccacagctggctgatcatccaggccgacatctactttgccaccaaccagtacagcgctgccctgcactactacctgcaggccggggctgtgtgcagcgacttcttcaacaaggctgtgcccccagatgtgtacacagaccaggtggccatcctgtgccagttcctgcgggagattgactacaagacagccttcaagagcctgcaggagcagaacagccatgatgccatggacagctactatgactacatctgggatgtgaccatcctggagtacctgacctacctgcaccacaagagaggagaaacagacaagaggcagatcgccatcaaggccatcggccagacagagctgaatgccagcaaccctgaggaggtgctgcagctggccgcccagaggaggaagaagaagttcctgcaggccatggccaagctgtacttctag

SEQ ID NO: 15848 - DNA, 2988 bp, Artificial Sequence
  Description of Artificial Sequence: Synthetic coding sequence
atgtctgctgaggccgctgaccgggaggccgccaccagcagccggccctgcaccccaccccagacctgctggtttgagttcctgctggaggagagcctgctggagaagcacctgaggaagccctgcccagaccctgcccctgtgcagctgattgtgcagttcctggagcaggccagcaagcccagcgtgaatgagcagaaccaggtgcagcccccaccagacaacaagaggaaccgcatcctgaagctgctggccctgaaggtggccgcccacctgaagtgggacctggacatcctggagaagagcctgtctgtgcctgtgctgaacatgctgctgaatgagctgctgtgcatcagcaaggtgcccccaggcaccaagcacgtggacatggacctggccaccctgccccccaccacagccatggctgtgctgctgtacaaccgctgggccatccgcaccatcgtgcagagcagcttccctgtgaagcaggccaagccaggccccccccagctgtctgtgatgaaccagatgcagcaggagaaggagctgacagagaacatcctgaaggtgctgaaggagcaggccgctgacagcatcctggtgctggaggccgccctgaagctgaacaaggacctgtatgtgcacaccatgaggaccctggacctgctggccatggagcccggcatggtgaatggagaaacagagagcagcacagctggcctgaaggtgaagacagaggagatgcagtgccaggtgtgctatgacctgggcgccgcctacttccagcagggcagcaccaacagcgctgtgtatgaaaatgcccgggagaagttcttccgcaccaaggagctgattgctgagatcggcagcctgagcctgcactgcaccattgatgagaagaggctggccggctactgccaggcctgtgatgtgctggtgcccagcagtgacagcaccagccagcagctgaccccctacagccaggtgcacatctgcctgcggagcggcaactaccaggaggtgatccagatcttcatcgaggacaacctgaccctgagcctgcctgtgcagttccggcagagcgtgctgcgggagctgttcaagaaggcccagcagggcaatgaggccctggatgagatctgcttcaaggtgtgtgcctgcaacacagtgcgggacatcctggagggccgcaccatctctgtgcagttcaaccagctgttcctgcggcccaacaaggagaagattgacttcctgctggaggtgtgcagccgctctgtgaacctggagaaggccagcgagagcctgaagggcaacatggccgccttcctgaagaatgtgtgcctgggcctggaggacctgcagtatgtgttcatgatcagcagccatgagctgttcatcaccctgctgaaggatgaggagaggaagctgctggtggaccagatgaggaagaggagcccccgggtgaacctgtgcatcaagcctgtgaccagcttctatgacatcccagccagcgcctctgtgaacatcggccagctggagcaccagctgatcctgtctgtggacccctggaggatccggcagatcctgattgagctgcacggcatgaccagcgagcggcagttctggacagtgagcaacaagtgggaggtgcccagcgtgtacagcggggtcatcctgggcatcaaggacaacctgacccgggacctggtgtacatcctgatggccaagggcctgcactgcagcacagtgaaggacttcagccacgccaagcagctgtttgctgcctgcctggagctggtgacagagttcagccccaagctgcggcaggtgatgctgaatgagatgctgctgctggacatccacacccatgaagctggcaccggccaggccggggagcggccccccagcgacctgatcagccgggtgcggggctacctggagatgaggctgcctgacatccccctgcggcaggtgattgctgaggagtgtgtggccttcatgctgaactggagagaaaatgagtacctgaccctgcaggtgcctgccttcctgctgcagagcaacccctacgtgaagctgggccagctgctggccgccacctgcaaggagctgcccggccccaaggagagcagaagaacagccaaggacctgtgggaggtggtggtgcagatctgcagcgtgagcagccagcacaagagaggaaatgatggccgggtgtccctcatcaagcagcgggagagcaccctgggcatcatgtacagaagtgagctgctgtccttcatcaagaagctgcgggagcccctggtgctgaccatcatcctgagcctgtttgtgaagctgcacaacgtgagagaagatattgtgaatgacatcacagctgagcacatcagcatctggcccagcagcatccccaacctgcagagcgtggactttgaagctgtggccatcaccgtgaaggagctggtgcgctacaccctgagcatcaaccccaacaaccacagctggctgatcatccaggccgacatctactttgccaccaaccagtacagcgctgccctgcactactacctgcaggccggggctgtgtgcagcgacttcttcaacaaggctgtgcccccagatgtgtacacagaccaggtgatcaagaggatgatcaagtgctgcagcctgctgaactgccacacccaggtggccatcctgtgccagttcctgcgggagattgactacaagacagccttcaagagcctgcaggagcagaacagccatgatgccatggacagctactatgactacatctgggatgtgaccatcctggagtacctgacctacctgcaccacaagagaggagaaacagacaagaggcagatcgccatcaaggccatcggccagacagagctgaatgccagcaaccctgaggaggtgctgcagctggccgcccagaggaggaagaagaagttcctgcaggccatggccaagctgtacttctag

SEQ ID NO: 15849 - DNA, 1659 bp, Artificial Sequence
  Description of Artificial Sequence: Synthetic coding sequence
atgatggccctgccctacatcacagagcacacaggcttcaccggcaccgtgtatgccacagagcccaccgtgcagatcggccgcctgctgatggaggagctggtgaacttcatcgagcgggtgcccaaggcccagagcgccagcctgtggaagaacaaggacatccagaggctgctgcccagccccctgaaggatgctgtggaggtgtccacctggaggcgctgctacaccatgcaggaggtgaacagcgccctgagcaagatccagctggtgggctacagccagaagattgagctgtttggagctgtgcaggtgacccccctgagcagcggctacgccctgggcagcagcaactggatcatccagagccactatgagaaggtgtcctatgtgtctggcagcagcctgctgaccacccacccccagcccatggaccaggccagcctgaagaacagtgatgtgctggtgctgaccggcctgacccagatccccacagccaacccagatggcatggtgggggagttctgcagcaacctggccctgactgtgagaaatggaggaaatgtgctggtgccctgctaccccagcggggtcatctatgacctgctggagtgcctgtaccagtacatcgacagcgctggcctgagctctgtgcccctgtacttcatcagccctgtggccaacagcagcctggagttcagccagatctttgctgagtggctgtgccacaacaagcagagcaaggtgtacctgcctgagccccccttcccccatgctgagctgatccagaccaacaagctgaagcactaccccagcatccacggggacttcagcaatgacttccggcagccctgtgtggtgttcaccggccaccccagcctgcgctttggagatgtggtgcacttcatggagctgtggggcaagagcagcctgaacacagtcatcttcacagagccagacttctcctacctggaggccctggccccctaccagcccctggccatgaagtgcatctactgccccatcgacacccggctgaacttcatccaggtgtccaagctgctgaaggaggtgcagcccctgcacgtggtgtgcccagagcagtacacccagcccccaccagcccagagccacaggatggacctgatgattgactgccagcccccagccatgagctaccgccgggcagaggtgctggccctgcccttcaagagaagatatgagaagattgagatcatgcctgagctggccgacagcctggtgcccatggagatcaagccaggcatcagcctggccaccgtgtctgctgtgctgcacaccaaggacaacaagcacctgctgcagcccccacccaggcctgcccagcccaccagcggcaagaagaggaagagggtgtctgatgatgtgcctgactgcaaggtgctgaagcccctgctgagcggcagcatccctgtggagcagtttgtgcagaccctggagaagcacggcttcagtgacatcaaggtggaggacacagccaagggccacatcgtgctgctgcaggaggccgagaccctcatccagatcgaggaggacagcacccacatcatctgtgacaatgatgagatgctgcgggtgcggctgcgggacctggtgctgaagttcctgcagaagttctag

SEQ ID NO: 15850 - DNA, 1977 bp, Artificial Sequence
  Description of Artificial Sequence: Synthetic coding sequence
atgaagctgtactgcctgagcggccaccccaccctgccctgcaatgtgctgaagttcaagagcaccaccatcatgctggactgtggcctggacatgaccagcaccctgaacttcctgcccctgcccctggtgcagagcccccggctgagcaacctgcccggctggagcctgaaggatggaaatgccttcctggacaaggagctgaaggagtgcagcggccacgtgtttgtggacagcgtgcctgagttctgcctgcctgagacagagctgattgacctgagcacagtggatgtgatcctgatcagcaactaccactgcatgatggccctgccctacatcacagagcacacaggcttcaccggcaccgtgtatgccacagagcccaccgtgcagatcggccgcctgctgatggaggagctggtgaacttcatcgagcgggtgcccaaggcccagagcgccagcctgtggaagaacaaggacatccagaggctgctgcccagccccctgaaggatgctgtggaggtgtccacctggaggcgctgctacaccatgcaggaggtgaacagcgccctgagcaagatccagctggtgggctacagccagaagattgagctgtttggagctgtgcaggtgacccccctgagcagcggctacgccctgggcagcagcaactggatcatccagagccactatgagaaggtgtcctatgtgtctggcagcagcctgctgaccacccacccccagcccatggaccaggccagcctgaagaacagtgatgtgctggtgctgaccggcctgacccagatccccacagccaacccagatggcatggtgggggagttctgcagcaacctggccctgactgtgagaaatggaggaaatgtgctggtgccctgctaccccagcggggtcatctatgacctgctggagtgcctgtaccagtacatcgacagcgctggcctgagctctgtgcccctgtacttcatcagccctgtggccaacagcagcctggagttcagccagatctttgctgagtggctgtgccacaacaagcagagcaaggtgtacctgcctgagccccccttcccccatgctgagctgatccagaccaacaagctgaagcactaccccagcatccacggggacttcagcaatgacttccggcagccctgtgtggtgttcaccggccaccccagcctgcgctttggagatgtggtgcacttcatggagctgtggggcaagagcagcctgaacacagtcatcttcacagagccagacttctcctacctggaggccctggccccctaccagcccctggccatgaagtgcatctactgccccatcgacacccggctgaacttcatccaggtgtccaagctgctgaaggaggtgcagcccctgcacgtggtgtgcccagagcagtacacccagcccccaccagcccagagccacaggatggacctgatgattgactgccagcccccagccatgagctaccgccgggcagaggtgctggccctgcccttcaagagaagatatgagaagattgagatcatgcctgagctggccgacagcctggtgcccatggagatcaagccaggcatcagcctggccaccgtgtctgctgtgctgcacaccaaggacaacaagcacctgctgcagcccccacccaggcctgcccagcccaccagcggcaagaagaggaagagggtgtctgatgatgtgcctgactgcaaggtgctgaagcccctgctgagcggcagcatccctgtggagcagtttgtgcagaccctggagaagcacggcttcagtgacatcaaggtggaggacacagccaagggccacatcgtgctgctgcaggaggccgagaccctcatccagatcgaggaggacagcacccacatcatctgtgacaatgatgagatgctgcgggtgcggctgcgggacctggtgctgaagttcctgcagaagttctag

SEQ ID NO: 15851 - DNA, 1509 bp, Artificial Sequence
  Description of Artificial Sequence: Synthetic coding sequence
aagatctactgcctgagcggccaccccaccctgccctgcaatgtgctgaagttcaagagcacctggaggcgctgctacaccatgcaggaggtgaacagcgccctgagcaagatccagctggtgggctacagccagaagattgagctgtttggagctgtgcaggtgacccccctgagcagcggctacgccctgggcagcagcaactggatcatccagagccactatgagaaggtgtcctatgtgtctggcagcagcctgctgaccacccacccccagcccatggaccaggccagcctgaagaacagtgatgtgctggtgctgaccggcctgacccagatccccacagccaacccagatggcatggtgggggagttctgcagcaacctggccctgactgtgagaaatggaggaaatgtgctggtgccctgctaccccagcggggtcatctatgacctgctggagtgcctgtaccagtacatcgacagcgctggcctgagctctgtgcccctgtacttcatcagccctgtggccaacagcagcctggagttcagccagatctttgctgagtggctgtgccacaacaagcagagcaaggtgtacctgcctgagccccccttcccccatgctgagctgatccagaccaacaagctgaagcactaccccagcatccacggggacttcagcaatgacttccggcagccctgtgtggtgttcaccggccaccccagcctgcgctttggagatgtggtgcacttcatggagctgtggggcaagagcagcctgaacacagtcatcttcacagagccagacttctcctacctggaggccctggccccctaccagcccctggccatgaagtgcatctactgccccatcgacacccggctgaacttcatccaggtgtccaagctgctgaaggaggtgcagcccctgcacgtggtgtgcccagagcagtacacccagcccccaccagcccagagccacaggatggacctgatgattgactgccagcccccagccatgagctaccgccgggcagaggtgctggccctgcccttcaagagaagatatgagaagattgagatcatgcctgagctggccgacagcctggtgcccatggagatcaagccaggcatcagcctggccaccgtgtctgctgtgctgcacaccaaggacaacaagcacctgctgcagcccccacccaggcctgcccagcccaccagcggcaagaagaggaagagggtgtctgatgatgtgcctgactgcaaggtgctgaagcccctgctgagcggcagcatccctgtggagcagtttgtgcagaccctggagaagcacggcttcagtgacatcaaggtggaggacacagccaagggccacatcgtgctgctgcaggaggccgagaccctcatccagatcgaggaggacagcacccacatcatctgtgacaatgatgagatgctgcgggtgcggctgcgggacctggtgctgaagttcctgcagaagttctag

SEQ ID NO: 15852 - DNA, 1914 bp, Artificial Sequence
  Description of Artificial Sequence: Synthetic coding sequence
atgaagctgtactgcctgagcggccaccccaccctgccctgcaatgtgctgaagttcaagagcaccaccatcatgctggactgtggcctggacatgaccagcaccctgaacttcctgcccctgcccctggtgcagagcccccggctgagcaacctgcccggctggagcctgaaggatggaaatgccttcctggacaagacagagctgattgacctgagcacagtggatgtgatcctgatcagcaactaccactgcatgatggccctgccctacatcacagagcacacaggcttcaccggcaccgtgtatgccacagagcccaccgtgcagatcggccgcctgctgatggaggagctggtgaacttcatcgagcgggtgcccaaggcccagagcgccagcctgtggaagaacaaggacatccagaggctgctgcccagccccctgaaggatgctgtggaggtgtccacctggaggcgctgctacaccatgcaggaggtgaacagcgccctgagcaagatccagctggtgggctacagccagaagattgagctgtttggagctgtgcaggtgacccccctgagcagcggctacgccctgggcagcagcaactggatcatccagagccactatgagaaggtgtcctatgtgtctggcagcagcctgctgaccacccacccccagcccatggaccaggccagcctgaagaacagtgatgtgctggtgctgaccggcctgacccagatccccacagccaacccagatggcatggtgggggagttctgcagcaacctggccctgactgtgagaaatggaggaaatgtgctggtgccctgctaccccagcggggtcatctatgacctgctggagtgcctgtaccagtacattgattctgctggcctgagctctgtgcccctgtacttcatcagccctgtggccaacagcagcctggagttcagccagatctttgctgagtggctgtgccacaacaagcagagcaaggtgtacctgcctgagccccccttcccccacgccgagctgatccagaccaacaagctgaagcactaccccagcatccatggagacttcagcaatgacttccggcagccctgtgtggtgttcaccggccaccccagcctgcgctttggagatgtggtgcacttcatggagctgtggggcaagagcagcctgaacacagtcatcttcacagagccagacttctcctacctggaggccctggccccctaccagcccctggccatgaagtgcatctactgccccatcgacacccggctgaacttcatccaggtgtccaagctgctgaaggaggtgcagcccctgcacgtggtgtgcccagagcagtacacccagcccccaccagcccagagccacaggatggacctgatgattgactgccagcccccagccatgagctacagaagagctgaggtgctggccctgcccttcaagagaagatatgagaagattgagatcatgcctgagctggccgacagcctggtgcccatggagatcaagccaggcatcagcctggccaccgtgtctgctgtgctgcacaccaaggacaacaagcacctgctgcagcccccacccaggcctgcccagcccaccagcggcaagaagaggaagagggtgtctgatgatgtgcctgactgcaaggtgctgaagcccctgctgagcggcagcatccctgtggagcagtttgtgcagaccctggagaagcacggcttcagtgacatcaaggtggaggacacagccaagggccacatcgtgctgctgcaggaggccgagaccctcatccagatcgaggaggacagcacccacatcatctgtgacaatgatgagatgctgcgggtgcggctgcgggacctggtgctgaagttcctgcagaagttctag

SEQ ID NO: 15853 - DNA, 1905 bp, Artificial Sequence
  Description of Artificial Sequence: Synthetic coding sequence
atgctggactgtggcctggacatgaccagcaccctgaacttcctgcccctgcccctggtgcagagcccccggctgagcaacctgcccggctggagcctgaaggatggaaatgccttcctggacaaggagctgaaggagtgcagcggccacgtgtttgtggacagcgtgcctgagttctgcctgcctgagacagagctgattgacctgagcacagtggatgtgatcctgatcagcaactaccactgcatgatggccctgccctacatcacagagcacacaggcttcaccggcaccgtgtatgccacagagcccaccgtgcagatcggccgcctgctgatggaggagctggtgaacttcatcgagcgggtgcccaaggcccagagcgccagcctgtggaagaacaaggacatccagaggctgctgcccagccccctgaaggatgctgtggaggtgtccacctggaggcgctgctacaccatgcaggaggtgaacagcgccctgagcaagatccagctggtgggctacagccagaagattgagctgtttggagctgtgcaggtgacccccctgagcagcggctacgccctgggcagcagcaactggatcatccagagccactatgagaaggtgtcctatgtgtctggcagcagcctgctgaccacccacccccagcccatggaccaggccagcctgaagaacagtgatgtgctggtgctgaccggcctgacccagatccccacagccaacccagatggcatggtgggggagttctgcagcaacctggccctgactgtgagaaatggaggaaatgtgctggtgccctgctaccccagcggggtcatctatgacctgctggagtgcctgtaccagtacatcgacagcgctggcctgagctctgtgcccctgtacttcatcagccctgtggccaacagcagcctggagttcagccagatctttgctgagtggctgtgccacaacaagcagagcaaggtgtacctgcctgagccccccttcccccatgctgagctgatccagaccaacaagctgaagcactaccccagcatccacggggacttcagcaatgacttccggcagccctgtgtggtgttcaccggccaccccagcctgcgctttggagatgtggtgcacttcatggagctgtggggcaagagcagcctgaacacagtcatcttcacagagccagacttctcctacctggaggccctggccccctaccagcccctggccatgaagtgcatctactgccccatcgacacccggctgaacttcatccaggtgtccaagctgctgaaggaggtgcagcccctgcacgtggtgtgcccagagcagtacacccagcccccaccagcccagagccacaggatggacctgatgattgactgccagcccccagccatgagctaccgccgggcagaggtgctggccctgcccttcaagagaagatatgagaagattgagatcatgcctgagctggccgacagcctggtgcccatggagatcaagccaggcatcagcctggccaccgtgtctgctgtgctgcacaccaaggacaacaagcacctgctgcagcccccacccaggcctgcccagcccaccagcggcaagaagaggaagagggtgtctgatgatgtgcctgactgcaaggtgctgaagcccctgctgagcggcagcatccctgtggagcagtttgtgcagaccctggagaagcacggcttcagtgacatcaaggtggaggacacagccaagggccacatcgtgctgctgcaggaggccgagaccctcatccagatcgaggaggacagcacccacatcatctgtgacaatgatgagatgctgcgggtgcggctgcgggacctggtgctgaagttcctgcagaagttctag

SEQ ID NO: 15854 - DNA, 1755 bp, Artificial Sequence
  Description of Artificial Sequence: Synthetic coding sequence
atggcctctgtgcaggccagccggcggcagtggtgctacctgtgtgacctgcccaagatgccctgggccatggtgtgggacttcagcgaggccgtgtgccggggctgtgtgaactttgaaggagctgacagaattgagctgctgattgatgctgcccggcagctgaagaggagccacgtgctgcctgagggccgcagccctggccccccagccctgaagcacccagccaccaaggacctggccgctgctgctgcccagggcccccagctgcccccaccccaggcccagccccagcccagcggcaccggcggcggcgtgtctggccaggacagatatgaccgggccaccagcagcggccgcctgcccctgcccagccctgccctggagtacaccctgggcagccggctggccaacggcctgggccgggaggaggccgtggccgagggcgcccggcgggccctgctgggctccatgcctggcctgatgcctcctggcctgctggccgctgctgtgtctggcctgggcagccggggcctgaccctggcccctggcctgagccctgcccggcccctgtttggaagtgactttgagaaggagaagcagcagagaaatgctgactgcctggccgagctgaatgaggccatgaggggccgggcagaggagtggcacggccggcccaaggctgtgcgggagcagctgctggccctgagcgcctgtgcccccttcaacgtgcgcttcaagaaggaccacggcctggtgggccgggtgtttgcctttgatgccacagcccggcccccaggctatgaatttgagctgaagctgttcacagagtacccctgtggcagcggaaatgtgtatgccggcgtgctggccgtggcccggcagatgtttcatgatgccctgcgggagcccgggaaggccctggccagcagcggcttcaagtacctggagtatgaaagaagacatggcagcggggagtggaggcagctgggggagctgctgacagatggagtgcgctccttccgggagcccgccccagctgaggccctgccccagcagtacccagagcccgccccagctgccctgtgtggccccccaccccgggcccccagcaggaacctggcccccaccccaagaagaaggaaggccagccctgagcctgagggggaggccgccggcaagatgaccacagaggagcagcagcagaggcactgggtggcccctgggggcccctacagcgctgagaccccaggagtgcccagccccatcgccgccctgaagaatgtggccgaggccctgggccacagccccaaggaccccggcggcggcggcggccctgtgcgggccggcggggccagccctgctgccagcagcacagcccagccccccacccagcaccggctggtggccagaaatggagaggccgaggtgagccccacagctggagctgaggccgtgtctgggggcggcagcggcactggagccacccctggggcccccctgtgctgcaccctgtgccgggagcggctggaggacacccactttgtgcagtgccccagcgtgcccggccacaagttctgcttcccctgcagccgggagttcatcaaggcccagggccctgctggggaggtgtactgccccagcggggacaagtgccccctggtgggcagctctgtgccctgggccttcatgcagggcgagatcgccaccatcctggccggggacatcaaggtgaagaaggagcgggacccctag

SEQ ID NO: 15855 - DNA, 1764 bp, Artificial Sequence
  Description of Artificial Sequence: Synthetic coding sequence
atggctgctgctgtggccgtggccgccgccagccggcggcagagctgctacctgtgtgacctgcccaggatgccctgggccatgatctgggacttcacagagcctgtgtgccggggctgtgtgaactatgaaggagctgacagagtggagtttgtgattgaaacagcccggcagctgaagagggcccacggctgcttccctgagggccgcagccccccaggagctgctgccagcgctgctgccaagcccccacccctgagcgccaaggacatcctgctgcagcagcagcagcagctgggccatggaggccctgaggccgccccccgggccccccaggccctggagcgctaccccctggccgctgctgctgagcggcccccccggctgggcagtgactttggcagcagcaggcctgctgccagcctggcccagccccccaccccccagcccccacctgtgaatggcatcctggtgcccaacggcttcagcaagctggaggagcccccagagctgaaccggcagagccccaacccccggcggggccatgctgtgccccccaccctggtgcccctgatgaatggaagtgccacccccctgcccacagccctgggcctgggcggccgggccgccgccagcctggccgctgtgtctggaacagctgctgccagcctgggcagcgcccagcccacagacctgggcgcccacaagaggcctgcctctgtgagcagcagcgctgctgtggagcacgagcagcgggaggccgccgccaaggagaagcagcccccacctccagcccaccggggccctgctgacagcctgagcacagctgctggagctgctgagctgtctgctgagggcgccggcaagagccggggcagcggggagcaggactgggtgaaccggcccaagacagtgcgggacaccctgctggccctgcaccagcacggccacagcggcccctttgagagcaagttcaagaaggagcccgccctgacagctggccgcctgctgggctttgaggccaacggggccaacggcagcaaggctgtggccaggacagccaggaagaggaagcccagccctgagcctgagggggaggtgggcccccccaagatcaatggagaggcccagccctggctgagcaccagcacagagggcctgaagatccccatgacccccaccagcagctttgtgagccccccaccacccacagccagcccccacagcaacagaaccaccccacctgaggccgcccagaatggccagagccccatggccgccctgatcctggtggccgacaatgccggcggcagccacgccagcaaggatgccaaccaggtgcacagcaccaccaggaggaacagcaacagcccccccagccccagctccatgaaccagaggcggctgggcccccgggaggtgggcggccagggcgccggcaacacaggaggcctggagcctgtgcacccagccagcctgcctgacagcagcctggccaccagcgcccccctgtgctgcaccctgtgccacgagcggctggaggacacccactttgtgcagtgccccagcgtgcccagccacaagttctgcttcccctgcagccggcagagcatcaagcagcagggcgccagcggggaggtgtactgccccagcggggagaagtgccccctggtgggcagcaatgtgccctgggccttcatgcagggcgagatcgccaccatcctggccggagatgtgaaggtgaagaaggagcgggacagctag

SEQ ID NO: 15856 - DNA, 1716 bp, Artificial Sequence
  Description of Artificial Sequence: Synthetic coding sequence
atggctgctgctgtggccgtggccgccgccagccggcggcagagctgctacctgtgtgacctgcccaggatgccctgggccatgatctgggacttcacagagcctgtgtgccggggctgtgtgaactatgaaggagctgacagagtggagtttgtgattgaaacagcccggcagctgaagagggcccacggctgcttccctgagggccgcagccccccaggagctgctgccagcgctgctgccaagcccccacccctgagcgccaaggacatcctgctgcagcagcagcagcagctgggccatggaggccctgaggccgccccccgggccccccaggccctggagcgctaccccctggccgctgctgctgagcggcccccccggctgggcagtgactttggcagcagcaggcctgctgccagcctggcccagccccccaccccccagcccccacctgtgaatggcatcctggtgcccaacggcttcagcaagctggaggagcccccagagctgaaccggcagagccccaacccccggcggggccatgctgtgccccccaccctggtgcccctgatgaatggaagtgccacccccctgcccacagccctgggcctgggcggccgggccgccgccagcctggccgctgtgtctggaacagctgctgccagcctgggcagcgcccagcccacagacctgggcgcccacaagaggcctgcctctgtgagcagcagcgctgctgtggagcacgagcagcgggaggccgccgccaaggagaagcagcccccacctccagcccaccggggccctgctgacagcctgagcacagctgctggagctgctgagctgtctgctgagggcgccggcaagagccggggcagcggggagcaggactgggtgaaccggcccaagacagtgcgggacaccctgctggccctgcaccagcacggccacagcggcccctttgagagcaagttcaagaaggagcccgccctgacagctgtggccaggacagccaggaagaggaagcccagccctgagcctgagggggaggtgggcccccccaagatcaatggagaggcccagccctggctgagcaccagcacagagggcctgaagatccccatgacccccaccagcagctttgtgagccccccaccacccacagccagcccccacagcaacagaaccaccccacctgaggccgcccagaatggccagagccccatggccgccctgatcctggtggccgacaatgccggcggcagccacgccagcaaggatgccaaccaggtgcacagcaccaccaggaggaacagcaacagcccccccagccccagctccatgaaccagaggcggctgggcccccgggaggtgggcggccagggcgccggcaacacaggaggcctggagcctgtgcacccagccagcctgcctgacagcagcctggccaccagcgcccccctgtgctgcaccctgtgccacgagcggctggaggacacccactttgtgcagtgccccagcgtgcccagccacaagttctgcttcccctgcagccggcagagcatcaagcagcagggcgccagcggggaggtgtactgccccagcggggagaagtgccccctggtgggcagcaatgtgccctgggccttcatgcagggcgagatcgccaccatcctggccggagatgtgaaggtgaagaaggagcgggacagctag

SEQ ID NO: 15857 - DNA, 2391 bp, Artificial Sequence
  Description of Artificial Sequence: Synthetic coding sequence
atgtctgctgcccaggtgagcagcagccggcggcagagctgctacctgtgtgacctgcccaggatgccctgggccatgatctgggacttcagcgagcctgtgtgccggggctgtgtgaactatgaaggagctgacagaattgaatttgtgattgaaacagcccggcagctgaagagggcccacggctgcttccaggacggccgcagccctggccccccacctcctgtgggcgtgaagacagtggccctgagcgccaaggaggccgctgctgctgctgctgctgctgctgctgctgctgctgctgcccagcagcagcagcagcagcagcagcagcagcagcagcagcagcagcagcagcagcagcagcagcagcagcagcagctgaaccacgtggatggcagcagcaagccagctgtgctggccgcccccagcggcctggagagatatggcctgtctgctgctgctgctgctgctgctgctgctgctgctgctgtggagcagaggagcagatttgagtacccacctcctcctgtgtccctgggcagcagcagccacacagcccggctgcccaacggcctgggcggccccaacggcttccccaagcccaccccagaggagggccccccagagctgaaccggcagagccccaacagcagcagcgctgctgcctctgtggccagccggcggggcacccacggcggcctggtgacaggcctgcccaaccctgggggcggcggcggcccccagctgactgtgccccccaacctgctgccccagaccctgctgaatggacctgccagcgctgctgtgctgcccccacctcctcctcatgccctgggcagccggggcccccccaccccagcccctcctggggcccctgggggccctgcctgcctgggcggcaccccaggagtgtctgccaccagcagcagcgccagcagcagcaccagcagctctgtggccgaggtgggcgtgggcgccggcggcaagaggcctggctctgtgagcagcacagaccaggagcgggagctgaaggagaagcagagaaatgctgaggccctggccgagctgtctgagagcctgaggaacagagctgaggagtgggccagcaagcccaagatggtgcgggacaccctgctgaccctggccggctgcaccccctatgaggtgcgcttcaagaaggaccacagcctgctgggccgggtgtttgcctttgatgctgtgtccaagccaggcatggactatgagctgaagctgttcatcgagtaccccactggaagtggaaatgtgtacagcagcgccagcggcgtggccaagcagatgtaccaggactgcatgaaggactttggccggggcctgagcagcggcttcaagtacctggagtatgagaagaagcacggcagcggggactggaggctgctgggggacctgctgcctgaggccgtgcgcttcttcaaggagggcgtgcctggagctgacatgctgccccagccctacctggatgccagctgccccatgctgcccacagccctggtgtccctgagccgggcccccagcgcccctcctggcaccggggccctgcccccagctgcccccagcggcagaggagctgctgccagcctgaggaagaggaaggccagccctgagcccccagattctgctgagggcgccctgaagctgggggaggagcagcagaggcagcagtggatggccaaccagagcgaggccctgaagctgaccatgtctgctgggggctttgctgcccctggccacgccgccggcggccccccacctcctcctccacccctgggcccccacagcaacagaaccaccccacctgagagcgccccccagaatggccccagccccatggccgccctgatgtctgtggccgacaccctgggcacagcccacagccccaaggatggcagctctgtgcacagcaccacagccagcgcccggaggaacagcagcagccctgtgtccccagcctctgtgcccggccagaggcggctggccagcagaaatggagacctgaacctgcaggtggcccctcctcctccttctgcccaccctggcatggaccaggtgcacccccagaacatcccagacagccccatggccaacagcggccccctgtgctgcaccatctgccacgagcggctggaggacacccactttgtgcagtgccccagcgtgcccagccacaagttctgcttcccctgcagccgggagagcatcaaggcccagggcgccactggagaggtgtactgccccagcggggagaagtgccccctggtgggcagcaatgtgccctgggccttcatgcagggcgagatcgccaccatcctggccggagatgtgaaggtgaagaaggagcgggacccctag

SEQ ID NO: 15858 - DNA, 1341 bp, Artificial Sequence
  Description of Artificial Sequence: Synthetic coding sequence
atgtccttcccccacttcggccacccctacagaggagccagccagttcctggccagcgccagcagcagcaccacctgctgtgagagcacccagaggtctgtgtctgatgtggccagcggcagcaccccagccccagccctgtgctgtgccccctatgacagccggctgctgggcagcgcccggcctgagctgggcgccgccctgggcatctatggagccccctatgctgctgctgctgctgcccagagctacccaggctacctgccctacagccctgagccccccagcctgtatggagccctgaacccccagtatgagttcaaggaggccgccggcagcttcaccagcagcctggcccagcccggggcctactacccctatgaaagaaccctgggccagtaccagtatgaaagatatggagctgtggagctgtctggagctggaagaaggaagaatgccacccgggagaccaccagcaccctgaaggcctggctgaatgagcacaggaagaacccctaccccaccaagggggagaagatcatgctggccatcatcaccaagatgaccctgacccaggtgtccacctggtttgccaatgcccggcggcggctgaagaaggagaacaagatgacctgggcccccaagaacaagggcggggaggagaggaaggccgagggcggggaggaggacagcctgggctgcctgacagctgacaccaaggaggtgacagccagccaggaggcccggggcctgcggctgagtgacctggaggacctggaggaggaggaggaggaggaggaggaggccgaggatgaggaggtggtggccacagctggggaccggctgacagagttcagaaaaggagcccagagcctgcccggcccctgtgccgccgcccgggagggccgcctggagcggcgggagtgtggcctggccgccccccgcttctccttcaatgaccccagcggcagcgaggaggccgacttcctgtctgctgagaccggcagcccccggctgaccatgcactacccctgcctggagaagccccgcatctggagcctggcccacacagccacagccagcgctgtggagggcgcccccccagcccggccccggcccaggagcccagaatgtaggatgatccctggccagcccccagccagcgcccggcggctgtctgtgccccgggacagcgcctgtgatgagagcagctgcatccccaaggccttcggcaaccccaagtttgccctgcagggcctgcccctgaactgtgccccctgccccaggagaagtgagcctgtggtgcagtgccagtaccccagcggggctgaggccggctag

SEQ ID NO: 15859 - DNA, 1080 bp, Artificial Sequence
  Description of Artificial Sequence: Synthetic coding sequence
atggtggacatcatcttccactaccccttcctgggcgccatgggagaccacagcaagaagaagccaggcacagccatgtgtgtgggctgcggcagccagatccatgaccagttcatcctgcgggtgtccccagacctggagtggcacgccgcctgcctgaagtgtgctgaatgttcccagtacctggatgagacctgcacctgctttgtgagagatggcaagacctactgcaagagggactatgtgcggctgtttggcatcaagtgtgccaagtgccaggtgggcttcagcagcagtgacctggtgatgagggcccgggacagcgtgtaccacatcgagtgcttccgctgcagcgtgtgcagccggcagctgctgcctggagatgagttcagcctgcgggagcacgagctgctgtgcagagctgaccacggcctgctgctggagagagctgctgctggcagccccaggagccctggccccctgcccggggcccggggcctgcacctgcctgatgctggcagcggccggcagcctgccctgcggccccacgtgcacaagcagacagagaagaccaccagggtgaggacagtgctgaatgagaagcagctgcacaccctgcggacctgctatgctgccaaccccaggccagatgccctgatgaaggagcagctggtggagatgacaggcctgagccccagggtcatccgggtgtggttccagaacaagcgctgcaaggacaagaagaagagcatcctgatgaagcagctgcagcagcagcagcacagcgacaagaccagcctgcagggcctgaccggcacccccctggtggccggcagccccatcagacatgaaaatgctgtgcagggcagcgctgtggaggtgcagacctaccagcccccctggaaggccctgtctgaatttgccctgcagagcgacctggaccagcctgccttccagcagctggtgtccttcagcgagagcggcagcctgggcaacagcagcggcagtgatgtgaccagcctgagcagccagctgcctgacacccccaacagcatggtgcccagccctgtggagacctag

SEQ ID NO: 15860 - DNA, 2460 bp, Artificial Sequence
  Description of Artificial Sequence: Synthetic coding sequence
atggattctgagtactacagcggggaccagagtgatgatggaggagccacccctgtgcaggatgagcgggacagcggcagtgatggagaagatgatgtgaatgagcagcacagcggcagtgacaccggctctgtggagcggcacagtgaaaatgagaccagtgacagagaagatggcctgcccaagggccaccacgtgacagattctgaaaatgatgagcccctgaacctgaatgccagtgacagcgagagcgaggagctgcaccggcagaaggacagcgacagcgagagcgaggagagagctgagcccccagccagtgacagtgaaaatgaagatgtgaaccagcacggcagtgacagcgagagcgaggagaccaggaagctgcccggcagtgacagtgaaaatgaggagctgctgaatggccacgccagtgacagtgaaaatgaagatgtgggcaagcacccagccagtgacagcgagattgaggagctgcagaagagccctgccagtgacagcgagacagaagatgccctgaagccccagatcagtgacagcgagagcgaggagccccccaggcaccaggccagtgacagtgaaaatgaggagccccccaagcccaggatgtctgattctgagagcgaggagctgcccaagccccaggtgtctgacagcgagagcgaggagcccccaagacaccaggccagtgacagtgaaaatgaggagctgcccaagccccgcatcagtgacagcgagagtgaagatcctcccaggcaccaggccagtgacagtgaaaatgaggagctgcccaagccccgcatcagtgacagcgagagtgaagatcctccaagaaaccaggccagtgacagtgaaaatgaggagctgcccaagccccgggtgtctgacagcgagagcgagggcccccagaagggccctgccagtgacagcgagacagaagatgccagccgccacaagcagaagccagagagtgatgatgacagcgaccgggagaacaagggggaggacacagagatgcagaatgacagcttccacagcgacagccacatggacaggaagaagttccacagcagtgacagcgaggaggaggagcacaagaagcagaagatggacagtgatgaagatgagaaggagggggaggaggagaaggtggccaagaggaaggctgctgtgctgagtgacagtgaagatgaggagaaggccagcgccaagaagagccgggtggtgtctgatgctgatgacagcgacagtgatgctgtgtctgacaagagcggcaagcgggagaagaccatcgccagtgacagcgaggaggaggccggcaaggagctgagtgacaagaagaatgaggagaaggacctgtttggaagtgacagcgagagcggaaatgaggaggagaacctgattgctgacatctttggagagagcggagatgaggaggaggaggagttcaccggcttcaaccaggaggacctggaggaggagaagggggagacccaggtgaaggaggctgaagattctgacagtgatgacaacatcaagaggggcaagcacatggacttcctgagtgactttgagatgatgctgcagaggaagaagtccatgtctgggaagagaagaagaaacagagatggcggcaccttcatcagtgatgctgatgatgtggtgtctgccatgattgtgaagatgaatgaggccgcagaagaagatcggcagctgaacaaccagaagaagccagccctgaagaagctgaccctgctgcctgctgtggtgatgcacctgaagaagcaggacctgaaggagaccttcatcgacagcggcgtgatgtctgccatcaaggagtggctgagccccctgcctgacaggagcctgcctgccctgaagatccgggaggagctgctgaagatcctgcaggagctgcccagcgtgtcccaggagaccctgaagcacagcggcatcggccgggctgtgatgtacctgtacaagcaccccaaggagagccgcagcaacaaggacatggccggcaagctgatcaatgagtggagccggcccatcttcggcctgaccagcaactacaagggcatgacccgggaggagcgggagcagagggacctggagcagatgccccagaggaggaggatgaacagcactggaggccagaccccaagaagagacctggagaaggtgctgactggagaggagaaggccctgcggcctggggaccccggcttctgtgcccgggcccgggtgcccatgcccagcaacaaggactatgtggtgcggcccaagtggaatgtggagatggagagcagccgcttccaggccaccagcaagaagggcatcagccggctggacaagcagatgaggaagttcacagacatcaggaagaagagccgcagcgcccatgctgtgaagatcagcattgagggcaacaagatgcccctgtag

SEQ ID NO: 15861 - DNA, 2319 bp, Artificial Sequence
  Description of Artificial Sequence: Synthetic coding sequence
atggattctgagtactacagcggggaccagagtgatgatggaggagccacccctgtgcaggatgagcgggacagcggcagtgatggagaagatgatgtgaatgagcagcacagcggcagtgacaccggctctgtggagcggcacagtgaaaatgagaccagtgacagagaagatggcctgcccaagggccaccacgtgacagattctgaaaatgattctgagagcgaggagaccaggaagctgcccggcagtgacagtgaaaatgaggagctgctgaatggacatgccagtgacagtgaaaatgaagatgtgggcaagcacccagccagtgacagcgagattgaggagctgcagaagagccctgccagtgacagcgagacagaagatgccctgaagccccagatcagtgacagcgagagcgaggagcccccaagacaccaggccagtgacagtgaaaatgaggagccccccaagcccaggatgtctgacagcgagagcgaggagctgcccaagccccaggtgtctgattctgagagcgaggagccccccaggcaccaggccagtgacagtgaaaatgaggagctgcccaagccccgcatcagtgacagcgagagcgaggacccccccaggcaccaggccagtgacagtgaaaatgaggagctgcccaagccccgcatcagtgacagcgagagcgaggacccccccaggaaccaggccagtgacagtgaaaatgaggagctgcccaagccccgggtgtctgattctgagagcgagggcccccagaagggccctgccagtgacagcgagacagaagatgccagccgccacaagcagaagccagagagtgatgatgacagcgacagagaaaataaaggagaggacacagagatgcagaatgacagcttccacagcgacagccacatggacaggaagaagttccacagcagtgacagcgaggaggaggagcacaagaagcagaagatggacagtgatgaagatgagaaggagggggaggaggagaaggtggccaagaggaaggctgctgtgctgagtgacagtgaagatgaggagaaggccagcgccaagaagagccgggtggtgtctgatgctgatgacagcgacagtgatgctgtgtctgacaagagcggcaagcgggagaagaccatcgccagtgacagcgaggaggaggccggcaaggagctgagtgacaagaagaatgaggagaaggacctgtttggaagtgacagcgagagcggaaatgaggaggagaacctgattgctgacatctttggagagagcggagatgaggaggaggaggagttcaccggcttcaaccaggaggacctggaggaggagaagggggagacccaggtgaaggaggccgaggacagcgacagtgatgacaacatcaagaggggcaagcacatggacttcctgagtgactttgagatgatgctgcagaggaagaagtccatgtctgggaagagaagaagaaacagagatggcggcaccttcatcagtgatgctgatgatgtggtgtctgccatgattgtgaagatgaatgaagctgctgaggaggaccggcagctgaacaaccagaagaagccagccctgaagaagctgaccctgctgcctgctgtggtgatgcacctgaagaagcaggacctgaaggagaccttcattgattctggagtgatgtctgccatcaaggagtggctgagccccctgcctgacaggagcctgcctgccctgaagatccgggaggagctgctgaagatcctgcaggagctgcccagcgtgtcccaggagaccctgaagcacagcggcatcggccgggctgtgatgtacctgtacaagcaccccaaggagagccgcagcaacaaggacatggccggcaagctgatcaatgagtggagccggcccatcttcggcctgaccagcaactacaagggcatgacccgggaggagcgggagcagagggacctggagcagatgccccagaggaggaggatgaacagcactggaggccagaccccccggcgggacctggagaaggtgctgaccggggaggagaaggccctgcggcctggggaccccggcttctgtgcccgggcccgggtgcccatgcccagcaacaaggactatgtggtgcggcccaagtggaatgtggagatggagagcagccgcttccaggccaccagcaagaagggcatcagccggctggacaagcagatgaggaagttcacagacatcaggaagaagagccgcagcgcccatgctgtgaagatcagcattgagggcaacaagatgcccctgtag

SEQ ID NO: 15862 - DNA, 1512 bp, Artificial Sequence
  Description of Artificial Sequence: Synthetic coding sequence
atgcctgcccggcccccagcctgccgggtgcggcccttccccccaggcctgcctgatgatggaggagccacccctgtgcaggatgagcgggacagcggcagtgatggagaagatgatgtgaatgagcagcacagcggcagtgacaccggctctgtggagcggcacagtgaaaatgagaccagtgaccgggaggatggcctgcccaagggccaccacgtgacagacagtgaaaatgatgagcccctgaacctgaatgccagtgacagcgagagcgaggagctgcaccggcagaaggacagcgacagcgagagcgaggagcgggcagagcccccagccagtgacagtgaaaatgaagatgtgaaccagcacggcagtgacagcgagagcgaggagaccaggaagctgcccggcagtgacagtgaaaatgaggagctgctgaatggacatgccagtgacagtgaaaatgaagatgtgggcaagcacccagccagtgacagcgagattgaggagctgcagaagagccctgccagtgacagcgagacagaagatgccctgaagccccagatcagtgacagcgagagcgaggagcccccaagacaccaggccagtgacagtgaaaatgaggagccccccaagcccaggatgtctgacagcgagagcgaggagctgcccaagccccaggtgtctgattctgagagcgaggagccccccaggcaccaggccagtgacagtgaaaatgaggagctgcccaagccccgcatcagtgacagcgagagcgaggacccccccaggcaccaggccagtgacagtgaaaatgaggagctgcccaagccccgcatcagtgacagcgagagcgaggacccccccaggaaccaggccagtgacagtgaaaatgaggagctgcccaagccccgggtgtctgattctgagagcgagggcccccagaagggccctgccagtgacagcgagacagaagatgccagccgccacaagcagaagccagagagtgatgatgacagcgacagagaaaataaaggagaggacacagagatgcagaatgacagcttccacagcgacagccacatggacaggaagaagttccacagcagtgacagcgaggaggaggagcacaagaagcagaagatggacagtgatgaagatgagaaggagggggaggaggagaaggtggccaagaggaaggctgctgtgctgagtgacagtgaagatgaggagaaggccagcgccaagaagagccgggtggtgtctgatgctgatgacagcgacagtgatgctgtgtctgacaagagcggcaagcgggagaagaccatcgccagtgacagcgaggaggaggccggcaaggagctgagtgacaagaagaatgaggagaaggacctgtttggaagtgacagcgagagcggaaatgaggaggagaacctgattgctgacatctttggagagagcggagatgaggaggaggaggagttcacctacggcctgtctgtgcgcttctag

SEQ ID NO: 15863 - DNA, 2430 bp, Artificial Sequence
  Description of Artificial Sequence: Synthetic coding sequence
atggccggggctgctgctgctgtggccgccggggctgctgctggagctgctgctgctgctgtgtctgtggccgcccctggccgggccagcgcccctcctcctcctcctcctgtgtactgtgtgtgccggcagccctatgatgtgaaccgcttcatgattgaatgtgacatctgcaaggactggttccacggcagctgtgtgggcgtggaggagcaccacgctgtggacatcgacctgtaccactgccccaactgtgctgtgctgcacggcagcagcctgatgaagaagagaagaaactggcacagacatgactacacagaaattgatgatggcagcaagcctgtgcaggccggcaccaggaccttcatcaaggagctgcggagcagggtcttccccagcgcagatgagatcatcatcaagatgcacggcagccagctgacccagcgctacctggagaagcacggctttgatgtgcccatcatggtgcccaagctggatgacctgggcctgcggctgcccagccccaccttctctgtgatggatgtggagagatatgtgggcggggacaaggtgattgatgtgattgatgtggcccggcaggccgacagcaagatgaccctgcacaactacgtgaagtacttcatgaaccccaaccggcccaaggtgctgaatgtcatcagcctggagttcagtgacaccaagatgtctgagctggtggaggtgcctgacatcgccaagaagctgtcctgggtggagaactactggccagatgattctgtgttccccaagccctttgtgcagaagtactgcctgatgggcgtgcaggacagctacacagacttccacatcgactttggaggcacctctgtgtggtaccacgtgctgtggggcgagaagatcttctacctgatcaagcccacagatgagaacctggcccgctatgagagctggagcagctctgtgacccagagcgaggtgttcttcggggacaaggtggacaagtgctacaagtgtgtggtgaagcagggccacaccctgtttgtgcccaccggctggattcatgctgtgctgaccagccaggactgcatggcctttggaggcaacttcctgcacaacctgaacatcggcatgcagctgcgctgctatgagatggagaagaggctgaagaccccagacctcttcaagttccccttctttgaggccatctgctggtttgtggccaagaacctgctggagaccctgaaggagctgagagaagatggcttccagccccagacctacctggtgcagggcgtgaaggccctgcacacagccctgaagctgtggatgaagaaggagctggtgtctgaacatgcctttgagatcccagacaacgtgcggcccggccacctgatcaaggagctgagcaaggtgatccgggccatcgaggaggagaatggcaagcctgtgaagagccagggcatccccatcgtgtgccctgtgagccgcagcagcaatgaggccaccagcccctaccacagcaggaggaagatgaggaagctgcgggaccacaacgtgaggacccccagcaacctggacatcctggagctgcacacccgggaggtgctgaagaggctggagatgtgcccctgggaggaggacatcctgagcagcaagctgaatggcaagttcaacaagcacctgcagcccagcagcacagtgcctgagtggagggccaaggacaatgacctgcggctgctgctgaccaacggccgcatcatcaaggatgagcggcagccctttgctgaccagagcctgtacacagctgacagtgaaaatgaggaggacaagaggaggaccaagaaggccaagatgaagattgaggagagcagcggcgtggagggcgtggagcacgaggagagccagaagcccctgaatggcttcttcaccagggtgaagtctgagctgcggagccgcagcagcggctacagcgacatcagcgagagtgaagattctggccctgagtgcacagccctgaagagcatcttcaccacagaggagagcgagagcagtggagatgagaagaagcaggagatcaccagcaacttcaaggaggagagcaatgtgatgaggaacttcctgcagaagagccagaagcccagccgctctgagatccccatcaagagagaatgtcccaccagcaccagcacagaggaggaggccatccagggcatgctgtccatggccggcctgcactacagcacctgcctgcagaggcagatccagagcacagactgcagcggggagaggaacagcctgcaggaccccagcagctgccacggcagcaaccacgaggtgcggcagctgtaccgctatgacaagcctgtggagtgtgagaccaggagccacctgtgctgcccagactggagccccaccccagagctgaagtag

SEQ ID NO: 15864 - DNA, 2826 bp, Artificial Sequence
  Description of Artificial Sequence: Synthetic coding sequence
atggccggggctgctgctgctgtggccgccggggctgctgctggagctgctgctgctgctgtgtctgtggccgcccctggccgggccagcgcccctcctcctcctcctcctgtgtactgtgtgtgccggcagccctatgatgtgaaccgcttcatgattgaatgtgacatctgcaaggactggttccacggcagctgtgtgggcgtggaggagcaccacgctgtggacatcgacctgtaccactgccccaactgtgctgtgctgcacggcagcagcctgatgaagaagagaagaaactggcacagacatgactacacagaaattgatgatggcagcaagcctgtgcaggccggcaccaggaccttcatcaaggagctgcggagcagggtcttccccagcgcagatgagatcatcatcaagatgcacggcagccagctgacccagcgctacctggagaagcacggctttgatgtgcccatcatggtgcccaagctggatgacctgggcctgcggctgcccagccccaccttctctgtgatggatgtggagagatatgtgggcggggacaaggtgattgatgtgattgatgtggcccggcaggccgacagcaagatgaccctgcacaactacgtgaagtacttcatgaaccccaaccggcccaaggtgctgaatgtcatcagcctggagttcagtgacaccaagatgtctgagctggtggaggtgcctgacatcgccaagaagctgtcctgggtggagaactactggccagatgattctgtgttccccaagccctttgtgcagaagtactgcctgatgggcgtgcaggacagctacacagacttccacatcgactttggaggcacctctgtgtggtaccacgtgctgtggggcgagaagatcttctacctgatcaagcccacagatgagaacctggcccgctatgagagctggagcagctctgtgacccagagcgaggtgttcttcggggacaaggtggacaagtgctacaagtgtgtggtgaagcagggccacaccctgtttgtgcccaccggctggattcatgctgtgctgaccagccaggactgcatggcctttggaggcaacttcctgcacaacctgaacatcggcatgcagctgcgctgctatgagatggagaagaggctgaagaccccagacctcttcaagttccccttctttgaggccatctgctggtttgtggccaagaacctgctggagaccctgaaggagctgagagaagatggcttccagccccagacctacctggtgcagggcgtgaaggccctgcacacagccctgaagctgtggatgaagaaggagctggtgtctgaacatgcctttgagatcccagacaacgtgcggcccggccacctgatcaaggagctgagcaaggtgatccgggccatcgaggaggagaatggcaagcctgtgaagagccagggcatccccatcgtgtgccctgtgagccgcagcagcaatgaggccaccagcccctaccacagcaggaggaagatgaggaagctgcgggaccacaacgtgaggacccccagcaacctggacatcctggagctgcacacccgggaggtgctgaagaggctggagatgtgcccctgggaggaggacatcctgagcagcaagctgaatggcaagttcaacaagcacctgcagcccagcagcacagtgcctgagtggagggccaaggacaatgacctgcggctgctgctgaccaacggccgcatcatcaaggatgagcggcagccctttgctgaccagagcctgtacacagctgacagtgaaaatgaggaggacaagaggaggaccaagaaggccaagatgaagattgaggagagcagcggcgtggagggcgtggagcacgaggagagccagaagcccctgaatggcttcttcaccagggtgaagtctgagctgcggagccgcagcagcggctacagcgacatcagcgagagtgaagattctggccctgagtgcacagccctgaagagcatcttcaccacagaggagagcgagagcagtggagatgagaagaagcaggagatcaccagcaacttcaaggaggagagcaatgtgatgaggaacttcctgcagaagagccagaagcccagccgctctgagatccccatcaagagagaatgtcccaccagcaccagcacagaggaggaggccatccagggcatgctgtccatggccggcctgcactacagcacctgcctgcagaggcagatccagagcacagactgcagcggggagaggaacagcctgcaggaccccagcagctgccacggcagcaaccacgaggtgcggcagctgtaccgctatgacaagcctgtggagtgtggctaccacgtgaagacagaggaccctgacctgcggaccagctcctggatcaagcagtttgacaccagccgcttccacccccaggacctgagccgcagccagaagtgcatcaggaaggagggcagcagcgagatcagccagagggtgcagagcagaaattatgtggacagcagcggcagcagcctgcagaatggcaagtacatgcagaacagcaacctgaccagcggggcctgccagatcagcaatggcagcctgagccctgagaggcctgtgggggagaccagcttctctgtgcccctgcaccccaccaagaggcctgccagcaaccccccacccatcagcaaccaggccaccaagggcaagaggcccaagaagggcatggccacagccaagcagaggctgggcaagatcctgaagctgaacagaaatggccacgcccgcttctttgtgtag

SEQ ID NO: 15865 - DNA, 4443 bp, Artificial Sequence
  Description of Artificial Sequence: Synthetic coding sequence
atgattgtgatgaatgaccaggtgctggagccccagaatgtggaccccagcatggtgcagatgaccttcctggatgatgtggtgcacagcctgctgaagggagaaaatattggcatcaccagcagaagaagaagccgggccaaccagaatgtgaatgctgtgcacagccactacacccgggcccaggccaacagccccaggcctgccatgaacagccaggccgctgtgcccaagcagaacacccaccagcagcagcagcagaggagcatccggcccaacaagaggaagggcagtgacagcagcatcccagatgaggagaagatgaaggaggagaagtatgactacatcagcagaggagagaaccccaagggcaagaacaagcacctgatgaacaagaggaggaagccagaggaggatgagaagaagctgaacatgaagaggctgaggacagacaacgtgtctgacttcagcgagagcagtgacagcgagaacagcaacaagaggatcatcgacaacagcagcgagcagaagccagaaaatgagctgaagaacaagaacaccagcaagatcaatggagaggagggcaagccccacaacaatgagaaggccggggaggagaccctgaagaacagccagcccccctgggaccagatccaggaggacaagaagcatgaggaggccgagaagaggaagtctgtggacacccagctgcaggaggacatgatcatccacagcagcgagcagagcacagtgtctgaccacaacagcaatgacctgctgccccaggagtgcaacatggacaagacccacaccatggagctgctgcccaaggagaagtttgtgtcccggccccccacccccaagtgtgtgattgacatcaccaatgacaccaacctggagaaggtggcccaggagaacagcagcaccttcggcctgcagaccctgcagaagatggaccccaacgtgtctgacagcaagcacagcatcgccaatgccaagttcctggagacagccaagaaggacagcgaccagagctgggtgtctgatgtggtgaaggtggacctgacccagagctctgtgaccaatgccagcagtggaaatgaccacctgaacatggagaaggagaagtatgtgtcctacatcagccccctgtctgctgtgtctgtgatggaggacaagctgcacaagaggagccccccacctgagaccatcaagagcaagctgaacacctctgtggacacccacaagatcaagagcagccccagccctgaggtggtgaagcccaagatcacccacagcccagacagcgtgaagagcaaggccacctacgtgaacagccaggccactggagagcggcggctggccaacaagattgagcacgagctgagccgctgcagcttccaccccatccccaccaggagcagcaccctggagaccaccaagagccccctcatcatcgacaagaatgagcacttcaccgtgtacagagatcctgccctgattggcagcgagactggagccaaccacatcagccccttcctgagccagcaccccttccccctgcacagcagcagccacaggacctgcctgaaccctggcacccaccacccagccctgaccccagccccccacctgctggccggcagcagcagccagacccccctgcccaccatcaacacccaccccctgaccagcggcccccaccacgctgtgcaccacccccacctgctgcccaccgtgctgcccggggtgcccacagccagcctgctgggcggccacccccggctggagagcgcccacgccagcagcctgagccacctggccctggcccaccagcagcagcagcagctgctgcagcaccagagcccccacctgctgggccaggcccaccccagcgccagctacaaccagctgggcctgtaccccatcatctggcagtacccaaatggcacccacgcctacagcggcctgggcctgcccagcagcaagtgggtgcacccagaaaatgctgtgaatgctgaggccagcctgcggaggaacagccccagcccctggctgcaccagcccacccctgtgaccagcgcagatggcatcggcctgctgagccacatccctgtgcggcccagcagcgctgagccccaccggcccctgaagatcacagcccacagcagcccccccctgaccaagaccctggtggaccaccacaaggaggagctggagaggaaggccttcatggagcccctgcggtctgtggccagcaccagcgccaagaatgacctggacctgaacagaagccagacaggcaaggactgccacctgcaccgccactttgtggaccctgtgctgaaccagctgcagaggcctccccaggagaccggggagcggctgaacaagtacaaggaggagcaccggcgcatcctgcaggagagcattgatgtggcccccttcaccaccaagatcaagggcctggagggggagcgggagaactacagccgggtggccagcagcagcagcagccccaagagccacatcatcaagcaggacatggatgtggagaggtctgtgtctgacctgtacaagatgaagcacagcgtgccccagagcctgccccagagcaactacttcaccaccctgagcaacagcgtggtgaatgagccccccaggagctaccccagcaaggaggtgagcaacatctatggagacaagcagagcaatgccctggccgctgctgctgccaacccccagaccctgaccagcttcatcaccagcctgagcaagcccccacccctcatcaagcaccagcctgagagcgagggcctggtgggcaagatccctgagcacctgccccaccagatcgccagccacagcgtgaccaccttcagaaatgactgccgcagccccacccacctgactgtgagcagcaccaacaccctgcgctccatgcctgccctgcaccgggcccctgtgttccacccccccatccaccacagcctggagaggaaggagggcagctacagcagcctgagcccccccaccctgacccctgtgatgcctgtgaatgccggcggcaaggtgcaggagagccagaagccacccaccctcatccctgagcccaaggacagccaggccaacttcaagagcagcagcgagcagagcctgacagagatgtggaggcccaacaacaacctgagcaaggagaagacagagtggcacgtggagaagagcagcggcaagctgcaggccgccatggcctctgtgattgtgcggcccagcagcagcaccaagacagacagcatgcctgccatgcagctggccagcaaggacagagtgtctgagaggagcagcgctggggcccacaagacagactgcctgaagctggccgaggccggggagaccggccgcatcatcctgcccaacgtgaacagcgacagcgtgcacaccaagtctgagaagaacttccaggccgtgtcccagggctctgtgcccagctctgtgatgtctgctgtgaacaccatgtgcaacaccaagacagatgtgatcaccagcgctgctgacaccacctctgtgtcctcctggggcggcagcgaggtgatcagcagcctgagcaacaccatcctggccagcaccagcagtgaatgtgtgagcagcaagtctgtgtcccagcctgtggcccagaagcaggagtgcaaggtgtccaccacagcccctgtgaccctggccagcagcaagacaggctctgtggtgcagcccagcagcggcttcagcggcaccacagacttcatccacctgaagaagcacaaggccgccctggccgccgcccagtacaagagcagcaatgccagcgagacagagcccaatgccatcaagaaccagaccctgagcgccagcctgcccctggacagcaccgtcatctgcagcaccatcaacaaggccaacagcgtgggcaatggccaggccagccagaccagccagcccaactaccacaccaagctgaagaaggcctggctgaccaggcacagcgaggaggacaagaacaccaacaagatggagaacagcggcaacagcgtgtctgagatcatcaagccctgcagcgtgaacctgattgccagcaccagcagtgacatccagaacagcgtggacagcaagatcatcgtggacaagtatgtgaaggatgacaaggtgaacagaaggaaggccaagaggacctatgaaagtggcagcgagagcggggacagtgatgaaagtgagagcaagtctgagcagaggaccaagaggcagcccaagcccacctacaagaagaagcagaatgacctgcagaagaggaagggggagattgaggaggacctgaagcccaacggggtgctgagccgcagcgccaaggagaggagcaagctgaagctgcagagcaacagcaacagctgccacctggtgaagacagaatag

SEQ ID NO: 15866 - DNA, 7623 bp, Artificial Sequence
  Description of Artificial Sequence: Synthetic coding sequence
atggctgtggagaccagggctgagctggtgggcaagcgcttcctgtgtgtggccgtgggagatgaggcccggtctgagcgctgggagagcggccggggctggaggtcctggagggctggggtcatccgggctgtgagccaccgggacagcagaaatccagacctggccgtgtatgtggagtttgatgacctggagtgggacaagcgggagtgggtgaaggtgtatgaggacttcagcaccttcctggtggagtaccacctgatctgggccaagagaaatgaccccagccagacccagggcagcaagagcaagcagatccagtggccagccctgaccttcaagcccctggtggagaggaacatccccagctctgtgacagctgtggagttcctggtggacaagcagctggacttcctgacagaagattctgccttccagccctaccaggatgacatcgacagcctgaaccctgtgctgcgggacaacccccagctgcacgaggaggtgaaggtgtgggtgaaggagcagaaggtgcaggagatcttcatgcagggcccctacagcctgaatggctacagagtgcgggtgtaccggcaggacagcgccacccagtggttcaccggcatcatcacccaccacgacctcttcaccaggaccatgattgtgatgaatgaccaggtgctggagccccagaatgtggaccccagcatggtgcagatgaccttcctggatgatgtggtgcacagcctgctgaagggggagaacatcggcatcaccagcagaagaagaagccgggccaaccagaatgtgaatgctgtgcacagccactacacccgggcccaggccaacagccccaggcctgccatgaacagccaggccgctgtgcccaagcagaacacccaccagcagcagcagcagaggagcatccggcccaacaagaggaaaggaagtgacagcagcatcccagatgaggagaagatgaaggaggagaagtatgactacatcagcagaggagagaaccccaagggcaagaacaagcacctgatgaacaagaggaggaagccagaagaagatgagaagaagctgaacatgaagaggctgaggacagacaacgtgtctgacttcagcgagagcagtgacagcgagaacagcaacaagaggatcatcgacaacagcagcgagcagaagccagaaaatgagctgaagaacaagaacaccagcaagatcaacggggaggagggcaagccccacaacaatgagaaggccggggaggagaccctgaagaacagccagcccccctgggaccagatccaggaggacaagaagcatgaggaggccgagaagaggaagtctgtggacacccagctgcaggaggacatgatcatccacagcagcgagcagagcacagtgtctgaccacaacagcaatgacctgctgccccaggagtgcaacatggacaagacccacaccatggagctgctgcccaaggagaagtttgtgtccaggcctcccacccccaagtgtgtgattgacatcaccaatgacaccaacctggagaaggtggcccaggagaacagcagcaccttcggcctgcagaccctgcagaagatggaccccaacgtgtctgacagcaagcacagcatcgccaatgccaagttcctggagacagccaagaaggacagcgaccagagctgggtgtctgatgtggtgaaggtggacctgacccagagctctgtgaccaatgccagcagtggaaatgaccacctgaacatggagaaggagaagtatgtgtcctacatcagccccctgtctgctgtgtctgtgatggaggacaagctgcacaagaggagccccccacctgagaccatcaagagcaagctgaacacctctgtggacacccacaagatcaagagcagccccagccctgaggtggtgaagcccaagatcacccacagcccagattctgtgaagagcaaggccacctacgtgaacagccaggccaccggggagcggcggctggccaacaagattgaacatgagctgagccgctgcagcttccaccccatccccaccaggagcagcaccctggagaccaccaagagccccctcatcatcgacaagaatgagcacttcaccgtgtacagagatcctgccctgattggcagcgagaccggggccaaccacatcagccccttcctgagccagcaccccttccccctgcacagcagcagccacaggacctgcctgaaccctggcacccaccacccagccctgaccccagccccccacctgctggccggcagcagcagccagacccccctgcccaccatcaacacccaccccctgaccagcggcccccaccacgctgtgcaccacccccacctgctgcccaccgtgctgcccggggtgcccacagccagcctgctgggcggccacccccggctggagagcgcccacgccagcagcctgagccacctggccctggcccaccagcagcagcagcagctgctgcagcaccagagcccccacctgctgggccaggcccaccccagcgccagctacaaccagctgggcctgtaccccatcatctggcagtaccccaacggcacccacgcctacagcggcctgggcctgcccagcagcaagtgggtgcacccagaaaatgctgtgaatgctgaggccagcctgcggaggaacagccccagcccctggctgcaccagcccacccctgtgaccagcgcagatggcatcggcctgctgagccacatccctgtgcggcccagcagcgctgagccccaccggcccctgaagatcacagcccacagcagcccccccctgaccaagaccctggtggaccaccacaaggaggagctggagaggaaggccttcatggagcccctgcggtctgtggccagcaccagcgccaagaatgacctggacctgaacagaagccagacaggcaaggactgccacctgcaccgccactttgtggaccctgtgctgaaccagctgcagaggcctccccaggagactggagagcggctgaacaagtacaaggaggagcaccggcgcatcctgcaggagagcattgatgtggcccccttcaccaccaagatcaagggcctggagggggagcgggagaactacagccgggtggccagcagcagcagcagccccaagagccacatcatcaagcaggacatggatgtggagaggtctgtgtctgacctgtacaagatgaagcacagcgtgccccagagcctgccccagagcaactacttcaccaccctgagcaacagcgtggtgaatgaaccacccaggagctaccccagcaaggaggtgagcaacatctacggggacaagcagagcaatgccctggccgctgctgctgccaacccccagaccctgaccagcttcatcaccagcctgagcaagcccccacccctcatcaagcaccagcctgagagcgagggcctggtgggcaagatccctgagcacctgccccaccagatcgccagccacagcgtgaccaccttcagaaatgactgccgcagccccacccacctgactgtgagcagcaccaacaccctgcgctccatgcctgccctgcaccgggcccctgtgttccacccccccatccaccacagcctggagaggaaggagggcagctacagcagcctgagcccccccaccctgacccctgtgatgcctgtgaatgctgggggcaaggtgcaggagagccagaagccacccaccctcatccctgagcccaaggacagccaggccaacttcaagagcagcagcgagcagagcctgacagagatgtggaggcccaacaacaacctgagcaaggagaagacagagtggcacgtggagaagagcagcggcaagctgcaggccgccatggccagcgtcatcgtgcggcccagcagcagcaccaagacagacagcatgcctgccatgcagctggccagcaaggacagagtgtctgagaggagcagcgctggggcccacaagacagactgcctgaagctggccgaggccggggagaccggccgcatcatcctgcccaacgtgaacagcgacagcgtgcacaccaagtctgagaagaacttccaggccgtgtcccagggctctgtgcccagctctgtgatgtctgctgtgaacaccatgtgcaacaccaagacagatgtgatcaccagcgctgctgacaccacctctgtgtcctcctggggcggcagcgaggtgatcagcagcctgagcaacaccatcctggccagcaccagcagtgaatgtgtgagcagcaagtctgtgtcccagcctgtggcccagaagcaggagtgcaaggtgtccaccacagcccctgtgaccctggccagcagcaagacaggctctgtggtgcagcccagcagcggcttcagcggcaccacagacttcatccacctgaagaagcacaaggccgccctggccgccgcccagtacaagagcagcaatgccagcgagacagagcccaatgccatcaagaaccagaccctgagcgccagcctgcccctggacagcaccgtcatctgcagcaccatcaacaaggccaacagcgtgggcaatggccaggccagccagaccagccagcccaactaccacaccaagctgaagaaggcctggctgaccaggcacagcgaggaggacaagaacaccaacaagatggagaacagcggcaacagcgtgtctgagatcatcaagccctgcagcgtgaacctgattgccagcaccagcagtgacatccagaacagcgtggacagcaagatcatcgtggacaagtatgtgaaggatgacaaggtgaacagaaggaaggccaagaggacctatgagagcggcagcgagagcggggacagtgatgagagcgagagcaagtctgagcagaggaccaagaggcagcccaagcccacctacaagaagaagcagaatgacctgcagaagaggaaaggagaaattgaggaggacctgaagcccaatggagtgctgagccgcagcgccaaggagaggagcaagctgaagctgcagagcaacagcaacacaggcatccccaggtctgtgctgaaggactggaggaaggtgaagaagctgaagcagacaggagagagcttcctgcaggatgacagctgctgtgagatcggccccaacctgcagaagtgcagagaatgtcgcctcatccgcagcaagaagggggaggagcccgcccacagccctgtgttctgccgcttctactacttccggcggctgtccttcagcaagaatggagtggtgagaattgatggcttcagcagcccagaccagtatgatgatgaggccatgagcctgtggacccatgagaactttgaagatgatgagctggacatcgagaccagcaagtacatcctggacatcattggagacaagttctgccagctggtgaccagcgagaagacagccctgtcctgggtgaagaaggatgccaagatcgcctggaagagagctgtgcggggcgtgcgggagatgtgtgatgcctgtgaggccaccctcttcaacatccactgggtgtgccagaagtgtggctttgtggtgtgcctggactgctacaaggccaaggagaggaagagcagccgggacaaggagctgtatgcctggatgaagtgtgtgaagggccagccccatgaccacaagcacctgatgcccacccagatcatccctggctctgtgctgacagacctgctggatgccatgcacaccctgcgggagaagtatggcatcaagagccactgccactgcaccaacaagcagaacctgcaggtgggcaacttccccaccatgaatggagtgtcccaggtgctgcagaatgtgctgaaccacagcaacaagatcagcctgtgcatgcctgagagccagcagcagaacaccccacccaagtctgagaagaatggaggcagcagccctgagagtgatgtgggcacagacaacaagctgaccccacctgagagccagagccccctgcactggctggccgacctggccgagcagaaggcccgggaggagaagaaggagaacaaggagctgaccctggagaaccagatcaaggaggagcgggagcaggacaacagcgagagccccaatggaagaaccagccccctggtgtcccagaacaatgagcagggcagcaccctgcgggacctgctgaccaccacagctgggaagctgcgggtgggcagcacagatgctggcatcgcctttgcccctgtgtacagcatgggcgcccccagcagcaagagcggccgcaccatgcccaacatcctggatgacatcatcgcctctgtggtggagaacaagatcccccccagcaagaccagcaagatcaacgtgaagccagagctgaaggaggagcctgaggagagcatcatctctgctgtggatgagaacaacaagctgtacagcgacatcccccacagctggatctgtgagaagcacatcctgtggctgaaggactacaagaacagcagcaactggaagctgttcaaggagtgctggaagcagggccagcctgctgtggtgtctggagtgcacaagaagatgaacatcagcctgtggaaggccgagagcatcagcctggactttggagaccaccaggccgacctgctgaactgcaaggacagcatcatcagcaatgccaacgtgaaggagttctgggatggctttgaggaggtgtccaagaggcagaagaacaagtctggagagaccgtggtgctgaagctgaaggactggcccagcggggaggacttcaagaccatgatgcctgcccgctatgaggacctgctgaagagcctgcccctgcctgagtactgcaaccctgagggcaagttcaacctggccagccacctgcccggcttctttgtgcggccagacctgggcccccggctgtgcagcgcctacggcgtggtggccgccaaggaccatgacatcggcaccaccaacctgcacatcgaggtgtctgatgtggtgaacatcctggtgtatgtgggcatcgccaagggaaatggcatcctgagcaaggccggcatcctgaagaagtttgaggaggaggacctggatgacatcctgaggaagaggctgaaggacagcagcgagatccctggggccctgtggcacatctatgccggcaaggatgtggacaagatccgggagttcctgcagaagatcagcaaggagcagggcctggaggtgctgcctgagcatgaccccatccgggaccagagctggtacgtgaacaagaagctgcggcagaggctgctggaggagtatggagtgaggacctgcaccctcatccagttcctgggagatgccatcgtgctgcctgctggggccctgcaccaggtgcagaacttccacagctgcatccaggtgacagaagattttgtgtccccagagcacctggtggagagcttccacctgacccaggagctgcggctgctgaaggaggagatcaactatgatgacaagctgcaggtgaagaacatcctgtaccacgctgtgaaggagatggtgcgggccctgaagatccatgaagatgaggtggaggacatggaggagaactag

SEQ ID NO: 15867 - DNA, 6912 bp, Artificial Sequence
  Description of Artificial Sequence: Synthetic coding sequence
atgattgtgatgaatgaccaggtgctggagccccagaatgtggaccccagcatggtgcagatgaccttcctggatgatgtggtgcacagcctgctgaagggagaaaatattggcatcaccagcagaagaagaagccgggccaaccagaatgtgaatgctgtgcacagccactacacccgggcccaggccaacagccccaggcctgccatgaacagccaggccgctgtgcccaagcagaacacccaccagcagcagcagcagaggagcatccggcccaacaagaggaagggcagtgacagcagcatcccagatgaggagaagatgaaggaggagaagtatgactacatcagcagaggagagaaccccaagggcaagaacaagcacctgatgaacaagaggaggaagccagaggaggatgagaagaagctgaacatgaagaggctgaggacagacaacgtgtctgacttcagcgagagcagtgacagcgagaacagcaacaagaggatcatcgacaacagcagcgagcagaagccagaaaatgagctgaagaacaagaacaccagcaagatcaatggagaggagggcaagccccacaacaatgagaaggccggggaggagaccctgaagaacagccagcccccctgggaccagatccaggaggacaagaagcatgaggaggccgagaagaggaagtctgtggacacccagctgcaggaggacatgatcatccacagcagcgagcagagcacagtgtctgaccacaacagcaatgacctgctgccccaggagtgcaacatggacaagacccacaccatggagctgctgcccaaggagaagtttgtgtcccggccccccacccccaagtgtgtgattgacatcaccaatgacaccaacctggagaaggtggcccaggagaacagcagcaccttcggcctgcagaccctgcagaagatggaccccaacgtgtctgacagcaagcacagcatcgccaatgccaagttcctggagacagccaagaaggacagcgaccagagctgggtgtctgatgtggtgaaggtggacctgacccagagctctgtgaccaatgccagcagtggaaatgaccacctgaacatggagaaggagaagtatgtgtcctacatcagccccctgtctgctgtgtctgtgatggaggacaagctgcacaagaggagccccccacctgagaccatcaagagcaagctgaacacctctgtggacacccacaagatcaagagcagccccagccctgaggtggtgaagcccaagatcacccacagcccagacagcgtgaagagcaaggccacctacgtgaacagccaggccactggagagcggcggctggccaacaagattgagcacgagctgagccgctgcagcttccaccccatccccaccaggagcagcaccctggagaccaccaagagccccctcatcatcgacaagaatgagcacttcaccgtgtacagagatcctgccctgattggcagcgagactggagccaaccacatcagccccttcctgagccagcaccccttccccctgcacagcagcagccacaggacctgcctgaaccctggcacccaccacccagccctgaccccagccccccacctgctggccggcagcagcagccagacccccctgcccaccatcaacacccaccccctgaccagcggcccccaccacgctgtgcaccacccccacctgctgcccaccgtgctgcccggggtgcccacagccagcctgctgggcggccacccccggctggagagcgcccacgccagcagcctgagccacctggccctggcccaccagcagcagcagcagctgctgcagcaccagagcccccacctgctgggccaggcccaccccagcgccagctacaaccagctgggcctgtaccccatcatctggcagtacccaaatggcacccacgcctacagcggcctgggcctgcccagcagcaagtgggtgcacccagaaaatgctgtgaatgctgaggccagcctgcggaggaacagccccagcccctggctgcaccagcccacccctgtgaccagcgcagatggcatcggcctgctgagccacatccctgtgcggcccagcagcgctgagccccaccggcccctgaagatcacagcccacagcagcccccccctgaccaagaccctggtggaccaccacaaggaggagctggagaggaaggccttcatggagcccctgcggtctgtggccagcaccagcgccaagaatgacctggacctgaacagaagccagacaggcaaggactgccacctgcaccgccactttgtggaccctgtgctgaaccagctgcagaggcctccccaggagaccggggagcggctgaacaagtacaaggaggagcaccggcgcatcctgcaggagagcattgatgtggcccccttcaccaccaagatcaagggcctggagggggagcgggagaactacagccgggtggccagcagcagcagcagccccaagagccacatcatcaagcaggacatggatgtggagaggtctgtgtctgacctgtacaagatgaagcacagcgtgccccagagcctgccccagagcaactacttcaccaccctgagcaacagcgtggtgaatgagccccccaggagctaccccagcaaggaggtgagcaacatctatggagacaagcagagcaatgccctggccgctgctgctgccaacccccagaccctgaccagcttcatcaccagcctgagcaagcccccacccctcatcaagcaccagcctgagagcgagggcctggtgggcaagatccctgagcacctgccccaccagatcgccagccacagcgtgaccaccttcagaaatgactgccgcagccccacccacctgactgtgagcagcaccaacaccctgcgctccatgcctgccctgcaccgggcccctgtgttccacccccccatccaccacagcctggagaggaaggagggcagctacagcagcctgagcccccccaccctgacccctgtgatgcctgtgaatgccggcggcaaggtgcaggagagccagaagccacccaccctcatccctgagcccaaggacagccaggccaacttcaagagcagcagcgagcagagcctgacagagatgtggaggcccaacaacaacctgagcaaggagaagacagagtggcacgtggagaagagcagcggcaagctgcaggccgccatggcctctgtgattgtgcggcccagcagcagcaccaagacagacagcatgcctgccatgcagctggccagcaaggacagagtgtctgagaggagcagcgctggggcccacaagacagactgcctgaagctggccgaggccggggagaccggccgcatcatcctgcccaacgtgaacagcgacagcgtgcacaccaagtctgagaagaacttccaggccgtgtcccagggctctgtgcccagctctgtgatgtctgctgtgaacaccatgtgcaacaccaagacagatgtgatcaccagcgctgctgacaccacctctgtgtcctcctggggcggcagcgaggtgatcagcagcctgagcaacaccatcctggccagcaccagcagtgaatgtgtgagcagcaagtctgtgtcccagcctgtggcccagaagcaggagtgcaaggtgtccaccacagcccctgtgaccctggccagcagcaagacaggctctgtggtgcagcccagcagcggcttcagcggcaccacagacttcatccacctgaagaagcacaaggccgccctggccgccgcccagtacaagagcagcaatgccagcgagacagagcccaatgccatcaagaaccagaccctgagcgccagcctgcccctggacagcaccgtcatctgcagcaccatcaacaaggccaacagcgtgggcaatggccaggccagccagaccagccagcccaactaccacaccaagctgaagaaggcctggctgaccaggcacagcgaggaggacaagaacaccaacaagatggagaacagcggcaacagcgtgtctgagatcatcaagccctgcagcgtgaacctgattgccagcaccagcagtgacatccagaacagcgtggacagcaagatcatcgtggacaagtatgtgaaggatgacaaggtgaacagaaggaaggccaagaggacctatgaaagtggcagcgagagcggggacagtgatgaaagtgagagcaagtctgagcagaggaccaagaggcagcccaagcccacctacaagaagaagcagaatgacctgcagaagaggaagggggagattgaggaggacctgaagcccaacggggtgctgagccgcagcgccaaggagaggagcaagctgaagctgcagagcaacagcaacacaggcatccccaggtctgtgctgaaggactggaggaaggtgaagaagctgaagcagacaggagagagcttcctgcaggatgacagctgctgtgaaattggccccaacctgcagaagtgccgggagtgccgcctcatccgcagcaagaagggggaggagcccgcccacagccctgtgttctgccgcttctactacttccggcggctgtccttcagcaagaatggagtggtgagaattgatggcttcagcagcccagaccagtatgatgatgaggccatgagcctgtggacccatgaaaattttgaagatgatgagctggacatcgagaccagcaagtacatcctggacatcatcggggacaagttctgccagctggtgaccagcgagaagacagccctgtcctgggtgaagaaggatgccaagatcgcctggaagagagctgtgcggggcgtgcgggagatgtgtgatgcctgtgaggccaccctcttcaacatccactgggtgtgccagaagtgtggctttgtggtgtgcctggactgctacaaggccaaggagaggaagagcagccgggacaaggagctgtatgcctggatgaagtgtgtgaagggccagccccatgaccacaagcacctgatgcccacccagatcatccctggctctgtgctgacagacctgctggatgccatgcacaccctgcgggagaagtatggcatcaagagccactgccactgcaccaacaagcagaacctgcaggtgggcaacttccccaccatgaatggagtgtcccagagccagcagcagaacaccccacccaagtctgagaagaatggaggcagcagccctgagagtgatgtgggcacagacaacaagctgaccccacctgagagccagagccccctgcactggctggccgacctggccgagcagaaggcccgggaggagaagaaggagaacaaggagctgaccctggagaaccagatcaaggaggagcgggagcaggacaacagcgagagccccaacggccgcaccagccccctggtgtcccagaacaatgagcagggcagcaccctgcgggacctgctgaccaccacagctgggaagctgcgggtgggcagcacagatgctggcatcgcctttgcccctgtgtacagcatgggcgcccccagcagcaagagcggccgcaccatgcccaacatcctggatgacatcatcgcctctgtggtggagaacaagatcccccccagcaagaccagcaagatcaacgtgaagccagagctgaaggaggagcctgaggagagcatcatctctgctgtggatgagaacaacaagctgtacagcgacatcccccacagctggatctgtgagaagcacatcctgtggctgaaggactacaagaacagcagcaactggaagctgttcaaggagtgctggaagcagggccagcctgctgtggtgtctggagtgcacaagaagatgaacatcagcctgtggaaggccgagagcatcagcctggactttggagaccaccaggccgacctgctgaactgcaaggacagcatcatcagcaatgccaacgtgaaggagttctgggatggctttgaggaggtgtccaagaggcagaagaacaagagcggggagaccgtggtgctgaagctgaaggactggcccagcggggaggacttcaagaccatgatgcctgcccgctatgaggacctgctgaagagcctgcccctgcctgagtactgcaaccctgagggcaagttcaacctggccagccacctgcccggcttctttgtgcggccagacctgggcccccggctgtgcagcgcctatggagtggtggccgccaaggaccatgacatcggcaccaccaacctgcacatcgaggtgtctgatgtggtgaacatcctggtgtatgtgggcatcgccaagggaaatggcatcctgagcaaggccggcatcctgaagaagtttgaggaggaggacctggatgacatcctgaggaagaggctgaaggacagcagcgagatccctggggccctgtggcacatctatgctgggaaggatgtggacaagatccgggagttcctgcagaagatcagcaaggagcagggcctggaggtgctgcctgagcatgaccccatccgggaccagagctggtacgtgaacaagaagctgcggcagaggctgctggaggagtatggagtgaggacctgcaccctcatccagttcctgggagatgccatcgtgctgcctgctggggccctgcaccaggtgcagaacttccacagctgcatccaggtgacagaggactttgtgtccccagagcacctggtggagagcttccacctgacccaggagctgcggctgctgaaggaggagatcaactatgatgacaagctgcaggtgaagaacatcctgtaccacgctgtgaaggagatggtgcgggccctgaagatccatgaagatgaggtggaggacatggaggagaactag

SEQ ID NO: 15868 - DNA, 7077 bp, Artificial Sequence
  Description of Artificial Sequence: Synthetic coding sequence
atgcagggcccctacagcctgaatggctacagagtgcgggtgtaccggcaggacagcgccacccagtggttcaccggcatcatcacccaccacgacctcttcaccaggaccatgattgtgatgaatgaccaggtgctggagccccagaatgtggaccccagcatggtgcagatgaccttcctggatgatgtggtgcacagcctgctgaagggggagaacatcggcatcaccagcagaagaagaagccgggccaaccagaatgtgaatgctgtgcacagccactacacccgggcccaggccaacagccccaggcctgccatgaacagccaggccgctgtgcccaagcagaacacccaccagcagcagcagcagaggagcatccggcccaacaagaggaaaggaagtgacagcagcatcccagatgaggagaagatgaaggaggagaagtatgactacatcagcagaggagagaaccccaagggcaagaacaagcacctgatgaacaagaggaggaagccagaagaagatgagaagaagctgaacatgaagaggctgaggacagacaacgtgtctgacttcagcgagagcagtgacagcgagaacagcaacaagaggatcatcgacaacagcagcgagcagaagccagaaaatgagctgaagaacaagaacaccagcaagatcaacggggaggagggcaagccccacaacaatgagaaggccggggaggagaccctgaagaacagccagcccccctgggaccagatccaggaggacaagaagcatgaggaggccgagaagaggaagtctgtggacacccagctgcaggaggacatgatcatccacagcagcgagcagagcacagtgtctgaccacaacagcaatgacctgctgccccaggagtgcaacatggacaagacccacaccatggagctgctgcccaaggagaagtttgtgtccaggcctcccacccccaagtgtgtgattgacatcaccaatgacaccaacctggagaaggtggcccaggagaacagcagcaccttcggcctgcagaccctgcagaagatggaccccaacgtgtctgacagcaagcacagcatcgccaatgccaagttcctggagacagccaagaaggacagcgaccagagctgggtgtctgatgtggtgaaggtggacctgacccagagctctgtgaccaatgccagcagtggaaatgaccacctgaacatggagaaggagaagtatgtgtcctacatcagccccctgtctgctgtgtctgtgatggaggacaagctgcacaagaggagccccccacctgagaccatcaagagcaagctgaacacctctgtggacacccacaagatcaagagcagccccagccctgaggtggtgaagcccaagatcacccacagcccagattctgtgaagagcaaggccacctacgtgaacagccaggccaccggggagcggcggctggccaacaagattgaacatgagctgagccgctgcagcttccaccccatccccaccaggagcagcaccctggagaccaccaagagccccctcatcatcgacaagaatgagcacttcaccgtgtacagagatcctgccctgattggcagcgagaccggggccaaccacatcagccccttcctgagccagcaccccttccccctgcacagcagcagccacaggacctgcctgaaccctggcacccaccacccagccctgaccccagccccccacctgctggccggcagcagcagccagacccccctgcccaccatcaacacccaccccctgaccagcggcccccaccacgctgtgcaccacccccacctgctgcccaccgtgctgcccggggtgcccacagccagcctgctgggcggccacccccggctggagagcgcccacgccagcagcctgagccacctggccctggcccaccagcagcagcagcagctgctgcagcaccagagcccccacctgctgggccaggcccaccccagcgccagctacaaccagctgggcctgtaccccatcatctggcagtaccccaacggcacccacgcctacagcggcctgggcctgcccagcagcaagtgggtgcacccagaaaatgctgtgaatgctgaggccagcctgcggaggaacagccccagcccctggctgcaccagcccacccctgtgaccagcgcagatggcatcggcctgctgagccacatccctgtgcggcccagcagcgctgagccccaccggcccctgaagatcacagcccacagcagcccccccctgaccaagaccctggtggaccaccacaaggaggagctggagaggaaggccttcatggagcccctgcggtctgtggccagcaccagcgccaagaatgacctggacctgaacagaagccagacaggcaaggactgccacctgcaccgccactttgtggaccctgtgctgaaccagctgcagaggcctccccaggagactggagagcggctgaacaagtacaaggaggagcaccggcgcatcctgcaggagagcattgatgtggcccccttcaccaccaagatcaagggcctggagggggagcgggagaactacagccgggtggccagcagcagcagcagccccaagagccacatcatcaagcaggacatggatgtggagaggtctgtgtctgacctgtacaagatgaagcacagcgtgccccagagcctgccccagagcaactacttcaccaccctgagcaacagcgtggtgaatgaaccacccaggagctaccccagcaaggaggtgagcaacatctacggggacaagcagagcaatgccctggccgctgctgctgccaacccccagaccctgaccagcttcatcaccagcctgagcaagcccccacccctcatcaagcaccagcctgagagcgagggcctggtgggcaagatccctgagcacctgccccaccagatcgccagccacagcgtgaccaccttcagaaatgactgccgcagccccacccacctgactgtgagcagcaccaacaccctgcgctccatgcctgccctgcaccgggcccctgtgttccacccccccatccaccacagcctggagaggaaggagggcagctacagcagcctgagcccccccaccctgacccctgtgatgcctgtgaatgctgggggcaaggtgcaggagagccagaagccacccaccctcatccctgagcccaaggacagccaggccaacttcaagagcagcagcgagcagagcctgacagagatgtggaggcccaacaacaacctgagcaaggagaagacagagtggcacgtggagaagagcagcggcaagctgcaggccgccatggccagcgtcatcgtgcggcccagcagcagcaccaagacagacagcatgcctgccatgcagctggccagcaaggacagagtgtctgagaggagcagcgctggggcccacaagacagactgcctgaagctggccgaggccggggagaccggccgcatcatcctgcccaacgtgaacagcgacagcgtgcacaccaagtctgagaagaacttccaggccgtgtcccagggctctgtgcccagctctgtgatgtctgctgtgaacaccatgtgcaacaccaagacagatgtgatcaccagcgctgctgacaccacctctgtgtcctcctggggcggcagcgaggtgatcagcagcctgagcaacaccatcctggccagcaccagcagtgaatgtgtgagcagcaagtctgtgtcccagcctgtggcccagaagcaggagtgcaaggtgtccaccacagcccctgtgaccctggccagcagcaagacaggctctgtggtgcagcccagcagcggcttcagcggcaccacagacttcatccacctgaagaagcacaaggccgccctggccgccgcccagtacaagagcagcaatgccagcgagacagagcccaatgccatcaagaaccagaccctgagcgccagcctgcccctggacagcaccgtcatctgcagcaccatcaacaaggccaacagcgtgggcaatggccaggccagccagaccagccagcccaactaccacaccaagctgaagaaggcctggctgaccaggcacagcgaggaggacaagaacaccaacaagatggagaacagcggcaacagcgtgtctgagatcatcaagccctgcagcgtgaacctgattgccagcaccagcagtgacatccagaacagcgtggacagcaagatcatcgtggacaagtatgtgaaggatgacaaggtgaacagaaggaaggccaagaggacctatgagagcggcagcgagagcggggacagtgatgagagcgagagcaagtctgagcagaggaccaagaggcagcccaagcccacctacaagaagaagcagaatgacctgcagaagaggaaaggagaaattgaggaggacctgaagcccaatggagtgctgagccgcagcgccaaggagaggagcaagctgaagctgcagagcaacagcaacacaggcatccccaggtctgtgctgaaggactggaggaaggtgaagaagctgaagcagacaggagagagcttcctgcaggatgacagctgctgtgagatcggccccaacctgcagaagtgcagagaatgtcgcctcatccgcagcaagaagggggaggagcccgcccacagccctgtgttctgccgcttctactacttccggcggctgtccttcagcaagaatggagtggtgagaattgatggcttcagcagcccagaccagtatgatgatgaggccatgagcctgtggacccatgagaactttgaagatgatgagctggacatcgagaccagcaagtacatcctggacatcattggagacaagttctgccagctggtgaccagcgagaagacagccctgtcctgggtgaagaaggatgccaagatcgcctggaagagagctgtgcggggcgtgcgggagatgtgtgatgcctgtgaggccaccctcttcaacatccactgggtgtgccagaagtgtggctttgtggtgtgcctggactgctacaaggccaaggagaggaagagcagccgggacaaggagctgtatgcctggatgaagtgtgtgaagggccagccccatgaccacaagcacctgatgcccacccagatcatccctggctctgtgctgacagacctgctggatgccatgcacaccctgcgggagaagtatggcatcaagagccactgccactgcaccaacaagcagaacctgcaggtgggcaacttccccaccatgaatggagtgtcccaggtgctgcagaatgtgctgaaccacagcaacaagatcagcctgtgcatgcctgagagccagcagcagaacaccccacccaagtctgagaagaatggaggcagcagccctgagagtgatgtgggcacagacaacaagctgaccccacctgagagccagagccccctgcactggctggccgacctggccgagcagaaggcccgggaggagaagaaggagaacaaggagctgaccctggagaaccagatcaaggaggagcgggagcaggacaacagcgagagccccaatggaagaaccagccccctggtgtcccagaacaatgagcagggcagcaccctgcgggacctgctgaccaccacagctgggaagctgcgggtgggcagcacagatgctggcatcgcctttgcccctgtgtacagcatgggcgcccccagcagcaagagcggccgcaccatgcccaacatcctggatgacatcatcgcctctgtggtggagaacaagatcccccccagcaagaccagcaagatcaacgtgaagccagagctgaaggaggagcctgaggagagcatcatctctgctgtggatgagaacaacaagctgtacagcgacatcccccacagctggatctgtgagaagcacatcctgtggctgaaggactacaagaacagcagcaactggaagctgttcaaggagtgctggaagcagggccagcctgctgtggtgtctggagtgcacaagaagatgaacatcagcctgtggaaggccgagagcatcagcctggactttggagaccaccaggccgacctgctgaactgcaaggacagcatcatcagcaatgccaacgtgaaggagttctgggatggctttgaggaggtgtccaagaggcagaagaacaagtctggagagaccgtggtgctgaagctgaaggactggcccagcggggaggacttcaagaccatgatgcctgcccgctatgaggacctgctgaagagcctgcccctgcctgagtactgcaaccctgagggcaagttcaacctggccagccacctgcccggcttctttgtgcggccagacctgggcccccggctgtgcagcgcctacggcgtggtggccgccaaggaccatgacatcggcaccaccaacctgcacatcgaggtgtctgatgtggtgaacatcctggtgtatgtgggcatcgccaagggaaatggcatcctgagcaaggccggcatcctgaagaagtttgaggaggaggacctggatgacatcctgaggaagaggctgaaggacagcagcgagatccctggggccctgtggcacatctatgccggcaaggatgtggacaagatccgggagttcctgcagaagatcagcaaggagcagggcctggaggtgctgcctgagcatgaccccatccgggaccagagctggtacgtgaacaagaagctgcggcagaggctgctggaggagtatggagtgaggacctgcaccctcatccagttcctgggagatgccatcgtgctgcctgctggggccctgcaccaggtgcagaacttccacagctgcatccaggtgacagaagattttgtgtccccagagcacctggtggagagcttccacctgacccaggagctgcggctgctgaaggaggagatcaactatgatgacaagctgcaggtgaagaacatcctgtaccacgctgtgaaggagatggtgcgggccctgaagatccatgaagatgaggtggaggacatggaggagaactag

SEQ ID NO: 15869 - DNA, 3741 bp, Artificial Sequence
  Description of Artificial Sequence: Synthetic coding sequence
atgagcaaggagcggcccaagaggaacatcatccagaagaagtatgatgacagtgatggcatcccctggagcgaggagcgggtggtgaggaaggtgctgtacctgagcctgaaggagttcaagaacagccagaagaggcagcacgccgagggcattgctggcagcctgaagacagtgaatggcctgctgggcaatgaccagagcaagggcctgggccctgccagcgagcagagtgaaaatgagaaggatgatgccagccaggtgagcagcaccagcaatgatgtgagcagcagtgactttgaggagggccccagcaggaagaggccccggctgcaggcccagaggaagtttgcccagagccagcccaacagccccagcaccacccctgtgaagatcgtggagcccctgctgcccccaccagccacccagatcagtgacctgagcaagaggaagcccaagacagaggacttcctgaccttcctgtgcctgcggggcagccctgccctgcccaacagcatggtgtacttcggcagcagccaggatgaggaggaggtggaggaggaggatgatgaaacagaagatgtgaagacagccaccaacaatgccagcagcagctgccagagcacccccaggaagggcaagacccacaagcacgtgcacaatggacatgtgttcaacggcagcagccgcagcacccgggagaaggagcctgtgcagaagcacaagagcaaggaggccaccccagccaaggagaagcacagcgaccacagagctgacagcagaagagagcaggccagcgccaaccaccctgctgctgcccccagcacaggcagcagcgccaagggcctggccgccacccaccaccacccccccctgcacaggtctgcccaggacctgaggaagcaggtgtccaaggtgaatggagtgaccaggatgagcagcctgggcgctggggtgaccagcgccaagaagatgagggaggtgcggcccagccccagcaagacagtgaagtacacagccaccgtgaccaagggagctgtgacctacaccaaggccaagcgggagctggtgaaggacaccaagcccaaccaccacaagcccagcagcgctgtgaaccacaccatcagcggcaagacagagagcagcaatgccaagaccaggaagcaggtgctgagcctgggcggggccagcaagagcacaggccctgctgtgaatggcctgaaggtgtctggccgcctgaaccccaagagctgcaccaaggaggtgggcggccggcagctgcgggagggcctgcagctgcgggagggcctgaggaacagcaagaggcggctggaggaggcccaccaggccgagaagccccagagcccccccaagaagatgaagggagctgctggccctgctgagggccctgggaagaaggccccagctgagcggggcctgctgaatggccacgtgaagaaggaggtgcctgagaggagcctggagaggaaccggcccaagagggccacagctgggaagagcaccccaggccggcaggcccacggcaaggctgacagcgccagctgtgaaaatagaagcaccagccagcctgagagcgtgcacaagccccaggacagcggcaaggccgagaagggcggcggcaaggccggctgggccgccatggatgagatccctgtgctgcggcccagcgccaaggagttccatgaccccctcatctacatcgagagcgtgcgggcccaggtggagaagtttggcatgtgcagggtcatccccccaccagactggaggcctgagtgcaagctgaatgatgagatgagatttgtgacccagatccagcacatccacaagctgggccgccgctggggccccaacgtgcagaggctggcctgcatcaagaagcacctgaagagccagggcatcaccatggatgagctgcccctcatcggcggctgtgagctggacctggcctgcttcttccgcctcatcaatgagatgggcggcatgcagcaggtgacagacctgaagaagtggaacaagctggccgacatgctgcgcatccccaggacagcccaggaccggctggccaagctgcaggaggcctactgccagtacctgctgtcctatgacagcctgagccctgaggagcaccggcggctggagaaggaggtgctgatggagaaggagatcctggagaagaggaagggccccctggagggccacacagaaaatgaccaccacaagttccaccccctgcccaggtttgagcccaagaatggcctcatccacggcgtggcccccagaaatggcttccgcagcaagctgaaggaggtgggccaggcccagctgaagacaggaagaagaagactctttgcccaggagaaggaggtggtgaaggaggaggaggaggacaagggcgtgctgaatgacttccacaagtgcatctacaagggccgctctgtgtccctgaccaccttctacagaacagccaggaacatcatgtccatgtgcttcagcaaggagcccgccccagctgagattgagcaggagtactggaggctggtggaggagaaggactgccacgtggccgtgcactgcggcaaggtggacaccaacacccacggcagcggcttccctgtgggcaagtctgagcccttcagccgccacggctggaacctgactgtgctgcccaacaacacaggcagcatcctgcggcacctgggcgctgtgcctggggtgaccatcccctggctgaacatcggcatggtgttcagcaccagctgctggagccgggaccagaaccacctgccctacatcgactacctgcacactggagctgactgcatctggtactgcatcccagctgaggaggagaacaagctggaggatgtggtgcacaccctgctgcaggccaacggcaccccaggcctgcagatgctggagagcaatgtgatgatcagccctgaggtgctgtgcaaggagggcatcaaggtgcacaggacagtgcagcagagcggccagtttgtggtgtgcttccctggcagctttgtgtccaaggtgtgctgcggctacagcgtgtctgagaccgtgcactttgccaccacccagtggacctccatgggctttgaaacagccaaggagatgaagagaagacacatcgccaagcccttctccatggagaagctgctgtaccagatcgcccaggccgaggccaagaaggaaaatggccccaccctgagcaccatcagcgccctgctggatgagctgcgggacacagagctgcggcagaggcggcagctgtttgaggccggcctgcacagcagcgcccgctatggcagccatgatggcagcagcacagtggctgatggcaagaagaagcccaggaagtggctgcagctggagaccagcgagcggcgctgccagatctgccagcacctgtgctacctgtccatggtggtgcaggagaatgaaaatgtggtgttctgcctggagtgtgccctgcggcacgtggagaagcagaagagctgccggggcctgaagctgatgtaccgctatgatgaggagcagatcatcagcctggtgaaccagatctgtgggaaggtgtctgggaagaatggcagcattgagaactgcctgagcaagcccacccccaagaggggccccaggaagagggccaccgtggatgtgccccccagccggctgagcgccagcagcagcagcaagagcgccagcagcagcagctag

SEQ ID NO: 15870 - DNA, 3225 bp, Artificial Sequence
  Description of Artificial Sequence: Synthetic coding sequence
atggtgtacttcggcagcagccaggatgaggaggaggtggaggaggaggatgatgaaacagaagatgtgaagacagccaccaacaatgccagcagcagctgccagagcacccccaggaagggcaagacccacaagcacgtgcacaatggacatgtgttcaacggcagcagccgcagcacccgggagaaggagcctgtgcagaagcacaagagcaaggaggccaccccagccaaggagaagcacagcgaccacagagctgacagcagaagagagcaggccagcgccaaccaccctgctgctgcccccagcacaggcagcagcgccaagggcctggccgccacccaccaccacccccccctgcacaggtctgcccaggacctgaggaagcaggtgtccaaggtgaatggagtgaccaggatgagcagcctgggcgctggggtgaccagcgccaagaagatgagggaggtgcggcccagccccagcaagacagtgaagtacacagccaccgtgaccaagggagctgtgacctacaccaaggccaagcgggagctggtgaaggacaccaagcccaaccaccacaagcccagcagcgctgtgaaccacaccatcagcggcaagacagagagcagcaatgccaagaccaggaagcaggtgctgagcctgggcggggccagcaagagcacaggccctgctgtgaatggcctgaaggtgtctggccgcctgaaccccaagagctgcaccaaggaggtgggcggccggcagctgcgggagggcctgcagctgcgggagggcctgaggaacagcaagaggcggctggaggaggcccaccaggccgagaagccccagagcccccccaagaagatgaagggagctgctggccctgctgagggccctgggaagaaggccccagctgagcggggcctgctgaatggccacgtgaagaaggaggtgcctgagaggagcctggagaggaaccggcccaagagggccacagctgggaagagcaccccaggccggcaggcccacggcaaggctgacagcgccagctgtgaaaatagaagcaccagccagcctgagagcgtgcacaagccccaggacagcggcaaggccgagaagggcggcggcaaggccggctgggccgccatggatgagatccctgtgctgcggcccagcgccaaggagttccatgaccccctcatctacatcgagagcgtgcgggcccaggtggagaagtttggcatgtgcagggtcatccccccaccagactggaggcctgagtgcaagctgaatgatgagatgagatttgtgacccagatccagcacatccacaagctgggccgccgctggggccccaacgtgcagaggctggcctgcatcaagaagcacctgaagagccagggcatcaccatggatgagctgcccctcatcggcggctgtgagctggacctggcctgcttcttccgcctcatcaatgagatgggcggcatgcagcaggtgacagacctgaagaagtggaacaagctggccgacatgctgcgcatccccaggacagcccaggaccggctggccaagctgcaggaggcctactgccagtacctgctgtcctatgacagcctgagccctgaggagcaccggcggctggagaaggaggtgctgatggagaaggagatcctggagaagaggaagggccccctggagggccacacagaaaatgaccaccacaagttccaccccctgcccaggtttgagcccaagaatggcctcatccacggcgtggcccccagaaatggcttccgcagcaagctgaaggaggtgggccaggcccagctgaagacaggaagaagaagactctttgcccaggagaaggaggtggtgaaggaggaggaggaggacaagggcgtgctgaatgacttccacaagtgcatctacaagggccgctctgtgtccctgaccaccttctacagaacagccaggaacatcatgtccatgtgcttcagcaaggagcccgccccagctgagattgagcaggagtactggaggctggtggaggagaaggactgccacgtggccgtgcactgcggcaaggtggacaccaacacccacggcagcggcttccctgtgggcaagtctgagcccttcagccgccacggctggaacctgactgtgctgcccaacaacacaggcagcatcctgcggcacctgggcgctgtgcctggggtgaccatcccctggctgaacatcggcatggtgttcagcaccagctgctggagccgggaccagaaccacctgccctacatcgactacctgcacactggagctgactgcatctggtactgcatcccagctgaggaggagaacaagctggaggatgtggtgcacaccctgctgcaggccaacggcaccccaggcctgcagatgctggagagcaatgtgatgatcagccctgaggtgctgtgcaaggagggcatcaaggtgcacaggacagtgcagcagagcggccagtttgtggtgtgcttccctggcagctttgtgtccaaggtgtgctgcggctacagcgtgtctgagaccgtgcactttgccaccacccagtggacctccatgggctttgaaacagccaaggagatgaagagaagacacatcgccaagcccttctccatggagaagctgctgtaccagatcgcccaggccgaggccaagaaggaaaatggccccaccctgagcaccatcagcgccctgctggatgagctgcgggacacagagctgcggcagaggcggcagctgtttgaggccggcctgcacagcagcgcccgctatggcagccatgatggcagcagcacagtggctgatggcaagaagaagcccaggaagtggctgcagctggagaccagcgagcggcgctgccagatctgccagcacctgtgctacctgtccatggtggtgcaggagaatgaaaatgtggtgttctgcctggagtgtgccctgcggcacgtggagaagcagaagagctgccggggcctgaagctgatgtaccgctatgatgaggagcagatcatcagcctggtgaaccagatctgtgggaaggtgtctgggaagaatggcagcattgagaactgcctgagcaagcccacccccaagaggggccccaggaagagggccaccgtggatgtgccccccagccggctgagcgccagcagcagcagcaagagcgccagcagcagcagctag

SEQ ID NO: 15871 - DNA, 1524 bp, Artificial Sequence
  Description of Artificial Sequence: Synthetic coding sequence
atgaagaggaccatgcaccccaagtgcccccccctggccaccatgctggtgctgcagatcctgaagaagggcagaagaggcaagggcagccctgccctgcccaacagcatggtgtacttcggcagcagccaggatgaggaggaggtggaggaggaggatgatgaaacagaagatgtgaagacagccaccaacaatgccagcagcagctgccagagcacccccaggaagggcaagacccacaagcacgtgcacaatggacatgtgttcaacggcagcagccgcagcacccgggagaaggagcctgtgcagaagcacaagagcaaggaggccaccccagccaaggagaagcacagcgaccacagagctgacagcagaagagagcaggccagcgccaaccaccctgctgctgcccccagcacaggcagcagcgccaagggcctggccgccacccaccaccacccccccctgcacaggtctgcccaggacctgaggaagcaggtgtccaaggtgaatggagtgaccaggatgagcagcctgggcgctggggtgaccagcgccaagaagatgagggaggtgcggcccagccccagcaagacagtgaagtacacagccaccgtgaccaagggagctgtgacctacaccaaggccaagcgggagctggtgaaggacaccaagcccaaccaccacaagcccagcagcgctgtgaaccacaccatcagcggcaagacagagagcagcaatgccaagaccaggaagcaggtgctgagcctgggcggggccagcaagagcacaggccctgctgtgaatggcctgaaggtgtctggccgcctgaaccccaagagctgcaccaaggaggtgggcggccggcagctgcgggagggcctgcagctgcgggagggcctgaggaacagcaagaggcggctggaggaggcccaccaggccgagaagccccagagcccccccaagaagatgaagggagctgctggccctgctgagggccctgggaagaaggccccagctgagcggggcctgctgaatggccacgtgaagaaggaggtgcctgagaggagcctggagaggaaccggcccaagagggccacagctgggaagagcaccccaggccggcaggcccacggcaaggctgacagcgccagctgtgaaaatagaagcaccagccagcctgagagcgtgcacaagccccaggacagcggcaaggccgagaagggcggcggcaaggccggctgggccgccatggatgagatccctgtgctgcggcccagcgccaaggagttccatgaccccctcatctacatcgagagcgtgcgggcccaggtggagaagtttggcatgtgcagggtcatccccccaccagactggaggcctgagtgcaagctgaatgatgagatgagatttgtgacccagatccagcacatccacaagctgggccgccgctggggccccaacgtgcagaggctggcctgcatcaagaagcacctgaagagcctgggcggctgcggcagctag

SEQ ID NO: 15872 - DNA, 2883 bp, Artificial Sequence
  Description of Artificial Sequence: Synthetic coding sequence
atggccgccccccgggtgtgccaggtgcagttcctggtggcctacctggaggagcccggcatcgagggcctgctgggcaatgaccagagcaagggcctgggccctgccagcgagcagagtgaaaatgagaaggatgatgccagccaggtgagcagcaccagcaatgatgtgagcagcagtgactttgaggagggccccagcaggaagaggccccggctgcaggcccagaggaagtttgcccagagccagcccaacagccccagcaccacccctgtgaagatcgtggagcccctgctgcccccaccagccacccagatcagtgacctgagcaagaggaagcccaagacagaggacttcctgaccttcctgtgcctgcggggcagccctgccctgcccaacagcatggtgtacttcggcagcagccaggatgaggaggaggtggaggaggaggatgatgaaacagaagatgtgaagacagccaccaacaatgccagcagcagctgccagagcacccccaggaagggcaagacccacaagcacgtgcacaatggacatgtgttcaacggcagcagccgcagcacccgggagaaggagcctgtgcagaagcacaagagcaaggaggccaccccagccaaggagaagcacagcgaccacagagctgacagcagaagagagcaggccagcgccaaccaccctgctgctgcccccagcacaggcagcagcgccaagggcctggccgccacccaccaccacccccccctgcacaggtctgcccaggacctgaggaagcaggtgtccaaggtgaatggagtgaccaggatgagcagcctgggcgctggggtgaccagcgccaagaagatgagggaggtgcggcccagccccagcaagacagtgaagtacacagccaccgtgaccaagggagctgtgacctacaccaaggccaagcgggagctggtgaaggacaccaagcccaaccaccacaagcccagcagcgctgtgaaccacaccatcagcggcaagacagagagcagcaatgccaagaccaggaagcaggtgctgagcctgggcggggccagcaagagcacaggccctgctgtgaatggcctgaaggtgtctggccgcctgaaccccaagagctgcaccaaggaggtgggcggccggcagctgcgggagggcctgcagctgcgggagggcctgaggaacagcaagaggcggctggaggaggcccaccaggccgagaagccccagagcccccccaagaagatgaagggagctgctggccctgctgagggccctgggaagaaggccccagctgagcggggcctgctgaatggccacgtgaagaaggaggtgcctgagaggagcctggagaggaaccggcccaagagggccacagctgggaagagcaccccaggccggcaggcccacggcaaggctgacagcgccagctgtgaaaatagaagcaccagccagcctgagagcgtgcacaagccccaggacagcggcaaggccgagaagggcggcggcaaggccggctgggccgccatggatgagatccctgtgctgcggcccagcgccaaggagttccatgaccccctcatctacatcgagagcgtgcgggcccaggtggagaagtttggcatgtgcagggtcatccccccaccagactggaggcctgagtgcaagctgaatgatgagatgagatttgtgacccagatccagcacatccacaagctgggccgccgctggggccccaacgtgcagaggctggcctgcatcaagaagcacctgaagagccagggcatcaccatggatgagctgcccctcatcggcggctgtgagctggacctggcctgcttcttccgcctcatcaatgagatgggcggcatgcagcaggtgacagacctgaagaagtggaacaagctggccgacatgctgcgcatccccaggacagcccaggaccggctggccaagctgcaggaggcctactgccagtacctgctgtcctatgacagcctgagccctgaggagcaccggcggctggagaaggaggtgctgatggagaaggagatcctggagaagaggaagggccccctggagggccacacagaaaatgaccaccacaagttccaccccctgcccaggtttgagcccaagaatggcctcatccacggcgtggcccccagaaatggcttccgcagcaagctgaaggaggtgggccaggcccagctgaagacaggaagaagaagactctttgcccaggagaaggaggtggtgaaggaggaggaggaggacaagggcgtgctgaatgacttccacaagtgcatctacaagggccgctctgtgtccctgaccaccttctacagaacagccaggaacatcatgtccatgtgcttcagcaaggagcccgccccagctgagattgagcaggagtactggaggctggtggaggagaaggactgccacgtggccgtgcactgcggcaaggtggacaccaacacccacggcagcggcttccctgtgggcaagtctgagcccttcagccgccacggctggaacctgactgtgctgcccaacaacacaggcagcatcctgcggcacctgggcgctgtgcctggggtgaccatcccctggctgaacatcggcatggtgttcagcaccagctgctggagccgggaccagaaccacctgccctacatcgactacctgcacactggagctgactgcatctgcctgtctgtggagcccgtcttcccccacctgtctgtggccgtgggcagccgggtggacctgggcatctccttcctgccctgtggggacaccagggtgatgtaccctgtggagagcgtggcctggaggggcgtgctgggcccccggctgtag

SEQ ID NO: 15873 - DNA, 525 bp, Artificial Sequence
  Description of Artificial Sequence: Synthetic coding sequence
atggtggccggctggccagccaccccaccagccatgatgcctggccagatcccagaccccagcgtgaccaccggcagcctgcccggcctgggccccctgaccggcctgcccagcagcgccctgactgtggaggagctgaagtatgctgacatccggaacctgggcgccatgattgcccccctgcacttcctggaggtgaagctgggcaagaggccccagcctgtgaagtctgagctggatgaggaggaggagaggaggaagagaagaagagagaagaacaaggtggccgccgcccgctgcaggaacaagaagaaggagaggacagagttcctgcagcgggagagcgagcggctggagctgatgaatgctgagctgaagacccagatcgaggagctgaagcaggagcggcagcagctgatcctgatgctgaacagacaccggcccacctgcatcgtgaggacagacagcgtgaagaccccagagagcgagggcaaccccctgctggagcagctggagaagaagtag

SEQ ID NO: 15874 - DNA, 492 bp, Artificial Sequence
  Description of Artificial Sequence: Synthetic coding sequence
atgatgcctggccagatcccagaccccagcgtgaccaccggcagcctgcccggcctgggccccctgaccggcctgcccagcagcgccctgactgtggaggagctgaagtatgctgacatccggaacctgggcgccatgattgcccccctgcacttcctggaggtgaagctgggcaagaggccccagcctgtgaagtctgagctggatgaggaggaggagaggaggaagagaagaagagagaagaacaaggtggccgccgcccgctgcaggaacaagaagaaggagaggacagagttcctgcagcgggagagcgagcggctggagctgatgaatgctgagctgaagacccagatcgaggagctgaagcaggagcggcagcagctgatcctgatgctgaacagacaccggcccacctgcatcgtgaggacagattctgtgaagaccccagagagcgagggcaaccccctgctggagcagctggagaagaagtag

SEQ ID NO: 15875 - DNA, 492 bp, Artificial Sequence; identical to SEQ ID NO: 15874
  Description of Artificial Sequence: Synthetic coding sequence

SEQ ID NO: 15876 - DNA, 492 bp, Artificial Sequence; identical to SEQ ID NO: 15874
  Description of Artificial Sequence: Synthetic coding sequence

SEQ ID NO: 15877 - DNA, 405 bp, Artificial Sequence
  Description of Artificial Sequence: Synthetic coding sequence
atgatgcctggccagatcccagaccccagcgtgaccaccggcagcctgcccggcctgggccccctgaccggcctgcccagcagcgccctgactgtggaggagctgaagtatgctgacatccggaacctgggcgccatgattgcccccctgcacttcctggaggtgaagctgggcaagaggccccagcctgtgaagtctgagctggatgaggaggaggagaggaggaagagaagaagagagaagaacaaggtggccgccgcccgctgcaggaacaagaagaaggagaggacagagttcctgcagcgggagagcgagcggctggagctgatgaatgctgagctgaagacccagatcgaggagctgaagcaggagcggcagcagctgatcctgatgctgaacagatag

SEQ ID NO: 15878 - DNA, 6015 bp, Artificial Sequence
  Description of Artificial Sequence: Synthetic coding sequence
atggtgaagctggccaaccccctgtacacagagtggatcctggaggccatcaagaaggtgaagaagcagaagcagaggcccagcgaggagcgcatctgcaatgctgtgagcagcagccacggcctggacaggaagacagtgctggagcagctggagctgtctgtgaaggatggcaccatcctgaaggtgagcaacaagggcctgaacagctacaaggaccctgacaaccctggccgcatcgccctgcccaagcccaggaaccacggcaagctggacaacaagcagaatgtggactggaacaagctgatcaagagagctgtggagggcctggccgagagcggcggcagcaccctgaagagcattgagcgcttcctgaagggccagaaggatgtgtctgccctgtttggaggcagcgctgccagcggcttccaccagcagctgcggctggccatcaagagggccatcggccacggccgcctgctgaaggatggccccctgtaccgcctgaacaccaaggccaccaacgtggatggcaaggagagctgtgagagcctgagctgcctgccccctgtgtccctgctgccccatgagaaggacaagcctgtggccgagcccatccccatctgcagcttctgcctgggcaccaaggagcagaaccgggagaagaagccagaggagctgatcagctgtgccgactgtggcaacagcggccaccccagctgcctgaagttcagccctgagctgactgtgcgggtgaaggccctgcgctggcagtgcatcgagtgcaagacctgcagcagctgccgggaccagggcaagaatgctgacaacatgctgttctgtgacagctgtgaccggggcttccacatggagtgctgtgacccccccctgaccaggatgcccaagggcatgtggatctgccagatctgccggcccaggaagaagggcaggaagctgctgcagaagaaggccgcccagatcaagaggcgctacaccaaccccatcggccggcccaagaaccggctgaagaagcagaacacagtgtccaagggccccttcagcaaggtgaggacaggccctggccggggcaggaagaggaagatcaccctgagcagccagagcgccagcagcagcagcgaggagggctacctggagagaattgatggcctggacttctgccgggacagcaatgtgtccctgaagttcaacaagaagaccaagggcctgattgatggcctgaccaagttcttcacccccagcccagatggcaggaaggcccggggggaggtggtggactacagcgagcagtaccgcatcaggaagaggggcaacaggaagagcagcaccagtgactggcccacagacaaccaggacggctgggatggcaagcaggagaatgaggagcggctgtttggcagccaggagatcatgacagagaaggacatggagctgttccgggacatccaggagcaggccctgcagaaggtgggcgtgactggacctccagacccccaggtgcgctgccccagcgtcatcgagtttgggaagtatgagatccacacctggtacagcagcccctacccccaggagtacagccggctgcccaagctgtacctgtgtgagttctgcctgaagtacatgaagagcaggaccatcctgcagcagcacatgaagaagtgtggctggttccaccccccagccaatgagatctacaggaagaacaacatctctgtgtttgaggtggatggaaatgtgtccaccatctactgccagaacctgtgcctgctggccaagctgttcctggaccacaagaccctgtactatgatgtggagcccttcctgttctacgtgctgacccagaatgatgtgaagggctgccacctggtgggctacttcagcaaggagaagcactgccagcagaagtacaacgtgtcctgcatcatgatcctgccccagtaccagaggaagggctacggccgcttcctgattgacttctcctacctgctgagcaagcgggagggccaggccggcagccctgagaagcccctgagtgacctgggccgcctgagctacatggcctactggaagagcgtcatcctggagtgcctgtaccaccagaatgacaagcagatcagcatcaagaagctgagcaagctgaccggcatctgcccccaggacatcaccagcaccctgcaccacctgaggatgctggacttcagaagtgaccagtttgtgatcatccggcgggagaagctgatccaggaccacatggccaagctgcagctgaacctgcggcctgtggatgtggaccctgagtgcctgcgctggacccctgtgattgtgagcaacagcgtggtgtctgaggaggaggaggaggaggccgaggagggggagaatgaggagccccagtgccaggagcgggagctggagatctctgtgggcaagtctgtgtcccatgagaacaaggagcaggacagctacagcgtggagagcgagaagaagccagaggtgatggcccctgtgagcagcacccggctgagcaagcaggtgctgccccatgacagcctgcctgccaacagccagcccagccggcggggccgctggggcaggaagaacaggaagacccaggagagatttggagacaaggacagcaagctgctgctggaggagaccagcagcgccccccaggagcagtatggagaatgtggggagaagtctgaggccacccaggagcagtacacagagagcgaggagcagctggtggccagcgaggagcagcccagccaggacggcaagccagacctgcccaagaggcggctgtctgaaggagtggagccctggaggggccagctgaagaagagccctgaggccctgaagtgccgcctgacagagggcagcgagcggctgccccggcgctacagcgagggggacagagctgtgctgcggggcttcagcgagagcagcgaggaggaggaggagcctgagagccccaggagcagcagcccccccatcctgaccaagcccaccctgaagaggaagaagcccttcctgcacagaagaagaagagtgaggaagaggaagcaccacaacagctctgtggtgacagagaccatcagcgagaccacagaggtgctggatgagccctttgaggacagcgacagcgagcggcccatgccccggctggagcccacctttgaaattgatgaggaggaggaggaggaggatgaaaatgaactcttcccccgggagtacttccggcggctgagcagccaggatgtgctgcgctgccagagcagcagcaagaggaagagcaaggatgaggaggaggatgaggagagtgatgatgctgatgacacccccatcctgaagcctgtgtccctgctgaggaagagagatgtgaagaacagccccctggagccagacaccagcacccccctgaagaagaagaagggctggcccaagggcaagagcaggaagcccatccactggaagaagaggcctggcaggaagccaggcttcaagctgagccgggagatcatgcctgtgtccacccaggcctgtgtgattgagcccatcgtgtccatccccaaggccggcaggaagcccaagatccaggagagcgaggagaccgtggagcccaaggaggacatgcccctgcctgaggagaggaaggaggaggaggagatgcaggccgaggccgaggaggccgaggagggggaggaggaggatgctgccagcagcgaggtgcctgctgccagccctgctgacagcagcaacagccctgagacagagaccaaggagcctgaggtggaggaggaggaggagaagccccgggtgtctgaggagcagaggcagagcgaggaggagcagcaggagctggaggagcctgagcctgaggaggaggaggatgctgctgctgagacagcccagaatgatgaccatgatgctgatgatgaagatgatggccacctggagagcaccaagaagaaggagctggaggagcagcccaccagagaagatgtgaaggaggagcccggggtgcaggagagcttcctggatgccaacatgcagaagagccgggagaagatcaaggacaaggaggagacagagctggacagcgaggaggagcagcccagccatgacacctctgtggtgtctgagcagatggccggctctgaagatgaccacgaggaggacagccacaccaaggaggagctgattgagctgaaggaggaggaggagatcccccacagcgagctggacctggagaccgtgcaggccgtgcagagcctgacccaggaggagagcagcgagcatgaaggagcctaccaggactgtgaggagaccctggccgcctgccagaccctgcagagctacacccaggctgatgaggacccccagatgtccatggtggaggactgccacgccagcgagcacaacagccccatcagctctgtgcagagccaccccagccagagcgtgcgctctgtgagcagccccaacgtgcctgccctggagagcggctacacccagatcagccctgagcagggcagcctgagcgcccccagcatgcagaacatggagaccagccccatgatggatgtgcccagcgtgtctgaccacagccagcaggtggtggacagcggcttcagtgacctgggcagcattgagagcaccacagaaaattatgagaaccccagcagctatgacagcaccatgggcggcagcatctgtggcaacagcagcagccagagcagctgcagctatggaggcctgagcagcagcagcagcctgacccagagcagctgtgtggtgacccagcagatggcctccatgggcagcagctgcagcatgatgcagcagagctctgtgcagcctgctgccaactgcagcatcaagagcccccagagctgtgtggtggagaggcctcccagcaaccagcagcagcagcccccacctcctccaccccagcagccccagcccccaccaccccagccccagcctgccccccagcccccaccaccccagcagcagccccagcagcagccccagccccagccccagcagcccccacctcctcctccaccccagcagcagccccccctgagccagtgcagcatgaacaacagcttcaccccagcccccatgatcatggagatccctgagagcggcagcacaggcaacatcagcatctatgaaagaattcctggggactttggagctggcagctacagccagcccagcgccaccttcagcctggccaagctgcagcagctgaccaacaccatcatggacccccacgccatgccctacagccacagccctgctgtgaccagctatgccacctctgtgtccctgagcaacacaggcctggcccagctggcccccagccaccccctggccggcaccccccaggcccaggccaccatgaccccaccacccaacctggccagcaccaccatgaacctgaccagccccctgctgcagtgcaacatgtctgccaccaacatcggcatcccccacacccagaggctgcagggccagatgcctgtgaagggccacatcagcatccgcagcaagagcgcccccctgcccagcgctgctgcccaccagcagcagctgtatggccgcagccccagcgctgtggccatgcaggccggcccccgggccctggccgtgcagaggggcatgaacatgggcgtgaacctgatgcccaccccagcctacaacgtgaacagcatgaacatgaacaccctgaatgccatgaacagctacaggatgacccagcccatgatgaacagcagctaccacagcaacccagcctacatgaaccagacagcccagtaccccatgcagatgcagatgggcatgatgggcagccaggcctacacccagcagcccatgcagcccaacccccacggcaacatgatgtacacaggccccagccaccacagctacatgaatgctgctggggtgcccaagcagagcctgaatggcccctacatgagaagatag

SEQ ID NO: 15879 - DNA, 6015 bp, Artificial Sequence; identical to SEQ ID NO: 15878
  Description of Artificial Sequence: Synthetic coding sequence

SEQ ID NO: 15880 - DNA, 6015 bp, Artificial Sequence; identical to SEQ ID NO: 15878
  Description of Artificial Sequence: Synthetic coding sequence

SEQ ID NO: 15881 - DNA, 42 bp, Artificial Sequence
  Description of Artificial Sequence: Synthetic coding sequence
atggtgaagctggccaaccccctgtacacagagtggatctag

SEQ ID NO: 15882 - DNA, 2448 bp, Artificial Sequence
  Description of Artificial Sequence: Synthetic coding sequence
atggtgaagctggccaaccccctgtacacagagtggatcctggaggccatcaagaaggtgaagaagcagaagcagaggcccagcgaggagcgcatctgcaatgctgtgagcagcagccacggcctggacaggaagacagtgctggagcagctggagctgtctgtgaaggatggcaccatcctgaaggtgagcaacaagggcctgaacagctacaaggaccctgacaaccctggccgcatcgccctgcccaagcccaggaaccacggcaagctggacaacaagcagaatgtggactggaacaagctgatcaagagagctgtggagggcctggccgagagcggcggcagcaccctgaagagcattgagcgcttcctgaagggccagaaggatgtgtctgccctgtttggaggcagcgctgccagcggcttccaccagcagctgcggctggccatcaagagggccatcggccacggccgcctgctgaaggatggccccctgtaccgcctgaacaccaaggccaccaacgtggatggcaaggagagctgtgagagcctgagctgcctgccccctgtgtccctgctgccccatgagaaggacaagcctgtggccgagcccatccccatctgcagcttctgcctgggcaccaaggagcagaaccgggagaagaagccagaggagctgatcagctgtgccgactgtggcaacagcggccaccccagctgcctgaagttcagccctgagctgactgtgcgggtgaaggccctgcgctggcagtgcatcgagtgcaagacctgcagcagctgccgggaccagggcaagaatgctgacaacatgctgttctgtgacagctgtgaccggggcttccacatggagtgctgtgacccccccctgaccaggatgcccaagggcatgtggatctgccagatctgccggcccaggaagaagggcaggaagctgctgcagaagaaggccgcccagatcaagaggcgctacaccaaccccatcggccggcccaagaaccggctgaagaagcagaacacagtgtccaagggccccttcagcaaggtgaggacaggccctggccggggcaggaagaggaagatcaccctgagcagccagagcgccagcagcagcagcgaggagggctacctggagagaattgatggcctggacttctgccgggacagcaatgtgtccctgaagttcaacaagaagaccaagggcctgattgatggcctgaccaagttcttcacccccagcccagatggcaggaaggcccggggggaggtggtggactacagcgagcagtaccgcatcaggaagaggggcaacaggaagagcagcaccagtgactggcccacagacaaccaggacggctgggatggcaagcaggagaatgaggagcggctgtttggcagccaggagatcatgacagagaaggacatggagctgttccgggacatccaggagcaggccctgcagaaggtgggcgtgactggacctccagacccccaggtgcgctgccccagcgtcatcgagtttgggaagtatgagatccacacctggtacagcagcccctacccccaggagtacagccggctgcccaagctgtacctgtgtgagttctgcctgaagtacatgaagagcaggaccatcctgcagcagcacatgaagaagtgtggctggttccaccccccagccaatgagatctacaggaagaacaacatctctgtgtttgaggtggatggaaatgtgtccaccatctactgccagaacctgtgcctgctggccaagctgttcctggaccacaagaccctgtactatgatgtggagcccttcctgttctacgtgctgacccagaatgatgtgaagggctgccacctggtgggctacttcagcaaggagaagcactgccagcagaagtacaacgtgtcctgcatcatgatcctgccccagtaccagaggaagggctacggccgcttcctgattgacttctcctacctgctgagcaagcgggagggccaggccggcagccctgagaagcccctgagtgacctgggccgcctgagctacatggcctactggaagagcgtcatcctggagtgcctgtaccaccagaatgacaagcagatcagcatcaagaagctgagcaagctgaccggcatctgcccccaggacatcaccagcaccctgcaccacctgaggatgctggacttcagaagtgaccagtttgtgatcatccggcgggagaagctgatccaggaccacatggccaagctgcagctgaacctgcggcctgtggatgtggaccctgagtgcctgcgctggacccctgtgattgtgagcaacagcgtggtgtctgaggaggaggaggaggaggccgaggagggggagaatgaggagccccagtgccaggagcgggagctggagatctctgtgcgggcctag

SEQ ID NO: 15883 - DNA, 1836 bp, Artificial Sequence
  Description of Artificial Sequence: Synthetic coding sequence
atgcccaggaggaagagaaatgccggcagcagcagtgatggaacagaggacagcgacttcagcacagacctggagcacacagacagcagcgagagtgatggcaccagcagaagaagtgcccgggtgaccaggagcagcgcccggctgagccagagcagccaggacagcagccctgtgaggaacctgcagagctttggaacagaggagcccgcctacagcaccaggagagtgaccaggagccagcagcagcccacccctgtgacccccaagaagtaccccctgcggcagaccaggagcagcggcagcgagacagagcaggtggtggacttcagtgaccgggagaccaagaacacagctgaccatgatgagagcccccccaggacccccactggaaatgcccccagcagcgagagtgacatcgacatcagcagccccaacgtgtcccatgatgagagcatcgccaaggacatgagcctgaaggacagcggcagtgacctgagccaccggcccaagagaagacgcttccacgagagctacaacttcaacatgaagtgccccaccccaggctgcaacagcctgggccacctgaccgggaagcatgagcggcacttcagcatcagcggctgccccctgtaccacaacctgtctgcagatgagtgcaaggtgcgggcccagagccgggacaagcagatcgaggagaggatgctgagccaccggcaggatgacaacaacagacatgccaccaggcaccaggcccccacagagcggcagctgcgctacaaggagaaggtggccgagctgaggaagaagagaaattctggcctgagcaaggagcagaaggagaagtacatggagcaccggcagacctacggcaacacccgggagcccctgctggagaacctgaccagtgaatatgacctggacctcttcagaagagcccaggcccgggccagcgaggacctggagaagctgcggctgcagggccagatcacagagggcagcaacatgatcaagaccatcgccttcggccgctatgagctggacacctggtaccacagcccctacccagaggagtatgcccggctgggccgcctgtacatgtgtgagttctgcctgaagtacatgaagagccagaccatcctgcggcggcacatggccaagtgtgtgtggaagcaccccccaggagatgagatctacaggaagggcagcatctctgtgtttgaggtggatggcaagaagaacaagatctactgccagaacctgtgcctgctggccaagctgttcctggaccacaagaccctgtactatgatgtggagcccttcctgttctacgtgatgacagaagctgacaacacaggctgccacctgattggctacttcagcaaggagaagaacagcttcctgaactacaacgtgtcctgcatcctgaccatgccccagtacatgaggcagggctacggcaagatgctgattgacttctcctacctgctgagcaaggtggaggagaaggtgggcagccctgagcggcccctgagtgacctgggcctcatctcctaccgcagctactggaaggaggtgctgctgcgctacctgcacaacttccagggcaaggagatcagcatcaaggagatcagccaggagacagctgtgaaccctgtggacatcgtgtccaccctgcaggccctgcagatgctgaagtactggaagggcaagcacctggtgctgaagaggcaggacctgattgatgagtggatcgccaaggaggccaagaggagcaacagcaacaagaccatggaccccagctgcctgaagtggaccccacccaagggcacctag

SEQ ID NO: 15884 - DNA, 1746 bp, Artificial Sequence
  Description of Artificial Sequence: Synthetic coding sequence
atgcccaggaggaagagaaatgccggcagcagcagtgatggaacagaggacagcgacttcagcacagacctggagcacacagacagcagcgagagtgatggcaccagcagaagaagtgcccgggtgaccaggagcagcgcccggctgagccagagcagccaggacagcagccctgtgaggaacctgcagagctttggaacagaggagcccgcctacagcaccaggagagtgaccaggagccagcagcagcccacccctgtgacccccaagaagtaccccctgcggcagaccaggagcagcggcagcgagacagagcaggtggtggacttcagtgaccgggagaccaagaacacagctgaccatgatgagagcccccccaggacccccactggaaatgcccccagcagcgagagtgacatcgacatcagcagccccaacgtgtcccatgatgagagcatcgccaaggacatgagcctgaaggacagcggcagtgacctgagccaccggcccaagagaagacgcttccacgagagctacaacttcaacatgaagtgccccaccccaggctgcaacagcctgggccacctgaccgggaagcatgagcggcacttcagcatcagcggctgccccctgtaccacaacctgtctgcagatgagtgcaaggcccccacagagcggcagctgcgctacaaggagaaggtggccgagctgaggaagaagagaaattctggcctgagcaaggagcagaaggagaagtacatggagcaccggcagacctacggcaacacccgggagcccctgctggagaacctgaccagtgaatatgacctggacctcttcagaagagcccaggcccgggccagcgaggacctggagaagctgcggctgcagggccagatcacagagggcagcaacatgatcaagaccatcgccttcggccgctatgagctggacacctggtaccacagcccctacccagaggagtatgcccggctgggccgcctgtacatgtgtgagttctgcctgaagtacatgaagagccagaccatcctgcggcggcacatggccaagtgtgtgtggaagcaccccccaggagatgagatctacaggaagggcagcatctctgtgtttgaggtggatggcaagaagaacaagatctactgccagaacctgtgcctgctggccaagctgttcctggaccacaagaccctgtactatgatgtggagcccttcctgttctacgtgatgacagaagctgacaacacaggctgccacctgattggctacttcagcaaggagaagaacagcttcctgaactacaacgtgtcctgcatcctgaccatgccccagtacatgaggcagggctacggcaagatgctgattgacttctcctacctgctgagcaaggtggaggagaaggtgggcagccctgagcggcccctgagtgacctgggcctcatctcctaccgcagctactggaaggaggtgctgctgcgctacctgcacaacttccagggcaaggagatcagcatcaaggagatcagccaggagacagctgtgaaccctgtggacatcgtgtccaccctgcaggccctgcagatgctgaagtactggaagggcaagcacctggtgctgaagaggcaggacctgattgatgagtggatcgccaaggaggccaagaggagcaacagcaacaagaccatggaccccagctgcctgaagtggaccccacccaagggcacctag

SEQ ID NO: 15885 - DNA, 1278 bp, Artificial Sequence
  Description of Artificial Sequence: Synthetic coding sequence
atgagcctgaaggacagcggcagtgacctgagccaccggcccaagagaagacgcttccacgagagctacaacttcaacatgaagtgccccaccccaggctgcaacagcctgggccacctgaccgggaagcatgagcggcacttcagcatcagcggctgccccctgtaccacaacctgtctgcagatgagtgcaaggcccccacagagcggcagctgcgctacaaggagaaggtggccgagctgaggaagaagagaaattctggcctgagcaaggagcagaaggagaagtacatggagcaccggcagacctacggcaacacccgggagcccctgctggagaacctgaccagtgaatatgacctggacctcttcagaagagcccaggcccgggccagcgaggacctggagaagctgcggctgcagggccagatcacagagggcagcaacatgatcaagaccatcgccttcggccgctatgagctggacacctggtaccacagcccctacccagaggagtatgcccggctgggccgcctgtacatgtgtgagttctgcctgaagtacatgaagagccagaccatcctgcggcggcacatggccaagtgtgtgtggaagcaccccccaggagatgagatctacaggaagggcagcatctctgtgtttgaggtggatggcaagaagaacaagatctactgccagaacctgtgcctgctggccaagctgttcctggaccacaagaccctgtactatgatgtggagcccttcctgttctacgtgatgacagaagctgacaacacaggctgccacctgattggctacttcagcaaggagaagaacagcttcctgaactacaacgtgtcctgcatcctgaccatgccccagtacatgaggcagggctacggcaagatgctgattgacttctcctacctgctgagcaaggtggaggagaaggtgggcagccctgagcggcccctgagtgacctgggcctcatctcctaccgcagctactggaaggaggtgctgctgcgctacctgcacaacttccagggcaaggagatcagcatcaaggagatcagccaggagacagctgtgaaccctgtggacatcgtgtccaccctgcaggccctgcagatgctgaagtactggaagggcaagcacctggtgctgaagaggcaggacctgattgatgagtggatcgccaaggaggccaagaggagcaacagcaacaagaccatggaccccagctgcctgaagtggaccccacccaagggcacctag

SEQ ID NO: 15886 - DNA, 1419 bp, Artificial Sequence
  Description of Artificial Sequence: Synthetic coding sequence
atgcccaggaggaagagaaatgccggcagcagcagtgatggaacagaggacagcgacttcagcacagacctggagcacacagacagcagcgagagtgatggcaccagcagaagaagtgcccgggtgaccaggagcagcgcccggctgagccagagcagccagggccacctgaccgggaagcatgagcggcacttcagcatcagcggctgccccctgtaccacaacctgtctgcagatgagtgcaaggtgcgggcccagagccgggacaagcagatcgaggagaggatgctgagccaccggcaggatgacaacaacagacatgccaccaggcaccaggcccccacagagcggcagctgcgctacaaggagaaggtggccgagctgaggaagaagaggaacagcggcctgagcaaggagcagaaggagaagtacatggagcaccggcagacctacggcaacacccgggagcccctgctggagaacctgaccagtgaatatgacctggacctcttccggcgggcccaggcccgggccagcgaggacctggagaagctgcggctgcagggccagatcacagagggcagcaacatgatcaagaccatcgccttcggccgctatgagctggacacctggtaccacagcccctacccagaggagtatgcccggctgggccgcctgtacatgtgtgagttctgcctgaagtacatgaagagccagaccatcctgcggcggcacatggccaagtgtgtgtggaagcaccccccaggagatgagatctacaggaagggcagcatctctgtgtttgaggtggatggcaagaagaacaagatctactgccagaacctgtgcctgctggccaagctgttcctggaccacaagaccctgtactatgatgtggagcccttcctgttctacgtgatgacagaggccgacaacacaggctgccacctgattggctacttcagcaaggagaagaacagcttcctgaactacaacgtgtcctgcatcctgaccatgccccagtacatgaggcagggctacggcaagatgctgattgacttctcctacctgctgagcaaggtggaggagaaggtgggcagccctgagcggcccctgagtgacctgggcctcatctcctaccgcagctactggaaggaggtgctgctgcgctacctgcacaacttccagggcaaggagatcagcatcaaggagatcagccaggagacagctgtgaaccctgtggacatcgtgtccaccctgcaggccctgcagatgctgaagtactggaagggcaagcacctggtgctgaagaggcaggacctgattgatgagtggatcgccaaggaggccaagaggagcaacagcaacaagaccatggaccccagctgcctgaagtggaccccacccaagggcacctag

SEQ ID NO: 15887 - DNA, 1368 bp, Artificial Sequence
  Description of Artificial Sequence: Synthetic coding sequence
atgagcctgaaggacagcggcagtgacctgagccaccggcccaagagaagacgcttccacgagagctacaacttcaacatgaagtgccccaccccaggctgcaacagcctgggccacctgaccgggaagcatgagcggcacttcagcatcagcggctgccccctgtaccacaacctgtctgcagatgagtgcaaggtgcgggcccagagccgggacaagcagatcgaggagaggatgctgagccaccggcaggatgacaacaacagacatgccaccaggcaccaggcccccacagagcggcagctgcgctacaaggagaaggtggccgagctgaggaagaagagaaattctggcctgagcaaggagcagaaggagaagtacatggagcaccggcagacctacggcaacacccgggagcccctgctggagaacctgaccagtgaatatgacctggacctcttcagaagagcccaggcccgggccagcgaggacctggagaagctgcggctgcagggccagatcacagagggcagcaacatgatcaagaccatcgccttcggccgctatgagctggacacctggtaccacagcccctacccagaggagtatgcccggctgggccgcctgtacatgtgtgagttctgcctgaagtacatgaagagccagaccatcctgcggcggcacatggccaagtgtgtgtggaagcaccccccaggagatgagatctacaggaagggcagcatctctgtgtttgaggtggatggcaagaagaacaagatctactgccagaacctgtgcctgctggccaagctgttcctggaccacaagaccctgtactatgatgtggagcccttcctgttctacgtgatgacagaagctgacaacacaggctgccacctgattggctacttcagcaaggagaagaacagcttcctgaactacaacgtgtcctgcatcctgaccatgccccagtacatgaggcagggctacggcaagatgctgattgacttctcctacctgctgagcaaggtggaggagaaggtgggcagccctgagcggcccctgagtgacctgggcctcatctcctaccgcagctactggaaggaggtgctgctgcgctacctgcacaacttccagggcaaggagatcagcatcaaggagatcagccaggagacagctgtgaaccctgtggacatcgtgtccaccctgcaggccctgcagatgctgaagtactggaagggcaagcacctggtgctgaagaggcaggacctgattgatgagtggatcgccaaggaggccaagaggagcaacagcaacaagaccatggaccccagctgcctgaagtggaccccacccaagggcacctag

SEQ ID NO: 15888 - DNA, 1506 bp, Artificial Sequence
  Description of Artificial Sequence: Synthetic coding sequence
atgcccaggaggaagagaaatgccggcagcagcagtgatggaacagaggacagcgacttcagcacagacctggagcacacagacagcagcgagagtgatggcaccagcagaagaagtgcccgggtgaccaggagcagcgcccggctgagccagagcagccaggacagcagccctgtgaggaacctgcagagctttggaacagaggagcccgcctacagcaccaggagagtgaccaggagccagcagcagcccacccctgtgacccccaagaagtaccccctgcggcagaccaggagcagcggcagcgagacagagcaggtggtggacttcagtgaccggggccacctgaccgggaagcatgagcggcacttcagcatcagcggctgccccctgtaccacaacctgtctgcagatgagtgcaaggcccccacagagcggcagctgcgctacaaggagaaggtggccgagctgaggaagaagagaaattctggcctgagcaaggagcagaaggagaagtacatggagcaccggcagacctacggcaacacccgggagcccctgctggagaacctgaccagtgaatatgacctggacctcttcagaagagcccaggcccgggccagcgaggacctggagaagctgcggctgcagggccagatcacagagggcagcaacatgatcaagaccatcgccttcggccgctatgagctggacacctggtaccacagcccctacccagaggagtatgcccggctgggccgcctgtacatgtgtgagttctgcctgaagtacatgaagagccagaccatcctgcggcggcacatggccaagtgtgtgtggaagcaccccccaggagatgagatctacaggaagggcagcatctctgtgtttgaggtggatggcaagaagaacaagatctactgccagaacctgtgcctgctggccaagctgttcctggaccacaagaccctgtactatgatgtggagcccttcctgttctacgtgatgacagaagctgacaacacaggctgccacctgattggctacttcagcaaggagaagaacagcttcctgaactacaacgtgtcctgcatcctgaccatgccccagtacatgaggcagggctacggcaagatgctgattgacttctcctacctgctgagcaaggtggaggagaaggtgggcagccctgagcggcccctgagtgacctgggcctcatctcctaccgcagctactggaaggaggtgctgctgcgctacctgcacaacttccagggcaaggagatcagcatcaaggagatcagccaggagacagctgtgaaccctgtggacatcgtgtccaccctgcaggccctgcagatgctgaagtactggaagggcaagcacctggtgctgaagaggcaggacctgattgatgagtggatcgccaaggaggccaagaggagcaacagcaacaagaccatggaccccagctgcctgaagtggaccccacccaagggcacctag

SEQ ID NO: 15889 - DNA, 1329 bp, Artificial Sequence
  Description of Artificial Sequence: Synthetic coding sequence
atgcccaggaggaagagaaatgccggcagcagcagtgatggaacagaggacagcgacttcagcacagacctggagcacacagacagcagcgagagtgatggcaccagcagaagaagtgcccgggtgaccaggagcagcgcccggctgagccagagcagccagggccacctgaccgggaagcatgagcggcacttcagcatcagcggctgccccctgtaccacaacctgtctgcagatgagtgcaaggcccccacagagcggcagctgcgctacaaggagaaggtggccgagctgaggaagaagaggaacagcggcctgagcaaggagcagaaggagaagtacatggagcaccggcagacctacggcaacacccgggagcccctgctggagaacctgaccagtgaatatgacctggacctcttccggcgggcccaggcccgggccagcgaggacctggagaagctgcggctgcagggccagatcacagagggcagcaacatgatcaagaccatcgccttcggccgctatgagctggacacctggtaccacagcccctacccagaggagtatgcccggctgggccgcctgtacatgtgtgagttctgcctgaagtacatgaagagccagaccatcctgcggcggcacatggccaagtgtgtgtggaagcaccccccaggagatgagatctacaggaagggcagcatctctgtgtttgaggtggatggcaagaagaacaagatctactgccagaacctgtgcctgctggccaagctgttcctggaccacaagaccctgtactatgatgtggagcccttcctgttctacgtgatgacagaggccgacaacacaggctgccacctgattggctacttcagcaaggagaagaacagcttcctgaactacaacgtgtcctgcatcctgaccatgccccagtacatgaggcagggctacggcaagatgctgattgacttctcctacctgctgagcaaggtggaggagaaggtgggcagccctgagcggcccctgagtgacctgggcctcatctcctaccgcagctactggaaggaggtgctgctgcgctacctgcacaacttccagggcaaggagatcagcatcaaggagatcagccaggagacagctgtgaaccctgtggacatcgtgtccaccctgcaggccctgcagatgctgaagtactggaagggcaagcacctggtgctgaagaggcaggacctgattgatgagtggatcgccaaggaggccaagaggagcaacagcaacaagaccatggaccccagctgcctgaagtggaccccacccaagggcacctag

SEQ ID NO: 15890 - DNA, 1239 bp, Artificial Sequence
  Description of Artificial Sequence: Synthetic coding sequence
atgatcctggcctctgtgctgcggagcggccctgggggcggcctgcccctgcggcccctgctgggccctgccctggccctgcgggcccggagcaccagcgccacagacacccaccacgtggagatggcccgggagaggagcaagacagtgaccagcttctacaaccagagcgccattgatgctgctgctgagaagcccagcgtgcggctgacccccaccatgatgctgtatgccggccgcagccaggacggcagccacctgctgaagagcgcccgctacctgcagcaggagctgcctgtgcgcatcgcccaccgcatcaagggcttccgctgcctgcccttcatcatcggctgcaaccccaccatcctgcacgtgcatgagctgtacatccgggccttccagaagctgacagacttcccccccatcaaggaccaggctgatgaggcccagtactgccagctggtgcggcagctgctggatgaccacaaggatgtggtgaccctgctggccgagggcctgcgggagagcaggaagcacattgaagatgagaagctggtgcgctacttcctggacaagaccctgaccagccggctgggcatccgcatgctggccacccaccacctggccctgcacgaggacaagccagactttgtgggcatcatctgcacccggctgagccccaagaagatcatcgagaagtgggtggactttgcccggcggctgtgtgagcacaagtatggaaatgccccccgggtgcgcatcaatggacatgtggccgcccgcttccccttcatccccatgcccctggactacatcctgcctgagctgctgaagaatgccatgagggccaccatggagagccacctggacaccccctacaacgtgcctgatgtggtgatcaccatcgccaacaatgatgtggacctgatcatccgcatcagtgacagaggaggcggcatcgcccacaaggacctggacagagtgatggactaccacttcaccacagctgaggccagcacccaggacccccgcatcagccccctgtttggccacctggacatgcacagcggggcccagagcggccccatgcacggcttcggcttcggcctgcccaccagccgggcctatgcagagtacctgggcggcagcctgcagctgcagagcctgcagggcatcggcacagatgtgtacctgcggctgcggcacattgatggccgggaggagagcttccgcatctag

SEQ ID NO: 15891 - DNA, 1404 bp, Artificial Sequence
  Description of Artificial Sequence: Synthetic coding sequence
atggccgcccagggcgctgctgctgctgtggccgccggcaccagcggcgtggccggggagggggagcccggccctggagaaaatgctgctgctgagggcacagcccccagccctggccgggtgtccccacccaccccagcccggggggagcctgaggtgacagtggagattggagagacctacctgtgccggcggccagacagcacctggcacagcgctgaggtgatccagagccgggtgaatgaccaggagggccgggaggagttctacgtgcactacgtgggcttcaacagaaggctggatgagtgggtggacaagaaccggctggccctgaccaagacagtgaaggatgctgtgcagaagaacagcgagaagtacctgtctgagctggccgagcagcctgagaggaagatcaccaggaaccagaagaggaagcatgatgagatcaaccacgtgcagaagacctatgcagagatggaccccaccacagctgccctggagaaggagcacgaggccatcaccaaggtgaagtatgtggacaagatccacatcggcaactatgaaattgatgcctggtacttcagccccttcccagaagattatggcaagcagcccaagctgtggctgtgtgagtactgcctgaagtacatgaagtatgagaagagctaccgcttccacctgggccagtgccagtggaggcagcccccaggcaaggagatctacaggaagagcaacatctctgtgtatgaggtggatggcaaggaccacaagatctactgccagaacctgtgcctgctggccaagctgttcctggaccacaagaccctgtactttgatgtggagccctttgtgttctacatcctgacagaggtggaccggcagggcgcccacatcgtgggctacttcagcaaggagaaggagagcccagatggcaacaacgtggcctgcatcctgaccctgcccccctaccagaggcggggctacggcaagttcctgattgccttctcctatgagctgagcaagctggagagcacagtgggcagccctgagaagcccctgagtgacctgggcaagctgagctaccgcagctactggagctgggtgctgctggagatcctgcgggacttccggggcaccctgagcatcaaggacctgagccagatgaccagcatcacccagaatgacatcatcagcaccctgcagagcctgaacatggtgaagtactggaagggccagcacgtgatctgtgtgacccccaagctggtggaggagcacctgaagagcgcccagtacaagaagccacccatcactggaggctggggcgctgctgtgtgccggggccgctggggctctgtgtccatctggacaggccgcagccagggcctgctgattgctgtgacctag

SEQ ID NO: 15892 - DNA, 1221 bp, Artificial Sequence
  Description of Artificial Sequence: Synthetic coding sequence
atggctgatggaaatgaagacctgcgggcagatgacctgcccggccctgcctttgagagctatgaatccatggagctggcctgcccagctgagaggagcggccacgtggccgtgtctgatggccgccacatgtttgtgtggggcggctacaagagcaaccaggtgcggggcctgtatgacttctacctgccccgggaggagctgtggatctacaacatggagaccggccgctggaagaagatcaacacagaaggagatgtgccccccagcatgagcggcagctgtgctgtgtgtgtggacagagtgctgtacctgtttggaggccaccacagccggggcaacaccaacaagttctacatgctggacagccgcagcacagacagagtgctgcagtgggagagaattgactgccagggcatcccccccagcagcaaggacaagctgggcgtgtgggtgtacaagaacaagctgatcttcttcggcggctacggctacctgcctgaggacaaggtgctgggcacctttgaatttgatgagaccagcttctggaacagcagccacccccggggctggaatgaccacgtgcacatcctggacacagagaccttcacctggagccagcccatcaccaccgggaaggcccccagccccagggctgcccacgcctgtgccaccgtgggcaacagaggatttgtgtttggaggccgctacagagatgccaggatgaatgacctgcactacctgaacctggacacctgggagtggaatgagctgatcccccagggcatctgccctgtgggccgctcctggcacagcctgacccctgtgtccagtgaccacctgttcctgtttggaggcttcaccacagacaagcagcccctgagtgatgcctggacctactgcatcagcaagaatgagtggatccagttcaaccacccctacacagagaagccccggctgtggcacacagcctgtgccagtgatgaaggagaggtgattgtgtttggaggctgtgccaacaacctgctggtgcaccaccgggccgcccacagcaatgagatcctgatcttctctgtgcagcccaagagcctggtgcggctgagcctggaggccgtcatctgcttcaaggagatgctggccaacagctggaactgcctgcccaagcacctgctgcacagcgtgaaccagcgcttcggcagcaacaacaccagcggcagctag

SEQ ID NO: 15893 - DNA, 411 bp, Artificial Sequence
  Description of Artificial Sequence: Synthetic coding sequence
atggtgaacagctgctgcggctctgtgtgcagcgaccagggctgcggcctggagaactgctgccggcccagctgctgccagaccacctgctgcaggaccacctgctgccggcccagctgctgcgtgagcagctgctgccggccccagtgctgccagagcgtgtgctgccagcccacctgctgcagccccagctgctgccagaccacctgctgcaggaccacctgctgccggcccagctgctgcgtgagcagctgcttccggccccagtgctgccagagcgtgtactgccagcccacctgctgccggcccagctgtggccagaccacctgctgcaggaccacctgctaccggcccagctgctgcgtgtccacctgctgccggcccacctgcagcagcggcagctgctgctag

SEQ ID NO: 15894 - DNA, 762 bp, Artificial Sequence
  Description of Artificial Sequence: Synthetic coding sequence
tgctgccaccccagctgctgccagaccacctgctgcaagacagcctgctgctgccgctccttcctgaccacagccccccagaccacctgctgctgccccagctgtgtggtgagcagctgctgccggcccagctgcagccagaccacctgctgccagaccacctgctgccggcccagctgctgccaccctgtgtgctgccagaccacctgccggcccagctgtggggtgagcagctgctgccggcccctgtgctgccagaccacctgccaccccagctgtggcatgagcagctgctgccggcccctgtgctgccagaccacctgccggcccagctgtggggtgagcagctgctgccggcccctgtgctgccagaccacctgctgccgggccacctgctgccggcccaactgctgccggcccagctgctgccagaccacctgctgcaggaccacctgctgccggcccagctgctgcgtgagcagctgctgccggccccagtgctgccagagcgtgtgctgccagcccacctgctgcagccccagctgctgccagaccacctgctgcaggaccacctgctgccggcccagctgctgcgtgagcagctgcttccggccccagtgctgccagagcgtgtactgccagcccacctgctgccggcccagctgtggccagaccacctgctgcaggaccacctgctaccggcccagctgctgcgtgtccacctgctgccggcccacctgcagcagcggcagctgctgctag

SEQ ID NO: 15895 - DNA, 1332 bp, Artificial Sequence
  Description of Artificial Sequence: Synthetic coding sequence
atgcagaggagagatgatcctgctgccaggatgagccgcagcagcggccgcagcggctccatggaccccagcggggcccaccccagcgtgcggcagacccccagccggcagccccccctgccccacaggagccggggcggcggcggcggcagcagaggaggagcccgggccagccctgccacccagcccccacccctgctgccccccagcgccaccggcccagatgccaccgtgggcggccctgcccccacccccctgctgccccccagcgccacagcctctgtgaagatggagcctgagaacaagtacctgcctgagctgatggccgagaaggacagcctggaccccagcttcacccacgccatgcagctgctgacagctgagattgagaagatccagaagggggacagcaagaaggatgatgaggagaactacctggacctcttcagccacaagaacatgaagctgaaggagcgggtgctgatccctgtgaagcagtaccccaagttcaactttgtgggcaagatcctgggcccccagggcaacaccatcaagaggctgcaggaggagactggagccaagatctctgtgctgggcaagggctccatgagggacaaggccaaggaggaggagctgaggaagggcggggaccccaagtatgcccacctgaacatggacctgcacgtgttcatcgaggtgtttggccccccctgtgaggcctatgccctgatggcccacgccatggaggaggtgaagaagttcctggtgcctgacatgatggatgacatctgccaggagcagttcctggagctgagctacctgaatggagtgcctgagcccagccggggccggggcgtgcctgtgcggggcagaggagctgcccctcctcctcctcctgtgccccggggccggggcgtgggcccccccaggggggccctggtgcggggcacccctgtgcggggggccatcaccaggggggccaccgtgacccggggcgtgcccccaccacccaccgtgcggggggccccagccccccgggccaggacagctggcatccagaggatccccctgcccccacctccagcccctgagacctatgaggagtatggctatgatgacacctacgccgagcagagctatgagggctatgagggctactacagccagagccagggcgacagcgagtactatgactatggccatggagaggtgcaggacagctatgaggcctacggccaggatgactggaatggcacccggcccagcctgaaggcccccccagcccggcctgtgaagggggcctaccgggagcacccctacggccgctactag

SEQ ID NO: 15896 - DNA, 1260 bp, Artificial Sequence
  Description of Artificial Sequence: Synthetic coding sequence
atgcagaggagagatgatcctgctgccaggatgagccgcagcagcggccgcagcggctccatggaccccagcggggcccaccccagcgtgcggcagacccccagccggcagcccccaccacccctgctgccccccagcgccaccggcccagatgccaccgtgggcggccctgcccccacccccctgctgccccccagcgccacagcctctgtgaagatggagcctgagaacaagtacctgcctgagctgatggccgagaaggacagcctggaccccagcttcacccacgccatgcagctgctgacagctgagattgagaagatccagaagggggacagcaagaaggatgatgaggagaactacctggacctcttcagccacaagaacatgaagctgaaggagcgggtgctgatccctgtgaagcagtaccccaagttcaactttgtgggcaagatcctgggcccccagggcaacaccatcaagaggctgcaggaggagactggagccaagatctctgtgctgggcaagggctccatgagggacaaggccaaggaggaggagctgaggaagggcggggaccccaagtatgcccacctgaacatggacctgcacgtgttcatcgaggtgtttggccccccctgtgaggcctatgccctgatggcccacgccatggaggaggtgaagaagttcctggtgcctgacatgatggatgacatctgccaggagcagttcctggagctgagctacctgaatggagtgcctgagcccagccggggccggggcgtgcctgtgcggggcagaggagctgcccctcctcctcctcctgtgccccggggccggggcgtgggcccccccaggggggccctggtgcggggcacccctgtgcggggggccatcaccaggggggccaccgtgacccggggcgtgcccccaccacccaccgtgcggggggccccagccccccgggccaggacagctggcatccagaggatccccctgcccccacctccagcccctgagacctatgaggagtatggctatgatgacacctacgccgagcagagctatgagggctatgagggctactacagccagagccagggcgacagcgagtactatgactatggccatggagaggtgcaggacagctatgaggcctacggccaggatgactggaatggcacccggcccagcctgaaggcccccccagcccggcctgtgaagggggcctaccgggagcacccctacggccgctactag

SEQ ID NO: 15897 - DNA, 1215 bp, Artificial Sequence
  Description of Artificial Sequence: Synthetic coding sequence
atgcagaggagagatgatcctgctgccaggatgagccgcagcagcggccgcagcggctccatggaccccagcggggcccaccccagcgtgcggcagacccccagccggcagccccccctgccccacaggagccggggcggcggcggcggcagcagaggaggagcccgggccagccctgccacccagcccccacccctgctgccccccagcgccaccggcccagatgccaccgtgggcggccctgcccccacccccctgctgccccccagcgccacagcctctgtgaagatggagcctgagaacaagtacctgcctgagctgatggccgagaaggacagcctggaccccagcttcacccacgccatgcagctgctgacagctgagattgagaagatccagaagggggacagcaagaaggatgatgaggagaactacctggacctcttcagccacaagaacatgaagctgaaggagcgggtgctgatccctgtgaagcagtaccccaaggaggaggagctgaggaaaggaggagaccccaagtatgcccacctgaacatggacctgcacgtgttcatcgaggtgtttggaccaccctgtgaggcctatgccctgatggcccacgccatggaggaggtgaagaagttcctggtgcctgacatgatggatgacatctgccaggagcagttcctggagctgagctacctgaatggagtgcctgagcccagccggggccggggcgtgcctgtgcggggccgcggggccgcccctcctcctcctcctgtgccccggggccggggcgtgggcccccccaggggggccctggtgcggggcacccctgtgcggggggccatcaccaggggggccaccgtgacccggggcgtgcccccaccacccaccgtgcggggggccccagccccccgggccaggacagctggcatccagaggatccccctgcccccacctccagcccctgagacctatgaggagtatggctatgatgacacctatgcagagcagagctatgagggctatgagggctactacagccagagccagggcgacagcgagtactatgactatggccacggggaggtgcaggacagctatgaggcctacggccaggatgactggaatggcacccggcccagcctgaaggcccccccagcccggcctgtgaagggggcctaccgggagcacccctacggccgctactag

SEQ ID NO: 15898 - DNA, 1050 bp, Artificial Sequence
  Description of Artificial Sequence: Synthetic coding sequence
atggaggaggagaagtacctgcctgagctgatggccgagaaggacagcctggaccccagctttgtgcacgccagccggctgctggccgaggagattgagaagttccagggcagtgatggcaagaaggaggatgaggagaagaagtacctggatgtgatcagcaacaagaacatcaagctgtctgagcgggtgctgatccctgtgaagcagtaccccaagttcaactttgtgggcaagctgctgggcccccggggcaacagcctgaagaggctgcaggaggagactggagccaagatgagcatcctgggcaagggctccatgagggacaaggccaaggaggaggagctgaggaagtctggagaggccaagtatgcccacctgagtgatgagctgcacgtgctgattgaggtgtttgcccctcctggagaggcctacagcaggatgagccacgccctggaggagatcaagaagttcctggtgcctgactacaatgatgagatccggcaggagcagctgcgggagctgagctacctgaatggaagtgaggacagcggccggggccggggcatccggggccggggcatcagaattgcccccacagcccccagccggggccggggcggggccatccccccacctcctcctcctggccggggcgtgctgaccccccggggcagcacagtgaccaggggggccctgcctgtgccccctgtggcccggggcgtgcccaccccccgggcccggggggcccccaccgtgcccggctaccgggcccctcctcctccagcccacgaggcctatgaggagtatggctatgatgatggctacggcggggagtatgatgaccagacctatgagacctatgacaacagctatgccacccagacccagagcgtgcctgagtactatgactatggccatggagtgtctgaagatgcctatgacagctatgcccctgaggagtgggccaccaccaggagcagcctgaaggccccaccccagaggtctgcccggggcggctaccgggagcacccctacggccgctactag

SEQ ID NO: 15899 - DNA, 951 bp, Artificial Sequence
  Description of Artificial Sequence: Synthetic coding sequence
atggaggaggagaagtacctgcctgagctgatggccgagaaggacagcctggaccccagctttgtgcacgccagccggctgctggccgaggagattgagaagttccagggcagtgatggcaagaaggaggatgaggagaagaagtacctggatgtgatcagcaacaagaacatcaagctgtctgagcgggtgctgatccctgtgaagcagtaccccaagttcaactttgtgggcaagctgctgggcccccggggcaacagcctgaagaggctgcaggaggagactggagccaagatgagcatcctgggcaagggctccatgagggacaaggccaaggaggaggagctgaggaagtctggagaggccaagtatgcccacctgagtgatgagctgcacgtgctgattgaggtgtttgcccctcctggagaggcctacagcaggatgagccacgccctggaggagatcaagaagttcctggtgcctgactacaatgatgagatccggcaggagcagctgcgggagctgagctacctgaatggaagtgaggacagcggccggggccggggcatccggggccggggcatcagaattgcccccacagcccccagccggggccggggcggggccatccccccacctcctcctcctggccggggcgtgctgaccccccggggcagcacagtgaccaggggggccctgcctgtgccccctgtggcccggggcgtgcccaccccccgggcccggggggcccccaccgtgcccggctaccgggcccctcctcctccagcccacgaggcctatgaggagtaccccagcctgcccctgagcctcttctttgacacagtggccaagagccaccagcactgtgacaatgaggtgccccagacaggcagcacccggctgaaccctggccgctccttcttcctggcctggcgctgggagtgggactag

SEQ ID NO: 15900 - DNA, 1905 bp, Artificial Sequence
  Description of Artificial Sequence: Synthetic coding sequence
atggccagcgccagaattggagatgaatatgcagaggacagcagtgatgaggaggacatccggaacacagtgggcaatgtgcccctggagtggtatgatgacttcccccacgtgggctatgacctggatggaagacgcatctacaagcccctgcggaccagagatgagctggaccagttcctggacaagatggatgatcctgactactggaggacagtgcaggaccccatgacaggccgggacctgcggctgacagatgagcaggtggccctggtgcggcggctgcagagcggccagtttggagatgtgggcttcaacccctatgagcctgctgtggacttcttctctggagatgtgatgatccaccctgtgaccaacagacctgctgacaagaggagcttcatccccagcctggtggagaaggagaaggtgtccaggatggtgcacgccatcaagatgggctggatccagccccggcggccccgggaccccacccccagcttctatgacctgtgggcccaggaggaccccaatgctgtgctgggccgccacaagatgcacgtgcctgcccccaagctggccctgcccggccatgctgagagctacaaccccccacctgagtacctgctgtctgaggaggagcggctggcctgggagcagcaggagcctggagagaggaagctgtccttcctgcccaggaagttccccagcctgcgggctgtgcctgcctacggccgcttcatccaggagagatttgagcgctgcctggacctgtacctgtgcccccggcagaggaagatgagggtgaatgtggaccctgaggacctgatccccaagctgccccggccccgggacctgcagcccttccccacctgccaggccctggtgtaccggggccacagcgacctggtgcgctgcctgtctgtgtccccaggcggccagtggctggtgtctggcagtgatgatggcagcctgcggctgtgggaggtggccacagcccgctgtgtgaggacagtgcctgtgggcggcgtggtgaagtctgtggcctggaaccccagccctgctgtgtgcctggtggccgctgctgtggaggacagcgtgctgctgctgaacccagccctgggggaccggctggtggccggcagcacagaccagctgctgagcgcctttgtgcccccagaggagccccccctgcagcctgcccgctggctggaggccagcgaggaggagcggcaggtgggcctgcggctgcgcatctgccacggcaagcctgtgacccaggtgacctggcacggccgcggggactacctggccgtggtgctggccacccagggccacacccaggtgctgatccaccagctgagcagaagaagaagccagagccccttccgccgcagccacggccaggtgcagagggtggccttccacccagcccggcccttcctgctggtggccagccagaggtctgtgcggctgtaccacctgctgcggcaggagctgaccaagaagctgatgcccaactgcaagtgggtgagcagcctggccgtgcaccctgctggggacaacgtcatctgtggcagctatgacagcaagctggtgtggtttgacctggacctgagcaccaagccctacaggatgctgcggcaccacaagaaggccctgcgggctgtggccttccacccccgctaccccctgtttgccagcggcagtgatgatggcagcgtcatcgtgtgccacggcatggtgtacaatgacctgctgcagaaccccctgctggtgcctgtgaaggtgctgaagggccacgtgctgacccgggacctgggcgtgctggatgtgatcttccaccccacccagccctgggtgttcagcagcggggctgatggcaccgtgcggctcttcacctag

SEQ ID NO: 15901 - DNA, 1443 bp, Artificial Sequence
  Description of Artificial Sequence: Synthetic coding sequence
atgctgaactttggagccagcctgcagcagacagctgaggagaggatggagatgatcagcgagcggcccaaggagagcatgtacagctggaacaagacagctgagaagagtgactttgaagctgtggaggccctgatgtccatgagctgctcctggaagagtgacttcaagaagtatgtggagaacagacctgtgacccctgtgtctgacctgtctgaggaggagaacctgctgcccggcaccccagacttccacaccatcccagccttctgcctgaccccaccctacagccccagcgactttgagcccagccaggtgagcaacctgatggccccagcccccagcacagtgcacttcaagagcctgagtgacacagccaagccccacatcgccgcccccttcaaggaggaggagaagagccctgtgtctgcccccaagctgcccaaggcccaggccaccagcgtcatccgccacacagcagatgcccagctgtgcaaccaccagacctgccccatgaaggccgccagcatcctgaactaccagaacaacagcttcagaagaaggacccacctgaatgtggaggccgccaggaagaacatcccctgtgccgctgtgagccccaacagaagcaaatgtgagaggaacacagtggctgatgtggatgagaaggccagcgctgccctgtatgacttctctgtgcccagcagcgagaccgtcatctgccgcagccagcctgcccctgtgagcccccagcagaagtctgtgctggtgtccccacctgctgtgtctgctgggggcgtgccccccatgcctgtgatctgccagatggtgcccctgcctgccaacaaccctgtggtgaccaccgtggtgcccagcaccccacccagccagcccccagctgtgtgcccccctgtggtgttcatgggcacccaggtgcccaagggagctgtgatgtttgtggtgccccagcctgtggtgcagagcagcaagccccctgtggtgagccccaacggcacccggctgagccccatcgccccagcccctggcttcagccccagcgctgccaaggtgaccccccagattgacagcagccgcatccgcagccacatctgcagccaccctggctgtgggaagacctacttcaagagcagccacctgaaggcccacaccaggacccacactggagagaagcccttcagctgctcctggaagggctgtgagaggagatttgcccggagtgatgagctgagccgccacaggaggacccacactggagagaagaagtttgcctgccccatgtgtgaccggcgcttcatgagaagtgaccacctgaccaagcacgcccggcggcacctgagcgccaagaagctgcccaactggcagatggaggtgtccaagctgaatgacatcgccctgccccccaccccagcccccacccagtag

SEQ ID NO: 15902 - DNA, 1410 bp, Artificial Sequence
  Description of Artificial Sequence: Synthetic coding sequence
atggaggagaggatggagatgatcagcgagcggcccaaggagagcatgtacagctggaacaagacagctgagaagagtgactttgaggccgtggaggccctgatgtccatgagctgctcctggaagagtgacttcaagaagtatgtggagaacagacctgtgacccctgtgtctgacctgtctgaggaggagaacctgctgcccggcaccccagacttccacaccatcccagccttctgcctgaccccaccctacagccccagcgactttgagcccagccaggtgagcaacctgatggccccagcccccagcacagtgcacttcaagagcctgagtgacacagccaagccccacatcgccgcccccttcaaggaggaggagaagagccctgtgtctgcccccaagctgcccaaggcccaggccaccagcgtcatccgccacacagcagatgcccagctgtgcaaccaccagacctgccccatgaaggccgccagcatcctgaactaccagaacaacagcttcagaagaaggacccacctgaatgtggaggccgccaggaagaacatcccctgtgccgctgtgagccccaacagaagcaaatgtgaaagaaacacagtggctgatgtggatgagaaggccagcgctgccctgtatgacttctctgtgcccagcagcgagaccgtcatctgccgcagccagcctgcccctgtgagcccccagcagaagtctgtgctggtgagccccccagctgtgtctgctggaggagtgccccccatgcctgtgatctgccagatggtgcccctgcctgccaacaaccctgtggtgaccaccgtggtgcccagcaccccacccagccagcccccagctgtgtgcccccctgtggtgttcatgggcacccaggtgcccaagggagctgtgatgtttgtggtgccccagcctgtggtgcagagcagcaagccccctgtggtgagccccaacggcacccggctgagccccatcgccccagcccctggcttcagccccagcgctgccaaggtgaccccccagattgacagcagccgcatccgcagccacatctgcagccaccctggctgcggcaagacctacttcaagagcagccacctgaaggcccacaccaggacccacactggagagaagcccttcagctgctcctggaagggctgtgaaagaagatttgcccggagtgatgagctgagccgccacaggaggacccacactggagagaagaagtttgcctgccccatgtgtgaccggcgcttcatgagaagtgaccacctgaccaagcacgcccggcggcacctgagcgccaagaagctgcccaactggcagatggaggtgtccaagctgaatgacatcgccctgccccccaccccagcccccacccagtag

SEQ ID NO: 15903 - DNA, 972 bp, Artificial Sequence
  Description of Artificial Sequence: Synthetic coding sequence
atgtctgctgctgtggcctgcctggactactttgctgctgagtgcctggtgtccatgtctgctggagctgtggtgcacagaagacctccagaccctgagggcgccggcggcgctgctggcagcgaggtgggcgccgcccaccctgagagcgccctgcccggccctggccccagcggccctgcctctgtgccccagctgccccaggtgcctgcccccagccctggggccggcggggccgccccccacctgctggccgcctctgtgtgggccgacctgcggggcagcagcggggagggctcctgggagaacagcggggaggccccccgggccagcagcggcttcagtgaccccatcccctgcagcgtgcagaccccctgcagcgagctggccccagccagcggggctgctgctgtgtgtgcccctgagagcagcagtgatgccccagctgtgcccagcgccccagctgcccctggggccccagctgccagcggcggcttctctggaggagccctgggcgccggccctgccccagctgctgaccaggcccccaggagaagatctgtgaccccagctgccaagaggcaccagtgccccttccctggctgcaccaaggcctactacaagagcagccacctgaagagccaccagaggacccacactggagagcggcccttcagctgtgactggctggactgtgacaagaagttcaccaggagtgatgagctggcccggcactaccgcacccacactggagagaagcgcttcagctgccccctgtgccccaagcagttcagcagaagtgaccacctgaccaagcacgcccggcggcaccccacctaccacccagacatgattgagtaccggggcagaagaaggaccccaagaattgacccccccctgaccagcgaggtggagagcagcgccagcggcagcggccctggccctgcccccagcttcaccacctgcctgtag

SEQ ID NO: 15904 - DNA, 759 bp, Artificial Sequence
  Description of Artificial Sequence: Synthetic coding sequence
atgtctgctgctgtggcctgtgtggactactttgctgctgatgtgctgatggccatcagcagtggagctgtggtgcaccggggccggcccggccctgagggcgccggccctgctgctggcctggatgtgcgggccgcccggcgggaggccgccagccctggcaccccaggccccccacctcctcctcctgctgccagcggccctggccctggagctgctgctgccccccacctgctggccgccagcatcctggccgacctgcggggcggccctggagctgcccctggaggagccagccctgccagcagcagcagcgctgccagcagccccagcagcggccgggcccctggggccgcccccagcgctgctgccaagagccaccgctgccccttcccagactgtgccaaggcctactacaagagcagccacctgaagagccacctgcggacccacactggagagcggccctttgcctgtgactggcagggctgtgacaagaagtttgcccggagtgatgagctggcccggcaccacaggacccacactggagagaagcgcttcagctgccccctgtgcagcaagcgcttcaccaggagtgaccacctggccaagcacgcccggcggcaccctggcttccacccagacctgctgcggcggcctggggcccggagcaccagccccagcgacagcctgccctgcagcctggccggcagccctgcccccagccctgcccccagccctgccccagctggcctgtag

SEQ ID NO: 15905 - DNA, 759 bp, Artificial Sequence; identical to SEQ ID NO: 15904
  Description of Artificial Sequence: Synthetic coding sequence

SEQ ID NO: 15906 - DNA, 1170 bp, Artificial Sequence
  Description of Artificial Sequence: Synthetic coding sequence
atgtatggccggccccaggccgagatggagcaggaggccggggagctgagccgctggcaggccgcccaccaggccgcccaggacaatgaaaacagcgcccccatcctgaacatgagcagcagcagcggcagcagtggagtgcacacctcctggaaccagggcctgcccagcatccagcacttcccccacagcgctgagatgctgggcagccccctggtgtctgtggaggcccctggccagaatgtgaatgaaggaggcccccagttctccatgcccctgcctgagcggggcatgagctactgcccccaggccaccctgacccccagcaggatgatctactgccagaggatgagccccccccagcaggagatgaccatcttcagcggcccccagctgatgcctgtgggggagcccaacatcccccgggtggcccggccctttggaggcaacctgaggatgccacccaacggcctgcctgtgtctgccagcacaggcatccccatcatgagccacacaggcaacccccctgtgccctacccaggcctgagcacagtgcccagtgatgagaccctgctgggccccaccgtgcccagcacagaggcccaggccgtgctgcccagcatggcccagatgctgcccccccaggatgcccatgacctgggcatgcctcctgctgagagccagagcctgctggtgctgggcagccaggacagcctggtgtcccagcctgacagccaggagggccccttcctgcctgagcagcccggccctgccccccagacagtggagaagaacagccggccccaggagggcaccggccggcggggcagcagcgaggcccggccctactgctgcaactatgagaactgtgggaaggcctacaccaagaggagccacctggtgagccaccagaggaagcacactggagagcggccctacagctgcaactgggagagctgctcctggagcttcttcagaagtgatgagctgcggcggcacatgagggtgcacacccgctaccggccctacaagtgtgaccagtgcagccgggagttcatgagaagtgaccacctgaagcagcaccagaagacccacaggcctggccccagcgacccccaggccaacaacaacaacggggagcaggacagccccccagctgctggcccctag

SEQ ID NO: 15907 - DNA, 1038 bp, Artificial Sequence
  Description of Artificial Sequence: Synthetic coding sequence
atgctgatgtttgatcctgtgcctgtgaagcaggaggccatggaccctgtgtctgtgtcctaccccagcaactacatggagagcatgaagcccaacaagtatggagtcatctacagcacccccctgcctgagaagttcttccagaccccagagggcctgagccacggcatccagatggagcctgtggacctgactgtgaacaagaggagcagcccccccagcgctggcaacagccccagcagcctgaagttccccagcagccacagaagagccagccctggcctgtccatgcccagcagcagcccccccatcaagaagtacagcccccccagccctggggtgcagccctttggagtgcccctgtccatgcctcctgtgatggctgctgccctgagccgccacggcatccgcagccctggcatcctgcctgtgatccagcctgtggtggtgcagcctgtgcccttcatgtacaccagccacctgcagcagcccctgatggtgtccctgtctgaggagatggagaacagcagcagctccatgcaggtgcctgtgattgagagctatgagaagcccatcagccagaagaagatcaagattgagcccggcatcgagccccagaggacagactactacccagaggagatgagcccccccctgatgaacagcgtgtccccaccccaggccctgctgcaggagaaccaccccagcgtcatcgtgcagcccgggaagaggcccctgcctgtggagagcccagacacccagaggaagaggcgcatccaccgctgtgactatgatggctgcaacaaggtgtacaccaagagcagccacctgaaggcccacaggaggacccacactggagagaagccctacaagtgcacctgggagggctgcacctggaagtttgcccggagtgatgagctgaccaggcacttcaggaagcacacaggcatcaagcccttccagtgcccagactgtgacaggagcttcagcagaagtgaccacctggccctgcacaggaagaggcacatgctggtgtag

SEQ ID NO: 15908 - DNA, 1374 bp, Artificial Sequence
  Description of Artificial Sequence: Synthetic coding sequence
atggccaccagggtgctgtccatgtctgcccggctgggccctgtgccccagcccccagccccccaggatgagcctgtgtttgcccagctgaagcctgtgctgggcgccgccaacccagccagagatgctgccctcttccctggagaggagctgaagcacgcccaccaccggccccaggcccagcctgccccagcccaggccccccagcctgcccagcccccagccaccggcccccggctgcccccagaggacctggtgcagacccgctgtgagatggagaagtacctgaccccccagctgccccctgtgcccatcatccctgagcacaagaagtacagaagagacagcgcctctgtggtggaccagttcttcacagacacagagggcctgccctacagcatcaacatgaatgtgttcctgcctgacatcacccacctgaggacaggcctgtacaagagccagaggccctgtgtgacccacatcaagacagagcctgtggccatcttcagccaccagagcgagaccacagcccctcctccagcccccacccaggccctgcctgagttcaccagcatcttcagcagccaccagacagctgcccctgaggtgaacaacatcttcatcaagcaggagctgcccaccccagacctgcacctgtctgtgcccacccagcagggccacctgtaccagctgctgaacaccccagacctggacatgcccagcagcaccaaccagacagctgccatggacaccctgaatgtgtccatgtctgctgccatggccggcctgaacacccacaccagcgctgtgccccagacagctgtgaagcagttccagggcatgccaccctgcacctacaccatgcccagccagttcctgccccagcaggccacctacttcccccccagcccccccagcagcgagcccggcagcccagaccggcaggccgagatgctgcagaacctgaccccacctccttcctatgctgccaccatcgccagcaagctggccatccacaaccccaacctgcccaccaccctgcctgtgaacagccagaacatccagcctgtgcgctacaacagaagaagcaacccagacctggagaagaggcgcatccactactgtgactacccaggctgcaccaaggtgtacaccaagagcagccacctgaaggcccacctgcggacccacactggagagaagccctacaagtgcacctgggagggctgtgactggaggtttgcccggagtgatgagctgaccaggcactacaggaagcacactggagccaagcccttccagtgtggggtgtgcaacagaagcttcagcagaagtgaccacctggccctgcacatgaagaggcaccagaactag

SEQ ID NO: 15909 - DNA, 1101 bp, Artificial Sequence
  Description of Artificial Sequence: Synthetic coding sequence
atggagaagtacctgaccccccagctgccccctgtgcccatcatccctgagcacaagaagtaccgccgggacagcgcctctgtggtggaccagttcttcacagacacagagggcctgccctacagcatcaacatgaatgtgttcctgcctgacatcacccacctgaggacaggcctgtacaagagccagaggccctgtgtgacccacatcaagacagagcctgtggccatcttcagccaccagagcgagaccacagcccctcctccagcccccacccaggccctgcctgagttcaccagcatcttcagcagccaccagacagctgcccctgaggtgaacaacatcttcatcaagcaggagctgcccaccccagacctgcacctgtctgtgcccacccagcagggccacctgtaccagctgctgaacaccccagacctggacatgcccagcagcaccaaccagacagctgccatggacaccctgaatgtgtccatgtctgctgccatggccggcctgaacacccacaccagcgctgtgccccagacagctgtgaagcagttccagggcatgccaccctgcacctacaccatgcccagccagttcctgccccagcaggccacctacttcccccccagcccccccagcagcgagcccggcagcccagaccggcaggccgagatgctgcagaacctgaccccaccacccagctatgctgccaccatcgccagcaagctggccatccacaaccccaacctgcccaccaccctgcctgtgaacagccagaacatccagcctgtgcgctacaacagaagaagcaacccagacctggagaagaggcgcatccactactgtgactacccaggctgcaccaaggtgtacaccaagagcagccacctgaaggcccacctgcggacccacactggagagaagccctacaagtgcacctgggagggctgtgactggaggtttgcccggagtgatgagctgaccaggcactacaggaagcacactggagccaagcccttccagtgtggggtgtgcaacagaagcttcagcagaagtgaccacctggccctgcacatgaagaggcaccagaactag

SEQ ID NO: 15910 - DNA, 1314 bp, Artificial Sequence
  Description of Artificial Sequence: Synthetic coding sequence
atggccaccagggtgctgtccatgtctgcccggctgggccctgtgccccagcccccagccccccaggatgagcctgtgtttgcccagctgaagcctgtgctgggcgccgccaacccagccagagatgctgccctcttccctggagaggagctgaagcacgcccaccaccggccccggctgcccccagaggacctggtgcagacccgctgtgagatggagaagtacctgaccccccagctgccccctgtgcccatcatccctgagcacaagaagtacagaagagacagcgcctctgtggtggaccagttcttcacagacacagagggcctgccctacagcatcaacatgaatgtgttcctgcctgacatcacccacctgaggacaggcctgtacaagagccagaggccctgtgtgacccacatcaagacagagcctgtggccatcttcagccaccagagcgagaccacagcccctcctccagcccccacccaggccctgcctgagttcaccagcatcttcagcagccaccagacagctgcccctgaggtgaacaacatcttcatcaagcaggagctgcccaccccagacctgcacctgtctgtgcccacccagcagggccacctgtaccagctgctgaacaccccagacctggacatgcccagcagcaccaaccagacagctgccatggacaccctgaatgtgtccatgtctgctgccatggccggcctgaacacccacaccagcgctgtgccccagacagctgtgaagcagttccagggcatgccaccctgcacctacaccatgcccagccagttcctgccccagcaggccacctacttcccccccagcccccccagcagcgagcccggcagcccagaccggcaggccgagatgctgcagaacctgaccccacctccttcctatgctgccaccatcgccagcaagctggccatccacaaccccaacctgcccaccaccctgcctgtgaacagccagaacatccagcctgtgcgctacaacagaagaagcaacccagacctggagaagaggcgcatccactactgtgactacccaggctgcaccaaggtgtacaccaagagcagccacctgaaggcccacctgcggacccacactggagagaagccctacaagtgcacctgggagggctgtgactggaggtttgcccggagtgatgagctgaccaggcactacaggaagcacactggagccaagcccttccagtgtggggtgtgcaacagaagcttcagcagaagtgaccacctggccctgcacatgaagaggcaccagaactag

SEQ ID NO: 15911 - DNA, 735 bp, Artificial Sequence
  Description of Artificial Sequence: Synthetic coding sequence
atgtctgctgctgcctacatggactttgtggccgcccagtgcctggtgtccatcagcaacagagctgctgtgcctgagcacggcgtggccccagatgctgagcggctgcggctgcctgagcgggaggtgaccaaggagcacggggaccccggggacacctggaaggactactgcaccctggtgaccatcgccaagagcctgctggacctgaacaagtaccggcccatccagacccccagcgtgtgcagcgacagcctggagagcccagatgaggacatgggcagtgacagtgatgtgaccacagaaagtggcagcagccccagccacagccctgaggagcggcaggaccccggcagcgcccccagccccctgagcctgctgcaccctggggtggccgccaagggcaagcacgccagcgagaagaggcacaagtgcccctacagcggctgtgggaaggtgtatggcaagagcagccacctgaaggcccactacagagtgcacactggagagcggcccttcccctgcacctggccagactgcctgaagaagttcagcagaagtgatgagctgaccaggcactaccgcacccacactggagagaagcagttccgctgccccctgtgtgagaagcgcttcatgagaagtgaccacctgaccaagcacgcccggcggcacacagagttccaccccagcatgatcaagaggagcaagaaggccctggccaatgccctgtag

SEQ ID NO: 15912 - DNA, 2343 bp, Artificial Sequence
  Description of Artificial Sequence: Synthetic coding sequence
atgacagagagcgccagcagcaccagcggccaggagtttgatgtgttttctgtgatggactggaaggatggagtgggcaccctgcccggcagtgacctgaagttccgggtgaatgaatttggagccctggaggtgatcacagatgaaaatgagatggagaatgtgaagaaggccacagccaccaccacctggatggtgcccacagcccaggaggcccccaccagcccccccagcagcaggcctgtgttccccccagcctactggaccagccccccaggctgccccaccgtcttcagcgagaagacaggcatgcccttccggctgaaggaccctgtgaaggtggagggcctgcagttctgtgagaactgctgccagtatggaaatgtggatgaatgtctgagcggcggcaactactgcagccagaactgtgcccggcacatcaaggacaaggaccagaaggaggagagagatgtggaggaggacaatgaggaggaggaccccaagtgcagcaggaagaagaagcccaagctgagcctgaaggctgacaccaaggaggatggagaggagagagatgatgagatggagaacaagcaggatgtgcgcatcctgcggggcagccagagggcccggaggaagagaagaggagacagcgctgtgctgaagcagggcctgccccccaagggcaagaaggcctggtgctgggccagctacctggaggaggagaaggctgtggccgtgcctgccaagctgttcaaggagcaccagagcttcccctacaacaagaatggcttcaaggtgggcatgaagctggagggcgtggaccctgagcaccagagcgtgtactgtgtgctgactgtggccgaggtgtgtggctaccgcatcaagctgcactttgatggctacagcgactgctatgacttctgggtgaatgctgatgccctggacatccaccctgtgggctggtgtgagaagacaggccacaagctgcacccccccaagggctacaaggaggaggagttcaactggcagacctacctgaagacctgcaaggcccaggccgcccccaagagcctgtttgagaaccagaacatcaccgtcatccccagcggcttccgggtgggcatgaagctggaggccgtggacaagaagaaccccagcttcatctgtgtggccaccgtgacagacatggtggacaaccgcttcctggtgcactttgacaactgggatgagagctatgactactggtgtgaggccagcagcccccacatccaccctgtgggctggtgcaaggagcacaggaggaccctcatcaccccacctggctaccccaacgtgaagcacttctcctgggacaagtacctggaggagaccaacagcctgcctgccccagcccgggccttcaaggtgaagccccctcatggcttccagaagaagatgaagctggaggtggtggacaagaggaaccccatgttcatccgggtggccaccgtggccgacacagatgaccaccgggtgaaggtgcactttgatggctggaacaactgctatgactactggattgatgctgacagcccagacatccaccctgtgggctggtgcagcaagacaggccaccccctgcagccccccctgagccccctggagctgatggaggccagcgagcacggcggctgcagcaccccaggctgcaagggcatcggccacttcaagagggcccggcacctgggcccccacagcgctgccaactgcccctacagcgagatcaacctgaacaaggaccgcatcttcccagaccggctgtctggagagatgcccccagccagccccagcttccccaggaacaagaggacagatgccaatgaaagcagcagcagccctgagatccgggaccagcacgcagatgatgtgaaggaggactttgaggagaggacagagagcgagatgaggaccagccatgaggcccggggggcccgggaggagcccaccgtgcagcaggcccagaggagatctgctgtgttcctgtccttcaagagccccatcccctgcctgcccctgcgctgggagcagcagagcaagctgctgcccaccgtggccggcatcccagccagcaaggtgtccaagtggagcacagatgaggtgtctgagttcatccagagcctgcccggctgtgaggagcacggcaaggtgttcaaggatgagcagattgatggagaggccttcctgctgatgacccagacagacatcgtgaagatcatgagcatcaagctgggccctgccctgaagatcttcaacagcatcctgatgttcaaggctgctgagaagaacagccacaatgagctgtag

SEQ ID NO: 15913 - DNA, 2343 bp, Artificial Sequence; identical to SEQ ID NO: 15912
  Description of Artificial Sequence: Synthetic coding sequence

SEQ ID NO: 15914 - DNA, 2268 bp, Artificial Sequence
  Description of Artificial Sequence: Synthetic coding sequence
atgacagagagcgccagcagcaccagcggccaggagtttgatgtgttttctgtgatggactggaaggatggagtgggcaccctgcccggcagtgacctgaagttccgggtgaatgaatttggagccctggaggtgatcacagatgaaaatgagatggagaatgtgaagaaggccacagccaccaccacctggatggtgcccacagcccaggaggtgttcagcgagaagacaggcatgcccttccggctgaaggaccctgtgaaggtggagggcctgcagttctgtgagaactgctgccagtatggaaatgtggatgagtgcctgagcggcggcaactactgcagccagaactgtgcccggcacatcaaggacaaggaccagaaggaggagagagatgtggaggaggacaatgaggaggaggaccccaagtgcagcaggaagaagaagcccaagctgagcctgaaggctgacaccaaggaggatggagaggagagagatgatgagatggagaacaagcaggatgtgcgcatcctgcggggcagccagagggcccggaggaagagaagaggagacagcgctgtgctgaagcagggcctgccccccaagggcaagaaggcctggtgctgggccagctacctggaggaggagaaggctgtggccgtgcctgccaagctgttcaaggagcaccagagcttcccctacaacaagaatggcttcaaggtgggcatgaagctggagggcgtggaccctgagcaccagagcgtgtactgtgtgctgactgtggccgaggtgtgtggctaccgcatcaagctgcactttgatggctacagcgactgctatgacttctgggtgaatgctgatgccctggacatccaccctgtgggctggtgtgagaagacaggccacaagctgcacccccccaagggctacaaggaggaggagttcaactggcagacctacctgaagacctgcaaggcccaggccgcccccaagagcctgtttgagaaccagaacatcaccgtcatccccagcggcttccgggtgggcatgaagctggaggccgtggacaagaagaaccccagcttcatctgtgtggccaccgtgacagacatggtggacaaccgcttcctggtgcactttgacaactgggatgagagctatgactactggtgtgaggccagcagcccccacatccaccctgtgggctggtgcaaggagcacaggaggaccctcatcaccccacctggctacccaaatgtgaagcacttctcctgggacaagtacctggaggagaccaacagcctgcctgccccagcccgggccttcaaggtgaagccaccccacggcttccagaagaagatgaagctggaggtggtggacaagaggaaccccatgttcatccgggtggccaccgtggccgacacagatgaccaccgggtgaaggtgcactttgatggctggaacaactgctatgactactggattgatgctgacagcccagacatccaccctgtgggctggtgcagcaagacaggccaccccctgcagccccccctgagccccctggagctgatggaggccagcgagcacggcggctgcagcaccccaggctgcaagggcatcggccacttcaagagggcccggcacctgggcccccacagcgctgccaactgcccctacagcgagatcaacctgaacaaggaccgcatcttcccagaccggctgagcggggagatgcccccagccagccccagcttccccaggaacaagaggacagatgccaatgaaagcagcagcagccctgagatccgggaccagcacgcagatgatgtgaaggaggactttgaggagaggacagaaagtgagatgaggaccagccatgaggcccggggggcccgggaggagcccaccgtgcagcaggcccagaggagatctgctgtgttcctgtccttcaagagccccatcccctgcctgcccctgcgctgggagcagcagagcaagctgctgcccaccgtggccggcatcccagccagcaaggtgtccaagtggagcacagatgaggtgtctgagttcatccagagcctgcccggctgtgaggagcacggcaaggtgttcaaggatgagcagattgatggagaggccttcctgctgatgacccagacagacatcgtgaagatcatgagcatcaagctgggccctgccctgaagatcttcaacagcatcctgatgttcaaggctgctgagaagaacagccacaatgagctgtag

SEQ ID NO: 15915 - DNA, 2268 bp, Artificial Sequence; identical to SEQ ID NO: 15914
  Description of Artificial Sequence: Synthetic coding sequence

SEQ ID NO: 15916 - DNA, 573 bp, Artificial Sequence
  Description of Artificial Sequence: Synthetic coding sequence
atgacagagagcgccagcagcaccagcggccaggagtttgatgtgttttctgtgatggactggaaggatggagtgggcaccctgcccggcagtgacctgaagttccgggtgaatgaatttggagccctggaggtgatcacagatgaaaatgagatggagaatgtgaagaaggccacagccaccaccacctggatggtgcccacagcccaggaggcccccaccagcccccccagcagcaggcctgtgttccccccagcctactggaccagccccccaggctgccccaccgtcttcagcgagaagacaggcatgcccttccggctgaaggaccctgtgaaggtggagggcctgcagttctgtgagaactgctgccagtatggaaatgtggatgaatgtctgagcggcggcaactactgcagccagaactgtgcccggcacatcaaggacaaggaccagaaggaggagagagatgtggaggaggacaatgaggaggaggaccccaagtgcagcaggaagaagaagcccaagctgagcctgaaggctgacaccaaggaggatggagaggagaggtag

SEQ ID NO: 15917 - DNA, 2343 bp, Artificial Sequence; identical to SEQ ID NO: 15912
  Description of Artificial Sequence: Synthetic coding sequence

SEQ ID NO: 15918 - DNA, 2268 bp, Artificial Sequence; identical to SEQ ID NO: 15914
  Description of Artificial Sequence: Synthetic coding sequence

SEQ ID NO: 15919 - DNA, 1872 bp, Artificial Sequence
  Description of Artificial Sequence: Synthetic coding sequence
atgaagcagcccaacaggaagaggaagctgaacatggacagcaaggagcggctggaccaggacggccgcctggagcaggccgaggaggagaagaagcccaaggacagcaccacccccctgagccacgtgcccagcgctgctgcccagggcgcctggagctgggagtggtacctgaaggagcagaaggctgtggccgcccctgtggagctgttcagcaaggaccagagcttccctgagcatgaaaatggcttccagatcggcatgaggctggagggcatcgaccccaggcaccccagcgtcttctgtgtgctgtctgtggccgaggtgtgtggctaccgcctgcggctgcactttgatggctacctgagctgctatgacttctggaccaatgccggcagcccagacatccaccctgtgggctggtgtgagaagaccaagcatgagctgcacatccccaagggctacaggaaggacaagtttgtgtggatggactacctgaaggcctgcaagctgcagaatgcccccaagaagctgttcaggaacagaagccccaacggccccatgagcaaggagttccaggtgggcatgaagctggaggccgtggacaggaagaaccccagcctggtgtgtgtggccaccatcgctgacatcgtggaggaccggctgctggtgcactttgacaactgggatgacagctatgactactggtgtgatgtgaacagcccctacgtgcagcctgtgggctggtgccaggagaatggaagaaccctcatcgccccccagggctaccccaaccctgagaacttctcctggacagagtacctggaggccacccagaccaatgctgtgcctgccaaggtgttcaagatgaggctgccccacggcttcctgcccaacatgaagctggaggtggtggacaagaggaaccccaggctcatccgggtggccaccatcgtggatgtggatgaccagagggtgaaggtgcactttgatggctgggaccacaagtatgactactgggtggaggccgacagcccagacatccaccccatcggctggtgtgatgtgacaggccaccccctggaggtgccccagaggaccaatgacctgaagatcctgcccggccaggccgtgtgccccaccccaggctgccggggcatcggccacatccggggcccccgctacagcggccaccacagcgccttcggctgcccctacagcgacatgaacctgaagaaggaggccaccctgcatgaccggctgcgggagcagacccaggccaacctggagagtgacagcagccacagcaagagcaagagcctgtgcagcctgaacttcaacgggaagcatgagaaggtgaacagccagccccggctggtgcagcaggccaagtgcctgaagatcaagggcaaggaggacatcgacctggacaacctcttccgggtgctggtgctgcacccccggggcctggagtacagcgtggagcaggcccagcaggtgctgcaccagagcgtgtccatgagcacagtgtctgcccaccccttccgggacctgcccctgggccgggagcagcactgcaagctgctgcccggggtggccgacatccgggccagccaggtggcccgctggacagtggatgaggtggccgagtttgtgcagagcctgctgggctgtgaggagcacgccaagtgcttcaagaaggagcagattgatggcaaggccttcctgctgctgacccagacagacatcgtgaaggtgatgaagatcaagctgggccctgccctgaagatctacaacagcatcctgatgttccgccacagccaggagctgcctgaagaagatattgccagcggccaggaggtgcggggctag

SEQ ID NO: 15920 - DNA, 1872 bp, Artificial Sequence; identical to SEQ ID NO: 15919
  Description of Artificial Sequence: Synthetic coding sequence

SEQ ID NO: 15921 - DNA, 1284 bp, Artificial Sequence
  Description of Artificial Sequence: Synthetic coding sequence
atgagcaaggagttccaggtgggcatgaagctggaggccgtggacaggaagaaccccagcctggtgtgtgtggccaccatcgctgacatcgtggaggaccggctgctggtgcactttgacaactgggatgacagctatgactactggtgtgatgtgaacagcccctacgtgcagcctgtgggctggtgccaggagaatggccgcaccctgattgccccccagggctaccccaaccctgagaacttctcctggacagagtacctggaggccacccagaccaatgctgtgcctgccaaggtgttcaagatgaggctgccccacggcttcctgcccaacatgaagctggaggtggtggacaagaggaaccccaggctcatccgggtggccaccatcgtggatgtggatgaccagagggtgaaggtgcactttgatggctgggaccacaagtatgactactgggtggaggccgacagcccagacatccaccccatcggctggtgtgatgtgacaggccaccccctggaggtgccccagaggaccaatgacctgaagatcctgcccggccaggccgtgtgccccaccccaggctgccggggcatcggccacatccggggcccccgctacagcggccaccacagcgccttcggctgcccctacagcgacatgaacctgaagaaggaggccaccctgcatgaccggctgcgggagcagacccaggccaacctggagagtgacagcagccacagcaagagcaagagcctgtgcagcctgaacttcaacgggaagcatgagaaggtgaacagccagccccggctggtgcagcaggccaagtgcctgaagatcaagggcaaggaggacatcgacctggacaacctcttccgggagtacagcgtggagcaggcccagcaggtgctgcaccagagcgtgtccatgagcacagtgtctgcccaccccttccgggacctgcccctgggccgggagcagcactgcaagctgctgcccggggtggccgacatccgggccagccaggtggcccgctggacagtggatgaggtggccgagtttgtgcagagcctgctgggctgtgaggagcacgccaagtgcttcaagaaggagcagattgatggcaaggccttcctgctgctgacccagacagacatcgtgaaggtgatgaagatcaagctgggccctgccctgaagatctacaacagcatcctgatgttccgccacagccaggagctgcctgaagaagatattgccagcggccaggaggtgcggggctag

SEQ ID NO: 15922 - DNA, 876 bp, Artificial Sequence
  Description of Artificial Sequence: Synthetic coding sequence
atgtcctgggagagcggggccggccctggcctgggcagccagggcatggacctggtgtggagcgcctggtacggcaaatgtgtgaagggcaagggcagcctgcccctgagcgcccatggaattgtggtggcctggctgagcagagctgagtgggaccaggtgacagtgtacctgttctgtgatgaccacaagctgcagagatatgccctgaaccgcatcaccgtgtggaggagccgctctggaaatgagctgcccctggccgtggccagcacagctgacctgatccgctgcaagctgctggatgtgactggaggcctgggcacagatgagctgcggctgctgtatggcatggccctggtgcgctttgtgaacctgatcagcgagaggaagaccaagtttgccaaggtgcccctgaagtgcctggcccaggaggtgaacatcccagactggatcgtggacctgcggcatgagctgacccacaagaagatgccccacatcaatgactgccggcggggctgctactttgtgctggactggctgcagaagacctactggtgccggcagctggagaacagcctgcgggagacctgggagctggaggagttccgggagggcatcgaggaggaggaccaggaggaggacaagaacatcgtggtggatgacatcacagagcagaagccagagccccaggatgatggcaagagcacagaaagtgatgtgaaggcagatggagacagcaaaggaagtgaggaggtggacagccactgcaagaaggccctgagccacaaggagctgtatgaaagagcccgggagctgctggtgtcctatgaggaggagcagttcaccggcggctgtgccggctgcttcagcggctag

SEQ ID NO: 15923 - DNA, 2028 bp, Artificial Sequence
  Description of Artificial Sequence: Synthetic coding sequence
atgtcctgggagagcggggccggccctggcctgggcagccagggcatggacctggtgtggagcgcctggtacggcaaatgtgtgaagggcaagggcagcctgcccctgagcgcccatggaattgtggtggcctggctgagcagagctgagtgggaccaggtgacagtgtacctgttctgtgatgaccacaagctgcagagatatgccctgaaccgcatcaccgtgtggaggagcagatttgtgaacctgatcagcgagaggaagaccaagtttgccaaggtgcccctgaagtgcctggcccaggaggtgaacatcccagactggatcgtggacctgcggcatgagctgacccacaagaagatgccccacatcaatgactgccggcggggctgctactttgtgctggactggctgcagaagacctactggtgccggcagctggagaacagcctgcgggagacctgggagctggaggagttccgggagggcatcgaggaggaggaccaggaggaggacaagaacatcgtggtggatgacatcacagagcagaagccagagccccaggatgatggcaagagcacagaaagtgatgtgaaggcagatggagacagcaaaggaagtgaggaggtggacagccactgcaagaaggccctgagccacaaggagctgtatgaaagagcccgggagctgctggtgtcctatgaggaggagcagttcaccgtgctggagaagttccgctacctgcccaaggccatcaaggcctggaacaaccccagcccccgggtggagtgtgtgctggccgagctgaagggcgtgacctgtgaaaatcgggaggccgtgctggatgccttcctggatgatggcttcctggtgcccacctttgagcagctggccgccctgcagatcgagtatgaggagaatgtggacctgaatgatgtgctggtgcccaagcccttcagccagttctggcagcccctgctgcggggcctgcacagccagaacttcacccaggccctgctggagaggatgctgtctgagctgcctgccctgggcatcagcggcatccggcccacctacatcctgcgctggacagtggagctgattgtggccaacaccaagacaggaagaaatgcccggcgcttctctgctggccagtgggaggcccggcggggctggaggctcttcaactgcagcgccagcctggactggcccaggatggtggagagctgcctgggcagcccctgctgggccagcccccagctgctgcgcatcatcttcaaggccatgggccagggcctgcctgatgaggagcaggagaagctgctgcgcatctgcagcatctacacccagagcggggagaacagcctggtgcaggagggcagcgaggccagccccatcggcaagagcccctacaccctggacagcctgtactggagcgtgaagccagccagcagcagctttggaagtgaggccaaggcccagcagcaggaggagcagggctctgtgaatgatgtgaaggaggaggagaaggaggagaaggaggtgctgcctgaccaggtggaggaggaggaggagaatgatgaccaggaggaggaggaggaggatgaagatgatgaagatgatgaggaggaggacaggatggaggtgggccccttcagcacaggccaggagagccccacagcagaaaatgcccggctgctggcccagaagagaggagccctgcagggcagcgcctggcaggtgtccagtgaagatgtgcgctgggacaccttccccctgggccgcatgcctggccagacagaagatcctgctgagctgatgctggagaactatgacaccatgtacctgctggaccagcctgtgctggagcagaggctggagcccagcacctgcaagacagacaccctgggcctgagctgtggggtgggcagcggcaactgcagcaacagcagcagcagcaactttgagggcctgctgtggagccagggccagctgcacggcctgaagacaggcctgcagctgttctag

SEQ ID NO: 15924 - DNA, 2154 bp, Artificial Sequence
  Description of Artificial Sequence: Synthetic coding sequence
atgtcctgggagagcggggccggccctggcctgggcagccagggcatggacctggtgtggagcgcctggtacggcaaatgtgtgaagggcaagggcagcctgcccctgagcgcccatggaattgtggtggcctggctgagcagagctgagtgggaccaggtgacagtgtacctgttctgtgatgaccacaagctgcagagatatgccctgaaccgcatcaccgtgtggaggagccgctctggaaatgagctgcccctggccgtggccagcacagctgacctgatccgctgcaagctgctggatgtgactggaggcctgggcacagatgagctgcggctgctgtatggcatggccctggtgcgctttgtgaacctgatcagcgagaggaagaccaagtttgccaaggtgcccctgaagtgcctggcccaggaggtgaacatcccagactggatcgtggacctgcggcatgagctgacccacaagaagatgccccacatcaatgactgccggcggggctgctactttgtgctggactggctgcagaagacctactggtgccggcagctggagaacagcctgcgggagacctgggagctggaggagttccgggagggcatcgaggaggaggaccaggaggaggacaagaacatcgtggtggatgacatcacagagcagaagccagagccccaggatgatggcaagagcacagaaagtgatgtgaaggcagatggagacagcaaaggaagtgaggaggtggacagccactgcaagaaggccctgagccacaaggagctgtatgaaagagcccgggagctgctggtgtcctatgaggaggagcagttcaccgtgctggagaagttccgctacctgcccaaggccatcaaggcctggaacaaccccagcccccgggtggagtgtgtgctggccgagctgaagggcgtgacctgtgaaaatcgggaggccgtgctggatgccttcctggatgatggcttcctggtgcccacctttgagcagctggccgccctgcagatcgagtatgaggagaatgtggacctgaatgatgtgctggtgcccaagcccttcagccagttctggcagcccctgctgcggggcctgcacagccagaacttcacccaggccctgctggagaggatgctgtctgagctgcctgccctgggcatcagcggcatccggcccacctacatcctgcgctggacagtggagctgattgtggccaacaccaagacaggaagaaatgcccggcgcttctctgctggccagtgggaggcccggcggggctggaggctcttcaactgcagcgccagcctggactggcccaggatggtggagagctgcctgggcagcccctgctgggccagcccccagctgctgcgcatcatcttcaaggccatgggccagggcctgcctgatgaggagcaggagaagctgctgcgcatctgcagcatctacacccagagcggggagaacagcctggtgcaggagggcagcgaggccagccccatcggcaagagcccctacaccctggacagcctgtactggagcgtgaagccagccagcagcagctttggaagtgaggccaaggcccagcagcaggaggagcagggctctgtgaatgatgtgaaggaggaggagaaggaggagaaggaggtgctgcctgaccaggtggaggaggaggaggagaatgatgaccaggaggaggaggaggaggatgaagatgatgaagatgatgaggaggaggacaggatggaggtgggccccttcagcacaggccaggagagccccacagcagaaaatgcccggctgctggcccagaagagaggagccctgcagggcagcgcctggcaggtgtccagtgaagatgtgcgctgggacaccttccccctgggccgcatgcctggccagacagaagatcctgctgagctgatgctggagaactatgacaccatgtacctgctggaccagcctgtgctggagcagaggctggagcccagcacctgcaagacagacaccctgggcctgagctgtggggtgggcagcggcaactgcagcaacagcagcagcagcaactttgagggcctgctgtggagccagggccagctgcacggcctgaagacaggcctgcagctgttctag

SEQ ID NO: 15925 - DNA, 2205 bp, Artificial Sequence
  Description of Artificial Sequence: Synthetic coding sequence
atgtcctgggagagcggggccggccctggcctgggcagccagggcatggacctggtgtggagcgcctggtacggcaaatgtgtgaagggcaagggcagcctgcccctgagcgcccatggaattgtggtggcctggctgagcagagctgagtgggaccaggtgacagtgtacctgttctgtgatgaccacaagctgcagagatatgccctgaaccgcatcaccgtgtggaggagccgctctggaaatgagctgcccctggccgtggccagcacagctgacctgatccgctgcaagctgctggatgtgactggaggcctgggcacagatgagctgcggctgctgtatggcatggccctggtgcgctttgtgaacctgatcagcgagaggaagaccaagtttgccaaggtgcccctgaagtgcctggcccaggaggtgaacatcccagactggatcgtggacctgcggcatgagctgacccacaagaagatgccccacatcaatgactgccggcggggctgctactttgtgctggactggctgcagaagacctactggtgccggcagctggagaacagcctgcgggagacctgggagctggaggagttccgggagggcatcgaggaggaggaccaggaggaggacaagaacatcgtggtggatgacatcacagagcagaagccagagccccaggatgatggcaagagcacagaaagtgatgtgaaggcagatggagacagcaaaggaagtgaggaggtggacagccactgcaagaaggccctgagccacaaggagctgtatgaaagagcccgggagctgctggtgtcctatgaggaggagcagttcaccgtgctggagaagttccgctacctgcccaaggccatcaaggcctggaacaaccccagcccccgggtggagtgtgtgctggccgagctgaagggcgtgacctgtgaaaatcgggaggccgtgctggatgccttcctggatgatggcttcctggtgcccacctttgagcagctggccgccctgcagatcgagtatgaagatggccagacagaggtgcagagaggagagggcacagaccccaagagccacaagaatgtggacctgaatgatgtgctggtgcccaagcccttcagccagttctggcagcccctgctgcggggcctgcacagccagaacttcacccaggccctgctggagaggatgctgtctgagctgcctgccctgggcatcagcggcatccggcccacctacatcctgcgctggacagtggagctgattgtggccaacaccaagacaggaagaaatgcccggcgcttctctgctggccagtgggaggcccggcggggctggaggctcttcaactgcagcgccagcctggactggcccaggatggtggagagctgcctgggcagcccctgctgggccagcccccagctgctgcgcatcatcttcaaggccatgggccagggcctgcctgatgaggagcaggagaagctgctgcgcatctgcagcatctacacccagagcggggagaacagcctggtgcaggagggcagcgaggccagccccatcggcaagagcccctacaccctggacagcctgtactggagcgtgaagccagccagcagcagctttggcagcgaggccaaggcccagcagcaggaggagcagggctctgtgaatgatgtgaaggaggaggagaaggaggagaaggaggtgctgcctgaccaggtggaggaggaggaggagaatgatgaccaggaggaggaggaggaggatgaagatgatgaagatgatgaggaggaggacaggatggaggtgggccccttcagcacaggccaggagagccccacagcagaaaatgcccggctgctggcccagaagagaggagccctgcagggcagcgcctggcaggtgtccagtgaagatgtgcgctgggacaccttccccctgggccgcatgcctggccagacagaggaccctgctgagctgatgctggagaactatgacaccatgtacctgctggaccagcctgtgctggagcagaggctggagcccagcacctgcaagacagacaccctgggcctgagctgtggggtgggcagcggcaactgcagcaacagcagcagcagcaactttgagggcctgctgtggagccagggccagctgcacggcctgaagacaggcctgcagctgttctag

SEQ ID NO: 15926 - DNA, 507 bp, Artificial Sequence
  Description of Artificial Sequence: Synthetic coding sequence
atgagcctgacccaccggctgcacctgtgcaagtactggggctgtgctgtgtccaatgtgtgccgcttctgggagggccggcccctgcccctgatgattgtggtgccctacaccctgcctgtgtccctgcctgtgggcagctgtgtgatcatcaccggcacccccatcctgacctttgtgaaggacccccagctggaggtgaacttctacacaggcatggatgaagattctgacatcgccttccagttccggctgcacttcggccacccagccatcatgaacagctgtgtgtttggcatctggaggtatgaggagaagtgctactacctgccctttgaagatggcaagccctttgagctgtgcatctacgtgcgccacaaggagtacaaggtgatggtgaatggccagaggatctacaactttgcccaccgcttccccccagcctctgtgaagatgctgcaggtgttccgggacatcagcctgaccagggtgctgatcagtgactag

SEQ ID NO: 15927 - DNA, 420 bp, Artificial Sequence
  Description of Artificial Sequence: Synthetic coding sequence
atgagcagcctgcctgtgccctacaccctgcctgtgtccctgcctgtgggcagctgtgtgatcatcaccggcacccccatcctgacctttgtgaaggacccccagctggaggtgaacttctacacaggcatggatgaggacagcgacatcgccttccagttccggctgcacttcggccacccagccatcatgaacagctgtgtgtttggcatctggaggtatgaggagaagtgctactacctgccctttgaagatggcaagccctttgagctgtgcatctacgtgcgccacaaggagtacaaggtgatggtgaatggccagaggatctacaactttgcccaccgcttccccccagcctctgtgaagatgctgcaggtgttccgggacatcagcctgaccagggtgctgatcagtgactag

SEQ ID NO: 15928 - DNA, 1314 bp, Artificial Sequence
  Description of Artificial Sequence: Synthetic coding sequence
atggcccgggtggcctggggcctgctgtggctgctgctgggcagcgctggggcccagtatgagaagtacagcttccggggcttccccccagaggacctgatgcccctggccgccgcctacggccacgccctggagcagtatgaaggagagagctggagggagagcgcccgctacctggaggccgccctgcggctgcaccggctgctgcgggacagcgaggccttctgccacgccaactgcagcggccctgccccagctgccaagccagaccctgatggcggccgggcagatgagtgggcctgtgagctgcggctgtttggccgggtgctggagagagctgcctgcctgcggcgctgcaagaggaccctgcctgccttccaggtgccctacccaccccggcagctgctgcgggacttccagagccggctgccctaccagtacctgcactacgccctcttcaaggccaaccggctggagaaggctgtggccgccgcctacaccttcctgcagaggaaccccaagcatgagctgacagccaagtacctgaactactaccagggcatgctggatgtggctgatgagagcctgacagacctggaggcccagccctatgaggccgtgttcctgcgggctgtgaagctgtacaacagcggggacttccgcagcagcacagaggacatggagcgggccctgtctgagtacctggccgtgtttgcccgctgcctggccggctgtgagggcgcccacgagcaggtggacttcaaggacttctacccagccatcgctgacctgtttgctgagagcctgcagtgcaaggtggactgtgaggccaacctgacccccaacgtgggcggctactttgtggacaagtttgtggccaccatgtaccactacctgcagtttgcctactacaagctgaatgatgtgcggcaggccgcccggtctgctgccagctacatgctgtttgaccccaaggacagcgtgatgcagcagaacctggtgtactaccgcttccaccgggcccgctggggcctggaggaggaggacttccagccccgggaggaggccatgctgtaccacaaccagacagctgagctgcgggagctgctggagttcacccacatgtacctgcagagtgatgatgagatggagctggaggagacagagccccccctggagccagaagatgccctgagtgatgctgagtttgaaggagagggggactatgaggagggcatgtatgctgactggtggcaggagccagatgccaagggagatgaggccgaggccgagcctgagcctgagctggcctag

SEQ ID NO: 15929 - DNA, 1314 bp, Artificial Sequence; identical to SEQ ID NO: 15928
  Description of Artificial Sequence: Synthetic coding sequence

SEQ ID NO: 15930 - DNA, 1281 bp, Artificial Sequence
  Description of Artificial Sequence: Synthetic coding sequence
atggcccgggtggcctggggcctgctgtggctgctgctgggcagcgctggggcccagtatgagaagtacagcttccggggcttccccccagaggacctgatgcccctggccgccgcctacggccacgccctggagcagtatgaaggagagagctggagggagagcgcccgctacctggaggccgccctgcggctgcaccggctgctgcgggacagcgaggccttctgccacgccaactgcagcggccctgccccagctgccaagccagaccctgatggcggccgggcagatgagtgggcctgtgagctgcggctgtttggccgggtgctggagagagctgccttccaggtgccctacccaccccggcagctgctgcgggacttccagagccggctgccctaccagtacctgcactacgccctcttcaaggccaaccggctggagaaggctgtggccgccgcctacaccttcctgcagaggaaccccaagcatgagctgacagccaagtacctgaactactaccagggcatgctggatgtggctgatgagagcctgacagacctggaggcccagccctatgaagctgtgttcctgcgggctgtgaagctgtacaacagcggggacttccgcagcagcacagaggacatggagcgggccctgtctgagtacctggccgtgtttgcccgctgcctggccggctgtgagggcgcccacgagcaggtggacttcaaggacttctacccagccatcgctgacctgtttgctgagagcctgcagtgcaaggtggactgtgaggccaacctgaccccaaatgtgggcggctactttgtggacaagtttgtggccaccatgtaccactacctgcagtttgcctactacaagctgaatgatgtgcggcaggccgcccggtctgctgccagctacatgctgtttgaccccaaggacagcgtgatgcagcagaacctggtgtactaccgcttccaccgggcccgctggggcctggaggaggaggacttccagccccgggaggaggccatgctgtaccacaaccagacagctgagctgcgggagctgctggagttcacccacatgtacctgcagagtgatgatgagatggagctggaggagacagagccccccctggagccagaagatgccctgagtgatgctgagtttgaaggagagggggactatgaggagggcatgtatgctgactggtggcaggagccagatgccaagggagatgaagctgaggccgagcctgagcctgagctggcctag

SEQ ID NO: 15931 - DNA, 942 bp, Artificial Sequence
  Description of Artificial Sequence: Synthetic coding sequence
atggccagcttcaggaagctgaccctgtctgagaaggtgccccccaaccaccccagcaggaagaaggtgaacttcctggacatgagcctggatgacatcatcatctacaaggagctggagggcaccaatgctgaggaggagaagaacaagaggcagaaccacagcaagaaggagagccccagccggcagcagagcaaggcccaccgccaccgccacagaagaggctacagccgctgccgcagcaacagcgaggagggcaaccacgacaagaagcccagccagaagcccagcggcttcaagagcggccagcaccccctgaatggccagcccctcatcgagcaggagaagtgcagcgacaactatgaggcccaggccgagaagaaccagggccagagcgagggcaaccagcaccagagcgagggcaacccagacaagtctgaggagagccagggccagcctgaggagaaccaccacagcgagaggagcaggaaccacctggagaggagcctgagccagagcgacaggagccagggccagctgaagaggcaccacccccagtatgaaagaagccacggccagtacaagaggagccacggccagagcgagaggagccacggccacagcgagaggagccacggccacagcgagaggagccacggccacagcgagaggagccacggccacagcaagaggagccgcagccagggcgacctggtggacacccagagcgacctgattgccacccagagggacctgattgccacccagaaggacctgattgccacccagagggacctgattgccacccagagggacctgattgtgacccagagggacctggtggccacagagcgggacctgatcaaccagagcggccgcagccacggccagagcgagcggcaccagcgctacagcacaggcaagaacaccatcaccacctag

SEQ ID NO: 15932 - DNA, 237 bp, Artificial Sequence
  Description of Artificial Sequence: Synthetic coding sequence
atggccagcttcaggaagctgaccctgtctgagaaggtgccccccaaccaccccagcaggaagaaggtgaacttcctggacatgagcctggatgacatcatcatctacaaggagctggagggcaccaatgctgaggaggagaagaacaagaggcagaaccacagcaagaaggagagccccagccggcagcagagcaaggcccaccgccaccgccacagaagaggagaggtgcagtag

SEQ ID NO: 15933 - DNA, 696 bp, Artificial Sequence
  Description of Artificial Sequence: Synthetic coding sequence
atgctgaagaagaagaggatcaaggacaggaccatcgtgaagaggaaccggctgcaggacagcaaccagaagctgattgacatcgccatcggggaggagaagtgcagcgacaactatgaggcccaggccgagaagaaccagggccagagcgagggcaaccagcaccagagcgagggcaacccagacaagtctgaggagagccagggccagcctgaggagaaccaccacagcgagaggagcaggaaccacctggagaggagcctgagccagagcgacaggagccagggccagctgaagaggcaccacccccagtatgaaagaagccacggccagtacaagaggagccacggccagagcgagaggagccacggccacagcgagaggagccacggccacagcgagaggagccacggccacagcgagaggagccacggccacagcaagaggagccgcagccagggcgacctggtggacacccagagcgacctgattgccacccagagggacctgattgccacccagaaggacctgattgccacccagagggacctgattgccacccagagggacctgattgtgacccagagggacctggtggccacagagcgggacctgatcaaccagagcggccgcagccacggccagagcgagcggcaccagcgctacagcacaggcaagaacaccatcaccacctag

SEQ ID NO: 15934 - DNA, 1944 bp, Artificial Sequence
  Description of Artificial Sequence: Synthetic coding sequence
atgggccccctgagcgcccggctgctgatgcagaggggccggcccaagagtgaccggctgggcaagatccgcagcctggacctgagcggcctggagctgctgtctgagcacctggaccccaagctgctgtgccgcctgacccagctgcaggagctggacctgagcaacaaccacctggagaccctgcctgacaacctgggcctgagccacctgcgggtgctgcgctgtgccaacaaccagctgggagatgtgacagccctgtgccagttccccaagctggaggagctgagcctggagggcaaccccttcctgactgtgaatgacaacctgaaggtgtccttcctgctgcccaccctgaggaaggtgaatggcaaggatgccagcagcacctacagccaggtggagaacctgaaccgggagctgaccagccgggtgacagcccactgggagaagttcatggccaccctgggccctgaggaggaggccgagaaggcccaggccgactttgtgaagtctgctgtgagagatgtgcgctatggccctgagagcctgtctgagttcacccagtggagggtgaggatgatcagcgaggagctggtggccgccagcaggacccaggtgcagaaggccaacagccctgagaagcccccagaggccggggccgcccacaagccccgggcccggctggccgccctgaagaggccagatgatgtgcccctgagcctgagccccagcaagagggcctgtgccagccccagcgcccaggtggagggcagccctgtggccggcagtgatggcagccagcctgctgtgaagctggagcccctgcacttcctgcagtgccacagcaagaacaacagcccccaggacctggagacccagctgtgggcctgtgcctttgagcccgcctgggaggagggcgccaccagccagacagtggccacctgtggcggggaggccgtgtgtgtgattgactgccagacaggcatcgtgctgcacaagtacaaggcccctggagaggagttcttctctgtggcctggacagccctgatggtggtgacccaggccggccacaagaagcgctggagcgtgctggccgccgccggcctgcggggcctggtgcggctgctgcacgtgcgggccggcttctgctgcggggtcatccgggcccacaagaaggccatcgccaccctgtgcttcagccctgcccacgagacccacctgttcaccgccagctatgacaagaggatcatcctgtgggacatcggcgtgcccaaccaggactatgagttccaggccagccagctgctgaccctggacaccaccagcatccccctgcggctgtgccctgtggccagctgcccagatgcccggctgctggccggctgtgagggcggctgctgctgctgggatgtgcggctggaccagccccagaagagaagagtgtgtgaggtggagtttgtgttcagcgagggcagcgaggccagcggccggcgggtggatggcctggcctttgtgaatgaagacatcgtggccagcaagggcagcggcctgggcaccatctgcctgtggagctggaggcagacctggggcggccggggcagccagagcacagtggccgtggtggtgctggcccggctgcagtggagcagcacagagctggcctacttcagcctgagcgcctgcccagacaagggcatcgtgctgtgtggagatgaggagggcaatgtgtggctgtatgatgtgagcaacatcctgaagcagccccccctgctgcctgctgccctgcaggcccccacccagatcctgaagtggccccagccctgggccctgggccaggtggtgaccaagaccatggtgaacacagtggtggccaatgccagcttcacctacctgacagccctgacagacagcaacatcgtggccatctggggccgcatgtag

SEQ ID NO: 15935 - DNA, 2310 bp, Artificial Sequence
  Description of Artificial Sequence: Synthetic coding sequence
atgagcaacaacctgcggcgggtcttcctgaagccagcagaagaaaattctggaaatgccagccgctgtgtgtctggctgcatgtaccaggtggtgcagaccatcggcagtgatggcaagaacctgctgcagctgctgcccatccccaagagcagcggcaacctgatccccctggtgcagagctctgtgatgtctgatgccctgaagggcaacacaggcaagcctgtgcaggtgaccttccagacccagatcagcagcagcagcaccagcgcctctgtgcagctgcccatcttccagcctgccagcagcagcaactacttcctgaccaggacagtggacaccagcgagaagggccgggtgacctctgtgggcactggaaacttcagcagctctgtgtccaaggtgcagagccacggcgtgaagattgatggcctgaccatgcagacctttgctgtgccccccagcacccagaaggacagcagcttcatcgtggtgaacacccagagcctgcctgtgacagtgaagagccctgtgctgcccagcggccaccacctgcagatcccagcccatgctgaggtgaagtctgtgcctgccagcagcctgccccccagcgtgcagcagaagatcctggccacagccaccaccagcaccagcggcatggtggaggccagccagatgcccaccgtcatctacgtgtcccctgtgaacacagtgaagaatgtggtgaccaagaacttccagaacatctaccccaagcctgtgacagaaattgccaagcctgtgatcctgaacaccacccagatccccaagaatgtggccacagagacccagctgaagggcggccagcacagccaggccgcccctgtgaagtggatcttccaggacaacctgcagcccttcacccccagcctggtgcctgtgaagagcagcaacaacgtggccagcaagatcctgaagacctttgtggacaggaagaacctgggggacaacaccatcaacatgccacccctgagcaccatcgaccccagcggcaccaggagcaagaacatgcccatcaaggacaatgccctggtgatgtttaatggcaaggtgtacctgctggccaagaagggcacagatgtgctgcccagccagattgaccagcagaacagcgtgtccccagacacccctgtgaggaaggacaccctgcagacagtgagcagcagccctgtgacagagatcagccgggaggtggtgaacatcgtgctggccaagagcaagagcagccagatggagaccaagagcctgagcaacacccagctggcctccatggccaacctgcgggcagagaagaacaaggtggagaagcccagccccagcaccaccaacccccacatgaaccagagcagcaactacctgaagcagagcaagaccctcttcaccaaccccatcttccctgtgggcttcagcacaggccacaatgcccccaggaaggtgacagctgtgatctatgccaggaagggctctgtgctgcagagcattgagaagatcagcagctctgtggatgccaccaccgtgaccagccagcagtgtgtgttccgggaccaggagcccaagatccacaatgagatggccagcaccagtgacaagggggcccagggcagaaatgacaagaaggacagccagggccgcagcaacaaggccctgcacctgaagagtgatgctgagttcaagaagatcttcggcctgaccaaggacctgcgggtgtgcctgacccgcatcccagaccacctgaccagcggggagggctttgacagcttcagcagcctggtgaagagcggcacctacaaggagacagagttcatggtgaaggagggggagaggaagcagcagaactttgacaagaagaggaaggccaagaccaacaagaagatggaccacatcaagaagaggaagacagaaaatgcctacaatgccatcatcaatggagaggccaacgtgacaggcagccagctgctgagcagcatcctgcccaccagtgatgtgtcccagcacaacatcctgaccagccacagcaagacccggcaggagaagaggacagagatggagtactacacccatgagaagcaggagaagggcaccctgaacagcaatgctgcctatgagcagagccacttcttcaacaagaactacacagaggacatcttccctgtgaccccacctgagctggaggagaccatcagagatgagaagatccggcggctgaagcaggtgctgcgggagaaggaggccgccctggaggagatgaggaagaagatgcaccagaagtag

SEQ ID NO: 15936 - DNA, 702 bp, Artificial Sequence
  Description of Artificial Sequence: Synthetic coding sequence
atggccagcaccagtgacaagggggcccagggcagaaatgacaagaaggacagccagggccgcagcaacaaggccctgcacctgaagagtgatgctgagttcaagaagatcttcggcctgaccaaggacctgcgggtgtgcctgacccgcatcccagaccacctgaccagcggggagggctttgacagcttcagcagcctggtgaagagcggcacctacaaggagacagagttcatggtgaaggagggggagaggaagcagcagaactttgacaagaagaggaaggccaagaccaacaagaagatggaccacatcaagaagaggaagacagaaaatgcctacaatgccatcatcaatggagaggccaacgtgacaggcagccagctgctgagcagcatcctgcccaccagtgatgtgtcccagcacaacatcctgaccagccacagcaagacccggcaggagaagaggacagagatggagtactacacccatgagaagcaggagaagggcaccctgaacagcaatgctgcctatgagcagagccacttcttcaacaagaactacacagaggacatcttccctgtgaccccacctgagctggaggagaccatcagagatgagaagatccggcggctgaagcaggtgctgcgggagaaggaggccgccctggaggagatgaggaagaagatgcaccagaagtag

SEQ ID NO: 15937 - DNA, 702 bp, Artificial Sequence; identical to SEQ ID NO: 15936
  Description of Artificial Sequence: Synthetic coding sequence

SEQ ID NO: 15938 - DNA, 1134 bp, Artificial Sequence
  Description of Artificial Sequence: Synthetic coding sequence
atgtactggaagcatgaaaatgctgccccagccctgcctgagggctgccgcctgcctgctgagggcggccctgccacagaccaggtgatggcccagcccggcagcggctgcaaggccaccacccgctgcctggagggcacagcccccccagccatggcccagagtgatgctgaggccctggccggggccctggacaaggatgagggccaggccagcccctgcacccccagcacccccagcgtgtgcagcccccccagcgctgccagctctgtgcccagcgctgggaagaacatctgcagcagctgtggcctggagatcctggaccgctacctgctgaaggtgaacaacctgatctggcacgtgcgctgcctggagtgcagcgtgtgcaggaccagcctgcggcagcagaacagctgctacatcaagaacaaggagatcttctgcaagatggactacttcagccgcttcggcaccaagtgtgcccgctgtggccggcagatctatgccagtgactgggtgcggcgggcccggggaaatgcctaccacctggcctgctttgcctgcttcagctgcaagaggcagctgagcactggagaggagtttggcctggtggaggagaaggtgctgtgccgcatccactatgacaccatgattgagaacctgaagagagctgctgaaaatggaaatggcctgaccctggagggcgctgtgcccagcgagcaggacagccagcccaagccagccaagagggcccggaccagcttcaccgctgagcagctgcaggtgatgcaggcccagtttgcccaggacaacaacccagatgcccagaccctgcagaagctggccgacatgacaggcctgagcagaagagtcatccaggtgtggttccagaactgccgggcccggcacaagaagcacaccccccagcaccctgtgcccccatctggggccccacccagccggctgcccagcgccctgagtgatgacatccactacacccccttcagcagccctgagcgggccaggatggtgaccctgcacggctacatcgagagccaccccttctctgtgctgaccctgcctgccctgccccacctgcctgtgggcgccccccagctgcccctgagcaggtag

SEQ ID NO: 15939 - DNA, 1092 bp, Artificial Sequence
  Description of Artificial Sequence: Synthetic coding sequence
atggcccagcccggcagcggctgcaaggccaccacccgctgcctggagggcacagcccccccagccatggcccagagtgatgctgaggccctggccggggccctggacaaggatgagggccaggccagcccctgcacccccagcaccccatctgtgtgcagccccccatctgctgccagctctgtgcccagcgctgggaagaacatctgcagcagctgtggcctggagatcctggaccgctacctgctgaaggtgaacaacctgatctggcacgtgcgctgcctggagtgcagcgtgtgcaggaccagcctgcggcagcagaacagctgctacatcaagaacaaggagatcttctgcaagatggactacttcagcagatttggcaccaagtgtgcccgctgtggccggcagatctatgccagtgactgggtgagaagagcccggggaaatgcctaccacctggcctgctttgcctgcttcagctgcaagaggcagctgagcactggagaggagtttggcctggtggaggagaaggtgctgtgccgcatccactatgacaccatgattgagaacctgaagagagctgctgaaaatggaaatggcctgaccctggagggcgctgtgcccagcgagcaggacagccagcccaagccagccaagagggcccggaccagcttcaccgctgagcagctgcaggtgatgcaggcccagtttgcccaggacaacaacccagatgcccagaccctgcagaagctggccgacatgacaggcctgagccggcgggtcatccaggtgtggttccagaactgccgggcccggcacaagaagcacaccccccagcaccctgtgccccccagcggggccccacccagccggctgcccagcgccctgagtgatgacatccactacacccccttcagcagccctgagcgggccaggatggtgaccctgcacggctacatcgagagccaggtgcagtgtggccaggtgcactgccgcctgccctacacagcccctcctgtgcacctgaaggctgacatggatggccccctgagcaacagaggagagaaggtgatcctcttccagtactag

SEQ ID NO: 15940 - DNA, 1179 bp, Artificial Sequence
  Description of Artificial Sequence: Synthetic coding sequence
atgtactggaagcatgaaaatgctgccccagccctgcctgagggctgccgcctgcctgctgagggcggccctgccacagaccaggtgatggcccagcccggcagcggctgcaaggccaccacccgctgcctggagggcacagcccccccagccatggcccagagtgatgctgaggccctggccggggccctggacaaggatgagggccaggccagcccctgcacccccagcacccccagcgtgtgcagcccccccagcgctgccagctctgtgcccagcgctgggaagaacatctgcagcagctgtggcctggagatcctggaccgctacctgctgaaggtgaacaacctgatctggcacgtgcgctgcctggagtgcagcgtgtgcaggaccagcctgcggcagcagaacagctgctacatcaagaacaaggagatcttctgcaagatggactacttcagccgcttcggcaccaagtgtgcccgctgtggccggcagatctatgccagtgactgggtgcggcgggcccggggaaatgcctaccacctggcctgctttgcctgcttcagctgcaagaggcagctgagcactggagaggagtttggcctggtggaggagaaggtgctgtgccgcatccactatgacaccatgattgagaacctgaagagagctgctgaaaatggaaatggcctgaccctggagggcgctgtgcccagcgagcaggacagccagcccaagccagccaagagggcccggaccagcttcaccgctgagcagctgcaggtgatgcaggcccagtttgcccaggacaacaacccagatgcccagaccctgcagaagctggccgacatgacaggcctgagcagaagagtcatccaggtgtggttccagaactgccgggcccggcacaagaagcacaccccccagcaccctgtgcccccatctggggccccacccagccggctgcccagcgccctgagtgatgacatccactacacccccttcagcagccctgagcgggccaggatggtgaccctgcacggctacatcgagagccaggtgcagtgtggccaggtgcactgccgcctgccctacacagcccctcctgtgcacctgaaggctgacatggatggccccctgagcaacagaggagagaaggtgatcctcttccagtactag

SEQ ID NO: 15941 - DNA, 1101 bp, Artificial Sequence
  Description of Artificial Sequence: Synthetic coding sequence
atgaggcggggcctgtgcagaagatctgcagaaaatccagatgctggccctgtgatggcccagcccggcagcggctgcaaggccaccacccgctgcctggagggcacagcccccccagccatggcccagagtgatgctgaggccctggccggggccctggacaaggatgagggccaggccagcccctgcacccccagcaccccatctgtgtgcagccccccatctgctgccagctctgtgcccagcgctgggaagaacatctgcagcagctgtggcctggagatcctggaccgctacctgctgaaggtgaacaacctgatctggcacgtgcgctgcctggagtgcagcgtgtgcaggaccagcctgcggcagcagaacagctgctacatcaagaacaaggagatcttctgcaagatggactacttcagcagatttggcaccaagtgtgcccgctgtggccggcagatctatgccagtgactgggtgagaagagcccggggaaatgcctaccacctggcctgctttgcctgcttcagctgcaagaggcagctgagcactggagaggagtttggcctggtggaggagaaggtgctgtgccgcatccactatgacaccatgattgagaacctgaagagagctgctgaaaatggaaatggcctgaccctggagggcgctgtgcccagcgagcaggacagccagcccaagccagccaagagggcccggaccagcttcaccgctgagcagctgcaggtgatgcaggcccagtttgcccaggacaacaacccagatgcccagaccctgcagaagctggccgacatgacaggcctgagccggcgggtcatccaggtgtggttccagaactgccgggcccggcacaagaagcacaccccccagcaccctgtgccccccagcggggccccacccagccggctgcccagcgccctgagtgatgacatccactacacccccttcagcagccctgagcgggccaggatggtgaccctgcacggctacatcgagagccaccccttctctgtgctgaccctgcctgccctgccccacctgcctgtgggcgccccccagctgcccctgagcaggtag

SEQ ID NO: 15942 - DNA, 66 bp, Artificial Sequence
  Description of Artificial Sequence: Synthetic coding sequence
atggcccagcccggcagcggctgcaaggccaccacccgctgcctggagggcacagccccaccctag

SEQ ID NO: 15943 - DNA, 105 bp, Artificial Sequence
  Description of Artificial Sequence: Synthetic coding sequence
atggcccagcccggcagcggctgcaaggccaccacccgctgcctggagggcacagcccccccagccatggcccagagtgatgctgaggccctggccggggcctag

SEQ ID NO: 15944 - DNA, 531 bp, Artificial Sequence
  Description of Artificial Sequence: Synthetic coding sequence
atgattgagaacctgaagagagctgctgaaaatggaaatggcctgaccctggagggcgctgtgcccagcgagcaggacagccagcccaagccagccaagagggcccggaccagcttcaccgctgagcagctgcaggtgatgcaggcccagtttgcccaggacaacaacccagatgcccagaccctgcagaagctggccgacatgacaggcctgagcagaagagtcatccaggtgtggttccagaactgccgggcccggcacaagaagcacaccccccagcaccctgtgcccccatctggggccccacccagccggctgcccagcgccctgagtgatgacatccactacacccccttcagcagccctgagcgggccaggatggtgaccctgcacggctacatcgagagccaggtgcagtgtggccaggtgcactgccgcctgccctacacagcccctcctgtgcacctgaaggctgacatggatggccccctgagcaacagaggagagaaggtgatcctcttccagtactag

SEQ ID NO: 15945 - DNA, 372 bp, Artificial Sequence
  Description of Artificial Sequence: Synthetic coding sequence
atggctgtgagccacagcgtgaaggagaggaccatcagcgagaacagcctcatcatcctgctgcagggcctgcagggccgggtgaccaccgtggacctgagagatgaatctgtggcccacggcagaattgacaacgtggatgccttcatgaacatccggctggccaaggtgacctacacagaccgctggggccaccaggtgaagctggatgacctgtttgtgactggaagaaatgtgcgctacgtgcacatcccagatgatgtgaacatcaccagcaccatcgagcagcagctgcagatcatccaccgggtgaggaactttggaggcaagggccagggccgctgggagttcccccccaagaactgcaagtag

SEQ ID NO: 15946 - DNA, 1083 bp, Artificial Sequence
  Description of Artificial Sequence: Synthetic coding sequence
atggaggagcgggagcggggggcccggtctgctggagctggcagccctgcccggccccccagcccccggctggatgtgtccagtgacagctttgaccccctgctggccctgtatgccccccggctgccccccatcccctacccaaatgccccctgcttcaacaacgtggccgagtatgagagcttcctgaggactggagtgcggggcggcggccggggccggggccgggcccggggagctgctgctggcagcggcgtgcctgctgcccctggccccagcggccgcacccggcggcggccagatgccccagccccagaccctgagcgcatccagaggctgcggcggctgatggtggccaaggaggagggagatggagctgctggagctggaagaagaggccctggccgcagcaggaaggcccccagaaatgtgctgaccaggatgcccctgcacgagggcagccccctgggggagctgcaccgctgcatccgggagggcgtgaaggtgaatgtgcacatccgcaccttcaagggcctgcggggcgtgtgcaccggcttcctggtggcctttgacaagttctggaacatggccctgacagatgtggatgagacctacaggaagcctgtgctgggcaaggcctatgaaagagacagcagcctgaccctgacccggctgtttgaccggctgaagctgcaggacagcagcaagaaggaggccgacagcaagtctgctgtggaggacagcaccctgagccgctacagccagaccagcacctggaagctggcctctgtgtggggccgggctgacaccggccggggcagccacaagaggagccgctctgtgcccagcagcctgcaggccagcgcccgggaggagagccgctctgagctgagcggccgcaccaccaggacagatggcagctctgtgggcggcaccttcagccgggccaccaccctgagccggggccagagcaggaagaagaagaggaagcccaaggtggactaccagcaggtgttcaccaggcacatcaaccagatcttcatcagaggagaaaatgtgctgctggtgcacctggcccagtag

SEQ ID NO: 15947 - DNA, 1140 bp, Artificial Sequence
  Description of Artificial Sequence: Synthetic coding sequence
atggtgttcttcacctgcaatgcctgtggggagagcgtgaagaagatccaggtggagaagcacgtgtctgtgtgcaggaactgtgaatgtctgagctgcatcgactgtgggaaggacttctggggagatgactacaagaaccacgtgaagtgcatcagcgaggaccagaagtatggaggcaagggctatgagggcaagacccacaagggggacatcaagcagcaggcctggatccagaagatcagcgagctgatcaagaggcccaacgtgagccccaaggtgcgggagctgctggagcagatcagcgcctttgacaacgtgcccaggaagaaggccaagttccagaactggatgaagaacagcctgaaggtgcacaatgaaagcatcctggaccaggtgtggaacatcttcagcgaggccagcaacagcgagcctgtgaacaaggagcaggaccagaggcccctgcaccctgtggccaacccccatgctgagatcagcaccaaggtgcctgccagcaaggtgaaggatgctgtggagcagcagggcgaggtgaagaagaacaagcgggagaggaaggaggagcggcagaagaagaggaagcgggagaagaaggagctgaagctggagaaccaccaggagaacagcaggaaccagaagcccaagaagaggaagaagggccaggaggccgacctggaggccggcggggaggaggtgcctgaggccaacggcagcgctgggaagaggagcaagaagaagaagcagaggaaggacagcgccagcgaggaggaggcccacgtgggcgctgggaagaggaagagaagacacagcgaggtggagacagacagcaagaagaagaagatgaagctgcctgagcaccctgagggcggggagccagaagatgatgaggccccagccaagggcaagttcaactggaagggcaccatcaaggccatcctgaagcaggccccagacaatgagatcaccatcaagaagctgaggaagaaggtgctggcccagtactacacagtgacagatgagcaccacaggtctgaggaggagctgctggtgatcttcaacaagaagatcagcaagaaccccaccttcaagctgctgaaggacaaggtgaagctggtgaagtag

SEQ ID NO: 15948 - DNA, 1140 bp, Artificial Sequence; identical to SEQ ID NO: 15947
  Description of Artificial Sequence: Synthetic coding sequence

SEQ ID NO: 15949 - DNA, 240 bp, Artificial Sequence
  Description of Artificial Sequence: Synthetic coding sequence
atggtgttcttcacctgcaatgcctgtggggagagcgtgaagaagatccaggtggagaagcacgtgtctgtgtgcaggaactgtgaatgtctgagctgcatcgactgtgggaaggacttctggggagatgactacaagaaccacgtgaagtgcatcagcgaggaccagaagtatggaggcaagggctatgagggcaagacccacaagggggacatcaagcagcaggcctggatccagtag

SEQ ID NO: 15950 - DNA, 1863 bp, Artificial Sequence
  Description of Artificial Sequence: Synthetic coding sequence
atgaagccagccccccggctgacccctgtgcggcctgctgctgccagccccatcgtgtctggggccaggagaagaagagtgcgctgcaggaagtgcaaggcctgtgtgcagggagaatgtggggtgtgccactactgccgggacatgaagaagtttggaggccctggccgcatgaagcagagctgtgtgctgcggcagtgcctggccccccggctgccccacagcgtgacctgcagcctgtgtggggaggtggaccagaatgaggagacccaggactttgagaagaagctgatggagtgctgcatctgcaatgagatcgtgcaccctggctgcctgcagatggatggagagggcctgctgaatgaggagctgcccaactgctgggagtgccccaagtgctaccaggaggacagcagcgagaaggcccagaagaggaagatggaggagagtgatgaggaggccgtgcaggccaaggtgctgcggcccctgcggagctgtgatgagcccctgaccccaccaccccacagccccacctccatgctgcagctgattcatgaccctgtgagcccccggggcatggtgaccaggagcagccctggagctggccccagcgaccaccacagcgccagcagagatgagcgcttcaagaggcggcagctgctgcggctgcaggccacagagaggaccatggtgcgggagaaggagaacaaccccagcggcaagaaggagctgtctgaggtggagaaggccaagatccggggcagctacctgactgtgaccctgcagaggcccaccaaggagctgcacggcaccagcatcgtgcccaagctgcaggccatcacagccagcagcgccaacctgcggcacagcccccgggtgctggtgcagcactgcccagcccggaccccccagagaggagatgaggagggcctgggcggggaggaggaggaggaggaggaggaggaggaggaggatgattctgctgaggagggcggggccgcccggctgaatggccggggctcctgggcccaggatggagatgagagctggatgcagcgggaggtgtggatgtctgtgttccgctacctgagcagaagagagctgtgtgagtgcatgagggtgtgcaagacctggtacaagtggtgctgtgacaagaggctgtggaccaagattgacctgagccgctgcaaggccatcgtgccccaggccctgagcggcatcatcaagaggcagcctgtgtccctggacctgtcctggaccaacatcagcaagaagcagctgacctggctggtgaaccggctgcccggcctgaaggacctgctgctggccggctgctcctggagcgctgtgtctgccctgagcaccagcagctgccccctgctgcggaccctggacctgcgctgggccgtgggcatcaaggacccccagatccgggacctgctgaccccacctgctgacaagccaggccaggacaacagaagcaagctgaggaacatgacagacttccggctggccggcctggacatcacagatgccaccctgcggctcatcatccgccacatgcccctgctgagccggctggacctgagccactgcagccacctgacagaccagagcagcaacctgctgacagctgtgggcagcagcacccgctacagcctgacagagctgaacatggccggctgcaacaagctgacagaccagaccctcatctacctgcggcgcatcgccaacgtgaccctgattgacctgcggggctgcaagcagatcaccaggaaggcctgtgagcacttcatcagtgacctgagcatcaacagcctgtactgcctgagtgatgagaagctgatccagaagatctcctag

SEQ ID NO: 15951 - DNA, 2349 bp, Artificial Sequence
  Description of Artificial Sequence: Synthetic coding sequence
atggagcctgaggaggagcgcatccgctacagccagaggctgcggggcaccatgagaagaagatatgaagatgatggcatcagtgatgatgaaattgagggcaagaggacctttgacctggaggagaagctgcacaccaacaagtacaatgccaactttgtgaccttcatggagggcaaggacttcaacgtggagtacatccagaggggcggcctgcgggaccccctcatcttcaagaacagtgatggcctgggcatcaagatgccagaccctgacttcaccgtgaatgatgtgaagatgtgtgtgggcagcaggaggatggtggatgtgatggatgtgaacacccagaagggcatcgagatgaccatggcccagtggacccgctactatgagaccccagaggaggagcgggagaagctgtacaacgtcatcagcctggagttcagccacacccggctggagaacatggtgcagaggcccagcacagtggacttcatcgactgggtggacaacatgtggcccaggcacctgaaggagagccagacagagagcaccaatgccatcctggagatgcagtaccccaaggtgcagaagtactgcctgatgtctgtgcggggctgctacacagacttccacgtggactttggaggcacctctgtgtggtaccacatccaccagggcggcaaggtgttctggctgatccccccaacagcccacaacctggagctgtatgagaactggctgctgagcggcaagcagggcgacatcttcctgggggacagagtgtctgactgccagagaattgagctgaagcagggctacaccttcgtcatccccagcggctggattcatgctgtgtacacccccacagacaccctggtgtttggaggcaacttcctgcacagcttcaacatccccatgcagctgaagatctacaacatcgaggacaggaccagggtgcccaacaagttccgctaccccttctactatgagatgtgctggtacgtgctggagcgctacgtgtactgcatcaccaacagaagccacctgaccaaggagttccagaaggagagcctgtccatggacctggagctgaatggcctggagagcggaaatggagatgaggaggccgtggaccgggagccccggcggctgagcagccgccgctctgtgctgaccagccctgtggccaacggggtgaacctggactatgatggcctgggcaagacctgccgcagcctgcccagcctgaagaagaccctggccggggacagcagcagtgactgcagccggggcagccacaacggccaggtgtgggacccccagtgtgcccccaggaaggaccggcaggtgcacctgacccactttgagctggagggcctgcgctgcctggtggacaagctggagagcctgcccctgcacaagaagtgtgtgcccaccggcattgaagatgaagatgccctgattgctgatgtgaagatcctgctggaggagctggccaacagcgaccccaagctggccctgactggagtgcccatcgtgcagtggcccaagagggacaagctgaagttccccacccggcccaaggtgcgggtgcccaccatccccatcaccaagccccacaccatgaagccagccccccggctgacccctgtgcggcctgctgctgccagccccatcgtgtctggggccaggagaagaagagtgcgctgcaggaagtgcaaggcctgtgtgcagggagaatgtggggtgtgccactactgccgggacatgaagaagtttggaggccctggccgcatgaagcagagctgtgtgctgcggcagtgcctggccccccggctgccccacagcgtgacctgcagcctgtgtggggaggtggaccagaatgaggagacccaggactttgagaagaagctgatggagtgctgcatctgcaatgagatcgtgcaccctggctgcctgcagatggatggagagggcctgctgaatgaggagctgcccaactgctgggagtgccccaagtgctaccaggaggacagcagcgagaaggcccagaagaggaagatggaggagagtgatgaggaggccgtgcaggccaaggtgctgcggcccctgcggagctgtgatgagcccctgaccccaccaccccacagccccacctccatgctgcagctgattcatgaccctgtgagcccccggggcatggtgaccaggagcagccctggagctggccccagcgaccaccacagcgccagcagagatgagcgcttcaagaggcggcagctgctgcggctgcaggccacagagaggaccatggtgctgcggcaggagaccctggacaagaactag

SEQ ID NO: 15952 - DNA, 1263 bp, Artificial Sequence
  Description of Artificial Sequence: Synthetic coding sequence
atgtgcagcggccgcttccagaacatccaggtgaacccagacttcccccggggccgcatcagcaacagcttccggaggaccagcagcacagagaacaagaccaagaccctgggcaagctgcaccaggagccccggcagctgcagagtgatggcaagaggaagatcctgctggaggagctggccaacagcgaccccaagctggccctgactggagtgcccatcgtgcagtggcccaagagggacaagctgaagttccccacccggcccaaggtgcgggtgcccaccatccccatcaccaagccccacaccatgaagccagccccccggctgacccctgtgcggcctgctgctgccagccccatcgtgtctggggccaggagaagaagagtgcgctgcaggaagtgcaaggcctgtgtgcagggagaatgtggggtgtgccactactgccgggacatgaagaagtttggaggccctggccgcatgaagcagagctgtgtgctgcggcagtgcctggccccccggctgccccacagcgtgacctgcagcctgtgtggggaggtggaccagaatgaggagacccaggactttgagaagaagctgatggagtgctgcatctgcaatgaaattgtgcaccctggctgcctgcagatggatggagagggcctgctgaatgaggagctgcccaactgctgggagtgccccaagtgctaccaggaggacagcagcgagaaggcccagaagaggaagatggaggagagtgatgaggaggccgtgcaggccaaggtgctgcggcccctgcggagctgtgatgagcccctgaccccaccaccccacagccccacctccatgctgcagctgattcatgaccctgtgagcccccggggcatggtgaccaggagcagccctggggccggccccagcgaccaccacagcgccagcagagatgagcgcttcaagaggcggcagctgctgcggctgcaggccacagagaggaccatggtgcgggagaaggagaacaaccccagcggcaagaaggagctgtctgaggtggagaaggccaagatccggggcagctacctgactgtgaccctgcagaggcccaccaaggagctgcacggcaccagcatcgtgcccaagctgcacggccaggtgctggtggtgtcctctgcccggctgagcagcatcaccctgagccggctggcccaggagggccctgctgcccctggggtgcctgacccctgccgcagccactggtgctgctag

SEQ ID NO: 15953 - DNA, 3489 bp, Artificial Sequence
  Description of Artificial Sequence: Synthetic coding sequence
atggagcctgaggaggagcgcatccgctacagccagaggctgcggggcaccatgagaagaagatatgaagatgatggcatcagtgatgatgaaattgagggcaagaggacctttgacctggaggagaagctgcacaccaacaagtacaatgccaactttgtgaccttcatggagggcaaggacttcaacgtggagtacatccagaggggcggcctgcgggaccccctcatcttcaagaacagtgatggcctgggcatcaagatgccagaccctgacttcaccgtgaatgatgtgaagatgtgtgtgggcagcaggaggatggtggatgtgatggatgtgaacacccagaagggcatcgagatgaccatggcccagtggacccgctactatgagaccccagaggaggagcgggagaagctgtacaacgtcatcagcctggagttcagccacacccggctggagaacatggtgcagaggcccagcacagtggacttcatcgactgggtggacaacatgtggcccaggcacctgaaggagagccagacagagagcaccaatgccatcctggagatgcagtaccccaaggtgcagaagtactgcctgatgtctgtgcggggctgctacacagacttccacgtggactttggaggcacctctgtgtggtaccacatccaccagggcggcaaggtgttctggctgatccccccaacagcccacaacctggagctgtatgagaactggctgctgagcggcaagcagggcgacatcttcctgggggacagagtgtctgactgccagagaattgagctgaagcagggctacaccttcgtcatccccagcggctggattcatgctgtgtacacccccacagacaccctggtgtttggaggcaacttcctgcacagcttcaacatccccatgcagctgaagatctacaacatcgaggacaggaccagggtgcccaacaagttccgctaccccttctactatgagatgtgctggtacgtgctggagcgctacgtgtactgcatcaccaacagaagccacctgaccaaggagttccagaaggagagcctgtccatggacctggagctgaatggcctggagagcggaaatggagatgaggaggccgtggaccgggagccccggcggctgagcagccgccgctctgtgctgaccagccctgtggccaacggggtgaacctggactatgatggcctgggcaagacctgccgcagcctgcccagcctgaagaagaccctggccggggacagcagcagtgactgcagccggggcagccacaacggccaggtgtgggacccccagtgtgcccccaggaaggaccggcaggtgcacctgacccactttgagctggagggcctgcgctgcctggtggacaagctggagagcctgcccctgcacaagaagtgtgtgcccaccggcattgaagatgaagatgccctgattgctgatgtgaagatcctgctggaggagctggccaacagcgaccccaagctggccctgactggagtgcccatcgtgcagtggcccaagagggacaagctgaagttccccacccggcccaaggtgcgggtgcccaccatccccatcaccaagccccacaccatgaagccagccccccggctgacccctgtgcggcctgctgctgccagccccatcgtgtctggggccaggagaagaagagtgcgctgcaggaagtgcaaggcctgtgtgcagggagaatgtggggtgtgccactactgccgggacatgaagaagtttggaggccctggccgcatgaagcagagctgtgtgctgcggcagtgcctggccccccggctgccccacagcgtgacctgcagcctgtgtggggaggtggaccagaatgaggagacccaggactttgagaagaagctgatggagtgctgcatctgcaatgagatcgtgcaccctggctgcctgcagatggatggagagggcctgctgaatgaggagctgcccaactgctgggagtgccccaagtgctaccaggaggacagcagcgagaaggcccagaagaggaagatggaggagagtgatgaggaggccgtgcaggccaaggtgctgcggcccctgcggagctgtgatgagcccctgaccccaccaccccacagccccacctccatgctgcagctgattcatgaccctgtgagcccccggggcatggtgaccaggagcagccctggagctggccccagcgaccaccacagcgccagcagagatgagcgcttcaagaggcggcagctgctgcggctgcaggccacagagaggaccatggtgcgggagaaggagaacaaccccagcggcaagaaggagctgtctgaggtggagaaggccaagatccggggcagctacctgactgtgaccctgcagaggcccaccaaggagctgcacggcaccagcatcgtgcccaagctgcaggccatcacagccagcagcgccaacctgcggcacagcccccgggtgctggtgcagcactgcccagcccggaccccccagagaggagatgaggagggcctgggcggggaggaggaggaggaggaggaggaggaggaggaggatgattctgctgaggagggcggggccgcccggctgaatggccggggctcctgggcccaggatggagatgagagctggatgcagcgggaggtgtggatgtctgtgttccgctacctgagcagaagagagctgtgtgagtgcatgagggtgtgcaagacctggtacaagtggtgctgtgacaagaggctgtggaccaagattgacctgagccgctgcaaggccatcgtgccccaggccctgagcggcatcatcaagaggcagcctgtgtccctggacctgtcctggaccaacatcagcaagaagcagctgacctggctggtgaaccggctgcccggcctgaaggacctgctgctggccggctgctcctggagcgctgtgtctgccctgagcaccagcagctgccccctgctgcggaccctggacctgcgctgggccgtgggcatcaaggacccccagatccgggacctgctgaccccacctgctgacaagccaggccaggacaacagaagcaagctgaggaacatgacagacttccggctggccggcctggacatcacagatgccaccctgcggctcatcatccgccacatgcccctgctgagccggctggacctgagccactgcagccacctgacagaccagagcagcaacctgctgacagctgtgggcagcagcacccgctacagcctgacagagctgaacatggccggctgcaacaagctgacagaccagaccctcatctacctgcggcgcatcgccaacgtgaccctgattgacctgcggggctgcaagcagatcaccaggaaggcctgtgagcacttcatcagtgacctgagcatcaacagcctgtactgcctgagtgatgagaagctgatccagaagatctcctag

SEQ ID NO: 15954 - DNA, 2172 bp, Artificial Sequence
  Description of Artificial Sequence: Synthetic coding sequence
atgtgcagcggccgcttccagaacatccaggtgaacccagacttcccccggggccgcatcagcaacagcttccggaggaccagcagcacagagaacaagaccaagaccctgggcaagctgcaccaggagccccggcagctgcagagtgatggcaagaggaagatcctgctggaggagctggccaacagcgaccccaagctggccctgactggagtgcccatcgtgcagtggcccaagagggacaagctgaagttccccacccggcccaaggtgcgggtgcccaccatccccatcaccaagccccacaccatgaagccagccccccggctgacccctgtgcggcctgctgctgccagccccatcgtgtctggggccaggagaagaagagtgcgctgcaggaagtgcaaggcctgtgtgcagggagaatgtggggtgtgccactactgccgggacatgaagaagtttggaggccctggccgcatgaagcagagctgtgtgctgcggcagtgcctggccccccggctgccccacagcgtgacctgcagcctgtgtggggaggtggaccagaatgaggagacccaggactttgagaagaagctgatggagtgctgcatctgcaatgaaattgtgcaccctggctgcctgcagatggatggagagggcctgctgaatgaggagctgcccaactgctgggagtgccccaagtgctaccaggaggacagcagcgagaaggcccagaagaggaagatggaggagagtgatgaggaggccgtgcaggccaaggtgctgcggcccctgcggagctgtgatgagcccctgaccccaccaccccacagccccacctccatgctgcagctgattcatgaccctgtgagcccccggggcatggtgaccaggagcagccctggggccggccccagcgaccaccacagcgccagcagagatgagcgcttcaagaggcggcagctgctgcggctgcaggccacagagaggaccatggtgcgggagaaggagaacaaccccagcggcaagaaggagctgtctgaggtggagaaggccaagatccggggcagctacctgactgtgaccctgcagaggcccaccaaggagctgcacggcaccagcatcgtgcccaagctgcaggccatcacagccagcagcgccaacctgcggcacagcccccgggtgctggtgcagcactgcccagcccggaccccccagagaggagatgaggagggcctgggcggggaggaggaggaggaggaggaggaggaggaggaggatgacagcgctgaggagggcggggccgcccggctgaatggccggggctcctgggcccaggatggagatgagagctggatgcagcgggaggtgtggatgtctgtgttccgctacctgagccggcgggagctgtgtgagtgcatgagggtgtgcaagacctggtacaagtggtgctgtgacaagaggctgtggaccaagattgacctgagccgctgcaaggccatcgtgccccaggccctgagcggcatcatcaagaggcagcctgtgtccctggacctgtcctggaccaacatcagcaagaagcagctgacctggctggtgaaccggctgcccggcctgaaggacctgctgctggccggctgctcctggagcgctgtgtctgccctgagcaccagcagctgccccctgctgcggaccctggacctgcgctgggccgtgggcatcaaggacccccagatccgggacctgctgaccccacctgctgacaagccaggccaggacaacagaagcaagctgaggaacatgacagacttccggctggccggcctggacatcacagatgccaccctgcggctcatcatccgccacatgcccctgctgagccggctggacctgagccactgcagccacctgacagaccagagcagcaacctgctgacagctgtgggcagcagcacccgctacagcctgacagagctgaacatggccggctgcaacaagctgacagaccagaccctcatctacctgcggagaattgccaacgtgaccctgattgacctgcggggctgcaagcagatcaccaggaaggcctgtgagcacttcatcagtgacctgagcatcaacagcctgtactgcctgagtgatgagaagctgatccagaagatctcctag

SEQ ID NO: 15955 - DNA, 3921 bp, Artificial Sequence
  Description of Artificial Sequence: Synthetic coding sequence
atggccggcccccagatgggcggcagcgctgaggaccacccccccaggaagagacatgctgctgagaagcagaagaagaagacagtcatctacaccaagtgctttgaatttgaaagtgccacccagaggcccatcgaccggcagagatatgatgaaaatgaagacctgagtgatgtggaggagatcgtgtctgtgcggggcttcagcctggaggagaagctgcggagccagctgtaccagggcgactttgtgcacgccatggagggcaaggacttcaactatgaatatgtgcagcgggaggccctgcgggtgcccctcatcttccgggagaaggatggcctgggcatcaagatgccagaccctgacttcaccgtgagagatgtgaagctgctggtgggcagccggcggctggtggatgtgatggatgtgaacacccagaagggcacagagatgtccatgagccagtttgtgcgctactatgagaccccagaggcccagagggacaagctgtacaacgtcatcagcctggagttcagccacaccaagctggagcacctggtgaagaggcccaccgtggtggacctggtggactgggtggacaacatgtggccccagcacctgaaggagaagcagacagaggccaccaatgccatcgccgagatgaagtaccccaaggtgaagaagtactgcctgatgtctgtgaagggctgcttcacagacttccacatcgactttggaggcacctctgtgtggtaccacgtgttccggggcggcaagatcttctggctgatcccccccaccctgcacaacctggccctgtatgaggagtgggtgctgagcggcaagcagagcgacatcttcctgggggacagagtggagcgctgccagagaattgagctgaagcagggctacaccttcttcatccccagcggctggattcatgctgtgtacacccctgtggacagcctggtgtttggaggcaacatcctgcacagcttcaacgtgcccatgcagctgcgcatctatgaaattgaggacaggaccagggtgcagcccaagttccgctaccccttctactatgagatgtgctggtacgtgctggagcgctacgtgtactgtgtgacccagaggagccacctgacccaggagtaccagcgggagagcatgctgattgatgcccccaggaagcccagcattgatggcttcagcagtgacagctggctggagatggaggaggaggcctgtgaccagcagccccaggaggaggaggagaaggatgaggagggggagggccgggaccgggcccccaagccacccacagatggcagcaccagccccaccagcaccccatctgaggaccaggaggccctgggcaagaagcccaaggccccagccctgcgcttcctgaagaggaccctgagcaatgaaagtgaggagagcgtgaagagcaccaccctggccgtggactaccccaagacccccaccggcagccctgccacagaggtgtctgccaagtggacccacctgacagaatttgagctgaagggcctgaaggccctggtggagaagctggagagcctgcctgagaacaagaagtgtgtgcctgagggcatcgaggacccccaggccctgctggagggcgtgaagaatgtgctgaaggagcacgcagatgatgaccccagcctggccatcactggagtgcctgtggtgacctggcccaagaagacccccaagaacagagctgtgggccggcccaagggcaagctgggccctgccagcgctgtgaagctggccgccaacagaaccacagctggggccaggagaagaaggacccgctgcaggaaatgtgaggcctgcctgaggacagaatgtggggagtgccacttctgcaaggacatgaagaagtttggaggccctggccgcatgaagcagagctgcatcatgaggcagtgcatcgcccctgtgctgccccacacagctgtgtgcctggtgtgtggggaggccggcaaggaggacacagtggaggaggaggagggcaagttcaacctgatgctgatggagtgcagcatctgcaatgagatcatccaccctggctgcctgaagatcaaggagagcgagggcgtggtgaatgatgagctgcccaactgctgggagtgccccaagtgcaaccacgccggcaagacaggcaaggcctacaagcagaagaggggccctggcttcaagtatgccagcaacctgcccggcagcctgctgaaggagcagaagatgaacagagacaacaaggagggccaggagcccgccaagagaagaagtgaatgtgaggaggcccccaggagaagaagtgatgagcacagcaagaaggtgcccccagatggcctgctgcggaggaagagtgatgatgtgcacctgaggaagaagaggaaatatgagaagccccaggagctgagcggcaggaagagggccagcagcctgcagaccagccctggcagcagcagccacctgagcccccggccccccctgggcagcagcctgagcccctggtggaggagcagcctgacctacttccagcagcagctgaagccaggcaaggaggacaagctgttcaggaagaagaggaggtcctggaagaatgctgaggacaggatggccctggccaacaagcccctgcggcgcttcaagcaggagccagaagatgagctgcctgaggccccacccaagacccgggagagtgaccacagccgcagcagcagccccacagctggccccagcacagagggcgctgagggccctgaggagaagaagaaggtgaagatgaggaggaagaggcggctgcccaacaaggagctgagccgggagctgagcaaggagctgaaccacgagatccagaggacagagaacagcctggccaatgaaaaccagcagcccatcaagtctgagcctgagagcgagggggaggagcccaagaggcctcctggcatctgtgagcggccccaccgcttcagcaagggcctgaatggcaccccccgggagctgcggcaccagctgggccccagcctgcggagcccccccagggtcatcagccggcccccacccagcgtgtccccacccaagtgcatccagatggagcggcacgtgatccggcccccacccatcagccccccaccagacagcctgcccctggatgatggagctgcccacgtgatgcaccgggaggtgtggatggctgtgttctcctacctgagccaccaggacctgtgtgtgtgcatgagggtgtgcaggacctggaaccgctggtgctgtgacaagaggctgtggaccagaattgacctgaaccactgcaagagcatcacccccctgatgctgagcggcatcatccggcggcagcctgtgtccctggacctgtcctggaccaacatcagcaagaagcagctgtcctggctgatcaaccggctgcccggcctgcgggacctggtgctgagcggctgctcctggattgctgtgtctgccctgtgcagcagcagctgccccctgctgcggaccctggatgtgcagtgggtggagggcctgaaggatgcccagatgagggacctgctgagccccccaacagacaaccggcccggccagatggacaacagaagcaagctgaggaacatcgtggagctgcggctggccggcctggacatcacagatgccagcctgcggctcatcatccgccacatgcccctgctgagcaagctgcacctgagctactgcaaccacgtgacagaccagagcatcaacctgctgacagctgtgggcaccaccacccgggacagcctgacagagatcaacctgagcggcttctttgtgggccgggtgtttggcctgcagttctggggcatctgtgagccccaggccaggaagaatgccggctgggcctag

SEQ ID NO: 15956 - DNA, 3798 bp, Artificial Sequence
  Description of Artificial Sequence: Synthetic coding sequence
atggaggccgagaaggacagcggccgccgcctgcggcccatcgaccggcagagatatgatgaaaatgaagacctgagtgatgtggaggagatcgtgtctgtgcggggcttcagcctggaggagaagctgcggagccagctgtaccagggcgactttgtgcacgccatggagggcaaggacttcaactatgaatatgtgcagcgggaggccctgcgggtgcccctcatcttccgggagaaggatggcctgggcatcaagatgccagaccctgacttcaccgtgagagatgtgaagctgctggtgggcagccggcggctggtggatgtgatggatgtgaacacccagaagggcacagagatgtccatgagccagtttgtgcgctactatgagaccccagaggcccagagggacaagctgtacaacgtcatcagcctggagttcagccacaccaagctggagcacctggtgaagaggcccaccgtggtggacctggtggactgggtggacaacatgtggccccagcacctgaaggagaagcagacagaggccaccaatgccatcgccgagatgaagtaccccaaggtgaagaagtactgcctgatgtctgtgaagggctgcttcacagacttccacatcgactttggaggcacctctgtgtggtaccacgtgttccggggcggcaagatcttctggctgatcccccccaccctgcacaacctggccctgtatgaggagtgggtgctgagcggcaagcagagcgacatcttcctgggggacagagtggagcgctgccagagaattgagctgaagcagggctacaccttcttcatccccagcggctggattcatgctgtgtacacccctgtggacagcctggtgtttggaggcaacatcctgcacagcttcaacgtgcccatgcagctgcgcatctatgaaattgaggacaggaccagggtgcagcccaagttccgctaccccttctactatgagatgtgctggtacgtgctggagagatatgtgtactgtgtgacccagaggagccacctgacccaggagtaccagcgggagagcatgctgattgatgcccccaggaagcccagcattgatggcttcagcagtgacagctggctggagatggaggaggaggcctgtgaccagcagccccaggaggaggaggagaaggatgaggagggggagggccgggaccgggcccccaagcccccaacagatggcagcaccagccccaccagcacccccagcgaggaccaggaggccctgggcaagaagcccaaggccccagccctgcgcttcctgaagaggaccctgagcaatgaaagtgaggagagcgtgaagagcaccaccctggccgtggactaccccaagacccccaccggcagccctgccacagaggtgtctgccaagtggacccacctgacagaatttgagctgaagggcctgaaggccctggtggagaagctggagagcctgcctgagaacaagaagtgtgtgcctgagggcatcgaggacccccaggccctgctggagggcgtgaagaatgtgctgaaggagcacgcagatgatgaccccagcctggccatcaccggggtgcctgtggtgacctggcccaagaagacccccaagaacagagctgtgggccggcccaagggcaagctgggccctgccagcgctgtgaagctggccgccaacagaaccacagctggggccaggagaagaaggacccgctgcaggaaatgtgaggcctgcctgaggacagaatgtggggagtgccacttctgcaaggacatgaagaagtttggaggccctggccgcatgaagcagagctgcatcatgaggcagtgcatcgcccctgtgctgccccacacagctgtgtgcctggtgtgtggggaggccggcaaggaggacacagtggaggaggaggagggcaagttcaacctgatgctgatggagtgcagcatctgcaatgagatcatccaccctggctgcctgaagatcaaggagagcgagggcgtggtgaatgatgagctgcccaactgctgggagtgccccaagtgcaaccacgccggcaagacaggcaagcagaagaggggccctggcttcaagtatgccagcaacctgcccggcagcctgctgaaggagcagaagatgaacagagacaacaaggagggccaggagcccgccaagagaagaagtgaatgtgaggaggcccccaggagaagaagtgatgagcacagcaagaaggtgcccccagatggcctgctgcggaggaagagtgatgatgtgcacctgaggaagaagaggaaatatgagaagccccaggagctgagcggcaggaagaggctgaagccaggcaaggaggacaagctgttcaggaagaagaggaggtcctggaagaatgctgaggacaggatggccctggccaacaagcccctgcggcgcttcaagcaggagccagaagatgagctgcctgaggccccacccaagacccgggagagtgaccacagccgcagcagcagccccacagctggccccagcacagagggcgctgagggccctgaggagaagaagaaggtgaagatgaggaggaagaggcggctgcccaacaaggagctgagccgggagctgagcaaggagctgaaccacgagatccagaggacagagaacagcctggccaatgaaaaccagcagcccatcaagtctgagcctgagagcgagggggaggagcccaagaggcctcctggcatctgtgagcggccccaccgcttcagcaagggcctgaatggcaccccccgggagctgcggcaccagctgggccccagcctgcggagcccccccagggtcatcagccggcccccacccagcgtgtccccacccaagtgcatccagatggagcggcacgtgatccggcccccacccatcagccccccaccagacagcctgcccctggatgatggagctgcccacgtgatgcaccgggaggtgtggatggctgtgttctcctacctgagccaccaggacctgtgtgtgtgcatgagggtgtgcaggacctggaaccgctggtgctgtgacaagaggctgtggaccagaattgacctgaaccactgcaagagcatcacccccctgatgctgagcggcatcatccggcggcagcctgtgtccctggacctgtcctggaccaacatcagcaagaagcagctgtcctggctgatcaaccggctgcccggcctgcgggacctggtgctgagcggctgctcctggattgctgtgtctgccctgtgcagcagcagctgccccctgctgcggaccctggatgtgcagtgggtggagggcctgaaggatgcccagatgagggacctgctgagccccccaacagacaaccggcccggccagatggacaacagaagcaagctgaggaacatcgtggagctgcggctggccggcctggacatcacagatgccagcctgcggctcatcatccgccacatgcccctgctgagcaagctgcacctgagctactgcaaccacgtgacagaccagagcatcaacctgctgacagctgtgggcaccaccacccgggacagcctgacagagatcaacctgagtgactgcaacaaggtgacagaccagtgcctgtccttcttcaagagatgtggcaacatctgccacatcgacctgcgctactgcaagcaggtgaccaaggagggctgtgagcagttcatcgccgagatgagcagcttccagggccgcagctgcagcaccacccggctgggagatgaatag

SEQ ID NO: 15957 - DNA, 4011 bp, Artificial Sequence
  Description of Artificial Sequence: Synthetic coding sequence
atggccggcccccagatgggcggcagcgctgaggaccacccccccaggaagagacatgctgctgagaagcagaagaagaagacagtcatctacaccaagtgctttgaatttgaaagtgccacccagaggcccatcgaccggcagagatatgatgaaaatgaagacctgagtgatgtggaggagatcgtgtctgtgcggggcttcagcctggaggagaagctgcggagccagctgtaccagggcgactttgtgcacgccatggagggcaaggacttcaactatgaatatgtgcagcgggaggccctgcgggtgcccctcatcttccgggagaaggatggcctgggcatcaagatgccagaccctgacttcaccgtgagagatgtgaagctgctggtgggcagccggcggctggtggatgtgatggatgtgaacacccagaagggcacagagatgtccatgagccagtttgtgcgctactatgagaccccagaggcccagagggacaagctgtacaacgtcatcagcctggagttcagccacaccaagctggagcacctggtgaagaggcccaccgtggtggacctggtggactgggtggacaacatgtggccccagcacctgaaggagaagcagacagaggccaccaatgccatcgccgagatgaagtaccccaaggtgaagaagtactgcctgatgtctgtgaagggctgcttcacagacttccacatcgactttggaggcacctctgtgtggtaccacgtgttccggggcggcaagatcttctggctgatcccccccaccctgcacaacctggccctgtatgaggagtgggtgctgagcggcaagcagagcgacatcttcctgggggacagagtggagcgctgccagagaattgagctgaagcagggctacaccttcttcatccccagcggctggattcatgctgtgtacacccctgtggacagcctggtgtttggaggcaacatcctgcacagcttcaacgtgcccatgcagctgcgcatctatgaaattgaggacaggaccagggtgcagcccaagttccgctaccccttctactatgagatgtgctggtacgtgctggagcgctacgtgtactgtgtgacccagaggagccacctgacccaggagtaccagcgggagagcatgctgattgatgcccccaggaagcccagcattgatggcttcagcagtgacagctggctggagatggaggaggaggcctgtgaccagcagccccaggaggaggaggagaaggatgaggagggggagggccgggaccgggcccccaagccacccacagatggcagcaccagccccaccagcaccccatctgaggaccaggaggccctgggcaagaagcccaaggccccagccctgcgcttcctgaagaggaccctgagcaatgaaagtgaggagagcgtgaagagcaccaccctggccgtggactaccccaagacccccaccggcagccctgccacagaggtgtctgccaagtggacccacctgacagaatttgagctgaagggcctgaaggccctggtggagaagctggagagcctgcctgagaacaagaagtgtgtgcctgagggcatcgaggacccccaggccctgctggagggcgtgaagaatgtgctgaaggagcacgcagatgatgaccccagcctggccatcactggagtgcctgtggtgacctggcccaagaagacccccaagaacagagctgtgggccggcccaagggcaagctgggccctgccagcgctgtgaagctggccgccaacagaaccacagctggggccaggagaagaaggacccgctgcaggaaatgtgaggcctgcctgaggacagaatgtggggagtgccacttctgcaaggacatgaagaagtttggaggccctggccgcatgaagcagagctgcatcatgaggcagtgcatcgcccctgtgctgccccacacagctgtgtgcctggtgtgtggggaggccggcaaggaggacacagtggaggaggaggagggcaagttcaacctgatgctgatggagtgcagcatctgcaatgagatcatccaccctggctgcctgaagatcaaggagagcgagggcgtggtgaatgatgagctgcccaactgctgggagtgccccaagtgcaaccacgccggcaagacaggcaagcagaagaggggccctggcttcaagtatgccagcaacctgcccggcagcctgctgaaggagcagaagatgaacagagacaacaaggagggccaggagcccgccaagagaagaagtgaatgtgaggaggccccccggcggcggagtgatgagcacagcaagaaggtgcccccagatggcctgctgcggaggaagagtgatgatgtgcacctgaggaagaagaggaaatatgagaagccccaggagctgagcggcaggaagagggccagcagcctgcagaccagccctggcagcagcagccacctgagccccaggcctcccctgggcagcagcctgagcccctggtggaggagcagcctgacctacttccagcagcagctgaagccaggcaaggaggacaagctgttcaggaagaagagaagatcctggaagaatgctgaggacaggatggccctggccaacaagcccctgcggcgcttcaagcaggagccagaagatgagctgcctgaggccccacccaagacccgggagagtgaccacagccgcagcagcagccccacagctggccccagcacagaaggagctgagggccctgaggagaagaagaaggtgaagatgaggaggaagaggcggctgcccaacaaggagctgagccgggagctgagcaaggagctgaaccacgagatccagaggacagagaacagcctggccaatgaaaaccagcagcccatcaagtctgagcctgagagcgagggggaggagcccaagaggcctcctggcatctgtgagcggccccaccgcttcagcaagggcctgaatggcaccccccgggagctgcggcaccagctgggccccagcctgcggagcccccccagggtcatcagccggcccccaccttctgtgagcccccccaagtgcatccagatggagagacatgtgatccggcccccacccatcagccccccaccagacagcctgcccctggatgatggagctgcccacgtgatgcaccgggaggtgtggatggctgtgttctcctacctgagccaccaggacctgtgtgtgtgcatgagggtgtgcaggacctggaaccgctggtgctgtgacaagaggctgtggaccagaattgacctgaaccactgcaagagcatcacccccctgatgctgagcggcatcatccggcggcagcctgtgtccctggacctgtcctggaccaacatcagcaagaagcagctgtcctggctgatcaaccggctgcccggcctgcgggacctggtgctgagcggctgctcctggattgctgtgtctgccctgtgcagcagcagctgccccctgctgcggaccctggatgtgcagtgggtggagggcctgaaggatgcccagatgagggacctgctgagccccccaacagacaacagacctggccagatggacaacagaagcaagctgagaaatattgtggagctgcggctggccggcctggacatcacagatgccagcctgcggctcatcatccgccacatgcccctgctgagcaagctgcacctgagctactgcaaccacgtgacagaccagagcatcaacctgctgacagctgtgggcaccaccacccgggacagcctgacagagatcaacctgagtgactgcaacaaggtgacagaccagtgcctgtccttcttcaagagatgtggcaacatctgccacatcgacctgcgctactgcaagcaggtgaccaaggagggctgtgagcagttcatcgccgagatgtctgtgtctgtgcagtttggccaggtggaggagaagctgctgcagaagctgtcctag

SEQ ID NO: 15958 - DNA, 2121 bp, Artificial Sequence
  Description of Artificial Sequence: Synthetic coding sequence
atggccggcccccagatgggcggcagcgctgaggaccacccccccaggaagagacatgctgctgagaagcagaagaagaagacagtcatctacaccaagtgctttgaatttgaaagtgccacccagaggcccatcgaccggcagagatatgatgaaaatgaagacctgagtgatgtggaggagatcgtgtctgtgcggggcttcagcctggaggagaagctgcggagccagctgtaccagggcgactttgtgcacgccatggagggcaaggacttcaactatgaatatgtgcagcgggaggccctgcgggtgcccctcatcttccgggagaaggatggcctgggcatcaagatgccagaccctgacttcaccgtgagagatgtgaagctgctggtgggcagccggcggctggtggatgtgatggatgtgaacacccagaagggcacagagatgtccatgagccagtttgtgcgctactatgagaccccagaggcccagagggacaagctgtacaacgtcatcagcctggagttcagccacaccaagctggagcacctggtgaagaggcccaccgtggtggacctggtggactgggtggacaacatgtggccccagcacctgaaggagaagcagacagaggccaccaatgccatcgccgagatgaagtaccccaaggtgaagaagtactgcctgatgtctgtgaagggctgcttcacagacttccacatcgactttggaggcacctctgtgtggtaccacgtgttccggggcggcaagatcttctggctgatcccccccaccctgcacaacctggccctgtatgaggagtgggtgctgagcggcaagcagagcgacatcttcctgggggacagagtggagcgctgccagagaattgagctgaagcagggctacaccttcttcatccccagcggctggattcatgctgtgtacacccctgtggacagcctggtgtttggaggcaacatcctgcacagcttcaacgtgcccatgcagctgcgcatctatgaaattgaggacaggaccagggtgcagcccaagttccgctaccccttctactatgagatgtgctggtacgtgctggagcgctacgtgtactgtgtgacccagaggagccacctgacccaggagtaccagcgggagagcatgctgattgatgcccccaggaagcccagcattgatggcttcagcagtgacagctggctggagatggaggaggaggcctgtgaccagcagccccaggaggaggaggagaaggatgaggagggggagggccgggaccgggcccccaagccacccacagatggcagcaccagccccaccagcaccccatctgaggaccaggaggccctgggcaagaagcccaaggccccagccctgcgcttcctgaagaggaccctgagcaatgaaagtgaggagagcgtgaagagcaccaccctggccgtggactaccccaagacccccaccggcagccctgccacagaggtgtctgccaagtggacccacctgacagaatttgagctgaagggcctgaaggccctggtggagaagctggagagcctgcctgagaacaagaagtgtgtgcctgagggcatcgaggacccccaggccctgctggagggcgtgaagaatgtgctgaaggagcacgcagatgatgaccccagcctggccatcactggagtgcctgtggtgacctggcccaagaagacccccaagaacagagctgtgggccggcccaagggcaagctgggccctgccagcgctgtgaagctggccgccaacagaaccacagctggggccaggagaagaaggacccgctgcaggaaatgtgaggcctgcctgaggacagaatgtggggagtgccacttctgcaaggacatgaagaagtttggaggccctggccgcatgaagcagagctgcatcatgaggcagtgcatcgcccctgtgctgccccacacagctgtgtgcctggtgtgtggggaggccggcaaggaggacacagtggaggaggaggagggcaagttcaacctgatgctgatggagtgcagcatctgcaatgagatcatccaccctggctgcctgaagagggaccagcctgtgtag

SEQ ID NO: 15959 - DNA, 3981 bp, Artificial Sequence
  Description of Artificial Sequence: Synthetic coding sequence
atggccggcccccagatgggcggcagcgctgaggaccacccccccaggaagagacatgctgctgagaagcagaagaagaagacagtcatctacaccaagtgctttgaatttgaaagtgccacccagaggcccatcgaccggcagagatatgatgaaaatgaagacctgagtgatgtggaggagatcgtgtctgtgcggggcttcagcctggaggagaagctgcggagccagctgtaccagggcgactttgtgcacgccatggagggcaaggacttcaactatgaatatgtgcagcgggaggccctgcgggtgcccctcatcttccgggagaaggatggcctgggcatcaagatgccagaccctgacttcaccgtgagagatgtgaagctgctggtgggcagccggcggctggtggatgtgatggatgtgaacacccagaagggcacagagatgtccatgagccagtttgtgcgctactatgagaccccagaggcccagagggacaagctgtacaacgtcatcagcctggagttcagccacaccaagctggagcacctggtgaagaggcccaccgtggtggacctggtggactgggtggacaacatgtggccccagcacctgaaggagaagcagacagaggccaccaatgccatcgccgagatgaagtaccccaaggtgaagaagtactgcctgatgtctgtgaagggctgcttcacagacttccacatcgactttggaggcacctctgtgtggtaccacgtgttccggggcggcaagatcttctggctgatcccccccaccctgcacaacctggccctgtatgaggagtgggtgctgagcggcaagcagagcgacatcttcctgggggacagagtggagcgctgccagagaattgagctgaagcagggctacaccttcttcatccccagcggctggattcatgctgtgtacacccctgtggacagcctggtgtttggaggcaacatcctgcacagcttcaacgtgcccatgcagctgcgcatctatgaaattgaggacaggaccagggtgcagcccaagttccgctaccccttctactatgagatgtgctggtacgtgctggagcgctacgtgtactgtgtgacccagaggagccacctgacccaggagtaccagcgggagagcatgctgattgatgcccccaggaagcccagcattgatggcttcagcagtgacagctggctggagatggaggaggaggcctgtgaccagcagccccaggaggaggaggagaaggatgaggagggggagggccgggaccgggcccccaagccacccacagatggcagcaccagccccaccagcaccccatctgaggaccaggaggccctgggcaagaagcccaaggccccagccctgcgcttcctgaagaggaccctgagcaatgaaagtgaggagagcgtgaagagcaccaccctggccgtggactaccccaagacccccaccggcagccctgccacagaggtgtctgccaagtggacccacctgacagaatttgagctgaagggcctgaaggccctggtggagaagctggagagcctgcctgagaacaagaagtgtgtgcctgagggcatcgaggacccccaggccctgctggagggcgtgaagaatgtgctgaaggagcacgcagatgatgaccccagcctggccatcactggagtgcctgtggtgacctggcccaagaagacccccaagaacagagctgtgggccggcccaagggcaagctgggccctgccagcgctgtgaagctggccgccaacagaaccacagctggggccaggagaagaaggacccgctgcaggaaatgtgaggcctgcctgaggacagaatgtggggagtgccacttctgcaaggacatgaagaagtttggaggccctggccgcatgaagcagagctgcatcatgaggcagtgcatcgcccctgtgctgccccacacagctgtgtgcctggtgtgtggggaggccggcaaggaggacacagtggaggaggaggagggcaagttcaacctgatgctgatggagtgcagcatctgcaatgagatcatccaccctggctgcctgaagatcaaggagagcgagggcgtggtgaatgatgagctgcccaactgctgggagtgccccaagtgcaaccacgccggcaagacaggcaagcagaagaggggccctggcttcaagtatgccagcaacctgcccggcagcctgctgaaggagcagaagatgaacagagacaacaaggagggccaggagcccgccaagagaagaagtgaatgtgaggaggccccccggcggcggagtgatgagcacagcaagaaggtgcccccagatggcctgctgcggaggaagagtgatgatgtgcacctgaggaagaagaggaaatatgagaagccccaggagctgagcggcaggaagagggccagcagcctgcagaccagccctggcagcagcagccacctgagccccaggcctcccctgggcagcagcctgagcccctggtggaggagcagcctgacctacttccagcagcagcagaggaggtcctggaagaatgctgaggacaggatggccctggccaacaagcccctgcggcgcttcaagcaggagccagaagatgagctgcctgaggccccacccaagacccgggagagtgaccacagccgcagcagcagccccacagctggccccagcacagaaggagctgagggccctgaggagaagaagaaggtgaagatgaggaggaagaggcggctgcccaacaaggagctgagccgggagctgagcaaggagctgaaccacgagatccagaggacagagaacagcctggccaatgaaaaccagcagcccatcaagtctgagcctgagagcgagggggaggagcccaagaggcctcctggcatctgtgagcggccccaccgcttcagcaagggcctgaatggcaccccccgggagctgcggcaccagctgggccccagcctgcggagcccccccagggtcatcagccggcccccaccttctgtgagcccccccaagtgcatccagatggagagacatgtgatccggcccccacccatcagccccccaccagacagcctgcccctggatgatggagctgcccacgtgatgcaccgggaggtgtggatggctgtgttctcctacctgagccaccaggacctgtgtgtgtgcatgagggtgtgcaggacctggaaccgctggtgctgtgacaagaggctgtggaccagaattgacctgaaccactgcaagagcatcacccccctgatgctgagcggcatcatccggcggcagcctgtgtccctggacctgtcctggaccaacatcagcaagaagcagctgtcctggctgatcaaccggctgcccggcctgcgggacctggtgctgagcggctgctcctggattgctgtgtctgccctgtgcagcagcagctgccccctgctgcggaccctggatgtgcagtgggtggagggcctgaaggatgcccagatgagggacctgctgagccccccaacagacaacagacctgcccctggccagatggacaacagaagcaagctgagaaatattgtggagctgcggctggccggcctggacatcacagatgccagcctgcggctcatcatccgccacatgcccctgctgagcaagctgcacctgagctactgcaaccacgtgacagaccagagcatcaacctgctgacagctgtgggcaccaccacccgggacagcctgacagagatcaacctgagtgactgcaacaaggtgacagaccagtgcctgtccttcttcaagagatgtggcaacatctgccacatcgacctgcgctactgcaagcaggtgaccaaggagggctgtgagcagttcatcgccgagatgtctgtgtctgtgcagtttggccaggtggaggagaagctgctgcagaagctgtcctag

SEQ ID NO: 15960 - DNA, 1680 bp, Artificial Sequence
  Description of Artificial Sequence: Synthetic coding sequence
atgccagaccctgacttcaccgtgagagatgtgaagctgctggtgggcagccggcggctggtggatgtgatggatgtgaacacccagaagggcacagagatgtccatgagccagtttgtgcgctactatgagaccccagaggcccagagggacaagctgtacaacgtcatcagcctggagttcagccacaccaagctggagcacctggtgaagaggcccaccgtggtggacctggtggactgggtggacaacatgtggccccagcacctgaaggagaagcagacagaggccaccaatgccatcgccgagatgaagtaccccaaggtgaagaagtactgcctgatgtctgtgaagggctgcttcacagacttccacatcgactttggaggcacctctgtgtggtaccacgtgttccggggcggcaagatcttctggctgatcccccccaccctgcacaacctggccctgtatgaggagtgggtgctgagcggcaagcagagcgacatcttcctgggggacagagtggagcgctgccagagaattgagctgaagcagggctacaccttcttcatccccagcggctggattcatgctgtgtacacccctgtggacagcctggtgtttggaggcaacatcctgcacagcttcaacgtgcccatgcagctgcgcatctatgaaattgaggacaggaccagggtgcagcccaagttccgctaccccttctactatgagatgtgctggtacgtgctggagagatatgtgtactgtgtgacccagaggagccacctgacccaggagtaccagcgggagagcatgctgattgatgcccccaggaagcccagcattgatggcttcagcagtgacagctggctggagatggaggaggaggcctgtgaccagcagccccaggaggaggaggagaaggatgaggagggggagggccgggaccgggcccccaagcccccaacagatggcagcaccagccccaccagcacccccagcgaggaccaggaggccctgggcaagaagcccaaggccccagccctgcgcttcctgaagaggaccctgagcaatgaaagtgaggagagcgtgaagagcaccaccctggccgtggactaccccaagacccccaccggcagccctgccacagaggtgtctgccaagtggacccacctgacagaatttgagctgaagggcctgaaggccctggtggagaagctggagagcctgcctgagaacaagaagtgtgtgcctgagggcatcgaggacccccaggccctgctggagggcgtgaagaatgtgctgaaggagcacgcagatgatgaccccagcctggccatcaccggggtgcctgtggtgacctggcccaagaagacccccaagaacagagctgtgggccggcccaagggcaagctgggccctgccagcgctgtgaagctggccgccaacagaaccacagctggggccaggagaagaaggacccgctgcaggaaatgtgaggcctgcctgaggacagaatgtggggagtgccacttctgcaaggacatgaagaagtttggaggccctggccgcatgaagcagagctgcatcatgaggcagtgcatcgccacagccatccgcagcctcatcagcgcctgccccagcagcaatgctgtggagaccagcgtcatcctgacctag

SEQ ID NO: 15961 - DNA, 2340 bp, Artificial Sequence
  Description of Artificial Sequence: Synthetic coding sequence
atggccatgtctgtgtctgcagaagatgatgattatgagagcgagccagaccagaacagagctgtgggccggcccaagggcaagctgggccctgccagcgctgtgaagctggccgccaacagaaccacagctggggccaggagaagaaggacccgctgcaggaaatgtgaggcctgcctgaggacagaatgtggggagtgccacttctgcaaggacatgaagaagtttggaggccctggccgcatgaagcagagctgcatcatgaggcagtgcatcgcccctgtgctgccccacacagctgtgtgcctggtgtgtggggaggccggcaaggaggacacagtggaggaggaggagggcaagttcaacctgatgctgatggagtgcagcatctgcaatgagatcatccaccctggctgcctgaagatcaaggagagcgagggcgtggtgaatgatgagctgcccaactgctgggagtgccccaagtgcaaccacgccggcaagacaggcaaggcctacaagcagaagaggggccctggcttcaagtatgccagcaacctgcccggcagcctgctgaaggagcagaagatgaacagagacaacaaggagggccaggagcccgccaagagaagaagtgaatgtgaggaggcccccaggagaagaagtgatgagcacagcaagaaggtgcccccagatggcctgctgcggaggaagagtgatgatgtgcacctgaggaagaagaggaaatatgagaagccccaggagctgagcggcaggaagagggccagcagcctgcagaccagccctggcagcagcagccacctgagcccccggccccccctgggcagcagcctgagcccctggtggaggagcagcctgacctacttccagcagcagctgaagccaggcaaggaggacaagctgttcaggaagaagaggaggtcctggaagaatgctgaggacaggatggccctggccaacaagcccctgcggcgcttcaagcaggagccagaagatgagctgcctgaggccccacccaagacccgggagagtgaccacagccgcagcagcagccccacagctggccccagcacagagggcgctgagggccctgaggagaagaagaaggtgaagatgaggaggaagaggcggctgcccaacaaggagctgagccgggagctgagcaaggagctgaaccacgagatccagaggacagagaacagcctggccaatgaaaaccagcagcccatcaagtctgagcctgagagcgagggggaggagcccaagaggcctcctggcatctgtgagcggccccaccgcttcagcaagggcctgaatggcaccccccgggagctgcggcaccagctgggccccagcctgcggagcccccccagggtcatcagccggcccccacccagcgtgtccccacccaagtgcatccagatggagcggcacgtgatccggcccccacccatcagccccccaccagacagcctgcccctggatgatggagctgcccacgtgatgcaccgggaggtgtggatggctgtgttctcctacctgagccaccaggacctgtgtgtgtgcatgagggtgtgcaggacctggaaccgctggtgctgtgacaagaggctgtggaccagaattgacctgaaccactgcaagagcatcacccccctgatgctgagcggcatcatccggcggcagcctgtgtccctggacctgtcctggaccaacatcagcaagaagcagctgtcctggctgatcaaccggctgcccggcctgcgggacctggtgctgagcggctgctcctggattgctgtgtctgccctgtgcagcagcagctgccccctgctgcggaccctggatgtgcagtgggtggagggcctgaaggatgcccagatgagggacctgctgagccccccaacagacaaccggcccggccagatggacaacagaagcaagctgaggaacatcgtggagctgcggctggccggcctggacatcacagatgccagcctgcggctcatcatccgccacatgcccctgctgagcaagctgcacctgagctactgcaaccacgtgacagaccagagcatcaacctgctgacagctgtgggcaccaccacccgggacagcctgacagagatcaacctgagtgactgcaacaaggtgacagaccagtgcctgtccttcttcaagagatgtggcaacatctgccacatcgacctgcgctactgcaagcaggtgaccaaggagggctgtgagcagttcatcgccgagatgtctgtgtctgtgcagtttggccaggtggaggagaagctgctgcagaagctgtcctag

SEQ ID NO: 15962 - DNA, 3291 bp, Artificial Sequence
  Description of Artificial Sequence: Synthetic coding sequence
atgggcagcgaggaccacggggcccagaaccccagctgcaagatcatgaccttccggcccaccatggaggagttcaaggacttcaacaagtatgtggcctacatcgagagccagggcgcccacagagctggcctggccaagatcatcccccccaaggagtggaagccccggcagacctatgatgacattgatgatgtggtgatcccagcccccatccagcaggtggtgacaggccagagcggcctcttcacccagtacaacatccagaagaaggccatgacagtgggggagtacagaaggctggccaacagcgagaagtactgcacccccaggcaccaggactttgatgacctggagaggaagtactggaagaacctgacctttgtgagccccatctatggagctgacatcagcggcagcctgtatgatgatgatgtggcccagtggaacatcggcagcctgcggaccatcctggacatggtggagcgggagtgtggcaccatcattgaaggagtgaacaccccctacctgtacttcggcatgtggaagaccacctttgcctggcacacagaggacatggacctgtacagcatcaactacctgcactttggagagcccaagtcctggtacgccatccccccagagcacggcaagaggctggagcggctggccatcggcttcttccctggcagcagccagggctgtgatgccttcctgcggcacaagatgaccctcatcagccccatcatcctgaagaagtatggcatccccttcagccgcatcacccaggaggccggggagttcatgatcaccttcccctacggctaccacgccggcttcaaccacggcttcaactgtgccgagagcaccaactttgccaccctgcgctggattgattatggcaaggtggccacccagtgcacctgcaggaaggacatggtgaagatctccatggatgtgtttgtgcgcatcctgcagcctgagagatatgagctgtggaagcagggcaaggacctgactgtgctggaccacacccggcccacagccctgaccagccctgagctgagctcctggagcgccagccgggccagcctgaaggccaagctgctgcggcgcagccacaggaagaggagccagcccaagaagcccaagccagaggaccccaagtttcctggagagggcacagctggggccgccctgctggaggaggccggcggctctgtgaaggaggaggccggccctgaggtggaccctgaggaggaggaggaggagccccagcccctgccccacggccgggaggccgagggcgcagaagaagatggccggggcaagctgcggcccaccaaggccaagtctgagaggaagaagaagagctttggcctgctgcccccccagctgcccccacctccagcccacttccccagcgaggaggccctgtggctgcccagccccctggagccccctgtgctgggccctggccctgctgccatggaggagagccccctgcctgcccccctgaatgtggtgcccccagaggtgcccagcgaggagctggaggccaagccccggcccatcatccccatgctgtatgtggtgcccaggcctgggaaggccgccttcaaccaggagcacgtgtcctgccagcaggcctttgagcactttgcccagaagggccccacctggaaggagcctgtgagccccatggagctgactggaccagaagatggagctgccagcagcggggccggccgcatggagaccaaggcccgggccggggagggccaggcccccagcaccttcagcaagctgaagatggagatcaagaagagcagaagacaccccctgggccggccccccaccaggagccccctgtctgtggtgaagcaggaggccagcagtgatgaggaggccagccccttctctggagaggaggatgtgtctgaccctgatgccctgcggcccctgctgagcctgcagtggaagaacagagctgccagcttccaggccgagaggaagttcaatgctgctgctgccaggacagagccctactgtgccatctgcaccctcttctacccctactgccaggccctgcagacagagaaggaggcccccatcgccagcctgggcaagggctgcccagccaccctgcccagcaagagccggcagaagacccggcccctcatccctgagatgtgcttcaccagcggcggggagaacacagagcccctgcctgccaacagctacatcggagatgatggcaccagccccctcatcgcctgtgggaagtgctgcctgcaggtgcacgccagctgctacggcatccggcctgagctggtgaatgaaggctggacctgcagccgctgtgccgcccacgcctggacagctgagtgctgcctgtgcaacctgcggggcggggccctgcagatgaccacagaccggcgctggattcatgtgatctgtgccatcgctgtgcctgaggcccgcttcctgaatgtgattgagcggcaccctgtggacatcagcgccatccctgagcagcgctggaagctgaagtgtgtgtactgcaggaagaggatgaagaaggtgtctggggcctgcatccagtgcagctatgagcactgcagcaccagcttccacgtgacctgtgcccatgctgctggggtgctgatggagccagatgactggccctacgtggtgtccatcacctgcctgaagcacaagagcggcggccatgctgtgcagctgctgcgggctgtgtccctgggccaggtggtgatcaccaagaacagaaatggcctgtactaccgctgcagggtcatcggggccgccagccagacctgctatgaggtgaactttgatgatggcagctacagcgacaacctgtacccagagagcatcaccagccgggactgtgtgcagctgggcccccccagcgagggggagctggtggagctgcgctggacagatggcaacctgtacaaggccaagttcatcagctctgtgaccagccacatctaccaggtggagtttgaagatggcagccagctgactgtgaagagaggagacatcttcaccctggaggaggagctgcccaagagggtgcgcagccggctgagcctgagcactggagccccccaggagcccgccttctctggagaggaggccaaggccgccaagaggccccgggtgggcacccccctggccacagaggacagcggccgcagccaggactatgtggcctttgtggagagcctgctgcaggtgcagggccggcctggggcccccttctag

SEQ ID NO: 15963 - DNA, 1347 bp, Artificial Sequence
  Description of Artificial Sequence: Synthetic coding sequence
atgggcagcgaggaccacggggcccagaaccccagctgcaagatcatgaccttccggcccaccatggaggagttcaaggacttcaacaagtatgtggcctacatcgagagccagggcgcccacagagctggcctggccaagatcatcccccccaaggagtggaagccccggcagacctatgatgacattgatgatgtggtgatcccagcccccatccagcaggtggtgacaggccagagcggcctcttcacccagtacaacatccagaagaaggccatgacagtgggggagtacagaaggctggccaacagcgagaagtactgcacccccaggcaccaggactttgatgacctggagaggaagtactggaagaacctgacctttgtgagccccatctatggagctgacatcagcggcagcctgtatgatgatgatgtggcccagtggaacatcggcagcctgcggaccatcctggacatggtggagcgggagtgtggcaccatcattgaaggagtgaacaccccctacctgtacttcggcatgtggaagaccacctttgcctggcacacagaggacatggacctgtacagcatcaactacctgcactttggagagcccaagtcctggtacgccatccccccagagcacggcaagaggctggagcggctggccatcggcttcttccctggcagcagccagggctgtgatgccttcctgcggcacaagatgaccctcatcagccccatcatcctgaagaagtatggcatccccttcagccgcatcacccaggaggccggggagttcatgatcaccttcccctacggctaccacgccggcttcaaccacggcttcaactgtgccgagagcaccaactttgccaccctgcgctggattgattatggcaaggtggccacccagtgcacctgcaggaaggacatggtgaagatctccatggatgtgtttgtgcgcatcctgcagcctgagagatatgagctgtggaagcagggcaaggacctgactgtgctggaccacacccggcccacagccctgaccagccctgagctgagctcctggagcgccagccgggccagcctgaaggccaagctgctgcggaggaccccaccctgtgtgagcccccaccggcccagccagcccggcatctggtgccccccaggaggagaggccaaggccagcgctgcctcctggctgctgaccacccggggccatggagacacagaggccggccctggcctgggcggggaccccctgcacgcccagagcgagggccaggccagctgtgtgtccaccagccggctgaggatggccacccaggacccctgcaggtag

SEQ ID NO: 15964 - DNA, 3393 bp, Artificial Sequence
  Description of Artificial Sequence: Synthetic coding sequence
atgggcagcgaggaccacggggcccagaaccccagctgcaagatcatgaccttccggcccaccatggaggagttcaaggacttcaacaagtatgtggcctacatcgagagccagggcgcccacagagctggcctggccaagatcatcccccccaaggagtggaagccccggcagacctatgatgacattgatgatgtggtgatcccagcccccatccagcaggtggtgacaggccagagcggcctcttcacccagtacaacatccagaagaaggccatgacagtgggggagtacagaaggctggccaacagcgagaagtactgcacccccaggcaccaggactttgatgacctggagaggaagtactggaagaacctgacctttgtgagccccatctatggagctgacatcagcggcagcctgtatgatgatgatgtggcccagtggaacatcggcagcctgcggaccatcctggacatggtggagcgggagtgtggcaccatcattgaaggagtgaacaccccctacctgtacttcggcatgtggaagaccacctttgcctggcacacagaggacatggacctgtacagcatcaactacctgcactttggagagcccaagtcctggtacgccatccccccagagcacggcaagaggctggagcggctggccatcggcttcttccctggcagcagccagggctgtgatgccttcctgcggcacaagatgaccctcatcagccccatcatcctgaagaagtatggcatccccttcagccgcatcacccaggaggccggggagttcatgatcaccttcccctacggctaccacgccggcttcaaccacggcttcaactgtgccgagagcaccaactttgccaccctgcgctggattgattatggcaaggtggccacccagtgcacctgcaggaaggacatggtgaagatctccatggatgtgtttgtgcgcatcctgcagcctgagagatatgagctgtggaagcagggcaaggacctgactgtgctggaccacacccggcccacagccctgaccagccctgagctgagctcctggagcgccagccgggccagcctgaaggccaagctgctgcggcggcagatcagcctgaaggagaacagacactggaggaagacagaggaggagaggaagcccagcctggagaggaagaaggagcagaccaagaggcctggcctgagcagccacaggaagaggagccagcccaagaagcccaagccagaggaccccaagtttcctggagagggcacagctggggccgccctgctggaggaggccggcggctctgtgaaggaggaggccggccctgaggtggaccctgaggaggaggaggaggagccccagcccctgccccacggccgggaggccgagggcgcagaagaagatggccggggcaagctgcggcccaccaaggccaagtctgagaggaagaagaagagctttggcctgctgcccccccagctgcccccacctccagcccacttccccagcgaggaggccctgtggctgcccagccccctggagccccctgtgctgggccctggccctgctgccatggaggagagccccctgcctgcccccctgaatgtggtgcccccagaggtgcccagcgaggagctggaggccaagccccggcccatcatccccatgctgtatgtggtgcccaggcctgggaaggccgccttcaaccaggagcacgtgtcctgccagcaggcctttgagcactttgcccagaagggccccacctggaaggagcctgtgagccccatggagctgactggaccagaagatggagctgccagcagcggggccggccgcatggagaccaaggcccgggccggggagggccaggcccccagcaccttcagcaagctgaagatggagatcaagaagagcagaagacaccccctgggccggccccccaccaggagccccctgtctgtggtgaagcaggaggccagcagtgatgaggaggccagccccttctctggagaggaggatgtgtctgaccctgatgccctgcggcccctgctgagcctgcagtggaagaacagagctgccagcttccaggccgagaggaagttcaatgctgctgctgccaggacagagccctactgtgccatctgcaccctcttctacccctactgccaggccctgcagacagagaaggaggcccccatcgccagcctgggcaagggctgcccagccaccctgcccagcaagagccggcagaagacccggcccctcatccctgagatgtgcttcaccagcggcggggagaacacagagcccctgcctgccaacagctacatcggagatgatggcaccagccccctcatcgcctgtgggaagtgctgcctgcaggtgcacgccagctgctacggcatccggcctgagctggtgaatgaaggctggacctgcagccgctgtgccgcccacgcctggacagctgagtgctgcctgtgcaacctgcggggcggggccctgcagatgaccacagaccggcgctggattcatgtgatctgtgccatcgctgtgcctgaggcccgcttcctgaatgtgattgagcggcaccctgtggacatcagcgccatccctgagcagcgctggaagctgaagtgtgtgtactgcaggaagaggatgaagaaggtgtctggggcctgcatccagtgcagctatgagcactgcagcaccagcttccacgtgacctgtgcccatgctgctggggtgctgatggagccagatgactggccctacgtggtgtccatcacctgcctgaagcacaagagcggcggccatgctgtgcagctgctgcgggctgtgtccctgggccaggtggtgatcaccaagaacagaaatggcctgtactaccgctgcagggtcatcggggccgccagccagacctgctatgaggtgaactttgatgatggcagctacagcgacaacctgtacccagagagcatcaccagccgggactgtgtgcagctgggcccccccagcgagggggagctggtggagctgcgctggacagatggcaacctgtacaaggccaagttcatcagctctgtgaccagccacatctaccaggtggagtttgaagatggcagccagctgactgtgaagagaggagacatcttcaccctggaggaggagctgcccaagagggtgcgcagccggctgagcctgagcactggagccccccaggagcccgccttctctggagaggaggccaaggccgccaagaggccccgggtgggcacccccctggccacagaggacagcggccgcagccaggactatgtggcctttgtggagagcctgctgcaggtgcagggccggcctggggcccccttctag

SEQ ID NO: 15965 - DNA, 3144 bp, Artificial Sequence
  Description of Artificial Sequence: Synthetic coding sequence
atggaggtggccgaggtggagagccccctgaaccccagctgcaagatcatgaccttccggcccagcatggaggagttccgggagttcaacaagtacctggcctacatggagagcaaaggagcccaccgggccggcctggccaaggtgattcctcccaaggagtggaagccccggcagtgctatgatgacatcgacaacctgctgatcccagcccccatccagcagatggtgacaggccagagcggcctcttcacccagtacaacatccagaagaaggccatgacagtgaaggagttccggcagctggccaacagcggcaagtactgcaccccccgctacctggactatgaggacctggagaggaagtactggaagaacctgacctttgtggcccccatctacggggctgacatcaatggcagcatctatgatgagggcgtggatgagtggaacatcgcccggctgaacacagtgctggatgtggtggaggaggagtgtggcatcagcattgagggcgtgaacaccccctacctgtacttcggcatgtggaagaccacctttgcctggcacacagaggacatggacctgtacagcatcaactacctgcactttggagagcccaagtcctggtacgccatccccccagagcacggcaagaggctggagcggctggcccagggcttcttccccagcagcagccagggctgtgatgccttcctgcggcacaagatgaccctcatcagccccagcgtgctgaagaagtatggcatcccctttgacaagatcacccaggaggccggggagttcatgatcaccttcccctacggctaccacgccggcttcaaccacggcttcaactgtgccgagagcaccaactttgccaccgtgcgctggattgattatggcaaggtggccaagctgtgcacctgcaggaaggacatggtgaagatctccatggacatctttgtgaggaagttccagcctgaccgctaccagctgtggaagcagggcaaggacatctacaccatcgaccacaccaagcccaccccagccagcaccccagaggtgaaggcctggctgcagaggaggaggaaggtgaggaaggccagccgctccttccagtgtgcccggagcaccagcaagaggcccaaggcagatgaggaggaggaggtgtctgatgaggtggatggagctgaggtgcccaacccagattctgtgacagatgacctgaaggtgtctgagaagtctgaggccgctgtgaagctgaggaacacagaggccagcagcgaggaggagagcagcgccagcaggatgcaggtggagcagaacctgagtgaccacatcaagctgagcggcaacagctgcctgagcacctctgtgacagaggacatcaagacagaagatgacaaggcctatgcctacagatctgtgcccagcatcagcagcgaggctgatgacagcatccccctgagcagcggctatgagaagccagagaagagtgaccccagcgagctgtcctggcccaagagccctgagagctgcagctctgtggccgagagcaatggagtgctgacagaaggagaggagagtgatgtggagagccatggaaatggcctggagcctggagagatcccagctgtgcccagcggggagaggaacagcttcaaggtgcccagcattgctgagggggagaacaagaccagcaagtcctggaggcaccccctgagccggcccccagcccggagccccatgaccctggtgaagcagcaggcccccagtgatgaggagctgcctgaggtgctgagcattgaggaggaggtggaggagacagagagctgggccaagcccctcatccacctgtggcagaccaagagccccaactttgctgctgagcaggagtacaatgccaccgtggccaggatgaagccccactgtgccatctgcaccctgctgatgccctaccacaagccagacagcagcaatgaagaaaatgatgcccgctgggagaccaagctggatgaggtggtgaccagcgagggcaagaccaagcccctcatccctgagatgtgcttcatctacagcgaggagaacatcgagtacagccccccaaatgccttcctggaggaggatggcaccagcctgctgatcagctgtgccaagtgctgcgtgcgggtgcacgccagctgctacggcatccccagccatgagatctgtgatggctggctgtgtgcccgctgcaagagaaatgcctggacagctgagtgctgcctgtgcaacctgcggggcggggccctgaagcagaccaagaacaacaagtgggcccacgtgatgtgtgctgtggccgtgcctgaggtgcgcttcaccaacgtgcctgagaggacccagattgatgtgggccgcatccccctgcagaggctgaagctgaagtgcatcttctgccgccaccgggtgaagagggtgtctggggcctgcatccagtgcagctatggccgctgcccagccagcttccacgtgacctgtgcccatgctgctggggtgctgatggagccagatgactggccctacgtggtgaacatcacctgcttccgccacaaggtgaaccccaacgtgaagagcaaggcctgtgagaaggtgatctctgtgggccagaccgtcatcaccaagcacaggaacacccgctactacagctgccgggtgatggctgtgaccagccagaccttctatgaggtgatgtttgatgatggcagcttcagccgggacaccttccctgaggacatcgtgtcccgggactgcctgaagctgggccccccagctgagggggaggtggtgcaggtgaagtggccagatggcaagctgtatggagccaagtacttcggcagcaacatcgcccacatgtaccaggtggagtttgaagatggcagccagatcgccatgaagcgggaggacatctacaccctggatgaggagctgcccaagagggtgaaggccaggtttgtgtctgctggccgctgccacctgggcacctgccaggtgaacagcctgagcagcccccacgtgtcccaggcccagcaggagacctacctgggcttctggatcaacagcaagaagagccagtgcaacatcttcctgagcggcacctactag

SEQ ID NO: 15966 - DNA, 3171 bp, Artificial Sequence
  Description of Artificial Sequence: Synthetic coding sequence
atggaggtggccgaggtggagagccccctgaaccccagctgcaagatcatgaccttccggcccagcatggaggagttccgggagttcaacaagtacctggcctacatggagagcaaaggagcccaccgggccggcctggccaaggtgattcctcccaaggagtggaagccccggcagtgctatgatgacatcgacaacctgctgatcccagcccccatccagcagatggtgacaggccagagcggcctcttcacccagtacaacatccagaagaaggccatgacagtgaaggagttccggcagctggccaacagcggcaagtactgcaccccccgctacctggactatgaggacctggagaggaagtactggaagaacctgacctttgtggcccccatctacggggctgacatcaatggcagcatctatgatgagggcgtggatgagtggaacatcgcccggctgaacacagtgctggatgtggtggaggaggagtgtggcatcagcattgagggcgtgaacaccccctacctgtacttcggcatgtggaagaccacctttgcctggcacacagaggacatggacctgtacagcatcaactacctgcactttggagagcccaagtcctggtacgccatccccccagagcacggcaagaggctggagcggctggcccagggcttcttccccagcagcagccagggctgtgatgccttcctgcggcacaagatgaccctcatcagccccagcgtgctgaagaagtatggcatcccctttgacaagatcacccaggaggccggggagttcatgatcaccttcccctacggctaccacgccggcttcaaccacggcttcaactgtgccgagagcaccaactttgccaccgtgcgctggattgattatggcaaggtggccaagctgtgcacctgcaggaaggacatggtgaagatctccatggacatctttgtgaggaagttccagcctgaccgctaccagctgtggaagcagggcaaggacatctacaccatcgaccacaccaagcccaccccagccagcaccccagaggtgaaggcctggctgcagaggaggaggaaggtgaggaaggccagccgctccttccagtgtgcccggagcaccagcaagaggcccaaggcagatgaggaggaggaggtgtctgatgaggtggatggagctgaggtgcccaacccagattctgtgacagatgacctgaaggtgtctgagaagtctgaggccgctgtgaagctgaggaacacagaggccagcagcgaggaggagagcagcgccagcaggatgcaggtggagcagaacctgagtgaccacatcaagctgagcggcaacagctgcctgagcacctctgtgacagaggacatcaagacagaagatgacaaggcctatgcctacagatctgtgcccagcatcagcagcgaggctgatgacagcatccccctgagcagcggctatgagaagccagagaagagtgaccccagcgagctgtcctggcccaagagccctgagagctgcagctctgtggccgagagcaatggagtgctgacagaaggagaggagagtgatgtggagagccatggaaatggcctggagcctggagagatcccagctgtgcccagcggggagaggaacagcttcaaggtgcccagcattgctgagggggagaacaagaccagcaagtcctggaggcaccccctgagccggcccccagcccggagccccatgaccctggtgaagcagcaggcccccagtgatgaggagctgcctgaggtgctgagcattgaggaggaggtggaggagacagagagctgggccaagcccctcatccacctgtggcagaccaagagccccaactttgctgctgagcaggagtacaatgccaccgtggccaggatgaagccccactgtgccatctgcaccctgctgatgccctaccacaagccagacagcagcaatgaagaaaatgatgcccgctgggagaccaagctggatgaggtggtgaccagcgagggcaagaccaagcccctcatccctgagatgtgcttcatctacagcgaggagaacatcgagtacagccccccaaatgccttcctggaggaggatggcaccagcctgctgatcagctgtgccaagtgctgcgtgcgggtgcacgccagctgctacggcatccccagccatgagatctgtgatggctggctgtgtgcccgctgcaagagaaatgcctggacagctgagtgctgcctgtgcaacctgcggggcggggccctgaagcagaccaagaacaacaagtgggcccacgtgatgtgtgctgtggccgtgcctgaggtgcgcttcaccaacgtgcctgagaggacccagattgatgtgggccgcatccccctgcagaggctgaagctgaagtgcatcttctgccgccaccgggtgaagagggtgtctggggcctgcatccagtgcagctatggccgctgcccagccagcttccacgtgacctgtgcccatgctgctggggtgctgatggagccagatgactggccctacgtggtgaacatcacctgcttccgccacaaggtgaaccccaacgtgaagagcaaggcctgtgagaaggtgatctctgtgggccagaccgtcatcaccaagcacaggaacacccgctactacagctgccgggtgatggctgtgaccagccagaccttctatgaggtgatgtttgatgatggcagcttcagccgggacaccttccctgaggacatcgtgtcccgggactgcctgaagctgggccccccagctgagggggaggtggtgcaggtgaagtggccagatggcaagctgtatggagccaagtacttcggcagcaacatcgcccacatgtaccaggtggagtttgaagatggcagccagatcgccatgaagcgggaggacatctacaccctggatgaggagctgcccaagagggtgaaggcccgcttcagcacagccagtgacatgagatttgaggacaccttctatggagctgacatcatccagggcgagaggaagaggcagagggtgctgagcagccgcttcaagaatgaatatgtggccgaccctgtgtaccgcaccttcctgaagagcagcttccagaagaagtgccagaagaggcagtag

SEQ ID NO: 15967 - DNA, 1065 bp, Artificial Sequence
  Description of Artificial Sequence: Synthetic coding sequence
ccagacagcagcaatgaagaaaatgatgcccgctgggagaccaagctggatgaggtggtgaccagcgagggcaagaccaagcccctcatccctgagatgtgcttcatctacagcgaggagaacatcgagtacagccccccaaatgccttcctggaggaggatggcaccagcctgctgatcagctgtgccaagtgctgcgtgcgggtgcacgccagctgctacggcatccccagccatgagatctgtgatggctggctgtgtgcccgctgcaagagaaatgcctggacagctgagtgctgcctgtgcaacctgcggggcggggccctgaagcagaccaagaacaacaagtgggcccacgtgatgtgtgctgtggccgtgcctgaggtgcgcttcaccaacgtgcctgagaggacccagattgatgtgggccgcatccccctgcagaggctgaagctgaagtgcatcttctgccgccaccgggtgaagagggtgtctggggcctgcatccagtgcagctatggccgctgcccagccagcttccacgtgacctgtgcccatgctgctggggtgctgatggagccagatgactggccctacgtggtgaacatcacctgcttccgccacaaggtgaaccccaacgtgttcaccgcccagagcaagcacagcaagaatgaaagctgcatcgccaccaccaccagcgctgctgctgctggggccaccatcctgtgtgagctgggccacaagagcaaggcctgtgagaaggtgatctctgtgggccagaccgtcatcaccaagcacaggaacacccgctactacagctgccgggtgatggctgtgaccagccagaccttctatgaggtgatgtttgatgatggcagcttcagccgggacaccttcccagaagatattgtgtcccgggactgcctgaagctgggccccccagctgagggggaggtggtgcaggtgaagtggccagatggcaagctgtatggagccaagtacttcggcagcaacatcgcccacatgtaccaggtggagtttgaagatggcagccagatcgcctag

SEQ ID NO: 15968 - DNA, 2232 bp, Artificial Sequence
  Description of Artificial Sequence: Synthetic coding sequence
atggtgaagatctccatggacatctttgtgaggaagttccagcctgaccgctaccagctgtggaagcagggcaaggacatctacaccatcgaccacaccaagcccaccccagccagcaccccagaggtgaaggcctggctgcagaggaggaggaaggtgaggaaggccagccgctccttccagtgtgcccggagcaccagcaagaggcccaaggcagatgaggaggaggaggtgtctgatgaggtggatggagctgaggtgcccaacccagacagcgtgacagatgacctgaaggtgtctgagaagtctgaggccgctgtgaagctgaggaacacagaggccagcagcgaggaggagagcagcgccagcaggatgcaggtggagcagaacctgagtgaccacatcaagctgagcggcaacagctgcctgagcacctctgtgacagaggacatcaagacagaagatgacaaggcctatgcctacagatctgtgcccagcatcagcagcgaggctgatgacagcatccccctgagcagcggctatgagaagccagagaagagtgaccccagcgagctgtcctggcccaagagccctgagagctgcagctctgtggccgagagcaatggagtgctgacagaaggagaggagagtgatgtggagagccacggcaatggcctggagcccggggagatcccagctgtgcccagcggggagagaaattccttcaaggtgcccagcattgctgaaggagagaacaagaccagcaagtcctggaggcaccccctgagccggcccccagcccggagccccatgaccctggtgaagcagcaggcccccagtgatgaggagctgcctgaggtgctgagcattgaggaggaggtggaggagacagagagctgggccaagcccctcatccacctgtggcagaccaagagccccaactttgctgctgagcaggagtacaatgccaccgtggccaggatgaagccccactgtgccatctgcaccctgctgatgccctaccacaagccagacagcagcaatgaggagaatgatgcccgctgggagaccaagctggatgaggtggtgaccagcgagggcaagaccaagcccctcatccctgagatgtgcttcatctacagtgaagaaaatattgagtacagccccccaaatgccttcctggaggaggatggcaccagcctgctgatcagctgtgccaagtgctgcgtgcgggtgcacgccagctgctacggcatccccagccatgagatctgtgatggctggctgtgtgcccgctgcaagagaaatgcctggacagctgagtgctgcctgtgcaacctgcggggcggggccctgaagcagaccaagaacaacaagtgggcccacgtgatgtgtgctgtggccgtgcctgaggtgcgcttcaccaacgtgcctgagaggacccagattgatgtgggccgcatccccctgcagaggctgaagctgaagtgcatcttctgccgccaccgggtgaagagggtgtctggggcctgcatccagtgcagctatggccgctgcccagccagcttccacgtgacctgtgcccacgccgccggcgtgctgatggagccagatgactggccctacgtggtgaacatcacctgcttccgccacaaggtgaaccccaacgtgaagagcaaggcctgtgagaaggtgatctctgtgggccagaccgtcatcaccaagcacaggaacacccgctactacagctgccgggtgatggctgtgaccagccagaccttctatgaggtgatgtttgatgatggcagcttcagccgggacaccttcccagaagatattgtgtcccgggactgcctgaagctgggccccccagctgagggggaggtggtgcaggtgaagtggccagatggcaagctgtatggagccaagtacttcggcagcaacatcgcccacatgtaccaggtggagtttgaagatggcagccagatcgccatgaagcgggaggacatctacaccctggatgaggagctgcccaagagggtgaaggcccgcttcagcacagccagtgacatgagatttgaggacaccttctacggggctgacatcatccagggcgagaggaagaggcagagggtgctgagcagccgcttcaagaatgaatatgtggccgaccctgtgtaccgcaccttcctgaagagcagcttccagaagaagtgccagaagaggcagtag

SEQ ID NO: 15969 - DNA, 2406 bp, Artificial Sequence
  Description of Artificial Sequence: Synthetic coding sequence
atgtggaagaccacctttgcctggcacacagaggacatggacctgtacagcatcaactacctgcactttggagagcccaagtcctggtacgccatccccccagagcacggcaagaggctggagcggctggcccagggcttcttccccagcagcagccagggctgtgatgccttcctgcggcacaagatgaccctcatcagccccagcgtgctgaagaagtatggcatcccctttgacaagatcacccaggaggccggggagttcatgatcaccttcccctacggctaccacgccggcttcaaccacggcttcaactgtgccgagagcaccaactttgccaccgtgcgctggattgattatggcaaggtggccaagctgtgcacctgcaggaaggacatggtgaagatctccatggacatctttgtgaggaagttccagcctgaccgctaccagctgtggaagcagggcaaggacatctacaccatcgaccacaccaagcccaccccagccagcaccccagaggtgaaggcctggctgcagaggaggaggaaggtgaggaaggccagccgctccttccagtgtgcccggagcaccagcaagaggcccaaggcagatgaggaggaggaggtgtctgatgaggtggatggagctgaggtgcccaacccagacagcgtgacagatgacctgaaggtgtctgagaagtctgaggccgctgtgaagctgaggaacacagaggccagcagcgaggaggagagcagcgccagcaggatgcaggtggagcagaacctgagtgaccacatcaagctgagcggcaacagctgcctgagcacctctgtgacagaggacatcaagacagaagatgacaaggcctatgcctacagatctgtgcccagcatcagcagcgaggctgatgacagcatccccctgagcagcggctatgagaagccagagaagagtgaccccagcgagctgtcctggcccaagagccctgagagctgcagctctgtggccgagagcaatgagctgcctgaggtgctgagcattgaggaggaggtggaggagacagagagctgggccaagcccctcatccacctgtggcagaccaagagccccaactttgctgctgagcaggagtacaatgccaccgtggccaggatgaagccccactgtgccatctgcaccctgctgatgccctaccacaagccagacagcagcaatgaggagaatgatgcccgctgggagaccaagctggatgaggtggtgaccagcgagggcaagaccaagcccctcatccctgagatgtgcttcatctacagtgaagaaaatattgagtacagccccccaaatgccttcctggaggaggatggcaccagcctgctgatcagctgtgccaagtgctgcgtgcgggtgcacgccagctgctacggcatccccagccatgagatctgtgatggctggctgtgtgcccgctgcaagagaaatgcctggacagctgagtgctgcctgtgcaacctgcggggcggggccctgaagcagaccaagaacaacaagtgggcccacgtgatgtgtgctgtggccgtgcctgaggtgcgcttcaccaacgtgcctgagaggacccagattgatgtgggccgcatccccctgcagaggctgaagctgaagtgcatcttctgccgccaccgggtgaagagggtgtctggggcctgcatccagtgcagctatggccgctgcccagccagcttccacgtgacctgtgcccacgccgccggcgtgctgatggagccagatgactggccctacgtggtgaacatcacctgcttccgccacaaggtgaaccccaacgtgaagagcaaggcctgtgagaaggtgatctctgtgggccagaccgtcatcaccaagcacaggaacacccgctactacagctgccgggtgatggctgtgaccagccagaccttctatgaggtgatgtttgatgatggcagcttcagccgggacaccttcccagaagatattgtgtcccgggactgcctgaagctgggccccccagctgagggggaggtggtgcaggtgaagtggccagatggcaagctgtatggagccaagtacttcggcagcaacatcgcccacatgtaccaggtggagtttgaagatggcagccagatcgccatgaagcgggaggacatctacaccctggatgaggagctgcccaagagggtgaaggcccgcttcagcacagccagtgacatgagatttgaggacaccttctacggggctgacatcatccagggcgagaggaagaggcagagggtgctgagcagccgcttcaagaatgaatatgtggccgaccctgtgtaccgcaccttcctgaagagcagcttccagaagaagtgccagaagaggcagtag

SEQ ID NO: 15970 - DNA, 2508 bp, Artificial Sequence
  Description of Artificial Sequence: Synthetic coding sequence
atgaagcactacggcctgccctggaagaggacagaggaggccgctgctgacacagccctgaccatcatggaggtggccgaggtggagagccccctgaaccccagctgcaagatcatgaccttccggcccagcatggaggagttccgggagttcaacaagtacctggcctacatggagagcaaaggagcccaccgggccggcctggccaaggtgattcctcccaaggagtggaagccccggcagtgctatgatgacatcgacaacctgctgatcccagcccccatccagcagatggtgacaggccagagcggcctcttcacccagtacaacatccagaagaaggccatgacagtgaaggagttccggcagctggccaacagcggcaagtactgcaccccccgctacctggactatgaggacctggagaggaagtactggaagaacctgacctttgtggcccccatctacggggctgacatcaatggcagcatctatgatgagggcgtggatgagtggaacatcgcccggctgaacacagtgctggatgtggtggaggaggagtgtggcatcagcattgagggcgtgaacaccccctacctgtacttcggcatgtggaagaccacctttgcctggcacacagaggacatggacctgtacagcatcaactacctgcactttggagagcccaagtcctggtacgccatccccccagagcacggcaagaggctggagcggctggcccagggcttcttccccagcagcagccagggctgtgatgccttcctgcggcacaagatgaccctcatcagccccagcgtgctgaagaagtatggcatcccctttgacaagatcacccaggaggccggggagttcatgatcaccttcccctacggctaccacgccggcttcaaccacggcttcaactgtgccgagagcaccaactttgccaccgtgcgctggattgattatggcaaggtggccaagctgtgcacctgcaggaaggacatggtgaagatctccatggacatctttgtgaggaagttccagcctgaccgctaccagctgtggaagcagggcaaggacatctacaccatcgaccacaccaagcccaccccagccagcaccccagaggtgaaggcctggctgcagaggaggaggaaggtgaggaaggccagccgctccttccagtgtgcccggagcaccagcaagaggcccaaggcagatgaggaggaggaggtgtctgatgaggtggatggagctgaggtgcccaacccagattctgtgacagatgacctgaaggtgtctgagaagtctgaggccgctgtgaagctgaggaacacagaggccagcagcgaggaggagagcagcgccagcaggatgcaggtggagcagaacctgagtgaccacatcaagctgagcggcaacagctgcctgagcacctctgtgacagaggacatcaagacagaagatgacaaggcctatgcctacagatctgtgcccagcatcagcagcgaggctgatgacagcatccccctgagcagcggctatgagaagccagagaagagtgaccccagcgagctgtcctggcccaagagccctgagagctgcagctctgtggccgagagcaatggagtgctgacagaaggagaggagagtgatgtggagagccatggaaatggcctggagcctggagagatcccagctgtgcccagcggggagaggaacagcttcaaggtgcccagcattgctgagggggagaacaagaccagcaagtcctggaggcaccccctgagccggcccccagcccggagccccatgaccctggtgaagcagcaggcccccagtgatgaggagctgcctgaggtgctgagcattgaggaggaggtggaggagacagagagctgggccaagcccctcatccacctgtggcagaccaagagccccaactttgctgctgagcaggagtacaatgccaccgtggccaggatgaagccccactgtgccatctgcaccctgctgatgccctaccacaagccagacagcagcaatgaagaaaatgatgcccgctgggagaccaagctggatgaggtggtgaccagcgagggcaagaccaagcccctcatccctgagatgtgcttcatctacagcgaggagaacatcgagtacagccccccaaatgccttcctggaggaggatggcaccagcctgctgatcagctgtgccaagtgctgcgtgcgggtgcacgccagctgctacggcatccccagccatgagatctgtgatggctggctgtgtgcccgctgcaagagaaatgcctggacagctgagtgctgcctgtgcaacctgcggggcggggccctgaagcagaccaagaacaacaagtgggcccacgtgatgtgtgctgtggccgtgcctgaggtgcgcttcaccaacgtgcctgagaggacccagattgatgtgggccgcatccccctgcagaggctgaagctgggccgcctgggcatctag

SEQ ID NO: 15971 - DNA, 1890 bp, Artificial Sequence
  Description of Artificial Sequence: Synthetic coding sequence
atgtggaagaccacctttgcctggcacacagaggacatggacctgtacagcatcaactacctgcactttggagagcccaagtcctggtacgccatccccccagagcacggcaagaggctggagcggctggcccagggcttcttccccagcagcagccagggctgtgatgccttcctgcggcacaagatgaccctcatcagccccagcgtgctgaagaagtatggcatcccctttgacaagatcacccaggaggccggggagttcatgatcaccttcccctacggctaccacgccggcttcaaccacggcttcaactgtgccgagagcaccaactttgccaccgtgcgctggattgattatggcaaggtggccaagctgtgcacctgcaggaaggacatggtgaagatctccatggacatctttgtgaggaagttccagcctgaccgctaccagctgtggaagcagggcaaggacatctacaccatcgaccacaccaagcccaccccagccagcaccccagaggtgaaggcctggctgcagaggaggaggaaggtgaggaaggccagccgctccttccagtgtgcccggagcaccagcaagaggcccaaggcagatgaggaggaggaggtgtctgatgaggtggatggagctgaggtgcccaacccagacagcgtgacagatgacctgaaggtgtctgagaagtctgaggccgctgtgaagctgaggaacacagaggccagcagcgaggaggagagcagcgccagcaggatgcaggtggagcagaacctgagtgaccacatcaagctgagcggcaacagctgcctgagcacctctgtgacagaggacatcaagacagaagatgacaaggcctatgcctacagatctgtgcccagcatcagcagcgaggctgatgacagcatccccctgagcagcggctatgagaagccagagaagagtgaccccagcgagctgtcctggcccaagagccctgagagctgcagctctgtggccgagagcaatggagtgctgacagaaggagaggagagtgatgtggagagccacggcaatggcctggagcccggggagatcccagctgtgcccagcggggagagaaattccttcaaggtgcccagcattgctgaaggagagaacaagaccagcaagtcctggaggcaccccctgagccggcccccagcccggagccccatgaccctggtgaagcagcaggcccccagtgatgaggagctgcctgaggtgctgagcattgaggaggaggtggaggagacagagagctgggccaagcccctcatccacctgtggcagaccaagagccccaactttgctgctgagcaggagtacaatgccaccgtggccaggatgaagccccactgtgccatctgcaccctgctgatgccctaccacaagccagacagcagcaatgaggagaatgatgcccgctgggagaccaagctggatgaggtggtgaccagcgagggcaagaccaagcccctcatccctgagatgtgcttcatctacagtgaagaaaatattgagtacagccccccaaatgccttcctggaggaggatggcaccagcctgctgatcagctgtgccaagtgctgcgtgcgggtgcacgccagctgctacggcatccccagccatgagatctgtgatggctggctgtgtgcccgctgcaagagaaatgcctggacagctgagtgctgcctgtgcaacctgcggggcggggccctgaagcagaccaagaacaacaagaatgccagcagcgctgacaccggcctgcggggcagcctggagcccgccagctctgtgcccaccgtggccgcccggcccccatccatgagcctggtgcccatgctgctgggctactag

SEQ ID NO: 15972 - DNA, 2442 bp, Artificial Sequence
  Description of Artificial Sequence: Synthetic coding sequence
atggaggtggccgaggtggagagccccctgaaccccagctgcaagatcatgaccttccggcccagcatggaggagttccgggagttcaacaagtacctggcctacatggagagcaaaggagcccaccgggccggcctggccaaggtgattcctcccaaggagtggaagccccggcagtgctatgatgacatcgacaacctgctgatcccagcccccatccagcagatggtgacaggccagagcggcctcttcacccagtacaacatccagaagaaggccatgacagtgaaggagttccggcagctggccaacagcggcaagtactgcaccccccgctacctggactatgaggacctggagaggaagtactggaagaacctgacctttgtggcccccatctacggggctgacatcaatggcagcatctatgatgagggcgtggatgagtggaacatcgcccggctgaacacagtgctggatgtggtggaggaggagtgtggcatcagcattgagggcgtgaacaccccctacctgtacttcggcatgtggaagaccacctttgcctggcacacagaggacatggacctgtacagcatcaactacctgcactttggagagcccaagtcctggtacgccatccccccagagcacggcaagaggctggagcggctggcccagggcttcttccccagcagcagccagggctgtgatgccttcctgcggcacaagatgaccctcatcagccccagcgtgctgaagaagtatggcatcccctttgacaagatcacccaggaggccggggagttcatgatcaccttcccctacggctaccacgccggcttcaaccacggcttcaactgtgccgagagcaccaactttgccaccgtgcgctggattgattatggcaaggtggccaagctgtgcacctgcaggaaggacatggtgaagatctccatggacatctttgtgaggaagttccagcctgaccgctaccagctgtggaagcagggcaaggacatctacaccatcgaccacaccaagcccaccccagccagcaccccagaggtgaaggcctggctgcagaggaggaggaaggtgaggaaggccagccgctccttccagtgtgcccggagcaccagcaagaggcccaaggcagatgaggaggaggaggtgtctgatgaggtggatggagctgaggtgcccaacccagattctgtgacagatgacctgaaggtgtctgagaagtctgaggccgctgtgaagctgaggaacacagaggccagcagcgaggaggagagcagcgccagcaggatgcaggtggagcagaacctgagtgaccacatcaagctgagcggcaacagctgcctgagcacctctgtgacagaggacatcaagacagaagatgacaaggcctatgcctacagatctgtgcccagcatcagcagcgaggctgatgacagcatccccctgagcagcggctatgagaagccagagaagagtgaccccagcgagctgtcctggcccaagagccctgagagctgcagctctgtggccgagagcaatggagtgctgacagaaggagaggagagtgatgtggagagccatggaaatggcctggagcctggagagatcccagctgtgcccagcggggagaggaacagcttcaaggtgcccagcattgctgagggggagaacaagaccagcaagtcctggaggcaccccctgagccggcccccagcccggagccccatgaccctggtgaagcagcaggcccccagtgatgaggagctgcctgaggtgctgagcattgaggaggaggtggaggagacagagagctgggccaagcccctcatccacctgtggcagaccaagagccccaactttgctgctgagcaggagtacaatgccaccgtggccaggatgaagccccactgtgccatctgcaccctgctgatgccctaccacaagccagacagcagcaatgaagaaaatgatgcccgctgggagaccaagctggatgaggtggtgaccagcgagggcaagaccaagcccctcatccctgagatgtgcttcatctacagcgaggagaacatcgagtacagccccccaaatgccttcctggaggaggatggcaccagcctgctgatcagctgtgccaagtgctgcgtgcgggtgcacgccagctgctacggcatccccagccatgagatctgtgatggctggctgtgtgcccgctgcaagagaaatgcctggacagctgagtgctgcctgtgcaacctgcggggcggggccctgaagcagaccaagaacaacaagtgggcccacgtgatgtgtgctgtggccgtgcctgaggtgcgcttcaccaacgtgcctgagaggacccagattgatgtgggccgcatccccctgcagaggctgaagctgggccgcctgggcatctag

SEQ ID NO: 15973 - DNA, 1572 bp, Artificial Sequence
  Description of Artificial Sequence: Synthetic coding sequence
atggagaccatgaagagcaaggccaactgtgcccagaaccccaactgcaacatcatgatcttccaccccaccaaggaggagttcaatgactttgacaagtacatcgcctacatggagagccagggcgcccaccgggccggcctggccaagatcatcccccccaaggagtggaaggcccgggagacctatgacaacatcagcgagatcctgattgccacccccctgcagcaggtggccagcggccgggccggggtcttcacccagtaccacaagaagaagaaggccatgacagtgggggagtaccgccacctggccaacagcaagaagtaccagaccccaccccaccagaactttgaggacctggagaggaagtactggaagaaccgcatctacaacagccccatctacggggctgacatcagcggcagcctgtttgatgagaacaccaagcagtggaacctgggccacctgggcaccatccaggacctgctggagaaggaatgtggggtggtgattgagggcgtgaacaccccctacctgtacttcggcatgtggaagaccacctttgcctggcacacagaggacatggacctgtacagcatcaactacctgcacctgggggagcccaagacctggtacgtggtgcccccagagcacggccagaggctggagcggctggcccgggagctgtttcctggcagcagccggggctgtggggccttcctgcggcacaaggtggccctgatcagccccaccgtgctgaaggaaaatggcatccccttcaaccgcatcacccaggaggccggggagttcatggtgaccttcccctacggctaccacgccggcttcaaccacggcttcaactgtgccgaggccatcaactttgccaccccccgctggattgattatggcaagatggccagccagtgcagctgtggggaggcccgggtgaccttctccatggatgcctttgtgcgcatcctgcagcctgagagatatgacctgtggaagaggggccaggacagagctgtggtggaccacatggagccccgggtgcctgccagccaggagctgagcacccagaaggaggtgcagctgccccggcgggccgccctgggcctgcggcagctgcccagccactgggcccggcacagcccctggcccatggccgcccggagcggcacccgctgccacaccctggtgtgcagcagcctgcccaggagatctgctgtgtctggaacagccacccagcccagggctgctgctgtgcacagcagcaagaagcccagcagcacccccagcagcaccccaggccccagcgcccagatcatccaccccagcaatggccggcggggccggggccggcccccccagaagctgcgggcccaggagctgaccctgcagaccccagccaagaggcccctgctggccggcaccacctgcacagccagcggccctgagcctgagcccctgcctgaagatggagccctgatggacaagcctgtgcccctgagccctggcctgcagcaccctgtgaaggccagcggctgctcctgggcccctgtgccctag

SEQ ID NO: 15974 - DNA, 1521 bp, Artificial Sequence
  Description of Artificial Sequence: Synthetic coding sequence
atgaagtctgtgcacagcagcccccagaacaccagccacaccatcatgaccttctaccccaccatggaggagtttgctgacttcaacacctacgtggcctacatggagagccagggcgcccaccaggccggcctggccaaggtgatcccccccaaggagtggaaggcccggcagatgtatgatgacatcgaggacatcctgattgccacccccctgcagcaggtgaccagcggccagggcggcgtcttcacccagtaccacaagaagaagaaggccatgagggtgggccagtacagaaggctggccaacagcaagaagtaccagaccccaccccaccagaactttgctgacctggagcagcgctactggaagagccaccctggcaacccccccatctatggagctgacatcagcggcagcctgtttgaggagagcaccaagcagtggaacctgggccacctgggcaccatcctggacctgctggagcaggagtgtggggtggtgattgaaggagtgaacaccccctacctgtacttcggcatgtggaagaccacctttgcctggcacacagaggacatggacctgtacagcatcaactacctgcactttggagagcccaagacctggtacgtggtgcccccagagcacggccagcacctggagcggctggcccgggagctgttcccagacatcagccggggctgtgaggccttcctgcggcacaaggtggccctgatcagccccaccgtgctgaaggaaaatggcatccccttcaactgcatgacccaggaggccggggagttcatggtgaccttcccctacggctaccacgccggcttcaaccacggcttcaactgtgccgaggccatcaactttgccaccccccgctggattgattatggcaagatggccagccagtgcagctgtggggagagcacagtgaccttctccatggacccctttgtgcgcatcgtgcagcctgagagctatgagctgtggaagcaccggcaggacctggccatcgtggagcacacagagccccgggtggccgagagccaggagctgagcaactggagagatgacatcgtgctgcggcgggccgccctgggcctgcggctgctgcccaacctgacagcccagtgccccacccagcctgtgagcagcggccactgctacaaccccaagggctgcggcacagatgctgtgcccggcagcgccttccagagcagcgcctaccacacccagacccagagcctgaccctgggcatgtctgcccgggtgctgctgcccagcacaggctcctggggcagcggccggggccggggccggggccagggccagggccggggctgcagccggggccggggccacggctgctgcacccgggagctgggcacagaggagcccaccgtgcagcctgccagcaagaggcggctgctgatgggcaccaggagccgggcccagggccaccggccccagctgcccctggccaatgacctgatgaccaacctgagcctgtag

SEQ ID NO: 15975 - DNA, 1080 bp, Artificial Sequence
  Description of Artificial Sequence: Synthetic coding sequence
atgattgctgcccaggccaagctggtgtaccagctgaacaagtactacacagagcgctgccaggccaggaaggccgccatcgccaagaccatccgggaggtgtgcaaggtggtgtctgatgtgctgaaggaggtggaggtgcaggagccccgcttcatcagcagcctgtctgaaattgatgcccgctatgagggcctggaggtgatcagccccacagaatttgaggtggtgctgtacctgaaccagatgggcgtcttcaactttgtggatgatggcagcctgcccggctgtgctgtgctgaagctgagtgatggcaggaagaggtccatgagcctgtgggtggagttcatcacagccagcggctacctgagcgccaggaagatccgcagccgcttccagaccctggtggcccaggccgtggacaagtgcagctacagagatgtggtgaagatgattgctgacaccagcgaggtgaagctgcgcatccgggagcgctacgtggtgcagatcaccccagccttcaagtgcaccggcatctggcccaggtctgctgcccagtggcccatgccccacatcccctggccaggccccaacagagtggccgaggtgaaggccgagggcttcaacctgctgagcaaggagtgctacagcctgaccgggaagcagagcagcgctgagagtgatgcctgggtgctgcagtttggagaggccgagaaccggctgctgatgggcggctgcaggaacaagtgcctgtctgtgctgaagaccctgcgggacagacacctggagctgcccggccagcccctgaacaactaccacatgaagaccctgctgctgtatgaatgtgagaagcacccccgggagacagactgggatgagagctgcctgggggaccggctgaatggcatcctgctgcagctgatcagctgcctgcagtgccgccgctgcccccactacttcctgcccaacctggacctcttccagggcaagccccacagcgccctggagagcgctgccaagcagacctggaggctggcccgggagatcctgaccaaccccaagagcctggacaagctgtag

SEQ ID NO: 15976 - DNA, 447 bp, Artificial Sequence
  Description of Artificial Sequence: Synthetic coding sequence
atggctgtggccagtgacttctacctgcgctactacgtgggccacaagggcaagtttggacatgagttcctggagtttgagttccggccagatggcaagctgcgctatgccaacaacagcaactacaagaatgatgtgatgatcaggaaggaggcctacgtgcacaagtctgtgatggaggagctgaagaggatcattgatgattctgagatcaccaaggaggatgatgccctgtggcccccaccagacagagtgggccggcaggagctggagatcgtgattggagatgagcacatctccttcaccaccagcaagattggcagcctgattgatgtgaaccagagcaaggaccctgagggcctgcgggtcttctactacctggtgcaggacctgaagtgcctggtgttcagcctgattggcctgcacttcaagatcaagcccatctag

SEQ ID NO: 15977 - DNA, 336 bp, Artificial Sequence
  Description of Artificial Sequence: Synthetic coding sequence
atggctgtggccagtgacttctacctgcgctactacgtgggccacaagggcaagtttggacatgagttcctggagtttgagttccggccagatggcaagctgcgctatgccaacaacagcaactacaagaatgatgtgatgatcaggaaggaggagctggagatcgtgattggagatgagcacatctccttcaccaccagcaagattggcagcctgattgatgtgaaccagagcaaggaccctgagggcctgcgggtcttctactacctggtgcaggacctgaagtgcctggtgttcagcctcatcggcctgcacttcaagatcaagcccatctag

SEQ ID NO: 15978 - DNA, 1041 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgctgtgtag

SEQ ID NO: 15979 - DNA, 903 bp, Artificial Sequence
  Description of Artificial Sequence: Synthetic coding sequence
atgcagagtgatgatgtgatctgggacaccctgggcaacaagcagttctgcagcttcaagatccgcaccaagacccagagcttctgcagaaatgagtacagcctgaccggcctgtgcaacagaagcagctgccccctggccaacagccagtatgccaccatcaaggaggagaagggccagtgctacctgtacatgaaggtgattgaaagagctgccttcccccggcggctgtgggagcgggtgcggctgagcaagaactatgagaaggccctggagcagattgatgagaacctgatctactggccccgcttcatccgccacaagtgcaagcagcgcttcaccaagatcacccagtacctgatccgcatcaggaagctgaccctgaagaggcagaggaagctggtgcccctgagcaagaaggtggagcggcgggagaagagaagagaggagaaggccctgattgctgcccagctggacaatgccatcgagaaggagctgctggagcggctgaagcaggacacctatggagacatctacaacttccccatccacgcctttgacaaggccctggagcagcaggaggccgagagtgacagcagtgacacagaggagaaggatgatgatgatgatgatgaagaagatgtgggcaagcgggagtttgtggaggatggagaggtggatgaaagtgacatcagtgactttgaggacatggacaagctggatgccagcagtgatgaggaccaggacggcaagagcagcagcgaggaggaggaggagaaggccctgagcgccaagcacaagggcaagatgcccctgcggggccccctgcagaggaagagggcctacgtggagattgaatatgagcaggagacagagcctgtggccaaggccaagaccacctag

SEQ ID NO: 15980 - DNA, 1056 bp, Artificial Sequence
  Description of Artificial Sequence: Synthetic coding sequence
atggagaggaggatgcagctggtgaagaaggacaatgagaaggagcggcacaagctgttccagggctatgaaacagaggagcgggaggagacagagctgtctgagaagatcaagctggagtgccagcctgagctgtctgagaccagccagaccctgccccccaagcccttcagctgtggccgcagcggcaagggccacaagaggaagagccccttcggcagcacagagaggaagacccctgtgaagaagctggcccctgagttcagcaaggtgaagaccaagacccccaagcacagccccatcaaggaggagccctgtggcagcctgtctgagaccgtgtgcaagcgggagctgcggagccaggagaccccagagaagcccaggagctctgtggacaccccaccccggctgagcaccccccagaagggccccagcacccaccccaaggagaaggccttcagcagcgagattgaggacctgccctacctgagcaccacagagatgtacctgtgccgctggcaccagcccccacccagccccctgcccctgcgggagagcagccccaagaaggaggagaccgtggcccgctgcctgatgcccagctctgtggccggggagacctctgtgctggccgtgcccagctggagggaccacagcgtggagcccctgcgggaccccaaccccagcgacctgctggagaacctggatgacagcgtcttcagcaagagacatgccaagctggagctggatgagaagaggaggaagcgctgggacatccagaggatccgggagcagaggatcctgcagaggctgcagctgaggatgtacaagaagaagggcatccaggagagcgagcctgaggtgaccagcttcttccctgagccagatgatgtggagagcctgatgatcacccccttcctgcctgtggtggccttcggccggcccctgcccaagctgaccccccagaactttgagctgccctggctggatgagaggagccgctgccgcctggagatccagaagaagcagaccccccacaggacctgcaggaagtag

SEQ ID NO: 15981 - DNA, 1845 bp, Artificial Sequence
  Description of Artificial Sequence: Synthetic coding sequence
atgaccatgaggtctgctgtgttcaaggctgctgctgccccagctgggggcaaccctgagcagaggctggactatgaaagagctgctgccctgggcggcccagaagatgagcccggggctgctgaggcccacttcctgcccaggcacaggaagctgaaggagcccggcccccccctggccagcagccagggcggcagccctgcccccagccctgctggctgcggcggcaagggccggggcctgctgctgcctgctggagctgcccctggccagcaggaggagagctggggcggctctgtgcccctgccctgccccccaccagccaccaagcaggccggcatcggcggggagcctgctgctgctggagctggctgcagcccccggcccaagtaccaggccgtgctgcccatccagacaggcagcctggtggccgccgccaaggagcccaccccctgggccggggacaagggcggggccgccagccctgctgccacagccagtgaccctgctggccccccacccctgcccctgcccggccccccacccctggcccccacagccacagctggcaccctggccgccagcgagggccgctggaagtccatgaggaagagccccctgggcggcggcggcggcagcggggccagcagccaggccgcctgcctgaagcagatcctgctgctgcagctggacctgattgagcagcagcagcagcagctgcaggccaaggagaaggagattgaggagctgaagtctgagcgggacaccctgctggccagaattgaaagaatggagaggaggatgcagctggtgaagaaggacaatgagaaggagcggcacaagctgttccagggctatgaaacagaggagcgggaggagacagagctgtctgagaagatcaagctggagtgccagcctgagctgtctgagaccagccagaccctgccccccaagcccttcagctgtggccgcagcggcaagggccacaagaggaagagccccttcggcagcacagagaggaagacccctgtgaagaagctggcccctgagttcagcaaggtgaagaccaagacccccaagcacagccccatcaaggaggagccctgtggcagcctgtctgaaacagtgtgcaagcgggagctgcggagccaggagaccccagagaagcccaggagctctgtggacaccccaccccggctgagcaccccccagaagggccccagcacccaccccaaggagaaggccttcagcagcgagattgaggacctgccctacctgagcaccacagagatgtacctgtgccgctggcaccagcccccacccagccccctgcccctgcgggagagcagccccaagaaggaggagaccgtggcccgctgcctgatgcccagctctgtggccggggagacctctgtgctggccgtgcccagctggagggaccacagcgtggagcccctgcgggaccccaaccccagcgacctgctggagaacctggatgattctgtgttcagcaagagacatgccaagctggagctggatgagaagaggaggaagcgctgggacatccagaggatccgggagcagaggatcctgcagaggctgcagctgaggatgtacaagaagaagggcatccaggagagcgagcctgaggtgaccagcttcttccctgagccagatgatgtggagagcctgatgatcacccccttcctgcctgtggtggccttcggccggcccctgcccaagctgaccccccagaactttgagctgccctggctggatgagaggagccgctgccgcctggagatccagaagaagcagaccccccacaggacctgcaggaagtag

SEQ ID NO: 15982 - DNA, 1056 bp, Artificial Sequence; identical to SEQ ID NO: 15980
  Description of Artificial Sequence: Synthetic coding sequence

SEQ ID NO: 15983 - DNA, 1734 bp, Artificial Sequence
  Description of Artificial Sequence: Synthetic coding sequence
atgaaccctgtgaatgccacagccctgtacatcagcgccagccggctggtgctgaactatgaccccggggaccccaaggccttcacagagatcaaccggctgctgccctacttccggcagagcctgagctgctgcgtgtgtggccacctgctgcaggaccccatcgcccccaccaacagcacctgccagcactacgtgtgcaagacctgcaagggcaagaagatgatgatgaagcccagctgctcctggtgcaaggactatgagcagtttgaggagaacaagcagctgagcatcctggtgaactgctacaagaagctgtgtgagtacatcacccagaccaccctggcccgggacatcatcgaggccgtggactgcagcagtgacatcctggccctgctgaatgatggcagcctcttctgtgaggagacagagaagcccagcgacagcagcttcaccctgtgcctgacccacagccccctgcccagcaccagcgagcccaccacagacccccaggccagcctgagccccatgtctgagagcaccctgagcatcgccatcggcagcagcgtcatcaatggcctgcccacctacaacggcctgagcattgacagatttggcatcaacatccccagccctgagcacagcaacaccattgatgtgtgcaacacagtggacatcaagacagaggacctgagtgacagcctgccccctgtgtgtgacacagtggccacagacctgtgcagcactggaattgacatctgcagcttcagcgaggacatcaagccaggggacagcctgctgctgtctgtggaggaggtgctgcggagcctggagaccgtgagcaacacagaggtgtgctgccccaacctgcagcccaacctggaggccaccgtgtccaatggccccttcctgcagctgagcagccagagcctgagccacaacgtgttcatgagcaccagccctgccctgcacggcctgagctgcacagctgccacccccaagatcgccaagctgaacaggaagaggagccgctctgagagtgacagcgagaaggtgcagcccctgcccatcagcaccatcatccggggccccaccctgggcgccagcgcccctgtgacagtgaagcgggagagcaagatcagcctgcagcccatcgccaccgtgcccaacggcggcaccacccccaagatcagcaagacagtgctgctgagcaccaagtccatgaagaagagccatgagcacggcagcaagaagagccacagcaagaccaagccaggcatcctgaagaaggacaaggctgtgaaggagaagatccccagccaccacttcatgcctggcagccccaccaagacagtgtacaagaagccccaggagaagaagggctgcaagtgtggccgggccacccagaaccccagcgtgctgacctgccggggccagcgctgcccctgctacagcaacaggaaggcctgcctggactgcatctgccggggctgccagaacagctacatggccaatggagagaagaagctggaggcctttgctgtgcctgagaaggccctggagcagacccggctgaccctgggcatcaacgtgaccagcattgctgtgagaaatgccagcaccagcaccagcgtcatcaacgtgacaggcagccctgtgaccaccttcctggccgccagcacccatgatgacaagagcctggatgaggccatcgacatgagatttgactgctag

SEQ ID NO: 15984 - DNA, 1512 bp, Artificial Sequence
  Description of Artificial Sequence: Synthetic coding sequence
atgatgatgaagcccagctgctcctggtgcaaggactatgagcagtttgaggagaacaagcagctgagcatcctggtgaactgctacaagaagctgtgtgagtacatcacccagaccaccctggcccgggacatcatcgaggccgtggactgcagcagtgacatcctggccctgctgaatgatggcagcctcttctgtgaggagacagagaagcccagcgacagcagcttcaccctgtgcctgacccacagccccctgcccagcaccagcgagcccaccacagacccccaggccagcctgagccccatgtctgagagcaccctgagcatcgccatcggcagcagcgtcatcaatggcctgcccacctacaacggcctgagcattgacagatttggcatcaacatccccagccctgagcacagcaacaccattgatgtgtgcaacacagtggacatcaagacagaggacctgagtgacagcctgccccctgtgtgtgacacagtggccacagacctgtgcagcactggaattgacatctgcagcttcagcgaggacatcaagccaggggacagcctgctgctgtctgtggaggaggtgctgcggagcctggagaccgtgagcaacacagaggtgtgctgccccaacctgcagcccaacctggaggccaccgtgtccaatggccccttcctgcagctgagcagccagagcctgagccacaacgtgttcatgagcaccagccctgccctgcacggcctgagctgcacagctgccacccccaagatcgccaagctgaacaggaagaggagccgctctgagagtgacagcgagaaggtgcagcccctgcccatcagcaccatcatccggggccccaccctgggcgccagcgcccctgtgacagtgaagcgggagagcaagatcagcctgcagcccatcgccaccgtgcccaacggcggcaccacccccaagatcagcaagacagtgctgctgagcaccaagtccatgaagaagagccatgagcacggcagcaagaagagccacagcaagaccaagccaggcatcctgaagaaggacaaggctgtgaaggagaagatccccagccaccacttcatgcctggcagccccaccaagacagtgtacaagaagccccaggagaagaagggctgcaagtgtggccgggccacccagaaccccagcgtgctgacctgccggggccagcgctgcccctgctacagcaacaggaaggcctgcctggactgcatctgccggggctgccagaacagctacatggccaatggagagaagaagctggaggcctttgctgtgcctgagaaggccctggagcagacccggctgaccctgggcatcaacgtgaccagcattgctgtgagaaatgccagcaccagcaccagcgtcatcaacgtgacaggcagccctgtgaccaccttcctggccgccagcacccatgatgacaagagcctggatgaggccatcgacatgagatttgactgctag

SEQ ID NO: 15985 - DNA, 1566 bp, Artificial Sequence
  Description of Artificial Sequence: Synthetic coding sequence
atgtctgccagcgagggcatgaagttcaagttccacagcggggagaaggtgctgtgctttgagccagaccccaccaaggcccgggtgctgtatgatgccaagatcgtggatgtgattgtgggcaaggatgagaagggcaggaagatccctgagtacctgatccacttcaacggctggaacagatcctgggaccgctgggccgcagaagatcatgtgctgcgggacacagatgagaacagaaggctgcagaggaagctggccaggaaggctgtggcccggctgcggagcactggaaggaagaagaagcgctgccgcctgcccggggtggacagcgtgctgaagggcctgcccacagaggagaaggatgaaaatgatgagaacagcctgagcagcagcagtgactgcagcgagaacaaggatgaggagatcagcgaggagagtgacatcgaggagaagacagaggtgaaggaggagcctgagctgcagacccggcgggagatggaggagaggaccatcaccatcgagatccctgaggtgctgaagaagcagctggaggatgactgctactacatcaacagaaggaagaggctggtgaagctgccctgccagaccaacatcatcaccatcctggagagctatgtgaagcactttgccatcaatgctgccttcagcgccaatgaaagacccaggcaccaccacgtgatgcctcatgccaacatgaatgtgcactacatcccagctgagaagaatgtggacctgtgcaaggagatggtggatggcctgcgcatcacctttgactacaccctgcccctggtgctgctgtacccctatgagcaggcccagtacaagaaggtgaccagcagcaagttcttcctgcccatcaaggagagcgccaccagcaccaacagaagccaggaggagctgagccccagcccccccctgctgaaccccagcaccccccagagcacagagagccagcccaccactggagagcccgccacccccaagaggaggaaggccgagcctgaggccctgcagagcctgcggcgcagcaccaggcacagcgccaactgtgaccggctgtctgagagcagcgccagcccccagcccaagaggcggcagcaggacaccagcgcctccatgcccaagctgttcctgcacctggagaagaagacccctgtgcacagccgcagcagcagccccatccccctgacccccagcaaggagggcagcgctgtgtttgctggctttgagggccgccgcaccaatgagatcaatgaggtgctgtcctggaagctggtgcctgacaactacccacctggggaccagcccccaccacccagctacatctatggagcccagcacctgctgcggctgtttgtgaagctgcctgagatcctgggcaagatgtccttcagcgagaagaacctgaaggccctgctgaagcactttgacctcttcctgcgcttcctggccgagtaccatgatgacttcttccctgagagcgcctacgtggccgcctgtgaggcccactacagcaccaagaacccccgggccatctactag

SEQ ID NO: 15986 - DNA, 1251 bp, Artificial Sequence
  Description of Artificial Sequence: Synthetic coding sequence
atgtctgccagcgagggcatgaagttcaagttccacagcggggagaaggtgctgtgctttgagccagaccccaccaaggcccgggtgctgtatgatgccaagatcgtggatgtgattgtgggcaaggatgagaagggcaggaagatccctgagtacctgatccacttcaacggctggaacagatcctgggaccgctgggccgcagaagatcatgtgctgcgggacacagatgagaacagaaggctgcagaggaagctggccaggaaggctgtggcccggctgcggagcactggaaggaagaagaagcgctgccgcctgcccggggtggacagcgtgctgaagggcctgcccacagaggagaaggatgaaaatgatgagaacagcctgagcagcagcagtgactgcagcgagaacaaggatgaggagatcagcgaggagagtgacatcgaggagaagacagaggtgaaggaggagcctgagctgcagacccggcgggagatggaggagaggaccatcaccatcgagatccctgaggtgctgaagaagcagctggaggatgactgctactacatcaacagaaggaagaggctggtgaagctgccctgccagaccaacatcatcaccatcctggagagctatgtgaagcactttgccatcaatgctgccttcagcgccaatgaaagacccaggcaccaccacgtgatgcctcatgccaacatgaatgtgcactacatcccagctgagaagaatgtggacctgtgcaaggagatggtggatggcctgcgcatcacctttgactacaccctgcccctggtgctgctgtacccctatgagcaggcccagtacaagaaggtgaccagcagcaagttcttcctgcccatcaaggagagcgccaccagcaccaacagaagccaggaggagctgagccccagcccccccctgctgaaccccagcaccccccagagcacagagagccagcccaccactggagagcccgccacccccaagaggaggaaggccgagcctgaggccctgcagagcctgcggcgcagcaccaggcacagcgccaactgtgaccggctgtctgagagcagcgccagcccccagcccaagaggcggcagcaggacaccagcgcctccatgcccaagctgttcctgcacctggagaagagccgcttcatcctgggctgcccccggcccggccgggcctctgtgtactttgtgttcagccagtgccaggcctggtgctag

SEQ ID NO: 15987 - DNA, 1119 bp, Artificial Sequence
  Description of Artificial Sequence: Synthetic coding sequence
atgaagatgatgaagaccaaggaggagcctgagctgcagacccggcgggagatggaggagaggaccatcaccatcgagatccctgaggtgctgaagaagcagctggaggatgactgctactacatcaacagaaggaagaggctggtgaagctgccctgccagaccaacatcatcaccatcctggagagctatgtgaagcactttgccatcaatgctgccttcagcgccaatgaaagacccaggcaccaccacgtgatgccccacgccaacatgaatgtgcactacatcccagctgagaagaatgtggacctgtgcaaggagatggtggatggcctgcgcatcacctttgactacaccctgcccctggtgctgctgtacccctatgagcaggcccagtacaagaaggtgaccagcagcaagttcttcctgcccatcaaggagagcgccaccagcaccaacagaagccaggaggagctgagccccagcccccccctgctgaaccccagcaccccccagagcacagagagccagcccaccaccggggagcccgccacccccaagaggaggaaggccgagcctgaggccctgcagagcctgcggcgcagcaccaggcacagcgccaactgtgaccggctgtctgagagcagcgccagcccccagcccaagaggcggcagcaggacaccagcgcctccatgcccaagctgttcctgcacctggagaagaagacccctgtgcacagccgcagcagcagccccatccccctgacccccagcaaggagggcagcgctgtgtttgctggctttgagggccgccgcaccaatgagatcaatgaggtgctgtcctggaagctggtgcctgacaactacccacctggggaccagcccccacctccttcctacatctacggggcccagcacctgctgcggctgtttgtgaagctgcctgagatcctgggcaagatgtccttcagcgagaagaacctgaaggccctgctgaagcactttgacctcttcctgcgcttcctggccgagtaccatgatgacttcttccctgagagcgcctacgtggccgcctgtgaggcccactacagcaccaagaacccccgggccatctactag

SEQ ID NO: 15988 - DNA, 591 bp, Artificial Sequence
  Description of Artificial Sequence: Synthetic coding sequence
atggaggagaggaccatcaccatcgagatccctgaggtgctgaagaagcagctggaggatgactgctactacatcaacagaaggaagaggctggtgaagctgccctgccagaccaacatcatcaccatcctggagagctatgtgaagcactttgccatcaatgctgccttcagcgccaatgaaagacccaggcaccaccacgtgatgcctcatgccaacatgaatgtgcactacatcccagctgagaagaatgtggacctgtgcaaggagatggtggatggcctgcgcatcacctttgactacaccctgcccctggtgctgctgtacccctatgagcaggcccagtacaagaaggtgaccagcagcaagttcttcctgcccatcaaggagagcgccaccagcaccaacagaagccaggaggagctgagccccagcccccccctgctgaaccccagcaccccccagagcacagagagccagcccaccactggagagcccgccacccccaagaggaggaaggccgagcctgaggccctgcagagcctgcggcgcagcaccaggcacagcgccaactgtgaccggctgtcctag

SEQ ID NO: 15989 - DNA, 1068 bp, Artificial Sequence
  Description of Artificial Sequence: Synthetic coding sequence
atggaggagaggaccatcaccatcgagatccctgaggtgctgaagaagcagctggaggatgactgctactacatcaacagaaggaagaggctggtgaagctgccctgccagaccaacatcatcaccatcctggagagctatgtgaagcactttgccatcaatgctgccttcagcgccaatgaaagacccaggcaccaccacgtgatgcctcatgccaacatgaatgtgcactacatcccagctgagaagaatgtggacctgtgcaaggagatggtggatggcctgcgcatcacctttgactacaccctgcccctggtgctgctgtacccctatgagcaggcccagtacaagaaggtgaccagcagcaagttcttcctgcccatcaaggagagcgccaccagcaccaacagaagccaggaggagctgagccccagcccccccctgctgaaccccagcaccccccagagcacagagagccagcccaccactggagagcccgccacccccaagaggaggaaggccgagcctgaggccctgcagagcctgcggcgcagcaccaggcacagcgccaactgtgaccggctgtctgagagcagcgccagcccccagcccaagaggcggcagcaggacaccagcgcctccatgcccaagctgttcctgcacctggagaagaagacccctgtgcacagccgcagcagcagccccatccccctgacccccagcaaggagggcagcgctgtgtttgctggctttgagggccgccgcaccaatgagatcaatgaggtgctgtcctggaagctggtgcctgacaactacccacctggggaccagcccccaccacccagctacatctatggagcccagcacctgctgcggctgtttgtgaagctgcctgagatcctgggcaagatgtccttcagcgagaagaacctgaaggccctgctgaagcactttgacctcttcctgcgcttcctggccgagtaccatgatgacttcttccctgagagcgcctacgtggccgcctgtgaggcccactacagcaccaagaacccccgggccatctactag

SEQ ID NO: 15990 - DNA, 1530 bp, Artificial Sequence
  Description of Artificial Sequence: Synthetic coding sequence
atgagccccagcgtgcggcctggagctggctgggcccctgtgggccggcccggccggcccatccagatcgtggatgtgattgtgggcaaggatgagaagggcaggaagatccctgagtacctgatccacttcaacggctggaacagatcctgggaccgctgggccgcagaagatcatgtgctgcgggacacagatgagaacagaaggctgcagaggaagctggccaggaaggctgtggcccggctgcggagcactggaaggaagaagaagcgctgccgcctgcccggggtggacagcgtgctgaagggcctgcccacagaggagaaggatgaaaatgatgagaacagcctgagcagcagcagtgactgcagcgagaacaaggatgaggagatcagcgaggagagtgacatcgaggagaagacagaggtgaaggaggagcctgagctgcagacccggcgggagatggaggagaggaccatcaccatcgagatccctgaggtgctgaagaagcagctggaggatgactgctactacatcaacagaaggaagaggctggtgaagctgccctgccagaccaacatcatcaccatcctggagagctatgtgaagcactttgccatcaatgctgccttcagcgccaatgaaagacccaggcaccaccacgtgatgcctcatgccaacatgaatgtgcactacatcccagctgagaagaatgtggacctgtgcaaggagatggtggatggcctgcgcatcacctttgactacaccctgcccctggtgctgctgtacccctatgagcaggcccagtacaagaaggtgaccagcagcaagttcttcctgcccatcaaggagagcgccaccagcaccaacagaagccaggaggagctgagccccagcccccccctgctgaaccccagcaccccccagagcacagagagccagcccaccactggagagcccgccacccccaagaggaggaaggccgagcctgaggccctgcagagcctgcggcgcagcaccaggcacagcgccaactgtgaccggctgtctgagagcagcgccagcccccagcccaagaggcggcagcaggacaccagcgcctccatgcccaagctgttcctgcacctggagaagaagacccctgtgcacagccgcagcagcagccccatccccctgacccccagcaaggagggcagcgctgtgtttgctggctttgagggccgccgcaccaatgagatcaatgaggtgctgtcctggaagctggtgcctgacaactacccacctggggaccagcccccaccacccagctacatctatggagcccagcacctgctgcggctgtttgtgaagctgcctgagatcctgggcaagatgtccttcagcgagaagaacctgaaggccctgctgaagcactttgacctcttcctgcgcttcctggccgagtaccatgatgacttcttccctgagagcgcctacgtggccgcctgtgaggcccactacagcaccaagaacccccgggccatctactag

SEQ ID NO: 15991 - DNA, 60 bp, Artificial Sequence
  Description of Artificial Sequence: Synthetic coding sequence
atggaggagaggaccatcaccatcgagatccctgaggtgctgaagaagcagctggagtag

SEQ ID NO: 15992 - DNA, 1842 bp, Artificial Sequence
  Description of Artificial Sequence: Synthetic coding sequence
atggccgcccaggccgctgctgctgcccaggccgctgctgcccaggccgcccaggccgaggccgctgacagctggtacctggccctgctgggctttgctgagcacttccgcaccagcagcccccccaagatccggctgtgtgtgcactgcctgcaggccgtgttccccttcaagccaccccagagaattgaggcccggacccacctgcagctgggctctgtgctgtaccaccacaccaagaacagcgagcaggcccggagccacctggagaaggccggcagcctgagccagcagatcccccagtttgaagatgtgaagtttgaagctgccagcctgctgtctgagctgtactgccaggagaacagcgtggatgctgccaagcccctgctgaggaaggccatccagatcagccagcagaccccctactggcactgccgcctgctcttccagctggcccagctgcacaccctggagaaggacctggtgtctgcctgtgacctgctgggcgtgggcgcagaatatgcccgggtggtgggcagcgagtacacccgggccctcttcctgctgagcaagggcatgctgctgctgatggagaggaagctgcaggaggtgcaccccctgctgaccctgtgtggccagatcgtggagaactggcagggcaaccccatccagaaggagagcctgcgggtcttcttcctggtgctgcaggtgacccactacctggatgctggccaggtgaagtctgtgaagccctgcctgaagcagctgcagcagtgcatccagaccatcagcaccctgcatgatgatgagatcctgcccagcaacccagctgacctcttccactggctgcccaaggagcacatgtgtgtgctggtgtacctggtgacagtgatgcacagcatgcaggccggctacctggagaaggcccagaagtacacagacaaggccctgatgcagctggagaagctgaagatgctggactgcagccccatcctgagcagcttccaggtgatcctgctggagcacatcatcatgtgccgcctggtgacaggccacaaggccacagccctgcaggagatcagccaggtgtgccagctgtgccagcagagccccaggctcttcagcaaccacgccgcccagctgcacaccctgctgggcctgtactgtgtgtctgtgaactgcatggacaatgctgaggcccagttcaccacagccctgcggctgaccaaccaccaggagctgtgggccttcatcgtgaccaacctggcctctgtgtacatccgggagggcaacagacaccaggaggtgctgtacagcctgctggagcgcatcaacccagaccacagcttccctgtgagcagccactgcctgcgggccgccgccttctacgtgcggggcctcttctccttcttccagggccgctacaatgaggccaagcgcttcctgcgggagaccctgaagatgagcaatgctgaggacctgaaccggctgacagcctgcagcctggtgctgctgggccacatcttctacgtgctgggcaaccaccgggagagcaacaacatggtggtgcctgccatgcagctggccagcaagatcccagacatgtctgtgcagctgtggagcagcgccctgctgcgggacctgaacaaggcctgtggaaatgccatggatgcccatgaagctgcccagatgcaccagaacttcagccagcagctgctgcaggaccacatcgaggcctgcagcctgcctgagcacaacctgatcacctggacagatggccccccacctgtgcagttccaggcccagaatggccccaacaccagcctggccagcctgctgtag

SEQ ID NO: 15993 - DNA, 504 bp, Artificial Sequence
  Description of Artificial Sequence: Synthetic coding sequence
atgcccatgaagcccccacgctgcaccaggaccagccgcagcagctgcagcaggaccaccctgcggcctgctgccagccccaacaccaccagcagccggggccagacagtgcaccccccctgcagcagcaagctgaggatggaccccaccccagcctggccagccagctgtgaggccctgatgggccccagcagcagcgctggccctgcccggctgcggctgcccccaagaagacacagcagcctgcccccaagaagagccagcttcctgattgtgtcccgggccagcaagtcctgggagtgtgccggccctgtgcctgccctgcctggaggagtggtggccgtgcccaccagccagcaggacccccagtgccggggcagccaggtggcccaccggcgctgcctgagccgggccatcctgcagagcggcccccagtgccagagctgcctgagcatctgggtgaccagcgcccggagccgggtgcaggccagcagccgctcctag

SEQ ID NO: 15994 - DNA, 1842 bp, Artificial Sequence
  Description of Artificial Sequence: Synthetic coding sequence
atggccgcccaggccgctgctgctgcccaggccgctgctgcccaggccgcccaggccgaggccgctgacagctggtacctggccctgctgggctttgctgagcacttccgcaccagcagcccccccaagatccggctgtgtgtgcactgcctgcaggccgtgttccccttcaagccaccccagagaattgaggcccggacccacctgcagctgggctctgtgctgtaccaccacaccaagaacagcgagcaggcccggagccacctggagaaggcctggctgatcagccagcagatcccccagtttgaagatgtgaagtttgaagctgccagcctgctgtctgagctgtactgccaggagaacagcgtggatgctgccaagcccctgctgaggaaggccatccagatcagccagcagaccccctactggcactgccgcctgctcttccagctggcccagctgcacaccctggagaaggacctggtgtctgcctgtgacctgctgggcgtgggcgcagaatatgcccgggtggtgggcagcgagtacacccgggccctcttcctgctgagcaagggcatgctgctgctgatggagaggaagctgcaggaggtgcaccccctgctgaccctgtgtggccagatcgtggagaactggcagggcaaccccatccagaaggagagcctgcgggtcttcttcctggtgctgcaggtgacccactacctggatgctggccaggtgaagtctgtgaagccctgcctgaagcagctgcagcagtgcatccagaccatcagcaccctgcatgatgatgagatcctgcccagcaacccagctgacctcttccactggctgcccaaggagcacatgtgtgtgctggtgtacctggtgacagtgatgcacagcatgcaggccggctacctggagaaggcccagaagtacacagacaaggccctgatgcagctggagaagctgaagatgctggactgcagccccatcctgagcagcttccaggtgatcctgctggagcacatcatcatgtgccgcctggtgacaggccacaaggccacagccctgcaggagatcagccaggtgtgccagctgtgccagcagagccccaggctcttcagcaaccacgccgcccagctgcacaccctgctgggcctgtactgtgtgtctgtgaactgcatggacaatgctgaggcccagttcaccacagccctgcggctgaccaaccaccaggagctgtgggccttcatcgtgaccaacctggcctctgtgtacatccgggagggcaacagacaccaggaggtgctgtacagcctgctggagcgcatcaacccagaccacagcttccctgtgagcagccactgcctgcgggccgccgccttctacgtgcggggcctcttctccttcttccagggccgctacaatgaggccaagcgcttcctgcgggagaccctgaagatgagcaatgctgaggacctgaaccggctgacagcctgcagcctggtgctgctgggccacatcttctacgtgctgggcaaccaccgggagagcaacaacatggtggtgcctgccatgcagctggccagcaagatcccagacatgtctgtgcagctgtggagcagcgccctgctgcgggacctgaacaaggcctgtggaaatgccatggatgcccatgaagctgcccagatgcaccagaacttcagccagcagctgctgcaggaccacatcgaggcctgcagcctgcctgagcacaacctgatcacctggacagatggccccccacctgtgcagttccaggcccagaatggccccaacaccagcctggccagcctgctgtag

SEQ ID NO: 15995 - DNA, 504 bp, Artificial Sequence; identical to SEQ ID NO: 15993
  Description of Artificial Sequence: Synthetic coding sequence

SEQ ID NO: 15996 - DNA, 426 bp, Artificial Sequence
  Description of Artificial Sequence: Synthetic coding sequence
atgagcagccccccccacagcggccagacagtgcaccccccctgcagcagcaagctgaggatggaccccaccccagcctggccagccagctgtgaggccctgatgggccccagcagcagcgctggccctgcccggctgcggctgcccccaagaagacacagcagcctgcccccaagaagagccagcttcctgattgtgtcccgggccagcaagtcctgggagtgtgccggccctgtgcctgccctgcctggaggagtggtggccgtgcccaccagccagcaggacccccagtgccggggcagccaggtggcccaccggcgctgcctgagccgggccatcctgcagagcggcccccagtgccagagctgcctgagcatctgggtgaccagcgcccggagccgggtgcaggccagcagccgctcctag

SEQ ID NO: 15997 - DNA, 666 bp, Artificial Sequence
  Description of Artificial Sequence: Synthetic coding sequence
atggctgctgctgtgaggatgaacatccagatgctgctggaggccgctgactacctggagcggcgggagcgggaggccgagcacggctacgcctccatgctgccctacaacaacaaggacagagatgccctgaagagaagaaacaagagcaagaagaacaacagcagcagccgcagcacccacaatgagatggagaagaacagaagagcccacctgcggctgtgcctggagaagctgaagggcctggtgcccctgggccctgagagcagccgccacaccaccctgagcctgctgaccaaggccaagctgcacatcaagaagctggaggactgtgacaggaaggctgtgcaccagattgaccagctgcagcgggagcagaggcacctgaagaggcagctggagaagctgggcatcgagcgcatccgcatggacagcatcggcagcacagtgagcagcgagaggagtgacagcgaccgggaggagattgatgtggatgtggagagcacagactacctgactggagacctggactggagcagcagctctgtgtctgacagtgatgagcggggctccatgcagagcctgggcagtgatgagggctacagcagcaccagcatcaagaggatcaagctgcaggacagccacaaggcctgcctgggcctgtag

SEQ ID NO: 15998 - DNA, 636 bp, Artificial Sequence
  Description of Artificial Sequence: Synthetic coding sequence
atggctgctgctgtgaggatgaacatccagatgctgctggaggccgctgactacctggagcggcgggagcgggaggccgagcacggctacgcctccatgctgccctacaacaacaaggacagagatgccctgaagagaagaaacaagagcaagaagaacaacagcagcagccggcgggcccacctgcggctgtgcctggagaagctgaagggcctggtgcccctgggccctgagagcagccgccacaccaccctgagcctgctgaccaaggccaagctgcacatcaagaagctggaggactgtgacaggaaggctgtgcaccagattgaccagctgcagcgggagcagaggcacctgaagaggcagctggagaagctgggcatcgagcgcatccgcatggacagcatcggcagcacagtgagcagcgagaggagtgacagcgaccgggaggagattgatgtggatgtggagagcacagactacctgactggagacctggactggagcagcagctctgtgtctgacagtgatgagcggggctccatgcagagcctgggcagtgatgagggctacagcagcaccagcatcaagaggatcaagctgcaggacagccacaaggcctgcctgggcctgtag

SEQ ID NO: 15999 - DNA, 630 bp, Artificial Sequence
  Description of Artificial Sequence: Synthetic coding sequence
atggagctgaacagcctgctgatcctgctggaggccgctgagtacctggagcggcgggaccgggaggccgagcacggctacgcctctgtgctgccctttgatggagactttgcccgggagaagaccaaggctgctggcctggtgaggaaggcccccaacaacagaagcagccacaatgagctggagaagcacagaagagccaagctgcggctgtacctggagcagctgaagcagctggtgcccctgggccctgacagcaccaggcacaccaccctgagcctgctgaagagggccaaggtgcacatcaagaagctggaggagcaggaccggcgggccctgagcatcaaggagcagctgcagcaggagcaccgcttcctgaagaggcggctggagcagctgtctgtgcagagcgtggagcgggtgaggacagacagcacaggcagcgctgtgtccacagatgattctgagcaggaggtggacatcgagggcatggagtttggacctggagagctggacagcgtgggcagcagcagtgatgctgatgaccactacagcctgcagagcggcaccggcggggacagcggcttcggcccccactgccggcggctgggccggcctgccctgtcctag

SEQ ID NO: 16000 - DNA, 177 bp, Artificial Sequence
  Description of Artificial Sequence: Synthetic coding sequence
atggagctgaacagcctgctgatcctgctggaggccgctgagtacctggagcggcgggaccgggaggccgagcacggctacgcctctgtgctgccctttgatggagactttgcccgggagaagaccaaggctgctggcctggtgaggaaggcccccaacaaccggcccccccagtag

SEQ ID NO: 16001 - DNA, 1293 bp, Artificial Sequence
  Description of Artificial Sequence: Synthetic coding sequence
atgtttgatggctatgacagctgcagcgaggacaccagcagcagcagcagcagcgaggagagcgaggaggaggtggcccccctgcccagcaacctgcccatcatcaagaacaacggccaggtgtacacctacccagatggcaagagcggcatggccacctgtgagatgtgtggcatggtgggcgtgagagatgccttctacagcaagaccaagcgcttctgcagcgtgtcctgcagccgcagctacagcagcaacagcaagaaggccagcatcctggcccggctgcagggcaagccacccaccaagaaggccaaggtgctgcagaagcagcccctggtggccaagctggccgcctatgcccagtaccaggccaccctgcagaaccaggccaagaccaaggctgctgtgtccatggagggcttctcctggggcaactacatcaacagcaacagcttcatcgccgcccctgtgacctgcttcaagcacgcccccatgggcacctgctggggagacatcagtgaaaatgtgcgggtggaggtgcccaacacagactgcagcctgcccaccaaggtgttctggattgctggcatcgtgaagctggccggctacaatgccctgctgcgctatgagggctttgaaaatgacagcggcctggacttctggtgcaacatctgtggcagtgacatccaccctgtgggctggtgtgccgccagcggcaagcccctggtgccccccaggaccatccagcacaagtacaccaactggaaggccttcctggtgaagaggctgaccggggccaagaccctgcccccagacttcagccagaaggtgtctgagagcatgcagtaccccttcaagccctgcatgagggtggaggtggtggacaagaggcacctgtgcaggaccagggtggccgtggtggagagcgtgattggaggccgcctgcggctggtgtatgaggagagcgaggacagaacagatgacttctggtgccacatgcacagccccctcatccaccacatcggctggagccgcagcatcggccaccgcttcaagagaagtgacatcaccaagaagcaggacggccactttgacaccccaccccacctgtttgccaaggtgaaggaggtggaccagagcggggagtggttcaaggagggcatgaagctggaggccatcgaccccctgaacctgagcaccatctgtgtggccaccatcaggaaggtgacccagaacttcctgctgaatggcctgaccaccagcggcaagctggcccccctgcagcaccagtag

SEQ ID NO: 16002 - DNA, 1887 bp, Artificial Sequence
  Description of Artificial Sequence: Synthetic coding sequence
atgtttgatggctatgacagctgcagcgaggacaccagcagcagcagcagcagcgaggagagcgaggaggaggtggcccccctgcccagcaacctgcccatcatcaagaacaacggccaggtgtacacctacccagatggcaagagcggcatggccacctgtgagatgtgtggcatggtgggcgtgagagatgccttctacagcaagaccaagcgcttctgcagcgtgtcctgcagccgcagctacagcagcaacagcaagaaggccagcatcctggcccggctgcagggcaagccacccaccaagaaggccaaggtgctgcagaagcagcccctggtggccaagctggccgcctatgcccagtaccaggccaccctgcagaaccaggccaagaccaaggctgctgtgtccatggagggcttctcctggggcaactacatcaacagcaacagcttcatcgccgcccctgtgacctgcttcaagcacgcccccatgggcacctgctggggagacatcagtgaaaatgtgcgggtggaggtgcccaacacagactgcagcctgcccaccaaggtgttctggattgctggcatcgtgaagctggccggctacaatgccctgctgcgctatgagggctttgaaaatgacagcggcctggacttctggtgcaacatctgtggcagtgacatccaccctgtgggctggtgtgccgccagcggcaagcccctggtgccccccaggaccatccagcacaagtacaccaactggaaggccttcctggtgaagaggctgaccggggccaagaccctgcccccagacttcagccagaaggtgtctgagagcatgcagtaccccttcaagccctgcatgagggtggaggtggtggacaagaggcacctgtgcaggaccagggtggccgtggtggagagcgtgattggaggccgcctgcggctggtgtatgaggagagcgaggacagaacagatgacttctggtgccacatgcacagccccctcatccaccacatcggctggagccgcagcatcggccaccgcttcaagagaagtgacatcaccaagaagcaggacggccactttgacaccccaccccacctgtttgccaaggtgaaggaggtggaccagagcggggagtggttcaaggagggcatgaagctggaggccatcgaccccctgaacctgagcaccatctgtgtggccaccatcaggaaggtgctggctgatggcttcctgatgattggaattgatggcagcgaggccgcagatggcagtgactggttctgctaccacgccaccagccccagcatcttccctgtgggcttctgtgagatcaacatgattgagctgaccccaccccggggctacaccaagctgcccttcaagtggtttgactacctgcgggagaccggcagcattgctgcccctgtgaagctgttcaacaaggatgtgcccaaccacggcttccgggtgggcatgaagctggaggccgtggacctgatggagcccaggctcatctgtgtggccaccgtgacccgcatcatccaccggctgctgcgcatccactttgatggctgggaggaggagtatgaccagtgggtggactgtgagagcccagacctgtaccctgtgggctggtgccagctgaccggctaccagctgcagcccccagccagccagagcagccgggagaaccagagcgccagcagcaagcagaagaagaaggccaagagccagcagtacaagggccacaagaagatgaccaccctgcagctgaaggaggagctgctggatggagaggactacaacttcctgcagggcgccagtgaccaggagagcaatggaagtgccaacttctacatcaagcaggagccctag

SEQ ID NO: 16003 - DNA, 1887 bp, Artificial Sequence; identical to SEQ ID NO: 16002
  Description of Artificial Sequence: Synthetic coding sequence

SEQ ID NO: 16004 - DNA, 1887 bp, Artificial Sequence; identical to SEQ ID NO: 16002
  Description of Artificial Sequence: Synthetic coding sequence

SEQ ID NO: 16005 - DNA, 16791 bp, Artificial Sequence
  Description of Artificial Sequence: Synthetic coding sequence
atggagcacttcctgctggaggtggccgccgcccccctgcggctgattgctgccaagaatgagaagagccgctctgagctgggccgcttcctggccaagcaggtgtggaccccccaggaccggcagtgtgtgctgagcaccctggcccagctgctgctggacaaggactgcaccgtgctggtgggccggcagctgcggcccctgctgctggacctgctggagagaaatgctgaggccatcaaggccggcggccagatcaaccacgacctgcacgagcggctgtgtgtgtccatgagcaagctgattggcaaccacccagatgtgctgccctttgccctgcgctacttcaaggacaccagccctgtgttccagaggctcttcctggagagcagtgatgccaaccctgtgcgctatggaagaagaaggatgaagctgcgggacctgatggaggccgccttcaagttcctgcagcaggagcagagcgtcttccgggagctgtgggactggagcgtgtgtgtgcccctgctgcggagccatgacaccctggtgcgctggtacacagccaactgcctggccctggtgacctgcatgaatgaggagcacaagctgtccttcctgaagaagatcttcaacagtgatgagctgatccacttccggctgcggctgctggaggaggcccagctgcaggacctggagaaggccctggtgctggccaaccctgaggtgtccctgtggaggaagcagaaggagctgcagtacctgcagggccacctggtgtccagtgacctgagcccccgggtgacagctgtgtgtggggtggtgctgcccggccagctgcctgcccctggagagctgggcggcaacagaagcagcagccgggagcaggagctggccctgcggagctatgtgctggtggagagcgtgtgcaagagcctgcagaccctggccatggctgtggccagccagaatgctgtgctgctggagggccccatcggctgcggcaagaccagcctggtggagtacctggccgctgtgacaggccgcaccaagccaccccagctgctgaaggtgcagctgggggaccagacagacagcaagatgctgctgggcatgtaccgctgcacagatgtgcctggagaatttgtgtggcagcccggcaccctgacccaggccgccaccatgggccactggatcctgctggaggacattgattatgcccccctggatgtggtgtctgtgctgatccccctgctggagaatggagagctgctgatccctggccgcggggactgcctgaaggtggcccctggcttccagttctttgccacccggcggctgctgagctgtggcggcaactggtaccggcccctgaacagccacgccaccctgctggacaagtactggaccaagatccacctggacaacctggacaagcgggagctgaatgaggtgctgcagagccgctaccccagcctgctggccgtggtggaccacctgctggacatctacatccagctgactggagagaagcaccacagctggagcgacagctctgtgggctgtgagcaggcccctgaggaggtgtctgaggcccggcgggagaacaagaggcccaccctggagggccgggagctgagcctgcgggacctgctgaactggtgcaacagaattgcccacagctttgacagcagcagcctgagcgccagcctgaacatcttccaggaggccctggactgcttcaccgccatgctgtctgagcacaccagcaagctgaagatggccgaggtgattggcagcaagctgaacatcagcaggaagaaggccgagttcttctgccagctgtacaagccagaaattgtcatcaatgagctggacctgcaggtgggccgggtgcggctgctgaggaagcagagcgaggccgtgcacctgcagcgggagaagttcacctttgctgccacccggcccagctctgtgctgattgagcagctggccgtgtgtgtgtccaaaggagagcctgtgctgctggtgggggagactggaacaggcaagaccagcaccatccagtacctggcccacatcaccggccaccggctgcgggtggtgaacatgaaccagcagagcgacacagctgacctgctgggcggctacaagcctgtggaccacaagctgatctggctgcccctgcgggaggcctttgaggagctgtttgcccagaccttcagcaagaagcagaacttcaccttcctgggccacatccagacctgctaccggcagaagcgctggcatgacctgctgcggctgatgcagcacgtgcacaagtctgctgtgaacaaggatggcaaggacagcgagaccggcctgctgatcaaggagaagtgggaggccttcggcctgcggctgaaccacgcccagcagcagatgaagatgacagagaacaccctgctgtttgcctttgtggagggcaccctggcccaggccgtgaagaagggggagtggatcctgctggatgagatcaacctggccgcccctgagatcctggagtgcctgagcggcctgctggagggcagcagcggcagcctggtgctgctggacagaggagacacagagcccctggtgcgccacccagacttccggctgtttgcctgcatgaacccagccacagatgtgggcaagaggaacctgcccccaggcatccggaaccgcttcacagagctgtatgtggaggagctggagagcaaggaggacctgcaggtgctgattgtggactacctgaagggcctgtctgtgaacaagaacacagtgcagggcatcatcaacttctacacagccctgaggaaggagagcggcaccaagctggtggatggcaccggccaccggccccactacagcctgcggaccctgtgccgggccctgcgctttgctgccagcaacccctgtggcaacatccagaggagcctgtatgagggcttctgcctgggcttcctgacccagctggaccgggccagccaccccatcgtgcagaagctgatctgccagcacatcgtgcctggaaatgtgaagagcctgctgaagcagcccatccctgagcccaagggcggccgcctcatccaggtggagggctactggattgctgtgggggacaaggagcccaccattgatgagacctacatcctgaccagctctgtgaagctgaacctgcgggacatcgtgcgggtggtgtctgctggcacctaccctgtgctgatccagggcgagacctctgtgggcaagaccagcctcatccagtggctggccgccgccactggaaaccactgtgtgcgcatcaacaaccacgagcacacagacatccaggagtacatcggctgctacaccagtgacagcagcggcaagctggtgttcaaggagggcgtgctgattgatgccatgaggaagggctactggatcatcctggatgagctgaacctggcccccacagatgtgctggaggccctgaaccggctgctggatgacaaccgggagctgctggtgacagagacccaggaggtggtgaaggcccacccccgcttcatgctgtttgccacccagaaccccccaggcctgtatggaggcaggaaggtgctgagccgggccttcaggaacagatttgtggagctgcactttgatgagctgcccagcagcgagctggagaccatcctgcacaagcgctgcagcctgcccccatcctactgcagcaagctggtgaaggtgatgctggacctgcagagctacagaagaagcagctctgtgtttgctgggaagcagggcttcatcaccctgcgggacctcttccgctgggccgagcgctaccgcctggccgagcccacagagaaggagtatgactggctgcagcacctggccaatgatggctacatgctgctggccggccgggtgaggaagcaggaggagattgatgtgatccaggaggtgctggagaagcacttcaagaagaagctgtgcccccagagcctcttcagcaaagaaaatgtgctgaagctgctgggcaagctgagcacccagatcagcaccctggagtgcaactttggccacatcgtgtggacagagggcatgaggcggctggccatgctggtgggccgggccctggagtttggagagcctgtgctgctggtgggggacaccggctgtgggaagaccaccatctgccaggtgtttgctgccctggccaaccagaagctgtacagcgtgtcctgccacctgcacatggagaccagtgacttcctgggcggcctgcggcctgtgcggcagaagcccaatgacaaggaggagattgacaccagccggctgtttgagtggcatgatggccccctggtgcaggccatgaaggaggatggcttcttcctgctggatgagatcagcctggctgatgacagcgtgctggagcggctgaacagcgtgctggaggtggagaagagcctggtgctggccgagaagggcagccctgaggacaaggacagcgagattgagctgctgacagctgggaagaagttccgcatcctggccaccatgaaccctggaggagactttgggaagaaggagctgagccctgccctgaggaaccgcttcacagagatctggtgcccccagagcaccagccgggaggacctgatccagatcatcagccacaacctgcggcccggcctgtgcctgggcagaattgaccccaagggcagtgacatccctgaggtgatgctggacttcatcgactggctgacccaccaggagtttggaagaaaatgtgtggtgtccatccgggacatcctgtcctgggtgaacttcatgaacaagatgggagaggaggccgccctgaagaggcctgagatcatcagcacagtgaccagctttgtgcacgccgcctgcctggtgtacattgatggcatcggcagcggcgtgaccagcagcggcttcggcacagccctgctggccaggaaagaatgtctgaagttcctgatcaagaggctggccaagatcgtgcggctgacagagtaccagaagaatgagctgaagatctatgacaggatgaaggccaaggagttcaccggcatcgacaacctgtggggcatccaccccttcttcatcccccggggccctgtgctgcacaggaacaacattgctgactatgccctgtctgctggcaccacagccatgaatgcccagaggctgctgcgggccaccaagctgaagaagcccatcctgctggagggcagccctggggtgggcaagaccagcctggtgggcgccctggccaaggccagcggcaacaccctggtgcgcatcaacctgtctgagcagacagacatcacagacctgtttggagctgacctgcctgtggagggcggcaaaggaggagaatttgcctggagagatggccccctgctggccgccctgaaggccggccactgggtggtgctggatgagctgaacctggccagccagagcgtgctggagggcctgaatgcctgctttgaccacagaggagagatctacgtgcctgagctgggcatgtccttccaggtgcagcacgagaagaccaagatcttcggctgccagaaccccttccggcagggcggcggcaggaagggcctgcccaggagcttcctgaaccgcttcacccaggtgtttgtggaccccctgactgtgattgacatggagttcatcgccagcaccctcttccctgccatcgagaagaacatcgtgaagaagatggtggccttcaacaaccagattgaccacgaggtgacagtggagaagaagtggggccagaagggcggcccctgggagttcaacctgcgggacctcttccgctggtgccagctgatgctggtggaccagagccctggctgctatgaccccggccagcacgtgttcctggtgtatggagagaggatgaggacagaggaggacaagaagaaggtgattgctgtgttcaaggatgtgtttggcagcaacagcaacccctacatgggcaccaggctcttccgcatcaccccctatgatgtgcagctgggctacagcgtgctgagccggggcagctgtgtgccccaccccagccgccaccccctgctgctgctgcaccagagcttccagcccctggagagcatcatgaagtgtgtgcagatgtcctggatggtgatcctggtgggccctgcctctgtgggcaagaccagcctggtgcagctgctggcccacctgaccggccacaccctgaagatcatggccatgaacagcgccatggacaccacagagctgctgggcggctttgagcaggtggacctgatccggccctggaggcggctgctggagaaggtggagggcaccgtgcgggccctgctgcgggacagcctgctgatctctgcagatgatgctgaggtggtgctgcgggcctggagccacttcctgctgacctacaagcccaagtgcctgggggagggcggcaaggccatcaccatggagatcgtgaacaagctggaggccgtgctgctgctgatgcagaggctgaacaacaagatcaacagctactgcaaggccgagtttgccaagctggtggaggagttccgcagctttggagtgaagctgacccagctggccagcggccacagccacggcacctttgagtgggtggacagcatgctggtgcaggccctgaagagcggggactggctgctgatggacaacgtgaacttctgcaaccccagcgtgctggaccggctgaatgccctgctggagcctggaggagtgctgaccatcagcgagcggggcatgattgatggcagcacccccaccatcacccccaaccccaacttccgcctcttcctgtccatggaccctgtgcacggggacatcagccgggccatgaggaacagaggcctggagatctacatctctggagaaggagatgccagcaccccagacaacctggacctgaaggtgctgctgcacagcctgggcctggtgggcaacagcgtgtgtgacatcctgctggccctgcacacagagaccaggagcacagtggtgggcagccccaccagctctgtgtccaccctcatccagacagccatcctgattgtgcagtacctgcagaggggcctgagcctggaccgggccttcagcgaggcctgctgggaggtgtatgtgtgcagccagcacagccctgccaacaggaagctggtgcaggccctgctggagaagcacgtgagcagcctgcgggcccacgagacctggggagacagcatcctgggcatgggcctgtggccagacagcgtgcccagcgccctgtttgccacagaggacagccacctgagcacagtgagaagagatggccagatcctggtgtactgcctgaacaggatgtccatgaagaccagctcctggaccaggagccagcccttcaccctgcaggacctggagaagatcatgcagagccccagccctgagaacctgaagttcaatgctgtggaggtgaacacctactggattgatgagccagatgtgctggtgatggctgtgaagctgctgattgaaagagccaccaaccaggactggatgctgcgggtgaagtggctgtaccacctggccaagaacatcccccagggcctggagagcatccagatccacctggaggccagcgctgccagcctgaggaacttctacagccacagcctgtctggagctgtgtccaatgtgttcaagatcctgcagcccaacaccacagatgaatttgtgatccccctggacccccgctggaacatgcaggccctggacatgatccggaacctgatggactttgacccccagacagaccagcctgaccagctgtttgccctgctggagagcgctgccaacaagaccatcatctacctggaccgggagaagagggtcttcacagaggccaacctggtgtctgtgggcagcaagaagctgcgggagagcgtgctgaggatgagctttgagttccaccaggaccctgagagctaccacaccctgccccatgaaattgtggtgaacctggccgccttctttgagctgtgtgatgccctggtgctgctgtgggtgcagagcagccagggcatggtgtctgatgccagcgccaatgagatcctgggcagcctgcgctggagggaccgcttctggacagtggccgacacagtgaaggtggatgcccctggcctggccctgctggccctgcactggcactgggtgctgaagcacctggtgcaccagatcccccggctgctgatgaactatgaggacaagtactacaaggaggtgcagacagtgtctgagcacatccagaactgcctgggcagccagacaggaggctttgctggcatcaagaagctgcagaagttcctgggccggcccttccccttcaaggacaagctggtggtggagtgcttcagccagctgaaggtgctgaacaaggtgctggccatccgggagcagatgtctgccctgggggagagcggctggcaggaggacatcaaccggctgcaggtggtggccagccagtggaccctgaagaagagcctgctgcaggcctggggcctcatcctgcgggccaacatcctggaggatgtgtccctggatgagctgaagaactttgtgcacgcccagtgcctggagctgaaggccaagggcctgagcctgggcttcctggagaagaagcatgatgaggccagcagcctgagccacccagacctgaccagcgtcatccacctgaccaggtctgtgcagctgtggccagccatggagtacctggccatgctgtggagatacaaggtgacagctgacttcatggcccaggcctgcctgcggcgctgcagcaagaaccagcagccccagatcaatgaggagatcagccacctgatctccttctgcctgtaccacacccctgtgaccccccaggagctgcgggacctgtggagcctgctgcaccaccagaaggtgtccccagaggagatcaccagcctgtggagcgagctgttcaacagcatgttcatgtccttctggagcagcacagtgaccaccaaccctgagtactggctgatgtggaaccccctgcccggcatgcagcagcgggaggcccccaagtctgtgctggacagcaccctgaagggccctggcaacctgaaccggcccatcttcagcaagtgctgctttgaggtgctgaccagctcctggagggccagcccctgggatgtgtctggcctgcccatcctgagcagcagccacgtgaccctgggggagtgggtggagaggacccagcagctgcaggacatcagctccatgctgtggaccaacatggccatcagctctgtggccgagttccggaggacagacagccagctgcagggccaggtgctcttccgccacctggccggcctggccgagctgctgcctgagagccggcggcaggagtacatgcagaactgtgagcagctgctgctgggcagcagccaggccttccagcacgtgggccagaccctgggggacatggccggccaggaggtgctgcccaaggagctgctgtgccagctgctgaccagcctgcaccactttgtgggggagggggagagcaagaggagcctgcctgagcccgcccagaggggcagcctgtgggtgtccctgggcctgctgcagatccagacctggctgccccaggccaggtttgatcctgctgtgaagcgggagtacaagctgaactacgtgaaggaggagctgcaccagctgcagtgtgagtggaagaccaggaacctgagcagccagctgcagacaggccgggacctggaggatgaggtggtggtgtcctacagccacccccacgtgcggctgctgcggcagaggatggaccggctggacaacctgacctgccacctgctgaagaagcaggccttccggccccagctgcctgcctatgagagcctggtgcaggagatccaccactacgtgaccagcatcgccaaggccccagctgtgcaggacctgctgacccggctgctgcaggccctgcacattgatggccccaggtctgcccaggtggcccagagcctgctgaaggaggaggcctcctggcagcagagccaccaccagttcaggaagaggctgtctgaggagtacaccttctacccagatgctgtgagccccctgcaggccagcatcctgcagctgcagcacggcatgaggctggtggccagcgagctgcacaccagcctgcacagctccatggtgggcgctgaccggctgggcaccctggccacagccctgctggccttccccagcgtgggccccaccttccccacctactatgcccacgccgacaccctgtgcagcgtgaagtctgaggaggtgctgcggggcctgggcaagctgatcctgaagaggtctgggggcaaggagctggagggcaagggccagaaggcctgccccacccgggagcagctgctgatgaatgccctgctgtacctgcggagccacgtgctgtgcaagggggagctggaccagagggccctgcagctgttccgccacgtgtgccaggagatcatcagcgagtgggatgagcaggagagaattgcccaggagaaggccgagcaggagagcggcctgtaccgctaccgcagcaggaacagcaggacagccctgtctgaggaggaggaggaggagcgggagttcaggaagcagttccccctgcacgagaaggactttgctgacatcctggtgcagcccaccctggaggagaacaagggcaccagtgatggccaggaggaggaggccggcaccaacccagccctgctgagccagaacagcatgcaggccgtgatgctgatccaccagcagctgtgcctgaactttgcccggagcctgtggtaccagcagaccctgccccctcatgaggccaagcactacctgagcctcttcctgagctgctaccagacaggagccagcctggtgacccacttctaccccctgatgggcgtggagctgaatgaccggctgctgggcagccagctgctggcctgcaccctgagccacaacaccctgtttggagaggcccccagcgacctgatggtgaagccagatggcccctatgacttctaccagcaccccaacgtgcctgaggcccggcagtgccagcctgtgctgcagggcttcagcgaggccgtgagccacctgctgcaggactggccagagcacccagccctggagcagctgctggtggtgatggaccgcatccgctccttccccctgagcagccccatcagcaagttcctgaatggcctggagatcctgctggccaaggcccaggactgggaggagaatgccagccgggccctgagcctgaggaagcacctggacctgatcagccagatgatcatccgctggaggaagctggagctgaactgctggagcatgagcctggacaacaccatgaagaggcacacagagaagagcaccaagcactggttcagcatctaccagatgctggagaagcacatgcaggagcagacagaggagcaggaggatgacaagcagatgaccctgatgctgctggtgtccaccctgcaggccttcatcgagggcagcagcctgggggagttccacgtgcggctgcagatgctgctggtgttccactgccacgtgctgctgatgccccaggtggagggcaaggacagcctgtgcagcgtgctgtggaacctgtaccactactacaagcagttctttgacagagtgcaggccaagatcgtggagctgcggagccccctggagaaggagctgaaggagtttgtgaagatcagcaagtggaatgatgtgtccttctggagcatcaagcagagcgtggagaagacccacaggaccctcttcaagttcatgaagaagtttgaagctgtgctgtctgagccctgccgcagcagcctggtggagagtgacaaggaggagcagcctgacttcctgccccggcccacagatggagctgccagcgagctgagcagcatccagaacctgaacagagccctgcgggagaccctgctggcccagcctgctgctggccaggccaccatccctgagtggtgccagggcgccgcccccagcggcctggagggggagctgctgcggcggctgcccaagctgaggaagaggatgaggaagatgtgcctgaccttcatgaaggagagccccctgccccggctggtggagggcctggaccagttcaccggggaggtgatcagctctgtgtctgagctgcagagcctgaaggtggagcccagcgctgagaaggagaagcagaggtctgaggccaagcacatcctgatgcagaagcagagggccctgagtgacctcttcaagcacctggccaagattggcctgagctacaggaagggcctggcctgggcccggagcaagaacccccaggagatgctgcacctgcaccccctggacctgcagagcgccctgagcatcgtgagcagcacccaggaggccgacagccggctgctgacagagatcagcagctcctgggatggctgccagaagtacttctaccgcagcctggcccggcatgcccggctgaatgctgccctggccaccccagccaaggagatgggcatgggaaatgtggagcgctgccggggcttcagcgcccacctgatgaagatgctggtgcggcagaggaggagcctgaccaccctgtctgagcagtggatcatcctgaggaacctgctgagctgtgtgcaggagatccacagccggctgatgggcccccaggcctaccctgtggccttccccccccaggatggagtgcagcagtggacagagcggctgcagcacctggccatgcagtgccagatcctgctggagcagctgtcctggctgctgcagtgctgccccagcgtgggccctgcccctggccacggcaatgtgcaggtgctgggccagcccccaggcccctgcctggagggccctgagctgagcaagggccagctgtgtggggtggtgctggacctgatccccagcaacctgagctaccccagccccatccctggcagccagctgcccagcggctgcaggatgaggaagcaggaccacctgtggcagcagagcaccacccggctgacagagatgctgaagaccatcaagacagtgaaggcagatgtggacaagatccggcagcagagctgtgagaccctcttccacagctggaaggactttgaggtgtgcagcagcgccctgagctgcctgagccaggtgtctgtgcacctgcagggcctggagagcctcttcatcctgcccggcatggaggtggagcagagggacagccagatggccctggtggagagcctggagtatgtgcggggggagatcagcaaggccatggctgacttcaccacctggaagacccacctgctgaccagtgacagccagggcggcaaccagatgctggatgagggctttgtggaggacttcagcgagcagatggagatcgccatccgggccatcctgtgtgccatccagaacctggaggagaggaagaatgagaaggccgaggagaacacagaccaggccagcccccaggaggactatgccggctttgagcggctgcagagcggccacctgaccaagctgctggaggatgacttctgggcagatgtgtccaccctgcacgtgcagaagatcatcagcgccatcagcgagctgctggagcggctgaagagctatggagaagatggaacagctgccaagcacctgttcttcagccagagctgcagcctgctggtgcggctggtgcctgtgctgagcagctacagcgacctggtgctcttcttcctgaccatgagcctggccacccacaggagcacagccaagctgctgtctgtgctggcccaggtgttcacagagctggcccagaagggcttctgcctgcccaaggagttcatggaggacagcgctggggagggcgccacagagttccatgactatgaaggaggcggcatcggggagggggagggcatgaaggatgtgtctgaccagattggaaatgaggagcaggtggaggacaccttccagaagggccaggagaaggacaaggaggaccctgacagcaagagtgacatcaagggagaagataatgccatcgagatgtctgaagattttgatggcaagatgcatgatggagagctggaggagcaggaggaggatgatgagaagagtgacagcgagggcggggacctggacaagcacatgggagacctgaatggagaggaggccgacaagctggatgagcggctgtggggagatgatgatgaggaggaggatgaggaggaggaggacaacaagacagaggagaccggccctggcatggatgaagaagattctgagctggtggccaaggatgacaacctggacagcggcaacagcaacaaggacaagagccagcaggacaagaaggaggagaaggaggaggccgaggctgatgatggcggccagggcgaggacaagatcaatgagcagattgatgagcgggactatgatgaaaatgaggtggacccctaccacggcaaccaggagaaggtgcctgagcctgaggccctggacctgcctgatgacctgaacctggacagcgaggacaagaatggaggagaggacacagacaatgaggagggggaggaggagaaccccctggagatcaaggagaagccagaggaggccggccacgaggccgaggagcggggggagacagaaacagaccagaatgaaagccagagcccccaggagcctgaggagggccccagtgaagatgacaaggccgagggggaggaggagatggacacaggagcagatgaccaggatggagatgctgcccagcaccctgaggagcacagcgaggagcagcagcagagcgtggaggagaaggacaaggaggctgatgaggagggcggggagaatggacctgctgaccagggcttccagccccaggaggaggaggagagagaagattctgacacagaggagcaggtgcctgaggccctggagaggaaggagcacgccagctgtggccagacaggagtggagaacatgcagaacacccaggccatggagctggccggggccgcccctgagaaggagcagggcaaggaggagcacggcagcggggctgctgatgccaaccaggccgagggccacgagagcaacttcatcgcccagctggccagccagaagcacaccaggaagaacacccagagcttcaagaggaagccaggccaggccgacaatgaaagatccatgggagaccacaatgaaagagtgcacaagaggctgaggacagtggacacagacagccacgccgagcagggccctgcccagcagccccaggcccaggtggaggatgctgatgcctttgagcacatcaagcagggcagtgatgcctatgatgcccagacctatgatgtggccagcaaggagcagcagcagagcgccaaggacagcggcaaggaccaggaggaggaggagattgaggacaccctgatggacacagaggagcaggaggagttcaaggccgcagatgtggagcagctgaagccagaggagatcaagagcggcaccacagcccccctgggctttgatgagatggaggtggagatccagacagtgaagacagaggaggaccaggaccccaggacagacaaggcccacaaggagacagaaaatgagaagccagagaggagccgggagagcaccatccacacagcccaccagttcctgatggacaccatcttccagcccttcctgaaggatgtgaatgagctgcggcaggagctggagcggcagctggagatgtggcagccccgggagagcggcaaccctgaggaggagaaggtggccgctgagatgtggcagagctacctgatcctgacagcccccctgagccagaggctgtgtgaggagctgcggctcatcctggagcccacccaggccgccaagctgaagggggactacagaacaggcaagaggctgaacatcaggaaggtgatcccctacatcgccagccagttcaggaaggacaagatctggctgcggaggaccaagcccagcaagaggcagtaccagatctgcctggccattgatgacagcagctccatggtggacaaccacaccaagcagctggcctttgagagcctggccgtgattggaaatgccctgaccctgctggaggtgggccagattgctgtgtgcagctttggagagagcgtgaagctgctgcaccccttccacgagcagttcagtgactacagcggcagccagatcctgcggctgtgcaagttccagcagaagaagaccaagatcgcccagttcctggagagcgtggccaacatgtttgctgctgcccagcagctgagccagaacatcagcagcgagacagcccagctgctgctggtggtgtctgatggccggggcctcttcctggagggcaaggagcgggtgctggccgctgtgcaggccgccagaaatgccaacatcttcgtcatctttgtggtgctggacaaccccagcagccgggacagcatcctggacatcaaggtgcccatcttcaagggccctggagagatgcctgagatccgcagctacatggaggagttccccttcccctactacatcatcctgagagatgtgaatgccctgcctgagaccctgagtgatgccctgcggcagtggtttgagctggtgacagccagtgaccacccctag

SEQ ID NO: 16006 - DNA, 16791 bp, Artificial Sequence; identical to SEQ ID NO: 16005
  Description of Artificial Sequence: Synthetic coding sequence

SEQ ID NO: 16007 - DNA, 3546 bp, Artificial Sequence
  Description of Artificial Sequence: Synthetic coding sequence
atggagcacttcctgctggaggtggccgccgcccccctgcggctgattgctgccaagaatgagaagagccgctctgagctgggccgcttcctggccaagcaggtgtggaccccccaggaccggcagtgtgtgctgagcaccctggcccagctgctgctggacaaggactgcaccgtgctggtgggccggcagctgcggcccctgctgctggacctgctggagagaaatgctgaggccatcaaggccggcggccagatcaaccacgacctgcacgagcggctgtgtgtgtccatgagcaagctgattggcaaccacccagatgtgctgccctttgccctgcgctacttcaaggacaccagccctgtgttccagaggctcttcctggagagcagtgatgccaaccctgtgcgctatggaagaagaaggatgaagctgcgggacctgatggaggccgccttcaagttcctgcagcaggagcagagcgtcttccgggagctgtgggactggagcgtgtgtgtgcccctgctgcggagccatgacaccctggtgcgctggtacacagccaactgcctggccctggtgacctgcatgaatgaggagcacaagctgtccttcctgaagaagatcttcaacagtgatgagctgatccacttccggctgcggctgctggaggaggcccagctgcaggacctggagaaggccctggtgctggccaaccctgaggtgtccctgtggaggaagcagaaggagctgcagtacctgcagggccacctggtgtccagtgacctgagcccccgggtgacagctgtgtgtggggtggtgctgcccggccagctgcctgcccctggagagctgggcggcaacagaagcagcagccgggagcaggagctggccctgcggagctatgtgctggtggagagcgtgtgcaagagcctgcagaccctggccatggctgtggccagccagaatgctgtgctgctggagggccccatcggctgcggcaagaccagcctggtggagtacctggccgctgtgacaggccgcaccaagccaccccagctgctgaaggtgcagctgggggaccagacagacagcaagatgctgctgggcatgtaccgctgcacagatgtgcctggagaatttgtgtggcagcccggcaccctgacccaggccgccaccatgggccactggatcctgctggaggacattgattatgcccccctggatgtggtgctgcagagccgctaccccagcctgctggccgtggtggaccacctgctggacatctacatccagctgaccggggagaagcaccacagctggagcgacagctctgtgggctgtgagcaggcccctgaggaggtgtctgaggcccggcgggagaacaagaggcccaccctggagggccgggagctgagcctgcgggacctgctgaactggtgcaaccgcatcgcccacagctttgacagcagcagcctgagcgccagcctgaacatcttccaggaggccctggactgcttcaccgccatgctgtctgagcacaccagcaagctgaagatggccgaggtgattggcagcaagctgaacatcagcaggaagaaggccgagttcttctgccagctgtacaagccagagatcgtcatcaatgagctggacctgcaggtgggccgggtgcggctgctgaggaagcagagcgaggccgtgcacctgcagcgggagaagttcacctttgctgccacccggcccagctctgtgctgattgagcagctggccgtgtgtgtgtccaagggggagcctgtgctgctggtgggggagaccggcaccgggaagaccagcaccatccagtacctggcccacatcaccggccaccggctgcgggtggtgaacatgaaccagcagagcgacacagctgacctgctgggcggctacaagcctgtggaccacaagctgatctggctgcccctgcgggaggcctttgaggagctgtttgcccagaccttcagcaagaagcagaacttcaccttcctgggccacatccagacctgctaccggcagaagcgctggcatgacctgctgcggctgatgcagcacgtgcacaagtctgctgtgaacaaggatggcaaggacagcgagaccggcctgctgatcaaggagaagtgggaggccttcggcctgcggctgaaccacgcccagcagcagatgaagatgacagagaacaccctgctgtttgcctttgtggagggcaccctggcccaggccgtgaagaagggggagtggatcctgctggatgagatcaacctggccgcccctgagatcctggagtgcctgagcggcctgctggagggcagcagcggcagcctggtgctgctggacagaggagacacagagcccctggtgcgccacccagacttccggctgtttgcctgcatgaacccagccacagatgtgggcaagaggaacctgcccccaggcatccggaaccgcttcacagagctgtatgtggaggagctggagagcaaagaagacctgcaggtgctgattgtggactacctgaagggcctgtctgtgaacaagaacacagtgcagggcatcatcaacttctacacagccctgaggaaggagagcggcaccaagctggtggatggcaccggccaccggccccactacagcctgcggaccctgtgccgggccctgcgctttgctgccagcaacccctgtggcaacatccagaggagcctgtatgagggcttctgcctgggcttcctgacccagctggaccgggccagccaccccatcgtgcagaagctgatctgccagcacatcgtgcctggaaatgtgaagagcctgctgaagcagcccatccctgagcccaagggcggccgcctcatccaggtggagggctactggattgctgtgggggacaaggagcccaccattgatgagacctacatcctgaccagctctgtgaagctgaacctgcgggacatcgtgcgggtggtgtctgctggcacctaccctgtgctgatccagggcgagacctctgtgggcaagaccagcctcatccagtggctggccgccgccaccggcaaccactgtgtgcgcatcaacaaccacgagcacacagacatccaggagtacatcggctgctacaccagtgacagcagcggcaagctggtgttcaaggagggcgtgctgattgatgccatgaggaagggctactggatcatcctggatgagctgaacctggcccccacagatgtgctggaggccctgaaccggctgctggatgacaaccgggagctgctggtgacagagacccaggaggtggtgaaggcccacccccgcttcatgctgtttgccacccagaaccccccaggcctgtatggaggcaggaaggtgctgagccgggccttcaggaacagatttgtggagctgcactttgatgagctgcccagcagcgagctggagaccatcctgcacaagcgctgcagcctgccccccagctactgcagcaagctggtgaaggtgatgctggacctgcagtag

SEQ ID NO: 16008 - DNA, 3351 bp, Artificial Sequence
  Description of Artificial Sequence: Synthetic coding sequence
atgatcctggatgagttctacaacgtgaagttctgcattgatgccagccagccagatgtgggctcctggctgaagtacatccgctttgctggctgctatgaccagcacaacctggtggcctgccagatcaatgaccagatcttctacagagtggtggccgacatcgcccctggagaggagctgctgctcttcatgaagtctgaggactacccccatgagaccatggccccagacatccacgaggagcggcagtaccgctgtgaggactgtgaccagctgtttgagagcaaggccgagctggccgaccaccagaagttcccctgcagcaccccccacagcgccttctccatggtggaggaggacttccagcagaagctggagagtgaaaatgacctgcaggagatccacaccatccaggagtgcaaggaatgtgaccaggtgtttcctgacctgcagagcctggagaagcacatgctgagccacacagaggagcgggagtacaagtgtgaccagtgccccaaggccttcaactggaagagcaacctgatccgccaccagatgagccatgattctgggaagcactatgaatgtgagaactgtgccaagcaggtgttcacagaccccagcaacctgcagaggcacatccgcagccagcacgtgggcgcccgggcccacgcctgcccagaatgtgggaagacctttgccaccagcagcggcctgaagcagcacaagcacatccacagctctgtgaagcccttcatctgtgaggtgtgccacaagagctacacccagttcagcaacctgtgccgccacaagaggatgcacgccgactgcaggacccagatcaagtgcaaggactgtggccagatgttcagcaccaccagcagcctgaacaagcaccggcgcttctgtgagggcaagaaccactttgctgctgggggcttcttcggccagggcatcagcctgcccggcaccccagccatggacaagacctccatggtgaacatgagccacgccaaccctggcctggccgactactttggagccaacagacaccctgctggcctgaccttccccacagcccctggcttctccttctccttccctggcctcttccccagcggcctgtaccaccggcccccactcatcccagccagcagccctgtgaagggcctgagcagcacagagcagaccaacaagagccagagccccctgatgacccacccccagatcctgcctgccacccaggacatcctgaaggccctgagcaagcaccccagcgtgggggacaacaagcctgtggagctgcagcctgagaggagcagcgaggagcggccctttgagaagatcagtgaccagagcgagagcagtgacctggatgatgtgtccacccccagcggcagtgacctggagaccaccagcggcagtgacctggagagtgacatcgagagtgacaaggagaagttcaaggaaaatggcaagatgttcaaggacaaggtgagccccctgcagaacctggccagcatcaacaacaagaaggagtacagcaaccacagcatcttcagccccagcctggaggagcagacagctgtgtctggagctgtgaatgacagcatcaaggccatcgccagcattgctgagaagtacttcggcagcacaggcctggtgggcctgcaggacaagaaggtgggcgccctgccctaccccagcatgttccccctgcccttcttccctgccttcagccagagcatgtaccccttcccagaccgggacctgcggagcctgcccctgaagatggagccccagagccctggagaggtgaagaagctgcagaagggcagcagcgagagcccctttgacctgaccaccaagaggaaggatgagaagcccctgacccctgtgcccagcaagccccctgtgaccccagccaccagccaggaccagcccctggacctgtccatgggcagccgcagccgggccagcggcaccaagctgacagagcccaggaagaaccacgtgtttggaggcaagaagggcagcaatgtggagagcaggcctgccagtgatggcagcctgcagcacgcccggcccacccccttcttcatggaccccatctacagagtggagaagaggaagctgacagaccccctggaggccctgaaggagaagtacctgcggcccagccctggcttcctgttccacccccagttccagctgcctgaccagaggacctggatgtctgccatcgagaacatggccgagaagctggagagcttcagcgccctgaagccagaggccagcgagctgctgcagagcgtgcccagcatgttcaacttccgggcccccccaaatgccctgcctgagaacctgctgaggaagggcaaggagcgctacacctgccgctactgcggcaagatcttccccaggtctgccaacctgaccaggcacctgcggacccacactggagagcagccctaccgctgcaagtactgtgacaggagcttcagcatcagcagcaacctgcagagacatgtgaggaacatccacaacaaggagaagcccttcaagtgccacctgtgtgaccgctgcttcggccagcagaccaacctggacagacacctgaagaagcatgaaaatggaaacatgtctggaacagccaccagcagcccccacagcgagctggagagcactggagccatcctggatgacaaggaggatgcctacttcacagagatccggaacttcatcggcaacagcaaccacggcagccagagccccagaaatgtggaggagaggatgaatggcagccacttcaaggatgagaaggccctggtgaccagccagaacagcgacctgctggatgatgaggaggtggaggatgaggtgctgctggatgaagaagatgaagataatgacatcaccgggaagacaggcaaggagcctgtgaccagcaacctgcacgagggcaacccagaagatgattatgaggagaccagcgccctggagatgagctgcaagaccagccctgtgcgctacaaggaggaggagtacaagagcggcctgagcgccctggaccacatccgccacttcacagacagcctgaagatgaggaagatggaggacaaccagtacagcgaggccgagctgagcagcttcagcaccagccacgtgcctgaggagctgaagcagcccctgcacaggaagagcaagagccaggcctatgccatgatgctgagcctgagtgacaaggagagcctgcacagcaccagccacagcagcagcaatgtgtggcacagcatggcccgggctgctgctgagagcagcgccatccagagcatcagccacgtgtag

SEQ ID NO: 16009 - DNA, 3156 bp, Artificial Sequence
  Description of Artificial Sequence: Synthetic coding sequence
atgaagtctgaggactacccccatgagaccatggccccagacatccacgaggagcggcagtaccgctgtgaggactgtgaccagctgtttgagagcaaggccgagctggccgaccaccagaagttcccctgcagcaccccccacagcgccttctccatggtggaggaggacttccagcagaagctggagagtgaaaatgacctgcaggagatccacaccatccaggagtgcaaggaatgtgaccaggtgtttcctgacctgcagagcctggagaagcacatgctgagccacacagaggagcgggagtacaagtgtgaccagtgccccaaggccttcaactggaagagcaacctgatccgccaccagatgagccatgattctgggaagcactatgaatgtgagaactgtgccaaggtgttcacagaccccagcaacctgcagaggcacatccgcagccagcacgtgggcgcccgggcccacgcctgcccagaatgtgggaagacctttgccaccagcagcggcctgaagcagcacaagcacatccacagctctgtgaagcccttcatctgtgaggtgtgccacaagagctacacccagttcagcaacctgtgccgccacaagaggatgcatgctgactgcaggacccagatcaagtgcaaggactgtggccagatgttcagcaccaccagcagcctgaacaagcaccggcgcttctgtgagggcaagaaccactttgctgctgggggcttcttcggccagggcatcagcctgcccggcaccccagccatggacaagacctccatggtgaacatgagccacgccaaccctggcctggccgactactttggagccaacagacaccctgctggcctgaccttccccacagcccctggcttctccttctccttccctggcctcttccccagcggcctgtaccacaggcctcctctcatcccagccagcagccctgtgaagggcctgagcagcacagagcagaccaacaagagccagagccccctgatgacccacccccagatcctgcctgccacccaggacatcctgaaggccctgagcaagcaccccagcgtgggggacaacaagcctgtggagctgcagcctgagaggagcagcgaggagcggccctttgagaagatcagtgaccagagcgagagcagtgacctggatgatgtgtccaccccatctggcagtgacctggagaccaccagcggcagtgacctggagagtgacattgaaagtgacaaggagaagttcaaggaaaatggcaagatgttcaaggacaaggtgagccccctgcagaacctggccagcatcaacaacaagaaggagtacagcaaccacagcatcttcagccccagcctggaggagcagacagctgtgtctggagctgtgaatgacagcatcaaggccatcgccagcattgctgagaagtacttcggcagcacaggcctggtgggcctgcaggacaagaaggtgggcgccctgccctaccccagcatgttccccctgcccttcttccctgccttcagccagagcatgtaccccttcccagaccgggacctgcggagcctgcccctgaagatggagccccagagccctggagaggtgaagaagctgcagaagggcagcagcgagagcccctttgacctgaccaccaagaggaaggatgagaagcccctgacccctgtgcccagcaagccccctgtgaccccagccaccagccaggaccagcccctggacctgtccatgggcagccgcagccgggccagcggcaccaagctgacagagcccaggaagaaccacgtgtttggaggcaagaagggcagcaatgtggagagcaggcctgccagtgatggcagcctgcagcacgcccggcccacccccttcttcatggaccccatctacagagtggagaagaggaagctgacagaccccctggaggccctgaaggagaagtacctgcggcccagccctggcttcctgttccacccccagttccagctgcctgaccagaggacctggatgtctgccatcgagaacatggccgagaagctggagagcttcagcgccctgaagccagaggccagcgagctgctgcagagcgtgcccagcatgttcaacttccgggcccccccaaatgccctgcctgagaacctgctgaggaagggcaaggagcgctacacctgccgctactgtgggaagatcttccccaggtctgccaacctgaccaggcacctgcggacccacactggagagcagccctaccgctgcaagtactgtgaccgctccttcagcatcagcagcaacctgcagagacatgtgaggaacatccacaacaaggagaagcccttcaagtgccacctgtgtgaccgctgcttcggccagcagaccaacctggacagacacctgaagaagcatgaaaatggaaacatgagcggcacagccaccagcagcccccacagcgagctggagagcactggagccatcctggatgacaaggaggatgcctacttcacagagatccggaacttcatcggcaacagcaaccacggcagccagagccccagaaatgtggaggagaggatgaatggcagccacttcaaggatgagaaggccctggtgaccagccagaacagcgacctgctggatgatgaggaggtggaggatgaggtgctgctggatgaggaggatgaggacaatgacatcaccgggaagacaggcaaggagcctgtgaccagcaacctgcacgagggcaacccagaagatgattatgaggagaccagcgccctggagatgagctgcaagaccagccctgtgcgctacaaggaggaggagtacaagagcggcctgagcgccctggaccacatccgccacttcacagacagcctgaagatgaggaagatggaggacaaccagtacagcgaggccgagctgagcagcttcagcaccagccacgtgcctgaggagctgaagcagcccctgcacaggaagagcaagagccaggcctatgccatgatgctgagcctgagtgacaaggagagcctgcacagcaccagccacagcagcagcaatgtgtggcacagcatggcccgggctgctgctgagagcagcgccatccagagcatcagccacgtgtag

SEQ ID NO: 16010 - DNA, 3159 bp, Artificial Sequence
  Description of Artificial Sequence: Synthetic coding sequence
atgaagtctgaggactacccccatgagaccatggccccagacatccacgaggagcggcagtaccgctgtgaggactgtgaccagctgtttgagagcaaggccgagctggccgaccaccagaagttcccctgcagcaccccccacagcgccttctccatggtggaggaggacttccagcagaagctggagagtgaaaatgacctgcaggagatccacaccatccaggagtgcaaggaatgtgaccaggtgtttcctgacctgcagagcctggagaagcacatgctgagccacacagaggagcgggagtacaagtgtgaccagtgccccaaggccttcaactggaagagcaacctgatccgccaccagatgagccatgattctgggaagcactatgaatgtgagaactgtgccaagcaggtgttcacagaccccagcaacctgcagaggcacatccgcagccagcacgtgggcgcccgggcccacgcctgcccagaatgtgggaagacctttgccaccagcagcggcctgaagcagcacaagcacatccacagctctgtgaagcccttcatctgtgaggtgtgccacaagagctacacccagttcagcaacctgtgccgccacaagaggatgcacgccgactgcaggacccagatcaagtgcaaggactgtggccagatgttcagcaccaccagcagcctgaacaagcaccggcgcttctgtgagggcaagaaccactttgctgctgggggcttcttcggccagggcatcagcctgcccggcaccccagccatggacaagacctccatggtgaacatgagccacgccaaccctggcctggccgactactttggagccaacagacaccctgctggcctgaccttccccacagcccctggcttctccttctccttccctggcctcttccccagcggcctgtaccaccggcccccactcatcccagccagcagccctgtgaagggcctgagcagcacagagcagaccaacaagagccagagccccctgatgacccacccccagatcctgcctgccacccaggacatcctgaaggccctgagcaagcaccccagcgtgggggacaacaagcctgtggagctgcagcctgagaggagcagcgaggagcggccctttgagaagatcagtgaccagagcgagagcagtgacctggatgatgtgtccacccccagcggcagtgacctggagaccaccagcggcagtgacctggagagtgacatcgagagtgacaaggagaagttcaaggaaaatggcaagatgttcaaggacaaggtgagccccctgcagaacctggccagcatcaacaacaagaaggagtacagcaaccacagcatcttcagccccagcctggaggagcagacagctgtgtctggagctgtgaatgacagcatcaaggccatcgccagcattgctgagaagtacttcggcagcacaggcctggtgggcctgcaggacaagaaggtgggcgccctgccctaccccagcatgttccccctgcccttcttccctgccttcagccagagcatgtaccccttcccagaccgggacctgcggagcctgcccctgaagatggagccccagagccctggagaggtgaagaagctgcagaagggcagcagcgagagcccctttgacctgaccaccaagaggaaggatgagaagcccctgacccctgtgcccagcaagccccctgtgaccccagccaccagccaggaccagcccctggacctgtccatgggcagccgcagccgggccagcggcaccaagctgacagagcccaggaagaaccacgtgtttggaggcaagaagggcagcaatgtggagagcaggcctgccagtgatggcagcctgcagcacgcccggcccacccccttcttcatggaccccatctacagagtggagaagaggaagctgacagaccccctggaggccctgaaggagaagtacctgcggcccagccctggcttcctgttccacccccagttccagctgcctgaccagaggacctggatgtctgccatcgagaacatggccgagaagctggagagcttcagcgccctgaagccagaggccagcgagctgctgcagagcgtgcccagcatgttcaacttccgggcccccccaaatgccctgcctgagaacctgctgaggaagggcaaggagcgctacacctgccgctactgcggcaagatcttccccaggtctgccaacctgaccaggcacctgcggacccacactggagagcagccctaccgctgcaagtactgtgacaggagcttcagcatcagcagcaacctgcagagacatgtgaggaacatccacaacaaggagaagcccttcaagtgccacctgtgtgaccgctgcttcggccagcagaccaacctggacagacacctgaagaagcatgaaaatggaaacatgtctggaacagccaccagcagcccccacagcgagctggagagcactggagccatcctggatgacaaggaggatgcctacttcacagagatccggaacttcatcggcaacagcaaccacggcagccagagccccagaaatgtggaggagaggatgaatggcagccacttcaaggatgagaaggccctggtgaccagccagaacagcgacctgctggatgatgaggaggtggaggatgaggtgctgctggatgaagaagatgaagataatgacatcaccgggaagacaggcaaggagcctgtgaccagcaacctgcacgagggcaacccagaagatgattatgaggagaccagcgccctggagatgagctgcaagaccagccctgtgcgctacaaggaggaggagtacaagagcggcctgagcgccctggaccacatccgccacttcacagacagcctgaagatgaggaagatggaggacaaccagtacagcgaggccgagctgagcagcttcagcaccagccacgtgcctgaggagctgaagcagcccctgcacaggaagagcaagagccaggcctatgccatgatgctgagcctgagtgacaaggagagcctgcacagcaccagccacagcagcagcaatgtgtggcacagcatggcccgggctgctgctgagagcagcgccatccagagcatcagccacgtgtag

SEQ ID NO: 16011 - DNA, 3012 bp, Artificial Sequence
  Description of Artificial Sequence: Synthetic coding sequence
atgaagtctgaggactacccccatgagaccatggccccagacatccacgaggagcggcagtaccgctgtgaggactgtgaccagctgtttgagagcaaggccgagctggccgaccaccagaagttcccctgcagcaccccccacagcgccttctccatggtggaggaggacttccagcagaagctggagagtgaaaatgacctgcaggagatccacaccatccaggagtgcaaggaatgtgaccaggtgtttcctgacctgcagagcctggagaagcacatgctgagccacacagaggagcgggagtacaagtgtgaccagtgccccaaggccttcaactggaagagcaacctgatccgccaccagatgagccatgattctgggaagcactatgaatgtgagaactgtgccaaggtgttcacagaccccagcaacctgcagaggcacatccgcagccagcacgtgggcgcccgggcccacgcctgcccagaatgtgggaagacctttgccaccagcagcggcctgaagcagcacaagcacatccacagctctgtgaagcccttcatctgtgaggtgtgccacaagagctacacccagttcagcaacctgtgccgccacaagaggatgcatgctgactgcaggacccagatcaagtgcaaggactgtggccagatgttcagcaccaccagcagcctgaacaagcaccggcgcttctgtgagggcaagaaccactttgctgctgggggcttcttcggccagggcatcagcctgcccggcaccccagccatggacaagacctccatggtgaacatgagccacgccaaccctggcctggccgactactttggagccaacagacaccctgctggcctgaccttccccacagcccctggcttctccttctccttccctggcctcttccccagcggcctgtaccacaggcctcctctcatcccagccagcagccctgtgaagggcctgagcagcacagagcagaccaacaagagccagagccccctgatgacccacccccagatcctgcctgccacccaggacatcctgaaggccctgagcaagcaccccagcgtgggggacaacaagcctgtggagctgcagcctgagaggagcagcgaggagcggccctttgagaagatcagtgaccagagcgagagcagtgacctggatgatgtgtccaccccatctggcagtgacctggagaccaccagcggcagtgacctggagagtgacattgaaagtgacaaggagaagttcaaggaaaatggcaagatgttcaaggacaaggtgagccccctgcagaacctggccagcatcaacaacaagaaggagtacagcaaccacagcatcttcagccccagcctggaggagcagacagctgtgtctggagctgtgaatgacagcatcaaggccatcgccagcattgctgagaagtacttcggcagcacaggcctggtgggcctgcaggacaagaaggtgggcgccctgccctaccccagcatgttccccctgcccttcttccctgccttcagccagagcatgtaccccttcccagaccgggacctgcggagcctgcccctgaagatggagccccagagccctggagaggtgaagaagctgcagaagggcagcagcgagagcccctttgacctgaccaccaagaggaaggatgagaagcccctgacccctgtgcccagcaagccccctgtgaccccagccaccagccaggaccagcccctggacctgtccatgggcagccgcagccgggccagcggcaccaagctgacagagcccaggaagaaccacgtgtttggaggcaagaagggcagcaatgtggagagcaggcctgccagtgatggcagcctgcagcacgcccggcccacccccttcttcatggaccccatctacagagtggagaagaggaagctgacagaccccctggaggccctgaaggagaagtacctgcggcccagccctggcttcctgttccacccccagatgtctgccatcgagaacatggccgagaagctggagagcttcagcgccctgaagccagaggccagcgagctgctgcagagcgtgcccagcatgttcaacttccgggcccccccaaatgccctgcctgagaacctgctgaggaagggcaaggagcgctacacctgccgctactgcggcaagatcttccccaggtctgccaacctgaccaggcacctgcggacccacactggagagcagccctaccgctgcaagtactgtgacaggagcttcagcatcagcagcaacctgcagagacatgtgaggaacatccacaacaaggagaagcccttcaagtgccacctgtgtgaccgctgcttcggccagcagaccaacctggacagacacctgaagaagcatgaaaatggaaacatgtctggaacagccaccagcagcccccacagcgagctggagagcactggagccatcctggatgacaaggaggatgcctacttcacagagatccggaacttcatcggcaacagcaaccacggcagccagagccccagaaatgtggaggagaggatgaatggcagccacttcaaggatgagaaggccctggtgaccagccagaacagcgacctgctggatgatgaggaggtggaggatgaggtgctgctggatgaagaagatgaagataatgacatcaccgggaagacaggcaaggagcctgtgaccagcaacctgcacgagggcaacccagaagatgattatgaggagaccagcgccctggagatgagctgcaagaccagccctgtgcgctacaaggaggaggagtacaagagcggcctgagcgccctggaccacatccgccacttcacagacagcctgaagatgaggaagatggaggacaaccagtacagcgaggccgagctgagcagcttcagcaccagccacgtgcctgaggagctgaagcagcccctgcacaggaagagcaagagccaggaggagagcaaggcctag

SEQ ID NO: 16012 - DNA, 312 bp, Artificial Sequence
  Description of Artificial Sequence: Synthetic coding sequence
atgaagtctgaggactacccccatgagaccatggccccagacatccacgaggagcggcagtaccgctgtgaggactgtgaccagctgtttgagagcaaggccgagctggccgaccaccagaagttcccctgcagcaccccccacagcgccttctccatggtggaggaggacttccagcagaagctggagagtgaaaatgacctgcaggagatccacaccatccaggagtgcaaggaatgtgaccaggtgtttcctgacctgcagagcctggagaagcacatgctgagccacacagaggagcgggagtactag

SEQ ID NO: 16013 - DNA, 3129 bp, Artificial Sequence
  Description of Artificial Sequence: Synthetic coding sequence
atgaagtctgaggactacccccatgagaccatggccccagacatccacgaggagcggcagtaccgctgtgaggactgtgaccagctgtttgagagcaaggccgagctggccgaccaccagaagttcccctgcagcaccccccacagcgccttctccatggtggaggaggacttccagcagaagctggagagtgaaaatgacctgcaggagatccacaccatccaggagtgcaaggaatgtgaccaggtgtttcctgacctgcagagcctggagaagcacatgctgagccacacagaggagcgggagtacaagtgtgaccagtgccccaaggccttcaactggaagagcaacctgatccgccaccagatgagccatgattctgggaagcactatgaatgtgagaactgtgccaaggtgttcacagaccccagcaacctgcagaggcacatccgcagccagcacgtgggcgcccgggcccacgcctgcccagaatgtgggaagacctttgccaccagcagcggcctgaagcagcacaagcacatccacagctctgtgaagcccttcatctgtgaggtgtgccacaagagctacacccagttcagcaacctgtgccgccacaagaggatgcatgctgactgcaggacccagatcaagtgcaaggactgtggccagatgttcagcaccaccagcagcctgaacaagcaccggcgcttctgtgagggcaagaaccactttgctgctgggggcttcttcggccagggcatcagcctgcccggcaccccagccatggacaagacctccatggtgaacatgagccacgccaaccctggcctggccgactactttggagccaacagacaccctgctggcctgaccttccccacagcccctggcttctccttctccttccctggcctcttccccagcggcctgtaccacaggcctcctctcatcccagccagcagccctgtgaagggcctgagcagcacagagcagaccaacaagagccagagccccctgatgacccacccccagatcctgcctgccacccaggacatcctgaaggccctgagcaagcaccccagcgtgggggacaacaagcctgtggagctgcagcctgagaggagcagcgaggagcggccctttgagaagatcagtgaccagagcgagagcagtgacctggatgatgtgtccaccccatctggcagtgacctggagaccaccagcggcagtgacctggagagtgacattgaaagtgacaaggagaagttcaaggaaaatggcaagatgttcaaggacaaggtgagccccctgcagaacctggccagcatcaacaacaagaaggagtacagcaaccacagcatcttcagccccagcctggaggagcagacagctgtgtctggagctgtgaatgacagcatcaaggccatcgccagcattgctgagaagtacttcggcagcacaggcctggtgggcctgcaggacaagaaggtgggcgccctgccctaccccagcatgttccccctgcccttcttccctgccttcagccagagcatgtaccccttcccagaccgggacctgcggagcctgcccctgaagatggagccccagagccctggagaggtgaagaagctgcagaagggcagcagcgagagcccctttgacctgaccaccaagaggaaggatgagaagcccctgacccctgtgcccagcaagccccctgtgaccccagccaccagccaggaccagcccctggacctgtccatgggcagccgcagccgggccagcggcaccaagctgacagagcccaggaagaaccacgtgtttggaggcaagaagggcagcaatgtggagagcaggcctgccagtgatggcagcctgcagcacgcccggcccacccccttcttcatggaccccatctacagagtggagaagaggaagctgacagaccccctggaggccctgaaggagaagtacctgcggcccagccctggcttcctgttccacccccagatgtctgccatcgagaacatggccgagaagctggagagcttcagcgccctgaagccagaggccagcgagctgctgcagagcgtgcccagcatgttcaacttccgggcccccccaaatgccctgcctgagaacctgctgaggaagggcaaggagcgctacacctgccgctactgcggcaagatcttccccaggtctgccaacctgaccaggcacctgcggacccacactggagagcagccctaccgctgcaagtactgtgacaggagcttcagcatcagcagcaacctgcagagacatgtgaggaacatccacaacaaggagaagcccttcaagtgccacctgtgtgaccgctgcttcggccagcagaccaacctggacagacacctgaagaagcatgaaaatggaaacatgtctggaacagccaccagcagcccccacagcgagctggagagcactggagccatcctggatgacaaggaggatgcctacttcacagagatccggaacttcatcggcaacagcaaccacggcagccagagccccagaaatgtggaggagaggatgaatggcagccacttcaaggatgagaaggccctggtgaccagccagaacagcgacctgctggatgatgaggaggtggaggatgaggtgctgctggatgaagaagatgaagataatgacatcaccgggaagacaggcaaggagcctgtgaccagcaacctgcacgagggcaacccagaagatgattatgaggagaccagcgccctggagatgagctgcaagaccagccctgtgcgctacaaggaggaggagtacaagagcggcctgagcgccctggaccacatccgccacttcacagacagcctgaagatgaggaagatggaggacaaccagtacagcgaggccgagctgagcagcttcagcaccagccacgtgcctgaggagctgaagcagcccctgcacaggaagagcaagagccaggcctatgccatgatgctgagcctgagtgacaaggagagcctgcacagcaccagccacagcagcagcaatgtgtggcacagcatggcccgggctgctgctgagagcagcgccatccagagcatcagccacgtgtag

SEQ ID NO: 16014 - DNA, 69 bp, Artificial Sequence
  Description of Artificial Sequence: Synthetic coding sequence
atgaagtctgaggactacccccatgagaccatggccccagacatccacgaggagcggcagtacagatag

SEQ ID NO: 16015 - DNA, 3156 bp, Artificial Sequence; identical to SEQ ID NO: 16009
  Description of Artificial Sequence: Synthetic coding sequence

SEQ ID NO: 16016 - DNA, 3159 bp, Artificial Sequence; identical to SEQ ID NO: 16010
  Description of Artificial Sequence: Synthetic coding sequence

SEQ ID NO: 16017 - DNA, 207 bp, Artificial Sequence
  Description of Artificial Sequence: Synthetic coding sequence
atgaagtctgaggactacccccatgagaccatggccccagacatccacgaggagcggcagtaccgctgtgaggactgtgaccagctgtttgagagcaaggccgagctggccgaccaccagaagttcccctgcagcaccccccacagcgccttctccatggtggaggaggacttccagcagaagctggagagtgaaaatgacctgtag

SEQ ID NO: 16018 - DNA, 90 bp, Artificial Sequence
  Description of Artificial Sequence: Synthetic coding sequence
atgaagtctgaggactacccccatgagaccatggccccagacatccacgaggagcggcagtaccgctgtgaggactgtgaccagctgtag

SEQ ID NO: 16019 - DNA, 378 bp, Artificial Sequence
  Description of Artificial Sequence: Synthetic coding sequence
atgaagtctgaggactacccccatgagaccatggccccagacatccacgaggagcggcagtaccgctgtgaggactgtgaccagctgtttgagagcaaggccgagctggccgaccaccagaagttcccctgcagcaccccccacagcgccttctccatggtggaggaggacttccagcagaagctggagagtgaaaatgacctgcaggagatccacaccatccaggagtgcaaggaatgtgaccaggtgtttcctgacctgcagagcctggagaagcacatgctgagccacacagaggagcgggagtacaagtgtgaccagtgccccaaggccttcaactggaagagcaacctgatccgccaccagatgagccactag

SEQ ID NO: 16020 - DNA, 312 bp, Artificial Sequence; identical to SEQ ID NO: 16012
  Description of Artificial Sequence: Synthetic coding sequence

SEQ ID NO: 16021 - DNA, 3693 bp, Artificial Sequence
  Description of Artificial Sequence: Synthetic coding sequence
atgaggagcaagggccgggccaggaagctggccaccaacaatgaatgtgtgtatggcaactacccagagatccccctggaggagatgccagatgctgatggagtggccagcacccccagcctgaacatccaggagccctgcagccctgccaccagcagcgaggccttcacccccaaggagggcagcccctacaaggcccccatctacatcccagatgacatccccatcccagctgagtttgagctgcgggagagcaacatgcctggggccggcctgggcatctggaccaagaggaagattgaggtgggggagaagtttggcccctacgtgggggagcagaggagcaacctgaaggaccccagctatggctgggagatcctggatgagttctacaacgtgaagttctgcattgatgccagccagccagatgtgggctcctggctgaagtacatccgctttgctggctgctatgaccagcacaacctggtggcctgccagatcaatgaccagatcttctacagagtggtggccgacatcgcccctggagaggagctgctgctcttcatgaagtctgaggactacccccatgagaccatggccccagacatccacgaggagcggcagtaccgctgtgaggactgtgaccagctgtttgagagcaaggccgagctggccgaccaccagaagttcccctgcagcaccccccacagcgccttctccatggtggaggaggacttccagcagaagctggagagtgaaaatgacctgcaggagatccacaccatccaggagtgcaaggaatgtgaccaggtgtttcctgacctgcagagcctggagaagcacatgctgagccacacagaggagcgggagtacaagtgtgaccagtgccccaaggccttcaactggaagagcaacctgatccgccaccagatgagccatgattctgggaagcactatgaatgtgagaactgtgccaaggtgttcacagaccccagcaacctgcagaggcacatccgcagccagcacgtgggcgcccgggcccacgcctgcccagaatgtgggaagacctttgccaccagcagcggcctgaagcagcacaagcacatccacagctctgtgaagcccttcatctgtgaggtgtgccacaagagctacacccagttcagcaacctgtgccgccacaagaggatgcatgctgactgcaggacccagatcaagtgcaaggactgtggccagatgttcagcaccaccagcagcctgaacaagcaccggcgcttctgtgagggcaagaaccactttgctgctgggggcttcttcggccagggcatcagcctgcccggcaccccagccatggacaagacctccatggtgaacatgagccacgccaaccctggcctggccgactactttggagccaacagacaccctgctggcctgaccttccccacagcccctggcttctccttctccttccctggcctcttccccagcggcctgtaccacaggcctcctctcatcccagccagcagccctgtgaagggcctgagcagcacagagcagaccaacaagagccagagccccctgatgacccacccccagatcctgcctgccacccaggacatcctgaaggccctgagcaagcaccccagcgtgggggacaacaagcctgtggagctgcagcctgagaggagcagcgaggagcggccctttgagaagatcagtgaccagagcgagagcagtgacctggatgatgtgtccaccccatctggcagtgacctggagaccaccagcggcagtgacctggagagtgacattgaaagtgacaaggagaagttcaaggaaaatggcaagatgttcaaggacaaggtgagccccctgcagaacctggccagcatcaacaacaagaaggagtacagcaaccacagcatcttcagccccagcctggaggagcagacagctgtgtctggagctgtgaatgacagcatcaaggccatcgccagcattgctgagaagtacttcggcagcacaggcctggtgggcctgcaggacaagaaggtgggcgccctgccctaccccagcatgttccccctgcccttcttccctgccttcagccagagcatgtaccccttcccagaccgggacctgcggagcctgcccctgaagatggagccccagagccctggagaggtgaagaagctgcagaagggcagcagcgagagcccctttgacctgaccaccaagaggaaggatgagaagcccctgacccctgtgcccagcaagccccctgtgaccccagccaccagccaggaccagcccctggacctgtccatgggcagccgcagccgggccagcggcaccaagctgacagagcccaggaagaaccacgtgtttggaggcaagaagggcagcaatgtggagagcaggcctgccagtgatggcagcctgcagcacgcccggcccacccccttcttcatggaccccatctacagagtggagaagaggaagctgacagaccccctggaggccctgaaggagaagtacctgcggcccagccctggcttcctgttccacccccagatgtctgccatcgagaacatggccgagaagctggagagcttcagcgccctgaagccagaggccagcgagctgctgcagagcgtgcccagcatgttcaacttccgggcccccccaaatgccctgcctgagaacctgctgaggaagggcaaggagcgctacacctgccgctactgcggcaagatcttccccaggtctgccaacctgaccaggcacctgcggacccacactggagagcagccctaccgctgcaagtactgtgacaggagcttcagcatcagcagcaacctgcagagacatgtgaggaacatccacaacaaggagaagcccttcaagtgccacctgtgtgaccgctgcttcggccagcagaccaacctggacagacacctgaagaagcatgaaaatggaaacatgtctggaacagccaccagcagcccccacagcgagctggagagcactggagccatcctggatgacaaggaggatgcctacttcacagagatccggaacttcatcggcaacagcaaccacggcagccagagccccagaaatgtggaggagaggatgaatggcagccacttcaaggatgagaaggccctggtgaccagccagaacagcgacctgctggatgatgaggaggtggaggatgaggtgctgctggatgaagaagatgaagataatgacatcaccgggaagacaggcaaggagcctgtgaccagcaacctgcacgagggcaacccagaagatgattatgaggagaccagcgccctggagatgagctgcaagaccagccctgtgcgctacaaggaggaggagtacaagagcggcctgagcgccctggaccacatccgccacttcacagacagcctgaagatgaggaagatggaggacaaccagtacagcgaggccgagctgagcagcttcagcaccagccacgtgcctgaggagctgaagcagcccctgcacaggaagagcaagagccaggcctatgccatgatgctgagcctgagtgacaaggagagcctgcacagcaccagccacagcagcagcaatgtgtggcacagcatggcccgggctgctgctgagagcagcgccatccagagcatcagccacgtgtag

SEQ ID NO: 16022 - DNA, 312 bp, Artificial Sequence; identical to SEQ ID NO: 16012
  Description of Artificial Sequence: Synthetic coding sequence

SEQ ID NO: 16023 - DNA, 2256 bp, Artificial Sequence
  Description of Artificial Sequence: Synthetic coding sequence
atgtgtgacctgcggcggcctgctgctgggggcatgatggacctggcctacgtgtgtgagtgggagaagtggagcaagagcacccactgccccagcgtgcccctggcctgtgcctggagctgcaggaacctgattgccttcaccatggacctgcggagtgatgaccaggacctgaccaggatgatccacatcctggacacagagcacccctgggacctgcacagcatccccagcgagcaccacgaggccatcacctgcctggagtgggaccagagcggcagccggctgctgtctgcagatgctgatggccagatcaagtgctggagcatggctgaccacctggccaacagctgggagagctctgtgggcagcctggtggagggggaccccatcgtggccctgtcctggctgcacaatggagtgaagctggccctgcacgtggagaagagcggggccagcagctttggagagaagttcagccgggtgaagttcagccccagcctgaccctgtttggaggcaagcccatggagggctggattgctgtgacagtgtctggcctggtgacagtgtccctgctgaagcccagcggccaggtgctgaccagcacagagagcctgtgccgcctgcggggccgggtggccctggccgacatcgccttcaccggcggcggcaacatcgtggtggccacagcagatggcagcagcgccagccctgtgcagttctacaaggtgtgtgtgtctgtggtgtctgagaagtgcagaattgacacagagatcctgcccagcctcttcatgcgctgcaccacagacctgaacaggaaggacaagtttcctgccatcacccacctgaagttcctggcccgggacatgtctgagcaggtgctgctgtgtgccagcagccagaccagcagcatcgtggagtgctggagcctgaggaaggagggcctgcctgtgaacaacatcttccagcagatcagccctgtggtgggggacaagcagcccaccatcctgaagtggaggatcctgagcgccaccaatgacctggacagagtgtctgctgtggccctgcccaagctgcccatcagcctgaccaacacagacctgaaggtggccagtgacacccagttctacccaggcctgggcctggccctggccttccatgatggctctgtgcacatcgtgcaccggctgagcctgcagaccatggctgtgttctacagcagcgctgcccccaggcctgtggatgagcccgccatgaagaggcccaggacagctggccctgctgtgcacctgaaggccatgcagctgtcctggaccagcctggccctggtgggcatcgacagccacggcaagctgtctgtgctgcggctgagccccagcatgggccaccccctggaggtgggcctggccctgcggcacctgctcttcctgctggagtactgcatggtgacaggctatgactggtgggacatcctgctgcacgtgcagcccagcatggtgcagagcctggtggagaagctgcacgaggagtacacccggcagacagctgccctgcagcaggtgctgagcacccgcatcctggccatgaaggccagcctgtgcaagctgagcccctgcaccgtgaccagggtgtgtgactaccacaccaagctgttcctgattgccatcagcagcaccctgaagagcctgctgcggccccacttcctgaacaccccagacaagagccctggggaccggctgacagagatctgcaccaagatcacagatgtggacatcgacaaggtgatgatcaacctgaagacagaggagtttgtgctggacatgaacaccctgcaggccctgcagcagctgctgcagtgggtgggggactttgtgctgtacctgctggccagcctgcccaaccaggtggccatgagggcccagagggccagcaggacccggcgctggtggatgaatgctgcctgctgcccagccagctgcctgagccctgcctggacaggctgccagcctgccacagcctggctggccgcctgcagccccagcagcccctttgtgtgcagcctggccggccggccccgctgcctggccgtgctgcccccctgcagcagcacagccagccctggcccccaggccagccccaggagcaccacctgtggcggctgcaccctggccctggcccccaggagaaatgcccggcctgcccctggagctgctgtgagcccctgcagcagccggcccacagagcccaggaggtag

SEQ ID NO: 16024 - DNA, 2583 bp, Artificial Sequence
  Description of Artificial Sequence: Synthetic coding sequence
atgtgtgacctgcggcggcctgctgctgggggcatgatggacctggcctacgtgtgtgagtgggagaagtggagcaagagcacccactgccccagcgtgcccctggcctgtgcctggagctgcaggaacctgattgccttcaccatggacctgcggagtgatgaccaggacctgaccaggatgatccacatcctggacacagagcacccctgggacctgcacagcatccccagcgagcaccacgaggccatcacctgcctggagtgggaccagagcggcagccggctgctgtctgcagatgctgatggccagatcaagtgctggagcatggctgaccacctggccaacagctgggagagctctgtgggcagcctggtggagggggaccccatcgtggccctgtcctggctgcacaatggagtgaagctggccctgcacgtggagaagagcggggccagcagctttggagagaagttcagccgggtgaagttcagccccagcctgaccctgtttggaggcaagcccatggagggctggattgctgtgacagtgtctggcctggtgacagtgtccctgctgaagcccagcggccaggtgctgaccagcacagagagcctgtgccgcctgcggggccgggtggccctggccgacatcgccttcaccggcggcggcaacatcgtggtggccacagcagatggcagcagcgccagccctgtgcagttctacaaggtgtgtgtgtctgtggtgtctgagaagtgcagaattgacacagagatcctgcccagcctcttcatgcgctgcaccacagacctgaacaggaaggacaagtttcctgccatcacccacctgaagttcctggcccgggacatgtctgagcaggtgctgctgtgtgccagcagccagaccagcagcatcgtggagtgctggagcctgaggaaggagggcctgcctgtgaacaacatcttccagcagatcagccctgtggtgggggacaagcagcccaccatcctgaagtggaggatcctgagcgccaccaatgacctggacagagtgtctgctgtggccctgcccaagctgcccatcagcctgaccaacacagacctgaaggtggccagtgacacccagttctacccaggcctgggcctggccctggccttccatgatggctctgtgcacatcgtgcaccggctgagcctgcagaccatggctgtgttctacagcagcgctgcccccaggcctgtggatgagcccgccatgaagaggcccaggacagctggccctgctgtgcacctgaaggccatgcagctgtcctggaccagcctggccctggtgggcatcgacagccacggcaagctgtctgtgctgcggctgagccccagcatgggccaccccctggaggtgggcctggccctgcggcacctgctcttcctgctggagtactgcatggtgacaggctatgactggtgggacatcctgctgcacgtgcagcccagcatggtgcagagcctggtggagaagctgcacgaggagtacacccggcagacagctgccctgcagcaggtgctgagcacccgcatcctggccatgaaggccagcctgtgcaagctgagcccctgcaccgtgaccagggtgtgtgactaccacaccaagctgttcctgattgccatcagcagcaccctgaagagcctgctgcggccccacttcctgaacaccccagacaagagccctggggaccggctgacagagatctgcaccaagatcacagatgtggacatcgacaaggtgatgatcaacctgaagacagaggagtttgtgctggacatgaacaccctgcaggccctgcagcagctgctgcagtgggtgggggactttgtgctgtacctgctggccagcctgcccaaccagggcagcctgctgcggcccggccacagcttcctgagagatggcaccagcctgggcatgctgcgggagctgatggtggtgatccgcatctggggcctgctgaagcccagctgcctgcctgtgtacacagccaccagtgacacccaggacagcatgagcctgctcttccggctgctgaccaagctgtggatctgcttccccagcacaggcccctgcagcgtgtgggtgctgctgggctggcagcccctgcccggcagagatgagggccctgccagcgagccagatgaggccctggtggatgagtgctgcctgctgcccagccagctgctgatccccagcctggactggctgcctgccagtgatggcctggtgtcccggctgcagcccaagcagcccctgcggctgcagtttggccgggcccccaccctgcccggcagcgctgccaccctgcagctggatggcctggcccgggcccctggccagcccaagattgaccacctgcggcggctgcacctgggcgcctgccccacagaggagtgcaaggcctgcacccgctgtggctgtgtgaccatgctgaagagccccaacagaaccacagctgtgaagcagtgggagcagcgctggatcaagaactgcctgtgtggcggcctgtggtggagggtgcccctgagctacccctag

SEQ ID NO: 16025 - DNA, 2634 bp, Artificial Sequence
  Description of Artificial Sequence: Synthetic coding sequence
atgtgtgacctgcggcggcctgctgctgggggcatgatggacctggcctacgtgtgtgagtgggagaagtggagcaagagcacccactgccccagcgtgcccctggcctgtgcctggagctgcaggaacctgattgccttcaccatggacctgcggagtgatgaccaggacctgaccaggatgatccacatcctggacacagagcacccctgggacctgcacagcatccccagcgagcaccacgaggccatcacctgcctggagtgggaccagagcggcagccggctgctgtctgcagatgctgatggccagatcaagtgctggagcatggctgaccacctggccaacagctgggagagctctgtgggcagcctggtggagggggaccccatcgtggccctgtcctggctgcacaatggagtgaagctggccctgcacgtggagaagagcggggccagcagctttggagagaagttcagccgggtgaagttcagccccagcctgaccctgtttggaggcaagcccatggagggctggattgctgtgacagtgtctggcctggtgacagtgtccctgctgaagcccagcggccaggtgctgaccagcacagagagcctgtgccgcctgcggggccgggtggccctggccgacatcgccttcaccggcggcggcaacatcgtggtggccacagcagatggcagcagcgccagccctgtgcagttctacaaggtgtgtgtgtctgtggtgtctgagaagtgcagaattgacacagagatcctgcccagcctcttcatgcgctgcaccacagacctgaacaggaaggacaagtttcctgccatcacccacctgaagttcctggcccgggacatgtctgagcaggtgctgctgtgtgccagcagccagaccagcagcatcgtggagtgctggagcctgaggaaggagggcctgcctgtgaacaacatcttccagcagatcagccctgtggtgggggacaagcagcccaccatcctgaagtggaggatcctgagcgccaccaatgacctggacagagtgtctgctgtggccctgcccaagctgcccatcagcctgaccaacacagacctgaaggtggccagtgacacccagttctacccaggcctgggcctggccctggccttccatgatggctctgtgcacatcgtgcaccggctgagcctgcagaccatggctgtgttctacagcagcgctgcccccaggcctgtggatgagcccgccatgaagaggcccaggacagctggccctgctgtgcacctgaaggccatgcagctgtcctggaccagcctggccctggtgggcatcgacagccacggcaagctgtctgtgctgcggctgagccccagcatgggccaccccctggaggtgggcctggccctgcggcacctgctcttcctgctggagtactgcatggtgacaggctatgactggtgggacatcctgctgcacgtgcagcccagcatggtgcagagcctggtggagaagctgcacgaggagtacacccggcagacagctgccctgcagcaggtgctgagcacccgcatcctggccatgaaggccagcctgtgcaagctgagcccctgcaccgtgaccagggtgtgtgactaccacaccaagctgttcctgattgccatcagcagcaccctgaagagcctgctgcggccccacttcctgaacaccccagacaagagccctggggaccggctgacagagatctgcaccaagatcacagatgtggacatcgacaaggtgatgatcaacctgaagacagaggagtttgtgctggacatgaacaccctgcaggccctgcagcagctgctgcagtgggtgggggactttgtgctgtacctgctggccagcctgcccaaccagggcagcctgctgcggcccggccacagcttcctgagagatggcaccagcctgggcatgctgcgggagctgatggtggtgatccgcatctggggcctgctgaagcccagctgcctgcctgtgtacacagccaccagtgacacccaggacagcatgagcctgctcttccggctgctgaccaagctgtggatctgctgcagagatgagggccctgccagcgagccagatgaggccctggtggatgagtgctgcctgctgcccagccagctgctgatccccagcctggactggctgcctgccagtgatggcctggtgtcccggctgcagcccaagcagcccctgcggctgcagtttggccgggcccccaccctgcccggcagcgctgccaccctgcagctggatggcctggcccgggcccctggccagcccaagattgaccacctgcggcggctgcacctgggcgcctgccccacagaggagtgcaaggcctgcacccgctgtggctgtgtgaccatgctgaagagccccaacagaaccacagctgtgaagcagtgggagcagcgctggatcaagaactgcctggccgtggagggccggggcccagatgcctgtgtgaccagccgggccagcgaggaggccccagcctttgtgcagctgggcccccagagcacccaccacagccccaggacccccaggagcctggaccacctgcaccctgaggaccggccctag

SEQ ID NO: 16026 - DNA, 2526 bp, Artificial Sequence
  Description of Artificial Sequence: Synthetic coding sequence
atgtgtgacctgcggcggcctgctgctgggggcatgatggacctggcctacgtgtgtgagtgggagaagtggagcaagagcacccactgccccagcgtgcccctggcctgtgcctggagctgcaggaacctgattgccttcaccatggacctgcggagtgatgaccaggacctgaccaggatgatccacatcctggacacagagcacccctgggacctgcacagcatccccagcgagcaccacgaggccatcacctgcctggagtgggaccagagcggcagccggctgctgtctgcagatgctgatggccagatcaagtgctggagcatggctgaccacctggccaacagctgggagagctctgtgggcagcctggtggagggggaccccatcgtggccctgtcctggctgcacaatggagtgaagctggccctgcacgtggagaagagcggggccagcagctttggagagaagttcagccgggtgaagttcagccccagcctgaccctgtttggaggcaagcccatggagggctggattgctgtgacagtgtctggcctggtgacagtgtccctgctgaagcccagcggccaggtgctgaccagcacagagagcctgtgccgcctgcggggccgggtggccctggccgacatcgccttcaccggcggcggcaacatcgtggtggccacagcagatggcagcagcgccagccctgtgcagttctacaaggtgtgtgtgtctgtggtgtctgagaagtgcagaattgacacagagatcctgcccagcctcttcatgcgctgcaccacagacctgaacaggaaggacaagtttcctgccatcacccacctgaagttcctggcccgggacatgtctgagcaggtgctgctgtgtgccagcagccagaccagcagcatcgtggagtgctggagcctgaggaaggagggcctgcctgtgaacaacatcttccagcagatcagccctgtggtgggggacaagcagcccaccatcctgaagtggaggatcctgagcgccaccaatgacctggacagagtgtctgctgtggccctgcccaagctgcccatcagcctgaccaacacagacctgaaggtggccagtgacacccagttctacccaggcctgggcctggccctggccttccatgatggctctgtgcacatcgtgcaccggctgagcctgcagaccatggctgtgttctacagcagcgctgcccccaggcctgtggatgagcccgccatgaagaggcccaggacagctggccctgctgtgcacctgaaggccatgcagctgtcctggaccagcctggccctggtgggcatcgacagccacggcaagctgtctgtgctgcggctgagccccagcatgggccaccccctggaggtgggcctggccctgcggcacctgctcttcctgctggagtactgcatggtgacaggctatgactggtgggacatcctgctgcacgtgcagcccagcatggtgcagagcctggtggagaagctgcacgaggagtacacccggcagacagctgccctgcagcaggtgctgagcacccgcatcctggccatgaaggccagcctgtgcaagctgagcccctgcaccgtgaccagggtgtgtgactaccacaccaagctgttcctgattgccatcagcagcaccctgaagagcctgctgcggccccacttcctgaacaccccagacaagagccctggggaccggctgacagagatctgcaccaagatcacagatgtggacatcgacaaggtgatgatcaacctgaagacagaggagtttgtgctggacatgaacaccctgcaggccctgcagcagctgctgcagtgggtgggggactttgtgctgtacctgctggccagcctgcccaaccagggcagcctgctgcggcccggccacagcttcctgagagatggcaccagcctgggcatgctgcgggagctgatggtggtgatccgcatctggggcctgctgaagcccagctgcctgcctgtgtacacagccaccagtgacacccaggacagcatgagcctgctcttccggctgctgaccaagctgtggatctgctgcagagatgagggccctgccagcgagccagatgaggccctggtggatgagtgctgcctgctgcccagccagctgctgatccccagcctggactggctgcctgccagtgatggcctggtgtcccggctgcagcccaagcagcccctgcggctgcagtttggccgggcccccaccctgcccggcagcgctgccaccctgcagctggatggcctggcccgggcccctggccagcccaagattgaccacctgcggcggctgcacctgggcgcctgccccacagaggagtgcaaggcctgcacccgctgtggctgtgtgaccatgctgaagagccccaacagaaccacagctgtgaagcagtgggagcagcgctggatcaagaactgcctgtgtggcggcctgtggtggagggtgcccctgagctacccctag

SEQ ID NO: 16027 - DNA, 1992 bp, Artificial Sequence
  Description of Artificial Sequence: Synthetic coding sequence
atgtgtgacctgcggcggcctgctgctgggggcatgatggacctggcctacgtgtgtgagtgggagaagtggagcaagagcacccactgccccagcgtgcccctggcctgtgcctggagctgcaggaacctgattgccttcaccatggacctgcggagtgatgaccaggacctgaccaggatgatccacatcctggacacagagcacccctgggacctgcacagcatccccagcgagcaccacgaggccatcacctgcctggagtgggaccagagcggcagccggctgctgtctgcagatgctgatggccagatcaagtgctggagcatggctgaccacctggccaacagctgggagagctctgtgggcagcctggtggagggggaccccatcgtggccctgtcctggctgcacaatggagtgaagctggccctgcacgtggagaagagcggggccagcagctttggagagaagttcagccgggtgaagttcagccccagcctgaccctgtttggaggcaagcccatggagggctggattgctgtgacagtgtctggcctggtgacagtgtccctgctgaagcccagcggccaggtgctgaccagcacagagagcctgtgccgcctgcggggccgggtggccctggccgacatcgccttcaccggcggcggcaacatcgtggtggccacagcagatggcagcagcgccagccctgtgcagttctacaaggtgtgtgtgtctgtggtgtctgagaagtgcagaattgacacagagatcctgcccagcctcttcatgcgctgcaccacagacctgaacaggaaggacaagtttcctgccatcacccacctgaagttcctggcccgggacatgtctgagcaggtgctgctgtgtgccagcagccagaccagcagcatcgtggagtgctggagcctgaggaaggagggcctgcctgtgaacaacatcttccagcagatcagccctgtggtgggggacaagcagcccaccatcctgaagtggaggatcctgagcgccaccaatgacctggacagagtgtctgctgtggccctgcccaagctgcccatcagcctgaccaacacagacctgaaggtggccagtgacacccagttctacccaggcctgggcctggccctggccttccatgatggctctgtgcacatcgtgcaccggctgagcctgcagaccatggctgtgttctacagcagcgctgcccccaggcctgtggatgagcccgccatgaagaggcccaggacagctggccctgctgtgcacctgaaggccatgcagctgtcctggaccagcctggccctggtgggcatcgacagccacggcaagctgtctgtgctgcggctgagccccagcatgggccaccccctggaggtgggcctggccctgcggcacctgctcttcctgctggagtactgcatggtgacaggctatgactggtgggacatcctgctgcacgtgcagcccagcatggtgcagagcctggtggagaagctgcacgaggagtacacccggcagacagctgccctgcagcaggtgctgagcacccgcatcctggccatgaaggccagcctgtgcaagctgagcccctgcaccgtgaccagggtgtgtgactaccacaccaagctgttcctgattgccatcagcagcaccctgaagagcctgctgcggccccacttcctgaacaccccagacaagagccctggggaccggctgacagagatctgcaccaagatcacagatgtggacatcgacaaggtgatgatcaacctgaagacagaggagtttgtgctggacatgaacaccctgcaggccctgcagcagctgctgcagtgggtgggggactttgtgctgtacctgctggccagcctgcccaaccagccctgccccaccagcgagccctgccccaccagcgagccctgccccaccagcgagcccagccccaccagcgagcccagccccacctag

SEQ ID NO: 16028 - DNA, 1614 bp, Artificial Sequence
  Description of Artificial Sequence: Synthetic coding sequence
atgtgtgacctgcggcggcctgctgctgggggcatgatggacctggcctacgtgtgtgagtgggagaagtggagcaagagcacccactgccccagcgtgcccctggcctgtgcctggagctgcaggaacctgattgccttcaccatggacctgcggagtgatgaccaggacctgaccaggatgatccacatcctggacacagagcacccctgggacctgcacagcatccccagcgagcaccacgaggccatcacctgcctggagtgggaccagagcggcagccggctgctgtctgcagatgctgatggccagatcaagtgctggagcatggctgaccacctggccaacagctgggagagctctgtgggcagcctggtggagggggaccccatcgtggccctgtcctggctgcacaatggagtgaagctggccctgcacgtggagaagagcggggccagcagctttggagagaagttcagccgggtgaagttcagccccagcctgaccctgtttggaggcaagcccatggagggctggattgctgtgacagtgtctggcctggtgacagtgtccctgctgaagcccagcggccaggtgctgaccagcacagagagcctgtgccgcctgcggggccgggtggccctggccgacatcgccttcaccggcggcggcaacatcgtggtggccacagcagatggcagcagcgccagccctgtgcagttctacaaggtgtgtgtgtctgtggtgtctgagaagtgcagaattgacacagagatcctgcccagcctcttcatgcgctgcaccacagacctgaacaggaaggacaagtttcctgccatcacccacctgaagttcctggcccgggacatgtctgagcaggtgctgctgtgtgccagcagccagaccagcagcatcgtggagtgctggagcctgaggaaggagggcctgcctgtgaacaacatcttccagcagatcagccctgtggtgggggacaagcagcccaccatcctgaagtggaggatcctgagcgccaccaatgacctggacagagtgtctgctgtggccctgcccaagctgcccatcagcctgaccaacacagacctgaaggtggccagtgacacccagttctacccaggcctgggcctggccctggccttccatgatggctctgtgcacatcgtgcaccggctgagcctgcagaccatggctgtgttctacagcagcgctgcccccaggcctgtggatgagcccgccatgaagaggcccaggacagctggccctgctgtgcacctgaaggccatgcagctgtcctggaccagcctggccctggtgggcatcgacagccacggcaaggtgctgagcacccgcatcctggccatgaaggccagcctgtgcaagctgagcccctgcaccgtgaccagggtgtgtgactaccacaccaagctgttcctgattgccatcagcagcaccctgaagagcctgctgcggccccacttcctgaacaccccagacaagagccctggggaccggctgacagagatctgcaccaagatcacagatgtggacatcgacaaggtgatgatcaacctgaagacagaggagtttgtgctgtag

SEQ ID NO: 16029 - DNA, 1389 bp, Artificial Sequence
  Description of Artificial Sequence: Synthetic coding sequence
atgtgtgacctgcggcggcctgctgctgggggcatgatggacctggcctacgtgtgtgagtgggagaagtggagcaagagcacccactgccccagcgtgcccctggcctgtgcctggagctgcaggaacctgattgccttcaccatggacctgcggagtgatgaccaggacctgaccaggatgatccacatcctggacacagagcacccctgggacctgcacagcatccccagcgagcaccacgaggccatcacctgcctggagtgggaccagagcggcagccggctgctgtctgcagatgctgatggccagatcaagtgctggagcatggctgaccacctggccaacagctgggagagctctgtgggcagcctggtggagggggaccccatcgtggccctgtcctggctgcacaatggagtgaagctggccctgcacgtggagaaggtgctgctgtgtgccagcagccagaccagcagcatcgtggagtgctggagcctgaggaaggagggcctgcctgtgaacaacatcttccagcagatcagccctgtggtgggggacaagcagcccaccatcctgaagtggaggatcctgagcgccaccaatgacctggacagagtgtctgctgtggccctgcccaagctgcccatcagcctgaccaacacagacctgaaggtggccagtgacacccagttctacccaggcctgggcctggccctggccttccatgatggctctgtgcacatcgtgcaccggctgagcctgcagaccatggctgtgttctacagcagcgctgcccccaggcctgtggatgagcccgccatgaagaggcccaggacagctggccctgctgtgcacctgaaggccatgcagctgtcctggaccagcctggccctggtgggcatcgacagccacggcaagctgtctgtgctgcggctgagccccagcatgggccaccccctggaggtgggcctggccctgcggcacctgctcttcctgctggagtactgcatggtgacaggctatgactggtgggacatcctgctgcacgtgcagcccagcatggtgcagagcctggtggagaagctgcacgaggagtacacccggcagacagctgccctgcagcaggtgctgagcacccgcatcctggccatgaaggccagcctgtgcaagctgagcccctgcaccgtgaccagggtgtgtgactaccacaccaagctgttcctgattgccatcagcagcaccctgaagagcctgctgcggccccacttcctgaacaccccagacaagagccctggggaccggctgacagagatctgcaccaagatcacagatgtggacatcgacaaggtgatgatcaacctgaagacagaggagtttgtgctgtag

SEQ ID NO: 16030 - DNA, 1098 bp, Artificial Sequence
  Description of Artificial Sequence: Synthetic coding sequence
atgtgtgacctgcggcggcctgctgctgggggcatgatggacctggcctacgtgtgtgagtgggagaagtggagcaagagcacccactgccccagcgtgcccctggcctgtgcctggagctgcaggaacctgattgccttcaccatggacctgcggagtgatgaccaggacctgaccaggatgatccacatcctggacacagagcacccctgggacctgcacagcatccccagcgagcaccacgaggccatcacctgcctggagtgggaccagagcggcagccggctgctgtctgcagatgctgatggccagatcaagtgctggagcatggctgaccacctggccaacagctgggagagctctgtgggcagcctggtggagggggaccccatcgtggccctgtcctggctgcacaacggcctggccctggccttccatgatggctctgtgcacatcgtgcaccggctgagcctgcagaccatggctgtgttctacagcagcgctgcccccaggcctgtggatgagcccgccatgaagaggcccaggacagctggccctgctgtgcacctgaaggccatgcagctgtcctggaccagcctggccctggtgggcatcgacagccacggcaagctgtctgtgctgcggctgagccccagcatgggccaccccctggaggtgggcctggccctgcggcacctgctcttcctgctggagtactgcatggtgacaggctatgactggtgggacatcctgctgcacgtgcagcccagcatggtgcagagcctggtggagaagctgcacgaggagtacacccggcagacagctgccctgcagcaggtgctgagcacccgcatcctggccatgaaggccagcctgtgcaagctgagcccctgcaccgtgaccagggtgtgtgactaccacaccaagctgttcctgattgccatcagcagcaccctgaagagcctgctgcggccccacttcctgaacaccccagacaagagccctggggaccggctgacagagatctgcaccaagatcacagatgtggacatcgacaaggtgatgatcaacctgaagacagaggagtttgtgctgtag

SEQ ID NO: 16031 - DNA, 1104 bp, Artificial Sequence
  Description of Artificial Sequence: Synthetic coding sequence
atgtgtgacctgcggcggcctgctgctgggggcatgatggacctggcctacgtgtgtgagtgggagaagtggagcaagagcacccactgccccagcgtgcccctggcctgtgcctggagctgcaggaacctgattgccttcaccatggacctgcggagtgatgaccaggacctgaccaggatgatccacatcctggacacagagcacccctgggacctgcacagcatccccagcgagcaccacgaggccatcacctgcctggagtgggaccagagcggcagccggctgctgtctgcagatgctgatggccagatcaagtgctggagcatggctgaccacctggccaacagctgggagagctctgtgggcagcctggtggagggggaccccatcgtggccctgtcctggctgcacaatggagtgcggctggccctggccttccatgatggctctgtgcacatcgtgcaccggctgagcctgcagaccatggctgtgttctacagcagcgctgcccccaggcctgtggatgagcccgccatgaagaggcccaggacagctggccctgctgtgcacctgaaggccatgcagctgtcctggaccagcctggccctggtgggcatcgacagccacggcaagctgtctgtgctgcggctgagccccagcatgggccaccccctggaggtgggcctggccctgcggcacctgctcttcctgctggagtactgcatggtgacaggctatgactggtgggacatcctgctgcacgtgcagcccagcatggtgcagagcctggtggagaagctgcacgaggagtacacccggcagacagctgccctgcagcaggtgctgagcacccgcatcctggccatgaaggccagcctgtgcaagctgagcccctgcaccgtgaccagggtgtgtgactaccacaccaagctgttcctgattgccatcagcagcaccctgaagagcctgctgcggccccacttcctgaacaccccagacaagagccctggggaccggctgacagagatctgcaccaagatcacagatgtggacatcgacaaggtgatgatcaacctgaagacagaggagtttgtgctgtag

SEQ ID NO: 16032 - DNA, 975 bp, Artificial Sequence
  Description of Artificial Sequence: Synthetic coding sequence
atgtgtgacctgcggcggcctgctgctgggggcatgatggacctggcctacgtgtgtgagtgggagaagtggagcaagagcacccactgccccagcgtgcccctggcctgtgcctggagctgcaggaacctgattgccttcaccatggacctgcggagtgatgaccaggacctgaccaggatgatccacatcctggacacagagcacccctgggacctgcacagcatccccagcgagcaccacgaggccatcacctgcctggagtgggaccagagcggcagccggctgctgtctgcagatgctgatggccagatcaagtgctggagcatggctgaccacctggccaacagctgggagagctctgtgggcagcctggtggagggggaccccatcgtggccctgtcctggctgcacaatggagtgaagctggccctgcacgtggagaagagcggggccagcagctttggagagaagttcagccgggtgaagttcagccccagcctgaccctgtttggaggcaagcccatggagggctggattgctgtgacagtgtctggcctggtgacagtgtccctgctcttcctgctggagtactgcatggtgacaggctatgactggtgggacatcctgctgcacgtgcagcccagcatggtgcagagcctggtggagaagctgcacgaggagtacacccggcagacagctgccctgcagcaggtgctgagcacccgcatcctggccatgaaggccagcctgtgcaagctgagcccctgcaccgtgaccagggtgtgtgactaccacaccaagctgttcctgattgccatcagcagcaccctgaagagcctgctgcggccccacttcctgaacaccccagacaagagccctggggaccggctgacagagatctgcaccaagatcacagatgtggacatcgacaaggtgatgatcaacctgaagacagaggagtttgtgctgtag

SEQ ID NO: 16033 - DNA, 603 bp, Artificial Sequence
  Description of Artificial Sequence: Synthetic coding sequence
atggcccagcagagggccctgccccagagcaaggagaccctgctgcagagctacaacaagaggctgaaggatgacatcaagagcatcatggacaacttcacagagatcatcaagacagccaagattgaagatgagacccaggtgtcccgggccacccagggcgagcaggacaactatgagatgcacgtgcgggccgccaacatcgtgcgggccggggagagcctgatgaagctggtgtctgacctgaagcagttcctgatcctgaatgacttccccagcgtgaatgaggccatcgaccagaggaaccagcagctgcggaccctgcaggaggagtgtgacaggaagctgatcaccctgagagatgagatcagcattgacctgtatgagctggaggaggagtactacagcagcagcagcagcctgtgtgaggccaatgacctgcccctgtgtgaggcctacggccgcctggacctggacacagacagcgcagatggcctgagcgcccccctgctggccagccctgagcccagcgctggccccctgcaggtggccgccccagcccacagccatgctgggggccctggccccacagaacatgcctag

SEQ ID NO: 16034 - DNA, 423 bp, Artificial Sequence
  Description of Artificial Sequence: Synthetic coding sequence
atggcccagcagagggccctgccccagagcaaggagaccctgctgcagagctacaacaagaggctgaaggatgacatcaagagcatcatggacaacttcacagagatcatcaagacagccaagattgaagatgagacccaggtgtcccgggccacccagggcgagcaggacaactatgagatgcacgtgcgggccgccaacatcgtgcgggccggggagagcctgatgaagctggtgtctgacctgaagcagttcctgatcctgaatgacttccccagcgtgaatgaggccatcgaccagaggaaccagcagctgcggaccctgcaggaggagtgtgacaggaagctgatcaccctgagagatgagatcagcattgacctgtatgagctggaggaggagtactacagcagccgctacaagtag

SEQ ID NO: 16035 - DNA, 405 bp, Artificial Sequence
  Description of Artificial Sequence: Synthetic coding sequence
atggcccagcagagggccctgccccagagcaaggagaccctgctgcagagctacaacaagaggctgaaggatgacatcaagagcatcatggacaacttcacagagatcatcaagacagccaagattgaagatgagacccaggtgtcccgggccacccagggcgagcaggacaactatgagatgcacgtgcgggccggggagagcctgatgaagctggtgtctgacctgaagcagttcctgatcctgaatgacttccccagcgtgaatgaggccatcgaccagaggaaccagcagctgcggaccctgcaggaggagtgtgacaggaagctgatcaccctgagagatgagatcagcattgacctgtatgagctggaggaggagtactacagcagccgctacaagtag

SEQ ID NO: 16036 - DNA, 414 bp, Artificial Sequence
  Description of Artificial Sequence: Synthetic coding sequence
atggcccagcagagggccctgccccagagcaaggagaccctgctgcagagctacaacaagaggctgaaggatgacatcaagagcatcatggacaacttcacagagatcatcaagacagccaagattgaagatgagacccaggtgtcccgggccacccagggcgagcaggacaactatgagatgcacgtgcgggccgccaacatcgtgcgggccggggagagcctgatgaagctggtgtctgacctgaagcagttcctgatcctgaatgacttccccagcgtgaatgaggccatcgaccagaggaaccagcagctgcggaccctgcaggaggagtgtgacaggaagctgatcaccctgagagatgagatcagcattgacctgtatgagctggaggaggagtactacagcagctag

SEQ ID NO: 16037 - DNA, 336 bp, Artificial Sequence
  Description of Artificial Sequence: Synthetic coding sequence
atggcccagcagagggccctgccccagagcaaggagaccctgctgcagagctacaacaagaggctgaaggatgacatcaagagcatcatggacaacttcacagagatcatcaagacagccaagattgaagatgagacccaggtgtcccgggccacccagggcgagcaggacaactatgagatgcacgtgcgggccgccaacatcgtgcgggccggggagagcctgatgaagctggtgtctgacctgaagcagttcctgatcctgaatgacttccccagcgtgaatgaggccatcgaccagaggaaccagcagctgcggaccctgcaggaggagtag

SEQ ID NO: 16038 - DNA, 423 bp, Artificial Sequence; identical to SEQ ID NO: 16034
  Description of Artificial Sequence: Synthetic coding sequence

SEQ ID NO: 16039 - DNA, 423 bp, Artificial Sequence; identical to SEQ ID NO: 16034
  Description of Artificial Sequence: Synthetic coding sequence

SEQ ID NO: 16040 - DNA, 603 bp, Artificial Sequence; identical to SEQ ID NO: 16033
  Description of Artificial Sequence: Synthetic coding sequence

SEQ ID NO: 16041 - DNA, 408 bp, Artificial Sequence
  Description of Artificial Sequence: Synthetic coding sequence
atggcccagcagagggccctgccccagagcaaggagaccctgctgcagagctacaacaagaggctgaaggatgacatcaagagcatcatggacaacttcacagagatcatcaagacagccaagattgaagatgagacccaggtgtcccgggccacccagggcgagcaggacaactatgagatgcacgtgcgggccgccaacatcgtgcgggccggggagagcctgatgaagctggtgtctgacctgaagcagttcctgatcctgaatgacttccccagcgtgaatgaggccatcgaccagaggaaccagcagctgcggaccctgcaggaggagtgtgacaggaagctgatcaccctgagagatgagatcagcattgacctgtatgagctggaggaggagtactactag

SEQ ID NO: 16042 - DNA, 1452 bp, Artificial Sequence
  Description of Artificial Sequence: Synthetic coding sequence
atgaaggccttccacaccttctgtgtggtgctgctggtgtttggatctgtgtctgaggccaagtttgatgactttgaagatgaagaagatattgtggagtatgatgacaatgactttgctgagtttgaagatgtgatggaggacagcgtgacagagagcccccagagggtcatcatcacagaagatgatgaagatgagaccaccgtggagctggagggccaggatgagaaccaggagggggactttgaagatgctgacacccaggagggggacacagagagcgagccctatgatgatgaggagtttgagggctatgaggacaagccagacaccagcagcagcaagaacaaggaccccatcaccatcgtggatgtgcctgcccacctgcagaacagctgggagagctactacctggagatcctgatggtgacaggcctgctggcctacatcatgaactacatcatcggcaagaacaagaacagccggctggcccaggcctggttcaacacccaccgggagctgctggagagcaacttcaccctggtgggagatgatggcaccaacaaggaggccaccagcacaggcaagctgaaccaggagaatgagcacatctacaacctgtggtgcagcggccgggtgtgctgtgagggcatgctgatccagctgcgcttcctgaagaggcaggacctgctgaatgtgctggccaggatgatgaggcctgtgtctgaccaggtgcagatcaaggtgaccatgaatgatgaggacatggacacctacgtgtttgctgtgggcaccaggaaggccctggtgcggctgcagaaggagatgcaggacctgtctgagttctgcagcgacaagcccaagagcggggccaagtatggcctgcctgacagcctggccatcctgtctgagatgggagaggtgacagatggcatgatggacaccaagatggtgcacttcctgacccactatgctgacaagattgagagcgtgcacttcagtgaccagttcagcggccccaagatcatgcaggaggagggccagcccctgaagctgcctgacaccaagaggaccctgctcttcaccttcaacgtgcccggcagcggcaacacctaccccaaggacatggaggccctgctgcccctgatgaacatggtgatctacagcattgacaaggccaagaagttccggctgaaccgggagggcaagcagaaggctgacaagaacagagcccgggtggaggagaacttcctgaagctgacccacgtgcagaggcaggaggccgcccagagccggcgggaggagaagaagagagctgagaaggagcgcatcatgaatgaggaggaccctgagaagcagaggcggctggaggaggccgccctgcggcgggagcagaagaagctggagaagaagcagatgaagatgaagcagatcaaggtgaaggccatgtag

SEQ ID NO: 16043 - DNA, 741 bp, Artificial Sequence
  Description of Artificial Sequence: Synthetic coding sequence
atggctgctgtggacatccgggacaacctgctgggcatctcctgggtggacagctcctggatccccatcctgaacagcggctctgtgctggactacttcagcgagaggagcaaccccttctatgacaggacctgcaacaatgaggtggtgaagatgcagaggctgaccctggagcacctgaaccagatggtgggcatcgagtacatcctgctgcacgcccaggagcccatcctcttcatcatcaggaagcagcagaggcagagccctgcccaggtgatccccctggccgactactacatcatcgccggggtcatctaccaggccccagacctgggcagcgtcatcaacagccgggtgctgacagctgtgcacggcatccagagcgcctttgatgaggccatgagctactgccgctaccaccccagcaagggctactggtggcacttcaaggaccacgaggagcaggacaaggtgcggcccaaggccaagaggaaggaggagcccagcagcatcttccagaggcagagggtggatgccctgctgctggacctgcggcagaagtttcctcccaagtttgtgcagctgaagccaggagagaagcctgtgcctgtggaccagaccaagaaggaggccgagcccatccctgagaccgtgaagccagaggagaaggagaccaccaagaatgtgcagcagacagtgtctgccaagggccccccagagaagaggatgaggctgcagtag

SEQ ID NO: 16044 - DNA, 762 bp, Artificial Sequence
  Description of Artificial Sequence: Synthetic coding sequence
atggctgctgtggacatccgggacaacctgctgggcatctcctgggtggacagctcctggatccccatcctgaacagcggctctgtgctggactacttcagcgagaggagcaaccccttctatgacaggacctgcaacaatgaggtggtgaagatgcagaggctgaccctggagcacctgaaccagatggtgggcatcgagtacatcctgctgcacgcccaggagcccatcctcttcatcatcaggaagcagcagaggcagagccctgcccaggtgatccccctggccgactactacatcatcgccggggtcatctaccaggccccagacctgggcagcgtcatcaacagccgggtgtccctcttctccttctacaagctgacagctgtgcacggcatccagagcgcctttgatgaggccatgagctactgccgctaccaccccagcaagggctactggtggcacttcaaggaccacgaggagcaggacaaggtgcggcccaaggccaagaggaaggaggagcccagcagcatcttccagaggcagagggtggatgccctgctgctggacctgcggcagaagttcccccccaagtttgtgcagctgaagccaggagagaagcctgtgcctgtggaccagaccaagaaggaggccgagcccatccctgagaccgtgaagccagaggagaaggagaccaccaagaatgtgcagcagacagtgtctgccaagggccccccagagaagaggatgaggctgcagtag

SEQ ID NO: 16045 - DNA, 546 bp, Artificial Sequence
  Description of Artificial Sequence: Synthetic coding sequence
atggctgctgtggacatccgggacaacctgctgggcatctcctgggtggacagctcctggatccccatcctgaacagcggctctgtgctggactacttcagcgagaggagcaaccccttctatgacaggacctgcaacaatgaggtggtgaagatgcagaggctgaccctggagcacctgaaccagatggtgggcatcgagtacatcctgctgcacgcccaggagcccatcctcttcatcatcaggaagcagcagaggcagagccctgcccaggtgatccccctggccgactactacatcatcgccggggtcatctaccaggccccagacctgggcagcgtcatcaacagccgggtgctgacagctgtgcacggcatccagagcgcctttgatgaggccatgagctactgccgctaccaccccagcaagggctactggtggcacttcaaggaccacgaggagcaggccaaggcctggaggaaggcctgcagcagcggcagcaacaaggagcggggccgcacctacaccaggaactgcaagacctag

SEQ ID NO: 16046 - DNA, 750 bp, Artificial Sequence
  Description of Artificial Sequence: Synthetic coding sequence
atggctgctgtggacatccgggacaacctgctgggcatctcctgggtggacagctcctggatccccatcctgaacagcggctctgtgctggactacttcagcgagaggagcaaccccttctatgacaggacctgcaacaatgaggtggtgaagatgcagaggctgaccctggagcacctgaaccagatggtgggcatcgagtacatcctgctgcacgcccaggagcccatcctcttcatcatcaggaagcagcagaggcagagccctgcccaggtgatccccctggccgactactacatcatcgccggggtcatctaccaggccccagacctgggcagcgtcatcaacagccgggtgctgacagctgtgcacggcatccagagcgcctttgatgaggccatgagctactgccgctaccaccccagcaagggctactggtggcacttcaaggaccacgaggagcaggacaaggtgcggcccaaggccaagaggaaggaggagcccagcagcatcttccagaggcagagggtggatgccctgctgctggacctgcggcagaagtttcctcccaagtttgtgcagctgaagccaggagagaagcctgtgcctgtggaccagaccaagaaggaggccgagcccatccctgagaccgtgaagccagaggagaaggagaccaccaagaatgtgcagcagacagtgtctgccaagggccccccagagaagaggatgaggctgcagaaggctgtgtag

SEQ ID NO: 16047 - DNA, 906 bp, Artificial Sequence
  Description of Artificial Sequence: Synthetic coding sequence
atgcagcgggaggagaagcagctggaggccagcctggatgccctgctgagccaggtggccgacctgaagaacagcctgggcagcttcatctgcaagctggagaatgaatatggccgcctgacctggcccagcgtgctggacagctttgccctgctgagcggccagctgaacaccctgaacaaggtgctgaagcatgagaagacccccctcttcaggaaccaggtgatcatccccctggtgctgagcccagacagagatgaggacctgatgaggcagacagagggccgggtgcctgtgttcagccatgaggtggtgcctgaccacctgcggaccaagccagaccctgaggtggaggagcaggagaagcagctgaccacagatgctgccagaattggagcagatgctgcccagaagcagatccagagcctgaacaagatgtgcagcaacctgctggagaagatcagcaaggaggagcgggagagcgagagcggcggcctgcggcccaacaagcagaccttcaaccccacagacaccaatgccctggtggccgctgtggccttcggcaagggcctgagcaactggaggccttctggcagcagcggccctggccaggccggccagcccggggccggcaccatcctggccggcaccagcggcctgcagcaggtgcagatggccggggcccccagccagcagcagcccatgctgtctggagtgcagatggcccaggccggccagcccgggaagatgcccagcggcatcaagaccaacatcaagagcgcctccatgcacccctaccagaggcccagctgcctgggcttcatcctggccatccccctgcggaggaaggtgaagaagctgctgggccaggagggcaagaagaatgcccacctgcagctgtggtag

SEQ ID NO: 16048 - DNA, 807 bp, Artificial Sequence
  Description of Artificial Sequence: Synthetic coding sequence
atgcagcgggaggagaagcagctggaggccagcctggatgccctgctgagccaggtggccgacctgaagaacagcctgggcagcttcatctgcaagctggagaatgaatatggccgcctgacctggcccagcgtgctggacagctttgccctgctgagcggccagctgaacaccctgaacaaggtgctgaagcatgagaagacccccctcttcaggaaccaggtgatcatccccctggtgctgagcccagacagagatgaggacctgatgaggcagacagagggccgggtgcctgtgttcagccatgaggtggtgcctgaccacctgcggaccaagccagaccctgaggtggaggagcaggagaagcagctgaccacagatgctgccagaattggagcagatgctgcccagaagcagatccagagcctgaacaagatgtgcagcaacctgctggagaagatcagcaaggaggagcgggagagcgagagcggcggcctgcggcccaacaagcagaccttcaaccccacagacaccaatgccctggtggccgctgtggccttcggcaagggcctgagcaactggaggccttctggcagcagcggccctggccaggccggccagcccggggccggcaccatcctggccggcaccagcggcctgcagcaggtgcagatggccggggcccccagccagcagcagcccatgctgtctggagtgcagatggcccaggccggccagcccgggaagatgcccagcggcatcaagaccaacatcaagagcgcctccatgcacccctaccagaggtag

SEQ ID NO: 16049 - DNA, 1248 bp, Artificial Sequence
  Description of Artificial Sequence: Synthetic coding sequence
atgaccctggccgccagcagccagaggagccagatcatccgcagcaagttccgctctgtgctgcagctgcgcatccacagaagaaaccaggagcagatcagtgaccctgacccctggatcagcgccagtgacccccccctggccccagccctgcccagcggcacagcccccttcctgttcagccctggggtgctgctgcctgagcctgagtactgccccccctggaggagccccaagaaggagagccccaagatcagccagcgctggagggagagcaagccccggggcaacctgacctaccaccagtacatgcctcctgagccccggcagggcagcagagctgacccccaggccgagggcagcgccctgggccccccaggccccagcctgtgggagggcacagacagccagcagccccaccccaggatgaagcccagccccctgaccccctgccccccaggagtgcccagccccagccccccaccccacaagctggagctgcagaccctgaagctggaggagctgactgtgtctgagctgcggcagcagctgcggctgcggggcctgcctgtgtctggcaccaagtccatgctgctggagaggatgaggggcggggccccaccccgggagcggcccaagccccggcgggaggacagccctgctggggccccctggccccggctgaagcccaaggccctggccgccgcccggcggcagggctctgtgaagcccagcgctgccagccacaggcctcccctgcccagggctgctgacaccccaggcacagccccagcccccacccccaccccagccccagctgctgccccagccctgacccccagcagcggccctggcagcgctgccctgaccctggaggaggagctgcaggaggccatccggcgggcccagctgctgcccaacagaggaattgatgacatcctggaggaccaggtggagccagatgaccccctgccccccatccccctggacttccctggcagctttgatgtgctgagccccagcccagacagcgagggcctgagctctgtgttcagcagcagcctgcccagccccaccaacagcagcagccccagcccccgggaccccacagacagcctggactggctggaggccctgagcggcggcccccccctgggcagcggccccccacctccttccatcttctctgctgacctgagtgacagcagcagcagccggctgtgggacctgctggaggacccctggtag

SEQ ID NO: 16050 - DNA, 939 bp, Artificial Sequence
  Description of Artificial Sequence: Synthetic coding sequence
atgcctcctgagccccggcagggcagcagagctgacccccaggccgagggcagcgccctgggccccccaggccccagcctgtgggagggcacagacagccagcagccccaccccaggatgaagcccagccccctgaccccctgccccccaggagtgcccagccccagccccccaccccacaagctggagctgcagaccctgaagctggaggagctgactgtgtctgagctgcggcagcagctgcggctgcggggcctgcctgtgtctggcaccaagtccatgctgctggagaggatgagaggaggagccccaccccgggagcggcccaagccccggcgggaggacagccctgctggggccccctggccccggctgaagcccaaggccctggccgccgcccggcggcagggctctgtgaagcccagcgctgccagccaccggccccccctgcccagggctgctgacaccccaggcacagccccagcccccacccccaccccagccccagctgctgccccagccctgacccccagcagcggccctggcagcgctgccctgaccctggaggaggagctgcaggaggccatcagaagagcccagctgctgcccaacagaggaattgatgacatcctggaggaccaggtggagccagatgaccccctgccccccatccccctggacttccctggcagctttgatgtgctgagccccagcccagattctgagggcctgagcagcgtcttcagcagcagcctgcccagccccaccaacagcagcagccccagcccccgggaccccacagacagcctggactggctggaggccctgagcggcggcccccccctgggcagcggccccccaccacccagcatcttctctgctgacctgagtgacagcagcagcagccggctgtgggacctgctggaggacccctggtag

SEQ ID NO: 16051 - DNA, 744 bp, Artificial Sequence
  Description of Artificial Sequence: Synthetic coding sequence
atgcctcctgagccccggcagggcagcagagctgacccccaggccgagggcagcgccctgggccccccaggccccagcctgtgggagggcacagacagccagcagccccaccccaggatgaagcccagccccctgaccccctgccccccaggagtgcccagccccagccccccaccccacaagctggagctgcagaccctgaagctggaggagctgactgtgaagcccagcgctgccagccacaggcctcccctgcccagggctgctgacaccccaggcacagccccagcccccacccccaccccagccccagctgctgccccagccctgacccccagcagcggccctggcagcgctgccctgaccctggaggaggagctgcaggaggccatccggcgggcccagctgctgcccaacagaggaattgatgacatcctggaggaccaggtggagccagatgaccccctgccccccatccccctggacttccctggcagctttgatgtgctgagccccagcccagacagcgagggcctgagctctgtgttcagcagcagcctgcccagccccaccaacagcagcagccccagcccccgggaccccacagacagcctggactggctggaggccctgagcggcggcccccccctgggcagcggccccccacctccttccatcttctctgctgacctgagtgacagcagcagcagccggctgtgggacctgctggaggacccctggtag

SEQ ID NO: 16052 - DNA, 939 bp, Artificial Sequence; identical to SEQ ID NO: 16050
  Description of Artificial Sequence: Synthetic coding sequence

SEQ ID NO: 16053 - DNA, 618 bp, Artificial Sequence
  Description of Artificial Sequence: Synthetic coding sequence
atgagcaagaagaagggcctgtctgctgaggagaagaggaccaggatgatggagatcttcagcgagaccaaggatgtgttccagctgaaggacctggagaagatcgcccccaaggagaagggcatcacagccatgtctgtgaaggaggtgctgcagagcctggtggatgatggcatggtggactgtgaaagaattggcaccagcaactactactgggccttccccagcaaggccctgcacgccaggaagcacaagctggaggtgctggagagccagctgtctgagggcagccagaagcacgccagcctgcagaagagcattgagaaggccaagattggccgctgtgaaacagaggagaggacccggctggccaaggagctgagcagcctgcgggaccagcgggagcagctgaaggccgaggtggagaagtacaaggactgtgacccccaggtggtggaggagatccggcaggccaacaaggtggccaaggaggccgccaaccgctggacagacaacatctttgccatcaagtcctgggccaagaggaagtttggatttgaggagaacaagattgacaggaccttcggcatcccagaagattttgactacatcgactag

SEQ ID NO: 16054 - DNA, 159 bp, Artificial Sequence
  Description of Artificial Sequence: Synthetic coding sequence
atgattgaccagagcaacagaacaggccagggcgccgccttcagccctgagggccagcccatcggcggctacacagagacccagccccacgtggccgtgcggcccccaggctctgtgggcatgagcctgaacctggagggggagtggcactacctgtag

SEQ ID NO: 16055 - DNA, 1077 bp, Artificial Sequence
  Description of Artificial Sequence: Synthetic coding sequence
atggccaggagatatgatgagctgccccactacccaggcatcgtggatggccctgctgccctggccagcttccctgagaccgtgcctgctgtgcccggcccctacggcccccaccggcccccccagcccctgcccccaggcctggacagtgatggcctgaagcgggagaaggatgagatctacggccaccccctcttccccctgctggccctggtgtttgagaagtgtgagctggccacctgcagccccagagatggagctggagctggcctgggcaccccacctggaggagatgtgtgcagcagtgacagcttcaatgaagatattgctgcctttgccaagcaggtgcgctctgagcggcccctcttcagcagcaaccctgagctggacaacctgatgatccaggccatccaggtgctgcgcttccacctgctggagctggagaagggcaagatgcccatcgacctggtgattgaagatagagatggcggctgcagagaagattttgaggactacccagccagctgccccagcctgcctgaccagaacaacatgtggatccgggaccatgaagattctggctctgtgcacctgggcaccccaggccccagcagcggcggcctggccagccagagcggggacaacagcagtgaccagggagatggcctggacacctctgtggccagccccagcagtggaggagaagatgaggacctggaccaggagaggagaagaaacaagaagaggggcatcttccccaaggtggccaccaacatcatgagggcctggctgttccagcacctgagccacccctaccccagcgaggagcagaagaagcagctggcccaggacaccggcctgaccatcctgcaggtgaacaactggttcatcaatgccaggagaagaattgtgcagcccatgattgaccagagcaacagaacaggccagggcgccgccttcagccctgagggccagcccatcggcggctacacagagacccagccccacgtggccgtgcggcccccaggctctgtgggcatgagcctgaacctggagggggagtggcactacctgtag

SEQ ID NO: 16056 - DNA, 1128 bp, Artificial Sequence
  Description of Artificial Sequence: Synthetic coding sequence
atggccaggagatatgatgagctgccccactacccaggcatcgtggatggccctgctgccctggccagcttccctgagaccgtgcctgctgtgcccggcccctacggcccccaccggcccccccagcccctgcccccaggcctggacagtgatggcctgaagcgggagaaggatgagatctacggccaccccctcttccccctgctggccctggtgtttgagaagtgtgagctggccacctgcagccccagagatggagctggagctggcctgggcaccccacctggaggagatgtgtgcagcagtgacagcttcaatgaagatattgctgcctttgccaagcaggtgcgctctgagcggcccctcttcagcagcaaccctgagctggacaacctgatgatccaggccatccaggtgctgcgcttccacctgctggagctggagaaggtgcatgacctgtgtgacaacttctgccaccgctacatcacctgcctgaagggcaagatgcccatcgacctggtgattgaggacagagatggcggctgccgggaggactttgaggactacccagccagctgccccagcctgcctgaccagaacaacatgtggatccgggaccacgaggacagcggctctgtgcacctgggcaccccaggccccagcagcggcggcctggccagccagagcggggacaacagcagtgaccagggagatggcctggacacctctgtggccagccccagcagtggaggagaagatgaggacctggaccaggagaggagaagaaacaagaagaggggcatcttccccaaggtggccaccaacatcatgagggcctggctgttccagcacctgagccacccctaccccagcgaggagcagaagaagcagctggcccaggacaccggcctgaccatcctgcaggtgaacaactggttcatcaatgcccggcggcgcatcgtgcagcccatgattgaccagagcaacagaacaggccagggcgccgccttcagccctgagggccagcccatcggcggctacacagagacccagccccacgtggccgtgcggcccccaggctctgtgggcatgagcctgaacctggagggggagtggcactacctgtag

SEQ ID NO: 16057 - DNA, 1266 bp, Artificial Sequence
  Description of Artificial Sequence: Synthetic coding sequence
atggccaggagatatgatgagctgccccactacccaggcatcgtggatggccctgctgccctggccagcttccctgagaccgtgcctgctgtgcccggcccctacggcccccaccggcccccccagcccctgcccccaggcctggacagtgatggcctgaagcgggagaaggatgagatctacggccaccccctcttccccctgctggccctggtgtttgagaagtgtgagctggccacctgcagccccagagatggagctggagctggcctgggcaccccacctggaggagatgtgtgcagcagtgacagcttcaatgaagatattgctgcctttgccaagcaggtgcgctctgagcggcccctcttcagcagcaaccctgagctggacaacctgatgatccaggccatccaggtgctgcgcttccacctgctggagctggagaaggtgcatgacctgtgtgacaacttctgccaccgctacatcacctgcctgaagggcaagatgcccatcgacctggtgattgaggacagagatggcggctgccgggaggactttgaggactacccagccagctgccccagcctgcctgaccagaacaacatgtggatccgggaccacgaggacagcggctctgtgcacctgggcaccccaggccccagcagcggcggcctggccagccagagcggggacaacagcagtgaccagggagatggcctggacacctctgtggccagccccagcagtggaggagaagatgaggacctggaccaggagaggagaagaaacaagaagaggggcatcttccccaaggtggccaccaacatcatgagggcctggctgttccagcacctgagcagaagaagtgaggcccctgtgctgcctgatgtgtgcctgggcctgggcagccccagccctggcccccgctgggcccggccctggggcagtgactgtggccggcccggccggcagagcgacagctgctggtggctgcagcacccctaccccagcgaggagcagaagaagcagctggcccaggacaccggcctgaccatcctgcaggtgaacaactggttcatcaatgcccggcggcgcatcgtgcagcccatgattgaccagagcaacagaacaggccagggcgccgccttcagccctgagggccagcccatcggcggctacacagagacccagccccacgtggccgtgcggcccccaggctctgtgggcatgagcctgaacctggagggggagtggcactacctgtag

SEQ ID NO: 16058 - DNA, 1266 bp, Artificial Sequence; identical to SEQ ID NO: 16057
  Description of Artificial Sequence: Synthetic coding sequence

SEQ ID NO: 16059 - DNA, 1266 bp, Artificial Sequence; identical to SEQ ID NO: 16057
  Description of Artificial Sequence: Synthetic coding sequence

SEQ ID NO: 16060 - DNA, 1929 bp, Artificial Sequence
  Description of Artificial Sequence: Synthetic coding sequence
atggtgtctgccagccagaatgaggtgcctgctgcccccctggaggagctggcctaccgccgcagcctgcgggtggccctggatgtgctgtctgagggcagcatctggagccaggagagcagcgctggcaccggccgggctgacaggagcctgcggggcaagcccatggagcacgtgagcagcccctgtgacagcaacagcagcagcctgcccagaggagatgtgctgggcagcagccggccccacagaagaagaccctgtgtgcagcagagcctgagcagcagcttcacctgtgagaaggaccctgagtgcaaggtggaccacaagaagggcctgaggaagtctgagaacccccggggccccctggtgctgcctgctgggggcggggcccaggatgagagcggcagccgcatccaccacaagaactggaccctggccagcaagaggggcggcaacagcgcccagaaggccagcctgtgcctgaatggcagcagcctgtctgaagatgacacagagcgggacatgggcagcaagggcggctcctgggccgcccccagcctgcccagcggcgtgagagaagatgacccctgtgccaatgctgagggccatgaccccggcctgcccctgggcagcctgacagcccccccagcccctgagcccagcgcctgcagcgagcccggggagtgcccagccaagaagaggccccggctggatggcagccagaggcctcctgctgtgcagctggagcccatggctgctggagctgcccccagccctggccctggccctggcccccgggagagcgtgacccccaggagcacagcccggctgggccccccacccagccacgccagcgcagatgccacccgctgcctgccctgcccagacagccagaagctggagaaggagtgccagagcagcgaggagagcatgggcagcaacagcatgaggagcatcctggaggaggatgaagaagatgaggagcccccccgggtgctgctgtaccacgagcccaggagctttgaggtgggcatgctggtgtggcacaagcacaagaagtaccccttctggccagctgtggtgaagtctgtgcggcagagggacaagaaggcctctgtgctgtacatcgagggccacatgaaccccaagatgaagggcttcaccgtgtccctgaagagcctgaagcactttgactgcaaggagaagcagaccctgctgaaccaggcccgggaggacttcaaccaggacatcggctggtgtgtgtccctcatcacagactacagagtgcggctgggctgcggcagctttgctggcagcttcctggagtactatgctgctgacatctcctaccctgtgaggaagagcatccagcaggatgtgctgggcaccaagctgccccagctgagcaagggcagccctgaggagcctgtggtgggctgccccctgggccagaggcagccctgcaggaagatgctgcctgacaggagccgggccgcccgggaccgggccaaccagaagctggtggagtacatcgtgaaggccaagggagctgagagccacctgcgggccatcctgaagagcaggaagcccagccgctggctgcagaccttcctgagcagcagccagtatgtgacctgtgtggagacctacctggaggatgagggccagctggacctggtggtgaagtacctgcagggcgtgtaccaggaggtgggcgccaaggtgctgcagaggaccaacggggaccgcatccgcttcatcctggatgtgctgctgcctgaggccatcatctgtgccatctctgctgtggatgaggtggactacaagacagctgaggagaagtacatcaagggccccagcctgagctaccgggagaaggagatctttgacaaccagctgctggaggagaggaacagaagaagaagatag

SEQ ID NO: 16061 - DNA, 2136 bp, Artificial Sequence
  Description of Artificial Sequence: Synthetic coding sequence
atgatggctgatgccaagtatgtgctgtgccgctgggagaagaggctgtggccagccaaggtgctggccaggacagccaccagcaccaagaacaagaggaggaaggagtacttcctggccgtgcagatcctgagcctggaggagaagatcaaggtgaagagcacagaggtggagatcctggagaagagccagatcgaggccatcgccagcagcctggccagccagaatgaggtgcctgctgcccccctggaggagctggcctacagaagaagcctgcgggtggccctggatgtgctgtctgagggcagcatctggagccaggagagcagcgctggcaccggccgggctgacaggagcctgcggggcaagcccatggagcacgtgagcagcccctgtgacagcaacagcagcagcctgcccagaggagatgtgctgggcagcagccggccccacagaagaagaccctgtgtgcagcagagcctgagcagcagcttcacctgtgagaaggaccctgagtgcaaggtggaccacaagaagggcctgaggaagtctgagaacccccggggccccctggtgctgcctgctgggggcggggcccaggatgaaagtggcagccgcatccaccacaagaactggaccctggccagcaagagaggaggcaacagcgcccagaaggccagcctgtgcctgaatggcagcagcctgtctgaagatgacacagagcgggacatgggcagcaaaggaggctcctgggccgcccccagcctgcccagcggcgtgcgggaggatgacccctgtgccaatgctgagggccatgaccccggcctgcccctgggcagcctgacagcccccccagcccctgagcccagcgcctgcagcgagcctggagaatgtcctgccaagaagaggccccggctggatggcagccagaggcccccagctgtgcagctggagcccatggccgccggggccgcccccagccctggccctggccctggcccccgggagagcgtgacccccaggagcacagcccggctgggccccccacccagccacgccagcgcagatgccacccgctgcctgccctgcccagacagccagaagctggagaaggagtgccagagcagcgaggagagcatgggcagcaacagcatgaggagcatcctggaggaggatgaggaggatgaggagcccccccgggtgctgctgtaccacgagcccaggagctttgaggtgggcatgctggtgtggcacaagcacaagaagtaccccttctggccagctgtggtgaagtctgtgcggcagagggacaagaaggcctctgtgctgtacatcgagggccacatgaaccccaagatgaagggcttcaccgtgtccctgaagagcctgaagcactttgactgcaaggagaagcagaccctgctgaaccaggcccgggaggacttcaaccaggacatcggctggtgtgtgtccctcatcacagactacagagtgcggctgggctgcggcagctttgctggcagcttcctggagtactatgctgctgacatctcctaccctgtgaggaagagcatccagcaggatgtgctgggcaccaagctgccccagctgagcaagggcagccctgaggagcctgtggtgggctgccccctgggccagaggcagccctgcaggaagatgctgcctgacaggagcagagctgcccgggaccgggccaaccagaagctggtggagtacatcgtgaaggccaagggagctgagagccacctgcgggccatcctgaagagcaggaagcccagccgctggctgcagaccttcctgagcagcagccagtatgtgacctgtgtggagacctacctggaggatgagggccagctggacctggtggtgaagtacctgcagggcgtgtaccaggaggtgggcgccaaggtgctgcagaggaccaatggagaccgcatccgcttcatcctggatgtgctgctgcctgaggccatcatctgtgccatctctgctgtggatgaggtggactacaagacagctgaggagaagtacatcaagggccccagcctgagctaccgggagaaggagatctttgacaaccagctgctggaggagaggaacagaagaagaagatag

SEQ ID NO: 16062 - DNA, 225 bp, Artificial Sequence
  Description of Artificial Sequence: Synthetic coding sequence
gggggcggcggcggcggccacatcggcgtgcggcccggcagcaccctgtgccagatcatcgccacctgccacatgtctgtgaatgatggcggctgctacgtgctgtgccgctgggagaagaggctgtggccagccaaggtgctggccaggacagccaccagcaccaagaacaagaggaggaaggagtacttcctggccgtgcagatcctgagcctggaggagtag

SEQ ID NO: 16063 - DNA, 2199 bp, Artificial Sequence
  Description of Artificial Sequence: Synthetic coding sequence
atgatggctgatgccaagtatgtgctgtgccgctgggagaagaggctgtggccagccaaggtgctggccaggacagccaccagcaccaagaacaagaggaggaaggagtacttcctggccgtgcagatcctgagcctggaggagaagatcaaggtgaagagcacagaggtggagatcctggagaagagccagatcgaggccatcgccagcagcctggccagccagaatgaggtgcctgctgcccccctggaggagctggcctacagaagaagcctgcgggtggccctggatgtgctgtctgagggcagcatctggagccaggagagcagcgctggcaccggccgggctgacaggagcctgcggggcaagcccatggagcacgtgagcagcccctgtgacagcaacagcagcagcctgcccagaggagatgtgctgggcagcagccggccccacagaagaagaccctgtgtgcagcagagcctgagcagcagcttcacctgtgagaaggaccctgagtgcaaggtggaccacaagaagggcctgaggaagtctgagaacccccggggccccctggtgctgcctgctgggggcggggcccaggatgaaagtggcagccgcatccaccacaagaactggaccctggccagcaagagaggaggcaacagcgcccagaaggccagcctgtgcctgaatggcagcagcctgtctgaagatgacacagagcgggacatgggcagcaaaggaggctcctgggccgcccccagcctgcccagcggcgtgcgggaggatgacccctgtgccaatgctgagggccatgaccccggcctgcccctgggcagcctgacagcccccccagcccctgagcccagcgcctgcagcgagcctggagaatgtcctgccaagaagaggccccggctggatggcagccagaggcccccagctgtgcagctggagcccatggccgccggggccgcccccagccctggccctggccctggcccccgggagagcgtgacccccaggagcacagcccggctgggccccccacccagccacgccagcgcagatgccacccgctgcctgccctgcccagacagccagaagctggagaaggagtgccagagcagcgaggagagcatgggcagcaacagcatgaggagcatcctggaggaggatgaggaggatgaggagcccccccgggtgctgctgtaccacgagcccaggagctttgaggtgggcatgctggtgtggcacaagcacaagaagtaccccttctggccagctgtggtgaagtctgtgcggcagagggacaagaaggcctctgtgctgtacatcgagggccacatgaaccccaagatgaagggcttcaccgtgtccctgaagagcctgaagcactttgactgcaaggagaagcagaccctgctgaaccaggcccgggaggacttcaaccaggacatcggctggtgtgtgtccctcatcacagactacagagtgcggctgggctgcggcagctttgctggcagcttcctggagtactatgctgctgacatctcctaccctgtgaggaagagcatccagcaggatgtgctgggcaccaagctgccccagctgagcaagggcagccctgaggagcctgtggtgggctgccccctgggccagaggcagccctgcaggaagatgctgcctgacaggagcagagctgcccgggaccgggccaaccagaagctggtggagtacatcgtgaaggccaagggagctgagagccacctgcgggccatcctgaagagcaggaagcccagccgctggctgcagaccttcctgagcagcagccagtatgtgacctgtgtggagacctacctggaggatgagggccagctggacctggtggtgaagtacctgcagggcgtgtaccaggaggtgggcgccaaggtgctgcagaggaccaatggagaccgcatccgcttcatcctggatgtgctgctgcctgagtgctgggagatgagggtgcgggccctggaccctgtgagaagaagaagccggctgctggacccctgtgccgagatggagctgctgcggagctgccagcaccagggcgtgaggacccccagcctgctgcgggcccaccgctgcttccctgcctctgtgggccaccacctgtgtgacctgtgtggcggccggggcggcctgcaggatggatag

SEQ ID NO: 16064 - DNA, 501 bp, Artificial Sequence
  Description of Artificial Sequence: Synthetic coding sequence
gtgctggccgccagccagaatgaggtgcctgcccacccctggaagaactggcccacagatggccgggtggccctggatgtgctgtctgagggcagcatctggagccaggagagcagcgctggcaccggccgggctgacaggagcctgcggggcaagcccatggagcacgtgagcagcccctgtgacagcaacagcagcagcctgcccagaggagatgtgctgggcagcagccggccccacagaagaagaccctgtgtgcagcagagcctgagcagcagcttcacctgtgagaaggaccctgagtgcaaggtggaccacaagaagggcctgaggaagtctgagaacccccggggccccctggtgctgcctgctgggggcggggcccaggatgagagcggcagccgcatccaccacaagaactggaccctggccagcaagaggggcggcaacagcgcccagaaggccagcctgtgcctgaatggcagcagcctgtctgagtag

SEQ ID NO: 16065 - DNA, 1539 bp, Artificial Sequence
  Description of Artificial Sequence: Synthetic coding sequence
atggccgagcccagcgtggagagcagcagccctgggggcagcgccaccagtgatgaccacgagtttgaccccagcgctgacatgctggtgcatgactttgatgatgagaggaccctggaggaggaggagatgatggagggggagaccaacttcagcagcgagattgaggacctggcccgggagggggacatgcccatccacgagctgctgagcctgtatggctacggcagcacagtgcggctgcctgaggaggatgaggaggaggaggaggaggaggaggagggggaggatgatgaagatgctgacaatgatgacaacagcggctgcagcggggagaacaaggaggagaacatcaaggacagcagcggccaggaggatgagacccagagcagcaatgatgaccccagccagagcgtggccagccaggatgcccaggagatcatccggccccggcgctgcaagtactttgacaccaacagcgaggtggaggaggagagcgaggaggatgaggactacatccccagcgaggactggaagaaggagatcatggtgggctccatgttccaggccgagatccctgtgggcatctgccgctacaaggaaaatgagaaggtgtatgaaaatgatgaccagctgctgtgggaccctgagtacctgcctgaggacaaggtgatcatcttcctgaaggatgccagcagaagaactggagatgagaagggcgtggaggccatccctgagggcagccacatcaaggacaatgagcaggccctgtatgagctggtgaagtgcaactttgacacagaggaggccctgcggcggctgcgcttcaacgtgaaggccgcccgggaggagctgtctgtgtggacagaggaggagtgcaggaactttgagcagggcctgaaggcctacggcaaggacttccacctgatccaggccaacaaggtgaggaccaggtctgtgggggagtgtgtggccttctactacatgtggaagaagtcagaaagatatgacttctttgcccagcagaccaggtttgggaagaagaagtacaacctgcaccctggggtgacagactacatggaccggctgctggatgaaagtgaatctgctgccagcagccgggcccccagccccccacccacagccagcaacagcagcaacagccagagcgagaaggaggatggcaccgtgtccacagccaaccagaatggagtgagcagcaatggacctggagagatcctgaacaaggaggaggtgaaggtggagggcctgcacatcaatggccccaccggcggcaacaagaagcccctgcatgctgacatggacaccaacggctatgaaacagacaacctgaccacagaccccaagctggcccacatgacagccagaaatgaaaatgactttgatgagaagtctgagaggcctgccaagagaagaagagtgaacagcaatggcaaggagagccctggcagcagcgagttcttccaggaggccgtgagccacggcaagtttgaggagctggagaacacagatgactag

SEQ ID NO: 16066 - DNA, 1113 bp, Artificial Sequence
  Description of Artificial Sequence: Synthetic coding sequence
atgcccatccacgagctgctgagcctgtatggctacggcagcacagtgcggctgcctgaagaagatgaggaggaggaggaggaggaggaggagggagaagatgatgaagatgctgacaatgatgacaacagcggctgcagcggggagaacaaggaggagaacatcaaggacagcagcggccaggaggatgagacccagagcagcaatgatgaccccagccagagcgtggccagccaggatgcccaggagatcatccggccccggcgctgcaagtactttgacaccaacagcgaggtggaggaggagagtgaagaagatgaggactacatccccagcgaggactggaagaaggagatcatggtgggctccatgttccaggccgagatccctgtgggcatctgccgctacaaggaaaatgagaaggtgtatgaaaatgatgaccagctgctgtgggaccctgagtacctgcctgaggacaaggtgatcatcttcctgaaggatgccagcagaagaactggagatgagaagggcgtggaggccatccctgagggcagccacatcaaggacaatgagcaggccctgtatgagctggtgaagtgcaactttgacacagaggaggccctgcggcggctgcgcttcaacgtgaaggccgcccgggaggagctgtctgtgtggacagaggaggagtgcaggaactttgagcagggcctgaaggcctacggcaaggacttccacctgatccaggccaacaaggtgaggaccaggtctgtgggagaatgtgtggccttctactacatgtggaagaagtcagaaagatatgacttctttgcccagcagaccaggtttgggaagaagaagtacaacctgcaccctggggtgacagactacatggaccggctgctggatgagagcgagagcgctgccagcagccgggcccccagccccccacccacagccagcaacagcagcaacagccagagcgagaaggaggatggcaccgtgtccacagccaaccagaatggagtgagcagcaatggacctggcatcctgcagatgctgctgcctgtgcacttcagcgccatcagcagccgggccaatgccttcctgaagtag

SEQ ID NO: 16067 - DNA, 1590 bp, Artificial Sequence
  Description of Artificial Sequence: Synthetic coding sequence
atgttcatgttcaactggttcacagactgcctgtggaccctcttcctgagcaactaccagcccagcgtggagagcagcagccctgggggcagcgccaccagtgatgaccatgaatttgaccccagcgctgacatgctggtgcatgactttgatgatgagaggaccctggaggaggaggagatgatggagggggagaccaacttcagcagcgagattgaggacctggcccgggagggggacatgcccatccacgagctgctgagcctgtatggctacggcagcacagtgcggctgcctgaagaagatgaggaggaggaggaggaggaggaggagggagaagatgatgaagatgctgacaatgatgacaacagcggctgcagcggggagaacaaggaggagaacatcaaggacagcagcggccaggaggatgagacccagagcagcaatgatgaccccagccagagcgtggccagccaggatgcccaggagatcatccggccccggcgctgcaagtactttgacaccaacagcgaggtggaggaggagagtgaagaagatgaggactacatccccagcgaggactggaagaaggagatcatggtgggctccatgttccaggccgagatccctgtgggcatctgccgctacaaggaaaatgagaaggtgtatgaaaatgatgaccagctgctgtgggaccctgagtacctgcctgaggacaaggtgatcatcttcctgaaggatgccagcagaagaactggagatgagaagggcgtggaggccatccctgagggcagccacatcaaggacaatgagcaggccctgtatgagctggtgaagtgcaactttgacacagaggaggccctgcggcggctgcgcttcaacgtgaaggccgcccgggaggagctgtctgtgtggacagaggaggagtgcaggaactttgagcagggcctgaaggcctacggcaaggacttccacctgatccaggccaacaaggtgaggaccaggtctgtgggagaatgtgtggccttctactacatgtggaagaagtcagaaagatatgacttctttgcccagcagaccaggtttgggaagaagaagtacaacctgcaccctggggtgacagactacatggaccggctgctggatgagagcgagagcgctgccagcagccgggcccccagccccccacccacagccagcaacagcagcaacagccagagcgagaaggaggatggcaccgtgtccacagccaaccagaatggagtgagcagcaatggacctggagagatcctgaacaaggaggaggtgaaggtggagggcctgcacatcaatggccccactggaggcaacaagaagcccctgcacgccgacatggacaccaacggctatgaaacagacaacctgaccacagaccccaagctggcccacatgacagccagaaatgaaaatgactttgatgagaagtctgagaggcctgccaagagaagaagagtgaacagcaatggcaaggagagccctggcagcagcgagttcttccaggaggccgtgagccacggcaagtttgaggagctggagaacacagatgactag

SEQ ID NO: 16068 - DNA, 1461 bp, Artificial Sequence
  Description of Artificial Sequence: Synthetic coding sequence
atggatggagccagcagcggcggcggcggcagcagcgagggcggcggcggcagcagcggcagcggctatggagtggtggcccgcttcagccagtgcctggccgagttccgcacctggctgcggaccaactggctgcgcttcaatgctgacaagacagatgtgatgctgcccagcgtggagagcagcagccctgggggcagcgccaccagtgatgaccatgaatttgaccccagcgctgacatgctggtgcatgactttgatgatgagaggaccctggaggaggaggagatgatggagggggagaccaacttcagcagcgagattgaggacctggcccgggagggggacatgcccatccacgagctgctgagcctgtatggctacggcagcacagtgcggctgcctgaagaagatgaggaggaggaggaggaggaggaggagggagaagatgatgaagatgctgacaatgatgacaacagcggctgcagcggggagaacaaggaggagaacatcaaggacagcagcggccaggaggatgagacccagagcagcaatgatgaccccagccagagcgtggccagccaggatgcccaggagatcatccggccccggcgctgcaagtactttgacaccaacagcgaggtggaggaggagagtgaagaagatgaggactacatccccagcgaggactggaagaaggagatcatggtgggctccatgttccaggccgagatccctgtgggcatctgccgctacaaggaaaatgagaaggtgtatgaaaatgatgaccagctgctgtgggaccctgagtacctgcctgaggacaaggtgatcatcttcctgaaggatgccagcagaagaactggagatgagaagggcgtggaggccatccctgagggcagccacatcaaggacaatgagcaggccctgtatgagctggtgaagtgcaactttgacacagaggaggccctgcggcggctgcgcttcaacgtgaaggccgcccgggaggagctgtctgtgtggacagaggaggagtgcaggaactttgagcagggcctgaaggcctacggcaaggacttccacctgatccaggccaacaaggtgaggaccaggtctgtgggagaatgtgtggccttctactacatgtggaagaagtcagaaagatatgacttctttgcccagcagaccaggtttgggaagaagaagtacaacctgcaccctggggtgacagactacatggaccggctgctggatgagagcgagagcgctgccagcagccgggcccccagccccccacccacagccagcaacagcagcaacagccagagcgagaaggaggatggcaccgtgtccacagccaaccagaatggagtgagcagcaatggacctggcatcctgcagatgctgctgcctgtgcacttcagcgccatcagcagccgggccaatgccttcctgaagtag

SEQ ID NO: 16069 - DNA, 1353 bp, Artificial Sequence
  Description of Artificial Sequence: Synthetic coding sequence
atgttcatgttcaactggttcacagactgcctgtggaccctcttcctgagcaactaccagcccagcgtggagagcagcagccctgggggcagcgccaccagtgatgaccatgaatttgaccccagcgctgacatgctggtgcatgactttgatgatgagaggaccctggaggaggaggagatgatggagggggagaccaacttcagcagcgagattgaggacctggcccgggagggggacatgcccatccacgagctgctgagcctgtatggctacggcagcacagtgcggctgcctgaagaagatgaggaggaggaggaggaggaggaggagggagaagatgatgaagatgctgacaatgatgacaacagcggctgcagcggggagaacaaggaggagaacatcaaggacagcagcggccaggaggatgagacccagagcagcaatgatgaccccagccagagcgtggccagccaggatgcccaggagatcatccggccccggcgctgcaagtactttgacaccaacagcgaggtggaggaggagagtgaagaagatgaggactacatccccagcgaggactggaagaaggagatcatggtgggctccatgttccaggccgagatccctgtgggcatctgccgctacaaggaaaatgagaaggtgtatgaaaatgatgaccagctgctgtgggaccctgagtacctgcctgaggacaaggtgatcatcttcctgaaggatgccagcagaagaactggagatgagaagggcgtggaggccatccctgagggcagccacatcaaggacaatgagcaggccctgtatgagctggtgaagtgcaactttgacacagaggaggccctgcggcggctgcgcttcaacgtgaaggccgcccgggaggagctgtctgtgtggacagaggaggagtgcaggaactttgagcagggcctgaaggcctacggcaaggacttccacctgatccaggccaacaaggtgaggaccaggtctgtgggagaatgtgtggccttctactacatgtggaagaagtcagaaagatatgacttctttgcccagcagaccaggtttgggaagaagaagtacaacctgcaccctggggtgacagactacatggaccggctgctggatgagagcgagagcgctgccagcagccgggcccccagccccccacccacagccagcaacagcagcaacagccagagcgagaaggaggatggcaccgtgtccacagccaaccagaatggagtgagcagcaatggacctggcatcctgcagatgctgctgcctgtgcacttcagcgccatcagcagccgggccaatgccttcctgaagtag

SEQ ID NO: 16070 - DNA, 1602 bp, Artificial Sequence
  Description of Artificial Sequence: Synthetic coding sequence
atgtgcatccgctgcctgtgcctgattggcctgcagacagtgtgtggcctcttcagctgccagatcacccggcccagcgtggagagcagcagccctgggggcagcgccaccagtgatgaccatgaatttgaccccagcgctgacatgctggtgcatgactttgatgatgagaggaccctggaggaggaggagatgatggagggggagaccaacttcagcagcgagattgaggacctggcccgggagggggacatgcccatccacgagctgctgagcctgtatggctacggcagcacagtgcggctgcctgaagaagatgaggaggaggaggaggaggaggaggagggagaagatgatgaagatgctgacaatgatgacaacagcggctgcagcggggagaacaaggaggagaacatcaaggacagcagcggccaggaggatgagacccagagcagcaatgatgaccccagccagagcgtggccagccaggatgcccaggagatcatccggccccggcgctgcaagtactttgacaccaacagcgaggtggaggaggagagtgaagaagatgaggactacatccccagcgaggactggaagaaggagatcatggtgggctccatgttccaggccgagatccctgtgggcatctgccgctacaaggaaaatgagaaggtgtatgaaaatgatgaccagctgctgtgggaccctgagtacctgcctgaggacaaggtgatcatcttcctgaaggatgccagcagaagaactggagatgagaagggcgtggaggccatccctgagggcagccacatcaaggacaatgagcaggccctgtatgagctggtgaagtgcaactttgacacagaggaggccctgcggcggctgcgcttcaacgtgaaggccgcccgggaggagctgtctgtgtggacagaggaggagtgcaggaactttgagcagggcctgaaggcctacggcaaggacttccacctgatccaggccaacaaggtgaggaccaggtctgtgggagaatgtgtggccttctactacatgtggaagaagtcagaaagatatgacttctttgcccagcagaccaggtttgggaagaagaagtacaacctgcaccctggggtgacagactacatggaccggctgctggatgagagcgagagcgctgccagcagccgggcccccagccccccacccacagccagcaacagcagcaacagccagagcgagaaggaggatggcaccgtgtccacagccaaccagaatggagtgagcagcaatggacctggagagatcctgaacaaggaggaggtgaaggtggagggcctgcacatcaatggccccactggaggcaacaagaagcccctgcacgccgacatggacaccaacggctatgaaacagacaacctgaccacagaccccaagctggcccacatgacagccagaaatgaaaatgactttgatgagaagtctgagaggcctgccaagagaagaagagtgaacagcaatggcaaggagagccctggcagcagcgagttcttccaggaggccgtgagccacggcaagtttgaggagctggagaacacagatgactag

SEQ ID NO: 16071 - DNA, 1413 bp, Artificial Sequence
  Description of Artificial Sequence: Synthetic coding sequence
atgttcatgttcaactggttcacagactgcctgtggaccctcttcctgagcaactaccagcccagcgtggagagcagcagccctgggggcagcgccaccagtgatgaccatgaatttgaccccagcgctgacatgctggtgcatgactttgatgatgagaggaccctggaggaggaggagatgatggagggggagaccaacttcagcagcgagattgaggacctggcccgggagggggacatgcccatccacgagctgctgagcctgtatggctacggcagcacagtgcggctgcctgaagaagatgaggaggaggaggaggaggaggaggagggagaagatgatgaagatgctgacaatgatgacaacagcggctgcagcggggagaacaaggaggagaacatcaaggacagcagcggccaggaggatgagacccagagcagcaatgatgaccccagccagagcgtggccagccaggatgcccaggagatcatccggccccggcgctgcaagtactttgacaccaacagcgaggtggaggaggagagtgaagaagatgaggactacatccccagcgaggactggaagaaggagatcatggtgggctccatgttccaggccgagatccctgtgggcatctgccgctacaaggaaaatgagaaggtgtatgaaaatgatgaccagctgctgtgggaccctgagtacctgcctgaggacaaggtgatcatcttcctgaaggatgccagcagaagaactggagatgagaagggcgtggaggccatccctgagggcagccacatcaaggacaatgagcaggccctgtatgagctggtgaagtgcaactttgacacagaggaggccctgcggcggctgcgcttcaacgtgaaggccgcccgggaggagctgtctgtgtggacagaggaggagtgcaggaactttgagcagggcctgaaggcctacggcaaggacttccacctgatccaggccaacaaggtgaggaccaggtctgtgggagaatgtgtggccttctactacatgtggaagaagtcagaaagatatgacttctttgcccagcagaccaggtttgggaagaagaagtacaacctgcaccctggggtgacagactacatggaccggctgctggatgagagcgagagcgctgccagcagccgggcccccagccccccacccacagccagcaacagcagcaacagccagagcgagaaggaggatggcaccgtgtccacagccaaccagaatggagtgagcagcaatggacctggagagatcctgaacaaggaggaggtgaaggtggagggcctgcacatcaatggccccaccggcatcctgcagatgctgctgcctgtgcacttcagcgccatcagcagccgggccaatgccttcctgaagtag

SEQ ID NO: 16072 - DNA, 1698 bp, Artificial Sequence
  Description of Artificial Sequence: Synthetic coding sequence
atggatggagccagcagcggcggcggcggcagcagcgagggcggcggcggcagcagcggcagcggctatggagtggtggcccgcttcagccagtgcctggccgagttccgcacctggctgcggaccaactggctgcgcttcaatgctgacaagacagatgtgatgctgcccagcgtggagagcagcagccctgggggcagcgccaccagtgatgaccatgaatttgaccccagcgctgacatgctggtgcatgactttgatgatgagaggaccctggaggaggaggagatgatggagggggagaccaacttcagcagcgagattgaggacctggcccgggagggggacatgcccatccacgagctgctgagcctgtatggctacggcagcacagtgcggctgcctgaagaagatgaggaggaggaggaggaggaggaggagggagaagatgatgaagatgctgacaatgatgacaacagcggctgcagcggggagaacaaggaggagaacatcaaggacagcagcggccaggaggatgagacccagagcagcaatgatgaccccagccagagcgtggccagccaggatgcccaggagatcatccggccccggcgctgcaagtactttgacaccaacagcgaggtggaggaggagagtgaagaagatgaggactacatccccagcgaggactggaagaaggagatcatggtgggctccatgttccaggccgagatccctgtgggcatctgccgctacaaggaaaatgagaaggtgtatgaaaatgatgaccagctgctgtgggaccctgagtacctgcctgaggacaaggtgatcatcttcctgaaggatgccagcagaagaactggagatgagaagggcgtggaggccatccctgagggcagccacatcaaggacaatgagcaggccctgtatgagctggtgaagtgcaactttgacacagaggaggccctgcggcggctgcgcttcaacgtgaaggccgcccgggaggagctgtctgtgtggacagaggaggagtgcaggaactttgagcagggcctgaaggcctacggcaaggacttccacctgatccaggccaacaaggtgaggaccaggtctgtgggagaatgtgtggccttctactacatgtggaagaagtcagaaagatatgacttctttgcccagcagaccaggtttgggaagaagaagtacaacctgcaccctggggtgacagactacatggaccggctgctggatgagagcgagagcgctgccagcagccgggcccccagccccccacccacagccagcaacagcagcaacagccagagcgagaaggaggatggcaccgtgtccacagccaaccagaatggagtgagcagcaatggacctggagagatcctgaacaaggaggaggtgaaggtggagggcctgcacatcaatggccccactggaggcaacaagaagcccctgcacgccgacatggacaccaacggctatgaaacagacaacctgaccacagaccccaagctggcccacatgacagccagaaatgaaaatgactttgatgagaagtctgagaggcctgccaagagaagaagagtgaacagcaatggcaaggagagccctggcagcagcgagttcttccaggaggccgtgagccacggcaagtttgaggagctggagaacacagatgactag

SEQ ID NO: 16073 - DNA, 1302 bp, Artificial Sequence
  Description of Artificial Sequence: Synthetic coding sequence
atggccgagcccagcgtggagagcagcagccctgggggcagcgccaccagtgatgaccacgagtttgaccccagcgctgacatgctggtgcatgactttgatgatgagaggaccctggaggaggaggagatgatggagggggagaccaacttcagcagcgagattgaggacctggcccgggagggggacatgcccatccacgagctgctgagcctgtatggctacggcagcacagtgcggctgcctgaggaggatgaggaggaggaggaggaggaggaggagggggaggatgatgaagatgctgacaatgatgacaacagcggctgcagcggggagaacaaggaggagaacatcaaggacagcagcggccaggaggatgagacccagagcagcaatgatgaccccagccagagcgtggccagccaggatgcccaggagatcatccggccccggcgctgcaagtactttgacaccaacagcgaggtggaggaggagagcgaggaggatgaggactacatccccagcgaggactggaagaaggagatcatggtgggctccatgttccaggccgagatccctgtgggcatctgccgctacaaggaaaatgagaaggtgtatgaaaatgatgaccagctgctgtgggaccctgagtacctgcctgaggacaaggtgatcatcttcctgaaggatgccagcagaagaactggagatgagaagggcgtggaggccatccctgagggcagccacatcaaggacaatgagcaggccctgtatgagctggtgaagtgcaactttgacacagaggaggccctgcggcggctgcgcttcaacgtgaaggccgcccgggaggagctgtctgtgtggacagaggaggagtgcaggaactttgagcagggcctgaaggcctacggcaaggacttccacctgatccaggccaacaaggtgaggaccaggtctgtgggggagtgtgtggccttctactacatgtggaagaagtcagaaagatatgacttctttgcccagcagaccaggtttgggaagaagaagtacaacctgcaccctggggtgacagactacatggaccggctgctggatgaaagtgaatctgctgccagcagccgggcccccagccccccacccacagccagcaacagcagcaacagccagagcgagaaggaggatggcaccgtgtccacagccaaccagaatggagtgagcagcaatggacctggcatcctgcagatgctgctgcctgtgcacttcagcgccatcagcagccgggccaatgccttcctgaagtag

SEQ ID NO: 16074 - DNA, 1638 bp, Artificial Sequence
  Description of Artificial Sequence: Synthetic coding sequence
atggccgaggccagcagcctgggccggcagagcccccgggtggtgtcctgcctggagcacagcctgtgccctggagagcccggcctgcagaccacagctgtggtgtccatgggcagcggggaccaccagttcaacctggccgagatcctgagccagaactacagcgtgagaggagaatgtgaggaggccagccgctgcccagacaagcccaaggaggagctggagaaggacttcatcagccagagcaatgacatgccctttgatgagctgctggccctgtatggctatgaggccagtgaccccatcagtgaccgggagagcgagggcggagatgtggcccccaacctgcctgacatgaccctggacaaggagcagatcgccaaggacctgctgagcggggaggaggaggaggagacccagagcagcgcagatgacctgaccccatctgtgaccagccatgaggccagtgacctcttccccaacagaagtggcagccgcttcctggctgatgaagatcgggagcccggcagcagcgccagcagtgacacagaggaggacagcctgcctgccaacaagtgcaagaaggagatcatggtgggcccccagttccaggccgacctgagcaacctgcacctgaacagacactgtgagaagatctatgaaaatgaagaccagctgctgtgggaccccagcgtgctgcctgagcgggaggtggaggagttcctgtacagagctgtgaagaggcgctggcatgagatggccggcccccagctgcctgagggggaggccgtgaaggacagcgagcaggccctgtatgagctggtgaagtgcaacttcaacgtggaggaggccctgcggcggctgcgcttcaacgtgaaggtgatcagagatggcctgtgtgcctggagcgaggaggagtgcaggaactttgagcacggcttccgggtgcacggcaagaacttccacctgatccaggccaacaaggtgaggaccaggtctgtgggggagtgtgtggagtactactacctgtggaagaagtcagaaagatatgactactttgcccagcagacccggctgggccgcaggaaatatgtgcccagcggcaccacagatgctgaccaggacctggatggcagtgaccctgatggccctggccggcccaggcctgagcaggacaccctgaccggcatgaggacagaccccctgtctgtggatggaacagctgggggcctggatgagcccggggtggccagtgatggcctgcccagcagcgagcccggcccctgcagcttccagcagctggatgagagccctgctgtgcccctgagccaccggcccccagccctggccgaccctgccagctaccagcctgctgtgacagcccctgagccagatgccagcccccggctggccgtggactttgccctgcccaaggagctgcccctcatcagcagccacgtggacctgagcggggaccctgaggagaccgtggccccagcccaggtggccctgtctgtgacagaatttggcctcatcggcattggagatgtgaaccccttcctggccgcccaccccacctgcccagcccctggcctgcacagcgagcccctgagccactgcaatgtgatgacctgctag

SEQ ID NO: 16075 - DNA, 1653 bp, Artificial Sequence
  Description of Artificial Sequence: Synthetic coding sequence
atggccgaggccagctttggcagcagcagccctgtgggcagcctgagcagcgaggaccatgactttgaccccacagctgagatgctggtgcatgactatgatgatgagaggaccctggaggaggaggagatgatggatgagggcaagaacttcagcagcgagattgaggacctggagaaggagggcaccatgcccctggaggacctgctggccttctacggctatgagcccaccatcccagctgtggccaacagcagcgccaacagcagccccagcgagctggctgatgagctgcctgacatgaccctggacaaggaggagatcgccaaggacctgctgtctggagatgatgaggagacccagagcagcgcagatgacctgacccccagcgtgaccagccatgagaccagtgacttcttcccccggcccctgcggagcaacacagcctgtgatggagacaaggagagcgaggtggaggatgtggagacagattctggcaacagccctgaggacctgaggaaggagatcatgattggcctgcagtaccaggccgagatccccccctacctgggggagtatgatggaaatgagaaggtgtatgaaaatgaagaccagctgctgtggtgcccagatgtggtgctggagagcaaggtgaaggagtacctggtggagaccagcctgaggactggaagtgagaagatcatggaccgcatctctgctggcacccacacccgggacaatgagcaggccctgtatgagctgctgaagtgcaaccacaacatcaaggaggccatcgagcgctactgctgcaatggcaaggccagccaggagggcatgacagcctggacagaggaggagtgccgcagctttgagcacgccctgatgctgtttgggaaggacttccacctgatccagaagaacaaggtgaggaccaggacagtggccgagtgtgtggccttctactacatgtggaagaagtcagaaagatatgactactttgcccagcagaccaggtttgggaagaagcgctacaaccaccaccctggggtgacagactacatggaccggctggtggatgaaacagaggccctgggcggcaccgtgaatgccagcgccctgaccagcaacagacctgagcccatcccagaccagcagctgaacatcctgaacagcttcaccgccagtgacctgacagccctgaccaacagcgtggccaccgtgtgtgaccccacagatgtgaactgcctggatgacagcttcccccccctgggcaacaccccccggggccaggtgaaccacgtgcctgtggtgacagaggagctgctgaccctgcccagcaatggagagagtgactgcttcaacctgtttgagaccggcttctaccacagcgagctgaaccccatgaacatgtgcagcgaggagagcgagaggcctgccaagaggctgaagatgggcattgctgtgcctgagagcttcatgaatgaggtgtctgtgaacaacctgggcgtggactttgagaaccacacccaccacatcaccagcgccaagatggctgtgtctgtggccgactttggcagcctgagcgccaatgagaccaacggcttcatcagcgcccacgccctgcaccagcacgccgccctgcacagcgagtag

SEQ ID NO: 16076 - DNA, 1650 bp, Artificial Sequence
  Description of Artificial Sequence: Synthetic coding sequence
atggccgaggccagctttggcagcagcagccctgtgggcagcctgagcagcgaggaccatgactttgaccccacagctgagatgctggtgcatgactatgatgatgagaggaccctggaggaggaggagatgatggatgagggcaagaacttcagcagcgagattgaggacctggagaaggagggcaccatgcccctggaggacctgctggccttctacggctatgagcccaccatcccagctgtggccaacagcagcgccaacagcagccccagcgagctggctgatgagctgcctgacatgaccctggacaaggaggagatcgccaaggacctgctgtctggagatgatgaggagacccagagcagcgcagatgacctgacccccagcgtgaccagccatgagaccagtgacttcttcccccggcccctgcggagcaacacagcctgtgatggagacaaggagagcgaggtggaggatgtggagacagattctggcaacagccctgaggacctgaggaaggagatcatgattggcctgcagtaccaggccgagatccccccctacctgggggagtatgatggaaatgagaaggtgtatgaaaatgaagaccagctgctgtggtgcccagatgtggtgctggagagcaaggtgaaggagtacctggtggagaccagcctgaggactggaagtgagaagatcatggaccgcatctctgctggcacccacacccgggacaatgagcaggccctgtatgagctgctgaagtgcaaccacaacatcaaggaggccatcgagcgctactgctgcaatggcaaggccagccagggcatgacagcctggacagaggaggagtgccgcagctttgaacatgccctgatgctgtttgggaaggacttccacctgatccagaagaacaaggtgaggaccaggacagtggctgaatgtgtggccttctactacatgtggaagaagtcagaaagatatgactactttgcccagcagaccaggtttgggaagaagcgctacaaccaccaccctggggtgacagactacatggaccggctggtggatgaaacagaggccctgggcggcaccgtgaatgccagcgccctgaccagcaacagacctgagcccatcccagaccagcagctgaacatcctgaacagcttcaccgccagtgacctgacagccctgaccaacagcgtggccaccgtgtgtgaccccacagatgtgaactgcctggatgacagcttcccccccctgggcaacaccccccggggccaggtgaaccacgtgcctgtggtgacagaggagctgctgaccctgcccagcaatggagagagtgactgcttcaacctgtttgaaacaggcttctaccacagcgagctgaaccccatgaacatgtgcagcgaggagagcgagaggcctgccaagaggctgaagatgggcattgctgtgcctgagagcttcatgaatgaggtgtctgtgaacaacctgggcgtggactttgagaaccacacccaccacatcaccagcgccaagatggctgtgtctgtggccgactttggcagcctgagcgccaatgagaccaacggcttcatcagcgcccacgccctgcaccagcacgccgccctgcacagcgagtag

SEQ ID NO: 16077 - DNA, 807 bp, Artificial Sequence
  Description of Artificial Sequence: Synthetic coding sequence
atggcccagcccctgtgcccccccctgtctgagagctggatgctgtctgctgcctggggccccacccggcggcccccacccagcgacaaggactgtggccgcagcctggtgagcagcccagacagctggggcagcaccccagctgacagccctgtggccagccctgcccggcccggcaccctgcgggacccccgggcccccagcgtgggcagaagaggagcccggagcagccggctgggcagcggccagaggcagagcgccagcgagcgggagaagctgaggatgaggaccctggcccgggccctgcacgagctgcggcgcttcctgccccccagcgtggccccagctggccagagcctgaccaagattgagaccctgcggctggccatccgctacatcggccacctgtctgctgtgctgggcctgtctgaggagagcctgcagaggcgctgccggcagagaggagatgctggcagcccccggggctgccccctgtgcccagatgactgcccagcccagatgcagaccaggacccaggccgagggccagggccagggccggggcctgggcctggtgtctgctgtgcgggccggggcctcctggggcagccccccagcctgccctggggcccgggccgcccctgagccccgggaccccccagccctgtttgctgaggccgcctgcccagagggccaggccatggagcccagcccccccagccccctgctgcctggagatgtgctggccctgctggagacctggatgcccctgagccccctggagtggctgcctgaggagcccaagtag

SEQ ID NO: 16078 - DNA, 2007 bp, Artificial Sequence
  Description of Artificial Sequence: Synthetic coding sequence
atggccgccaacatgtacagagtgggggactatgtgtactttgagaacagcagcagcaacccctacctggtgagaagaattgaggagctgaacaagacagccaatggaaatgtggaggccaaggtggtgtgcctcttcagaagaagagacatcagcagcagcctgaacagcctggccgacagcaatgcccgggagtttgaggaggagagcaagcagcccggggtgtctgagcagcagaggcaccagctgaagcaccgggagctgttcctgagccggcagtttgagagcctgcctgccacccacatccggggcaaatgttctgtgaccctgctgaatgaaacagacatcctgagccagtacctggagaaggaggactgcttcttctacagcctggtgtttgatcctgtgcagaagaccctgctggccgaccagggcgagatccgggtgggctgcaagtaccaggccgagatcccagaccggctggtggagggggagagtgacaacagaaaccagcagaagatggagatgaaggtgtgggaccctgacaaccccctgacagaccggcagattgaccagttcctggtggtggcccgggctgtgggcacctttgcccgggccctggactgcagcagcagcatccggcagcccagcctgcacatgtctgctgctgctgccagccgggacatcaccctcttccacgccatggacaccctgcagagaaatggctatgacctggccaaggccatgagcaccctggtgccccagggcggccctgtgctgtgcagagatgagatggaggagtggagcgccagcgaggccatgctgtttgaggaggccctggagaagtatggcaaggacttcaatgacatccggcaggacttcctgccctggaagagcctggccagcatcgtgcagttctactacatgtggaagaccacagaccgctacatccagcagaagaggctgaaggctgctgaggccgacagcaagctgaagcaggtgtacatccccacctacaccaagcccaaccccaaccagatcatctctgtgggcagcaagccaggcatgaatggagctggcttccagaagggcctgacctgtgagagctgccacaccacccagagcgcccagtggtacgcctggggcccccccaacatgcagtgccgcctgtgtgccagctgctggatctactggaagaagtatggaggcctgaagacccccacccagctggagggcgccacccggggcaccacagagccccacagccggggccacctgagcaggcctgaggcccagagcctgagcccctacaccaccagcgccaacagagccaagctgctggccaagaaccggcagaccttcctgctgcagaccaccaagctgacccggctggcccggaggatgtgccgggacctgctgcagccccggcgggccgcccggcggccctatgcccccatcaatgccaatgccatcaaggccgagtgcagcatccggctgcccaaggccgccaagacccccctgaagatccaccccctggtgcggctgcccctggccaccatcgtgaaggacctggtggcccaggcccccctgaagcccaagaccccccggggcaccaagacccccatcaacagaaaccagctgagccagaacagaggcctgggcggcatcatggtgaagagggcctatgagaccatggccggggccggcgtgcccttcagcgccaacggccggcccctggccagcggcatccgcagcagcagccagcctgctgccaagaggcagaagctgaacccagcagatgcccccaaccctgtggtgtttgtggccaccaaggacacccgggccctgaggaaggccctgacccacctggagatgaggcgggccgcccggcggcccaacctgcccctgaaggtgaagcccaccctgattgctgtgcggccccctgtgcccctgcctgcccccagccacccagccagcaccaatgagcccatcgtgctggaggactag

SEQ ID NO: 16079 - DNA, 1488 bp, Artificial Sequence
  Description of Artificial Sequence: Synthetic coding sequence
atggagatgaaggtgtgggaccctgacaaccccctgacagaccggcagattgaccagttcctggtggtggcccgggctgtgggcacctttgcccgggccctggactgcagcagcagcatccggcagcccagcctgcacatgtctgctgctgctgccagccgggacatcaccctcttccacgccatggacaccctgcagagaaatggctatgacctggccaaggccatgagcaccctggtgccccagggcggccctgtgctgtgcagagatgagatggaggagtggagcgccagcgaggccatgctgtttgaggaggccctggagaagtatggcaaggacttcaatgacatccggcaggacttcctgccctggaagagcctggccagcatcgtgcagttctactacatgtggaagaccacagaccgctacatccagcagaagaggctgaaggctgctgaggccgacagcaagctgaagcaggtgtacatccccacctacaccaagcccaaccccaaccagatcatctctgtgggcagcaagccaggcatgaatggagctggcttccagaagggcctgacctgtgagagctgccacaccacccagagcgcccagtggtacgcctggggcccccccaacatgcagtgccgcctgtgtgccagctgctggatctactggaagaagtatggaggcctgaagacccccacccagctggagggcgccacccggggcaccacagagccccacagccggggccacctgagcaggcctgaggcccagagcctgagcccctacaccaccagcgccaacagagccaagctgctggccaagaaccggcagaccttcctgctgcagaccaccaagctgacccggctggcccggaggatgtgccgggacctgctgcagcccaggagagctgcccggcggccctatgcccccatcaatgccaatgccatcaaggcagaatgttccatccggctgcccaaggccgccaagacccccctgaagatccaccccctggtgcggctgcccctggccaccatcgtgaaggacctggtggcccaggcccccctgaagcccaagaccccccggggcaccaagacccccatcaacagaaaccagctgagccagaacagaggcctgggcggcatcatggtgaagagggcctatgagaccatggccggggccggcgtgcccttcagcgccaacggccggcccctggccagcggcatccgcagcagcagccagcctgctgccaagaggcagaagctgaacccagcagatgcccccaaccctgtggtgtttgtggccaccaaggacacccgggccctgaggaaggccctgacccacctggagatgagaagagctgcccggcggcccaacctgcccctgaaggtgaagcccaccctgattgctgtgcggccccctgtgcccctgcctgcccccagccacccagccagcaccaatgagcccatcgtgctggaggactag

SEQ ID NO: 16080 - DNA, 1488 bp, Artificial Sequence; identical to SEQ ID NO: 16079
  Description of Artificial Sequence: Synthetic coding sequence

SEQ ID NO: 16081 - DNA, 1761 bp, Artificial Sequence
  Description of Artificial Sequence: Synthetic coding sequence
atggccgccaacatgtacagagtgggggactatgtgtactttgagaacagcagcagcaacccctacctgatcagaagaattgaggagctgaacaagacagccagcggaaatgtggaggccaaggtggtgtgcttctacagaagaagagacatcagcaacaccctcatcatgctggccgacaagcacgccaaggagattgaggaggagagcgagaccaccgtggaggccgacctgacagacaagcagaagcaccagctgaagcaccgggagctgttcctgagccggcagtatgagagcctgcctgccacccacatccggggcaagtgcagcgtggccctgctgaatgaaacagaatctgtgctgagctacctggacaaggaggacaccttcttctacagcctggtgtatgaccccagcctgaagaccctgctggccgacaagggggagatccgggtgggcccccgctaccaggccgacatccctgagatgctgctggagggggagagtgatgagcgggagcagagcaagctggaggtgaaggtgtgggaccccaacagccccctgacagaccggcagattgaccagttcctggtggtggcccgggctgtgggcacctttgcccgggccctggactgcagcagctctgtgcggcagcccagcctgcacatgtctgctgctgctgccagccgggacatcaccctcttccacgccatggacaccctgtaccgccacagctatgacctgagcagcgccatctctgtgctggtgcccctgggcggccctgtgctgtgcagagatgagatggaggagtggagcgccagcgaggccagcctgtttgaggaggccctggagaagtatggcaaggacttcaatgacatccggcaggacttcctgccctggaagagcctgaccagcatcatcgagtactactacatgtggaagaccacagacagatatgtgcagcagaagaggctgaaggctgctgaggccgagagcaagctgaagcaggtgtacatccccacctacagcaagcccaaccccaaccagatcagcaccagcaatggcaagccaggagctgtgaatggagctgtgggcaccaccttccagccccagaaccccctgctgggccgggcctgtgagagctgctacgccacccagagccaccagtggtacagctggggcccccccaacatgcagtgccgcctgtgtgccatctgctggctgtactggaagaagtatggaggcctgaagatgcccacccagagcgaggaggagaagctgagccccagccccaccacagaggacccccgggtgcgcagccacgtgtcccggcaggccatgcagggcatgcctgtgaggaacacaggcagccccaagtctgctgtgaagacccggcaggccttcttcctgcacaccacctacttcaccaagtttgcccggcaggtgtgcaagaacaccctgcggctgcggcaggccgcccggcggccctttgtggccatcaactatgctgccatccgggcagaatatgctgacagacatgctgagctgagcggcagccccctgaagagcaagagcaccaggaagcccctggcctgcatcatcggctacctggagatccacccagccaagaagcccaacgtcatccgcagcacccccagcctgcagacccccaccaccaagaggatgctgaccacccccaaccacaccagcctgagcatcctgggcaagaggaactacagccaccacaacggcctggactag

SEQ ID NO: 16082 - DNA, 1785 bp, Artificial Sequence
  Description of Artificial Sequence: Synthetic coding sequence
atggccgccaacatgtacagagtgggggactatgtgtactttgagaacagcagcagcaacccctacctgatcagaagaattgaggagctgaacaagacagccagcggaaatgtggaggccaaggtggtgtgcttctacagaagaagagacatcagcaacaccctcatcatgctggccgacaagcacgccaaggagattgaggaggagagcgagaccaccgtggaggccgacctgacagacaagcagaagcaccagctgaagcaccgggagctgttcctgagccggcagtatgagagcctgcctgccacccacatccggggcaagtgcagcgtggccctgctgaatgaaacagaatctgtgctgagctacctggacaaggaggacaccttcttctacagcctggtgtatgaccccagcctgaagaccctgctggccgacaagggggagatccgggtgggcccccgctaccaggccgacatccctgagatgctgctggagggggagagtgatgagcgggagcagagcaagctggaggtgaaggtgtgggaccccaacagccccctgacagaccggcagattgaccagttcctggtggtggcccgggctgtgggcacctttgcccgggccctggactgcagcagctctgtgcggcagcccagcctgcacatgtctgctgctgctgccagccgggacatcaccctcttccacgccatggacaccctgtaccgccacagctatgacctgagcagcgccatctctgtgctggtgcccctgggcggccctgtgctgtgcagagatgagatggaggagtggagcgccagcgaggccagcctgtttgaggaggccctggagaagtatggcaaggacttcaatgacatccggcaggacttcctgccctggaagagcctgaccagcatcatcgagtactactacatgtggaagaccacagacagatatgtgcagcagaagaggctgaaggctgctgaggccgagagcaagctgaagcaggtgtacatccccacctacagcaagcccaaccccaaccagatcagcaccagcaatggcaagccaggagctgtgaatggagctgtgggcaccaccttccagccccagaaccccctgctgggccgggcctgtgagagctgctacgccacccagagccaccagtggtacagctggggcccccccaacatgcagtgccgcctgtgtgccatctgctggctgtactggaagaagtatggaggcctgaagatgcccacccagagcgaggaggagaagctgagccccagccccaccacagaggacccccgggtgcgcagccacgtgtcccggcaggccatgcagggcatgcctgtgaggaacacaggcagccccaagtctgctgtgaagacccggcaggccttcttcctgcacaccacctacttcaccaagtttgcccggcaggtgtgcaagaacaccctgcggctgcggcaggccgcccggcggccctttgtggccatcaactatgctgccatccgggcagaatatgctgacagacatgctgagctgagcggcagccccctgaagagcaagagcaccaggaagcccctggcctgcatcatcggctacctggagatccacccagccaagaagcccaacgtcatccgcagcacccccagcctgcagacccccaccaccaagaggatgctgaccacccccaaccacaccagcctgagcatcctgggcaagaggaactacagccaccacaacggcctggatgagctgacctgctgcgtgtctgactag

SEQ ID NO: 16083 - DNA, 1548 bp, Artificial Sequence
  Description of Artificial Sequence: Synthetic coding sequence
atggccgccaacatgtacagagtgggggactatgtgtactttgagaacagcagcagcaacccctacctgatcagaagaattgaggagctgaacaagacagccagcggaaatgtggaggccaaggtggtgtgcttctacagaagaagagacatcagcaacaccctcatcatgctggccgacaagcacgccaaggagattgaggaggagagcgagaccaccgtggaggccgacctgacagacaagcagaagcaccagctgaagcaccgggagctgttcctgagccggcagtatgagagcctgcctgccacccacatccggggcaagtgcagcgtggccctgctgaatgaaacagaatctgtgctgagctacctggacaaggaggacaccttcttctacagcctggtgtatgaccccagcctgaagaccctgctggccgacaagggggagatccgggtgggcccccgctaccaggccgacatccctgagatgctgctggagggggagagtgatgagcgggagcagagcaagctggaggtgaaggtgtgggaccccaacagccccctgacagaccggcagattgaccagttcctggtggtggcccgggctgtgggcacctttgcccgggccctggactgcagcagctctgtgcggcagcccagcctgcacatgtctgctgctgctgccagccgggacatcaccctcttccacgccatggacaccctgtaccgccacagctatgacctgagcagcgccatctctgtgctggtgcccctgggcggccctgtgctgtgcagagatgagatggaggagtggagcgccagcgaggccagcctgtttgaggaggccctggagaagtatggcaaggacttcaatgacatccggcaggacttcctgccctggaagagcctgaccagcatcatcgagtactactacatgtggaagaccacagacagatatgtgcagcagaagaggctgaaggctgctgaggccgagagcaagctgaagcaggtgtacatccccacctacagcaagcccaaccccaaccagatcagcaccagcaatggcaagccaggagctgtgaatggagctgtgggcaccaccttccagccccagaaccccctgctgggccgggcctgtgagagctgctacgccacccagagccaccagtggtacagctggggcccccccaacatgcagtgccgcctgtgtgccatctgctggctgtactggaagaagtatggaggcctgaagatgcccacccagagcgaggaggagaagctgagccccagccccaccacagaggacccccgggtgcgcagccacgtgtcccggcaggccatgcagggcatgcctgtgaggaacacaggcagccccaagtctgctgtgaagacccggcaggccttcttcctgcacaccacctacttcaccaagtttgcccggcaggtgtgcaagaacaccctgcggctgcggcaggccgcccggcggccctttgtggccatcaactatgctgccatccgggcagagtgcaagatgctgctgaacagctag

SEQ ID NO: 16084 - DNA, 585 bp, Artificial Sequence
  Description of Artificial Sequence: Synthetic coding sequence
atggccaagagcagccagaggaagcagagggactgtgtgaaccagtgcaagagcaagccaggcctgagcaccagcatccccctgaggatgagcagctacaccttcaagaggcctgtgacccgcatcaccccccaccctggaaatgaggtgcgctaccaccagtgggaggagagcctggagaagccccagcaggtgtgctggcagaggcggctgcagggcctgcaggcctacagcagcgctggggagctgagcagcaccctggacctggccaacaccctgcagaagctggtgcccagctacacaggaggcagcctgctggaggacctggccagcggcctggagcacagctgccccatgccccacctggcctgcagcagtgatgctgtggagatcatcccagctgagggcgtgggcatcagccagctgctgtgcaagcagttcctggtgacagaggaggacatcaggaagcaggagggcaaggtgaagacagtgcgggagcggctggccatcgccctgattgctgatggcctggccaatgaagctgagaaggtgcgggaccaggagggccggcctgagaagaggtag

SEQ ID NO: 16085 - DNA, 1245 bp, Artificial Sequence
  Description of Artificial Sequence: Synthetic coding sequence
atgctgggcgccctgcccctgcccctgagcctgggccagcccccacccagccccctgctgaaccacagcctgtttggagtgctgactggaggcggcggccagcccccacctgagcccctgctgcccccacctgggggccctggcccccccctggcccctggagagcctgagggccccagcctgctggtggccagcctgctgcccccaccacccagcgacctgctgcccccaccttctgccccacccagcaacctgctggccagcttcctgcccctgctggccctgggccccacagctggagatggagagggcagcgctgagggcgccggcggccccagcggggagcccttcagcggcctgggggacctgagccccctgctcttcccccccctgagcgccccacccaccctcatcgccctgaacagcgccctgctggccgccaccctggaccccccatctggcaccccaccccagccctgtgtgctgagcgccccccagcccggcccccccaccagctctgtgaccacagccaccacagatcctggggccagcagcctgggcaaggcccccagcaacagcggccggcccccccagctgctgagccccctgctgggcgccagcctgctgggggacctgagcagcctgaccagcagccctggggccctgcccagcctgctgcagcccccaggccccctgctgagcggccagctgggcctgcagctgctgcccggcggcggggcccccccacccctgtctgaggccagcagccccctggcctgcctgctgcagagcctgcagatccccccagagcagcctgaggccccctgcctgcccccagagagccctgccagcgccctggagcctgagcccgcccggccccccctgagcgccctggccccaccccacggcagcccagacccccctgtgcctgagctgctgaccggccggggcagcggcaagagaggaagaagaggaggcggcggcctgcggggcatcaatggagaggcccggcctgcccggggcaggaagccaggcagcagaagagagcccggccgcctggccctgaagtggggcacccggggcggcttcaacggccagatggagcggcaggaggagcccaccatcggcagcatcatgggctcctggctgaagggcgtgctgagcccccgcatccaccccctgcccggccccatcctgcggaccctgcgctgccccagcagccagaaggtgtcctcctggccctag

SEQ ID NO: 16086 - DNA, 3012 bp, Artificial Sequence
  Description of Artificial Sequence: Synthetic coding sequence
atgaatggaggaaatgaaagcagcggggctgacagagctgggggccctgtggccacctctgtgcccatcggctggcagagatgtgtgcgggagggcgctgtgctgtacatcagccccagcggcacagagctgagcagcctggagcagaccaggagctacctgctgagtgatggcacctgcaagtgtggcctggagtgccccctgaatgtgcccaaggtgttcaactttgaccccctggcccctgtgacccctgggggcgccggcgtgggccctgccagcgaggaggacatgaccaagctgtgcaaccacaggaggaaggctgtggccatggccaccctgtaccgctccatggagaccacctgcagccacagcagccctggagagggcgccagcccccagatgttccacacagtgtccccaggcccccccagcgcccggcccccctgccgggtgccccccaccacccccctgaatggaggccctggcagcctgcccccagagccccccagcgtgtcccaggccttccccaccctggccggccctgggggcctcttccccccccggctggccgaccctgtgcccagcggcggcagcagcagcccccgcttcctgcccagaggaaatgcccccagccctgcccctcctcctcctccagccatcagcctgaatgcccccagctacaactggggcgccgccctgcggagcagcctggtgcccagcgacctgggcagccccccagcccctcatgccagcagcagcccccccagcgaccccccactcttccactgcagtgatgccctgaccccaccacccctgccccccagcaacaacctgcctgcccaccctggccctgccagccagccccctgtgagcagcgccaccatgcacctgcccctggtgctgggccccctgggcggggcccccaccgtggagggccctggggccccacccttcctggccagcagcctgctgtctgctgctgccaaggcccagcacccccccctgcccccacccagcaccctgcagggccggcggccccgggcccaggcccccagcgccagccacagcagcagcctgcggcccagccagaggcggccccggcggcccccaacagtgttccggctgctggagggccggggcccccagaccccaagaagaagccggccccgggccccagcccctgtgccccagcccttcagcctgcctgagcccagccagcccatcctgcccagcgtgctgagcctgctgggcctgcccaccccaggccccagccacagtgatggcagcttcaacctgctgggcagtgatgcccacctgcccccaccacccaccctgagcagcggcagccccccccagcccaggcaccccatccagcccagcctgcccggcaccaccagcggcagcctgagctctgtgcctggggccccagcccccccagctgccagcaaggcccctgtggtgcccagccctgtgctgcagagccccagcgagggcctgggcatgggcgccggccctgcctgccccctgccccccctggccggcggggaggccttccccttccccagccctgagcagggcctggccctgagcggggccggcttccctggcatgctgggcgccctgcccctgcccctgagcctgggccagcccccacccagccccctgctgaaccacagcctgtttggagtgctgactggaggcggcggccagcccccacctgagcccctgctgcccccacctgggggccctggcccccccctggcccctggagagcctgagggccccagcctgctggtggccagcctgctgcccccaccacccagcgacctgctgcccccaccttctgccccacccagcaacctgctggccagcttcctgcccctgctggccctgggccccacagctggagatggagagggcagcgctgagggcgccggcggccccagcggggagcccttcagcggcctgggggacctgagccccctgctcttcccccccctgagcgccccacccaccctcatcgccctgaacagcgccctgctggccgccaccctggaccccccatctggcaccccaccccagccctgtgtgctgagcgccccccagcccggcccccccaccagctctgtgaccacagccaccacagatcctggggccagcagcctgggcaaggcccccagcaacagcggccggcccccccagctgctgagccccctgctgggcgccagcctgctgggggacctgagcagcctgaccagcagccctggggccctgcccagcctgctgcagcccccaggccccctgctgagcggccagctgggcctgcagctgctgcccggcggcggggcccccccacccctgtctgaggccagcagccccctggcctgcctgctgcagagcctgcagatccccccagagcagcctgaggccccctgcctgcccccagagagccctgccagcgccctggagcctgagcccgcccggccccccctgagcgccctggccccaccccacggcagcccagacccccctgtgcctgagctgctgaccggccggggcagcggcaagagaggaagaagaggaggcggcggcctgcggggcatcaatggagaggcccggcctgcccggggcaggaagccaggcagcagaagagagcccggccgcctggccctgaagtggggcacccggggcggcttcaacggccagatggagaggagccccaggaggacccaccactggcagcacaacggggagctggccgagggcggcgctgagcccaaggaccccccacctcctggcccccacagcgaggacctgaaggtgcccccaggagtggtgaggaagagccggcggggcagaagaaggaagtacaaccccaccaggaacagcaacagcagccggcaggacatcaccctggagcccagccccacagcccgggctgctgtgcccctgcccccccgggcccggcccggccgcccagccaagaacaagaggaggaagctggccccctag

SEQ ID NO: 16087 - DNA, 3012 bp, Artificial Sequence; identical to SEQ ID NO: 16086
  Description of Artificial Sequence: Synthetic coding sequence

SEQ ID NO: 16088 - DNA, 162 bp, Artificial Sequence
  Description of Artificial Sequence: Synthetic coding sequence
atgaatggaggaaatgaaagcagcggggctgacagagctgggggccctgtggccacctctgtgcccatcggctggcagagatgtgtgcgggagggcgctgtgctgtacatcagccccagcggcacagagctgagcagcctggagcagaccaggagctactag

SEQ ID NO: 16089 - DNA, 222 bp, Artificial Sequence
  Description of Artificial Sequence: Synthetic coding sequence
atgaatggaggaaatgaaagcagcggggctgacagagctgggggccctgtggccacctctgtgcccatcggctggcagagatgtgtgcgggagggcgctgtgctgtacatcagccccagcggcacagagctgagcagcctggagcagaccaggagctacctgctgagtgatggcacctgcaagtgtggcctggagtgccccctgaatgtgcccaaggtgtag

SEQ ID NO: 16090 - DNA, 447 bp, Artificial Sequence
  Description of Artificial Sequence: Synthetic coding sequence
atgaatggaggaaatgaaagcagcggggctgacagagctgggggccctgtggccacctctgtgcccatcggctggcagagatgtgtgcgggagggcgctgtgctgtacatcagccccagcggcacagagctgagcagcctggagcagaccaggagctacctgctgagtgatggcacctgcaagtgtggcctggagtgccccctgaatgtgcccaaggtgttcaactttgaccccctggcccctgtgacccctgggggcgccggcgtgggccctgccagcgaggaggacatgaccaagctgtgcaaccacaggaggaaggctgtggccatggccaccctgtaccgctccatggagaccacctgcagccacagcagccctggagagggcgccagcccccagatgttccacacagtgtccccaggcccccccagcgcccggcccccatag

SEQ ID NO: 16091 - DNA, 162 bp, Artificial Sequence; identical to SEQ ID NO: 16088
  Description of Artificial Sequence: Synthetic coding sequence

SEQ ID NO: 16092 - DNA, 138 bp, Artificial Sequence
  Description of Artificial Sequence: Synthetic coding sequence
atgaatggaggaaatgaaagcagcggggctgacagagctgggggccctgtggccacctctgtgcccatcggctggcagagatgtgtgcgggagggcgctgtgctgtacatcagccccagcggcacagagctgtcctag

SEQ ID NO: 16093 - DNA, 672 bp, Artificial Sequence
  Description of Artificial Sequence: Synthetic coding sequence
atgaccagcgaggtgattgaagatgagaagcagttctacagcaaggccaagacctactggaagcagatcccccccaccgtggatggcatgctgggcggctacggccacatcagcagcattgacatcaacagcagcaggaagttcctgcagcgcttcctgcgggagggccccaacaagacaggcaccagctgtgccctggactgtggggccggcatcggccgcatcaccaagaggctgctgctgcccctcttccgggaggtggacatggtggacatcacagaggacttcctggtgcaggccaagacctacctgggggaggagggcaagagggtgaggaactacttctgctgcggcctgcaggacttcaccccagagccagacagctatgatgtgatctggatccagtgggtgattggccacctgacagaccagcacctggccgagttcctgcggcgctgcaagggcagcctgcggcccaacggcatcatcgtcatcaaggacaacatggcccaggagggcgtcatcctggatgatgtggacagctctgtgtgccgggacctggatgtggtgcggcgcatcatctgcagcgctggcctgagcctgctggccgaggagcggcaggagaacctgcctgatgagatctaccacgtgtacagctttgccctgaggtag

SEQ ID NO: 16094 - DNA, 438 bp, Artificial Sequence
  Description of Artificial Sequence: Synthetic coding sequence
atgaccagcgaggtgattgaagatgagaagcagttctacagcaaggccaagacctactggaagcagatcccccccaccgtggatggcatgctgggcggctacggccacatcagcagcattgacatcaacagcagcaggaagttcctgcagcgcttcctgcgggagggccccaacaagacaggcaccagctgtgccctggactgtggggccggcatcggccgcatcaccaagaggctgctgctgcccctcttccgggaggtggacatggtggacatcacagaggacttcctggtgcaggccaagacctacctgggggaggagggcaagagggccaccagccccatcagcacctggcccagcagctgtggggccgcccgggccgccagcgcccccacagccagcagcagcagcaagaccacctggccccggcgggcctag

SEQ ID NO: 16095 - DNA, 672 bp, Artificial Sequence; identical to SEQ ID NO: 16093
  Description of Artificial Sequence: Synthetic coding sequence

SEQ ID NO: 16096 - DNA, 672 bp, Artificial Sequence; identical to SEQ ID NO: 16093
  Description of Artificial Sequence: Synthetic coding sequence

SEQ ID NO: 16097 - DNA, 1371 bp, Artificial Sequence
  Description of Artificial Sequence: Synthetic coding sequence
atggacagccggctgcaggagatccgggagcggcagaagctgcggcggcagctgctggcccagcagctgggcgctgagagcgctgacagcattggagctgtgctgaacagcaaggatgagcagcgggagattgctgagacccgggagacctgccgggccagctatgacaccagcgccccaaatgccaagaggaagtacctggatgaaggagaaacagatgaggacaagatggaggagtacaaggatgagctggagatgcagcaggatgaggagaacctgccctatgaggaggagatctacaaggacagcagcaccttcctgaagggcacccagagcctgaacccccacaatgactactgccagcactttgtggacaccggccaccggccccagaacttcatcagagatgtgggcctggccgacagatttgaggagtaccccaagctgcgggagctgatccggctgaaggatgagctgattgccaagagcaacaccccacccatgtacctgcaggccgacatcgaggcctttgacatccgggagctgacccccaagtttgatgtgatcctgctggagccccccctggaggagtactaccgggagaccggcatcacagccaatgagaagtgctggacctgggatgacatcatgaagctggagattgatgaaattgctgcccccaggagcttcatcttcctgtggtgtggcagcggggagggcctggacctgggccgggtgtgcctgaggaagtggggctaccgccgctgtgaggacatctgctggatcaagaccaacaagaacaaccctgggaagaccaagaccctggaccccaaggctgtgttccagaggaccaaggagcactgcctgatgggcatcaagggcaccgtgaagaggagcacagatggagacttcatccacgccaacgtggacatcgacctgatcatcacagaggagcctgagatcggcaacatcgagaagcctgtggagatcttccacatcatcgagcacttctgcctgggcagaagaaggctgcacctgtttggccgggacagcaccatccggcccggctggctgactgtgggccccaccctgaccaacagcaactacaatgctgagacctacgccagctacttcagcgcccccaacagctacctgaccggctgcacagaggagattgaaaggctgcggcccaagagccccccacccaagagcaagagtgacagaggaggaggagccccccggggcggcggccggggcggcaccagcgctggccggggccgggagaggaacagaagcaacttccggggggagcggggcggcttccggggcggccggggcggggcccacagaggaggcttcccccccaggtag

SEQ ID NO: 16098 - DNA, 3399 bp, Artificial Sequence
  Description of Artificial Sequence: Synthetic coding sequence
atgattgccacccccctgaagcacagccgcatctacctgcccccagaggccagcagccagaggaggaacctgcccatggatgccatcttctttgacagcatccccagcggcaccctgacccctgtgaaggacctggtgaagtaccagaacagcagcctgaagctgaatgaccacaagaagaaccagttcctgaagatgaccaccttcaacaacaagaacatcttccagagcaccatgctgacagaggccaccaccagcaacagcagcctggacatcagcgccatcaagcccaacaaggatggcctgaagaacaaggccaactatgagagccctgggaagatcttcctgaggatgaaggagaaggtgctgcgggacaagcaggagcagcccagcaggaacagcagcctgctggagccccagaagagcggcaacaatgagaccttcacccccaacagagtggagaagaagaagctgcagcacacctacctgtgtgaggagaaggagaacaacaagagcttccagagtgatgacagcagcctgcgggcctctgtgcagggcgtgcccctggagagcagcaacaatgacatcttcctgcctgtgaagcagaagatccagtgccagcaggagaagaaggcccccctgcacaacctgacctatgagctgcccaccctgaaccaggagcaggagaacttcctggccgtggaggccaggaacaagaccctgacccgggcccagctggccaagcagatcttccacagcaaggagagcatcgtggccaccaccaagagcaagaaggacacctttgtgctggagagcgtggacagcgcagatgagcagttccagaacaccaatgctgagaccctgagcaccaactgcatccccatcaagaatggcagcctgctgatggtgtctgacagcgagaggaccacagagggcaccagccagcagaaggtgaaggagggcaatggcaagacagtgcctggagagaccggcctgcccggctccatgaaggacacctgcaagatcgtgctggccaccccccggctgcacatcaccatccccaggaggagcaagaggaacatcagcaagctgagccccccacgcatcttccagacagtgaccaacggcctgaagaagaaccaggtggtgcagctgcaggagtggatgatcaagagcatcaacaacaacacagccatctgtgtggagggcaagctgattgatgtgaccaacatctactggcacagcaatgtcatcatcgagcgcatcgagcacaacaagctgcggaccatctctggaaatgtgtacatcctgaagggcatgattgaccagatctccatgaaggaggccggctaccccaactacctgatcaggaagttcatgtttggcttccctgagaactggaaggagcacatcgacaacttcctggagcagctgcgggccggggagaagaaccgggagaagaccaagcagaagcagaagacaggccgctctgtgcgggacatcaggaagtccatgaagaatgatgcccgggagaaccagacagacacagcccagagggccaccaccacctatgactttgactgtgacaacctggagctgaagagcaacaagcacagcgagagccctggggccacagagctgaacatgtgccacagcaactgccagaacaagcccaccctgcgcttcccagatgaccaggtgaacaacaccatccagaatggaggaggagatgacctgagcaaccaggagctgattggcaagaaggagtacaagatgagcagcaagaagctgaagattggagagaggaccaatgaaagaatcatcaagagccagaagcaggagaccacagaggagctggatgtgtccattgacatcctgaccagccgggagcagttcttcagtgatgaggagaggaagtacatggccatcaaccagaagaaggcctacatcctggtgacccccctgaagagcaggaaggtgattgagcagcgctgcatgagatacaacctgtctgctggcaccatcaaggctgtgacagactttgtgattcctgagtgccagaagaagagccccatcagcaagtccatgggcaccctggagaacacctttgagggccacaagagcaagaacaaggaggactgtgatgagcgggacctgctgactgtgaacaggaagatcaagatcagcaacctggagaaggagcagatgctgaccagtgacttcaagaagaacacccggctgctgcccaagctgaagaagattgagaaccaggtggccatgtccttctacaagcaccagagcagcccagacctgagcagcgaggagagcgagacagagaaggagatcaagaggaaggccgaggtgaagaagaccaaggccggcaacaccaaggaggccgtggtgcacctgaggaagagcaccaggaacaccagcaacatccctgtgatcctggagcctgagacagaggagagtgaaaatgagttctacatcaagcagaagaaggcccggcccagcgtgaaggagaccctgcagaagagcggcgtgaggaaggagttccccatcacagaagctgtgggcagtgacaagaccaacagacaccccctggagtgcctgcccggcctcatccaggacaaggagtggaatgagaaggagctgcagaagctgcactgtgcctttgccagcctgcccaagcacaagccaggcttctggagcgaggtggccgctgctgtgggcagccgcagccctgaggagtgccagaggaagtacatggagaacccccggggcaagggcagccagaagcacgtgaccaagaagaagccagccaacagcaagggccagaatggcaagagaggagatgctgaccagaagcagaccatcaagatcacagccaaggtgggcaccctgaagaggaagcagcagatgagggagttcctggagcagctgcccaaggatgaccatgatgacttcttcagcaccacccccctgcagcaccagaggatcctgctgcccagcttccaggacagtgaagatgatgatgacatcctgcccaacatggacaagaaccccaccacccccagcagcgtcatcttccccctggtgaagaccccccagtgccagcacgtgtccccaggcatgctgggcagcatcaacagaaatgactgtgacaagtatgtgttcaggatgcagaagtaccacaagagcaatggaggcatcgtgtggggcaacatcaagaagaagctggtggagacagacttcagcacccccacccccaggaggaagacccccttcaacacagacctgggggagaacagcggcatcggcaagctgttcaccaatgctgtggagagcctggatgaggaggagaaggactactacttcagcaacagcgacagcgcctag

SEQ ID NO: 16099 - DNA, 468 bp, Artificial Sequence
  Description of Artificial Sequence: Synthetic coding sequence
atgattgccacccccctgaagcacagccgcatctacctgcccccagaggccagcagccagaggaggaacctgcccatggatgccatcttctttgacagcatccccagcggcaccctgacccctgtgaaggacctggtgaagtaccagaacagcagcctgaagctgaatgaccacaagaagaaccagttcctgaagatgaccaccttcaacaacaagaacatcttccagagcaccatgctgacagaggccaccaccagcaacagcagcctggacatcagcgccatcaagcccaacaaggatggcctgaagaacaaggccaactatgagagccctgggaagatcttcctgaggatgaaggagaaggtgctgcgggacaagcaggagcagcccagcaggaacagcagcctgctggagccccagaagagcggcaacaatgagaccttcacccccaacagagtggagaagtag

SEQ ID NO: 16100 - DNA, 702 bp, Artificial Sequence
  Description of Artificial Sequence: Synthetic coding sequence
atggccggcgtgcgcagcctgcgctgcagccggggctgtgccggcggctgtgaatgtggggacaagggcaagtgcagcgacagcagcctgctgggcaagaggctgtctgaggacagcagccgccaccagctgctgcagaagtgggcctccatgtggagctccatgtctgaagatgcctctgtggccgacatggagcgggcccagctggaggaggaggccgctgctgctgaggagcggcccctggtgttcctgtgcagcggctgcagaagacccctgggggacagcctgtcctgggtggccagccaggaggacaccaactgcatcctgctgcgctgtgtgtcctgcaatgtgtctgtggacaaggagcagaagctgagcaagcgggagaaggaaaatggctgtgtgctggagaccctgtgctgtgccggctgcagcctgaacctgggctacgtgtaccgctgcacccccaagaacctggactacaagagggacctcttctgcctgtctgtggaggccatcgagagctatgtgctgggcagcagcgagaagcagatcgtgtctgaggacaaggagctgttcaacctggagagccgggtggagattgagaagagcctgacccagatggaggatgtgctgaaggccctgcagatgaagctgtgggaggccgagagcaagctgagctttgccacctgcaagagctag

SEQ ID NO: 16101 - DNA, 3150 bp, Artificial Sequence
  Description of Artificial Sequence: Synthetic coding sequence
atggaccacactggagccatcgacacagaagatgaggtgggccccctggcccacctggcccccagcccccagagcgaggccgtggcccacgagttccaggagctgagcctgcagagcagccagaacctgccccccctgaatgaaaggaagaatgtgctgcagctgcggctgcagcagaggaggacccgggagcagctggtggaccagggcatcatgccacccctgaagagccctgctgccttccacgagcagatcaagagcctggagcgggccaggacagagaacttcctgaagcacaagatccgcagcaggccagacagaagtgagctggtgaggatgcacatcctggaggagacctttgctgagcccagcctgcaggccacccagatgaagctgaagagggcccggctggctgatgacctgaatgagaagatcgcccagaggcctggccccatggagctggtggagaagaacatcctgcctgtggacagctctgtgaaggaggccatcattggagtgggcaaggaggactacccccacacccagggcgacttctcctttgatgaggacagcagtgatgccctgagcccagaccagcctgccagccaggagagccagggcagcgctgccagccccagcgagcccaaggtgtctgagagccccagccctgtgaccaccaacaccccagcccagtttgcctctgtgagccccaccgtgcctgagttcctgaagaccccacccacagctgaccagcccccacccaggcctgctgcccctgtgctgcccaccaacacagtgagcagcgccaagccaggccctgccctggtgaagcagagccaccccaagaaccccaatgacaagcacaggagcaagaagtgcaaggaccccaagccccgggtgaagaagctgaagtaccaccagtacatccccccagaccagaagggggagaagaatgagccccagatggacagcaactatgcccggctgctgcagcagcagcagctgttcctgcagctgcagatcctgagccagcagaagcagcactacaactaccagaccatcctgcctgcccccttcaagcccctgaatgacaagaacagcaacagcggcaacagcgccctgaacaatgccacccccaacaccccccggcagaacaccagcacccctgtgaggaagccaggccccctgcccagcagcctggatgacctgaaggtgtctgagctgaagacagagctgaagctgcggggcctgcctgtgtctggcaccaagccagacctgattgagcggctgaagccctaccaggaggtgaacagcagcggcctggccgccggcggcatcgtggccgtgagcagcagcgccatcgtgaccagcaaccctgaggtgacagtggccctgcctgtgaccaccctgcacaacacagtgaccagctctgtgtccaccctgaaggccgagctgccccccaccggcaccagcaatgccaccagggtggagaatgtgcacagccccctgcccatcagccccagccccagcgagcagagcagcctgagcacagatgacaccaacatggctgacaccttcacagagatcatgaccatgatgagccccagccagttcctgagcagcagccccctgaggatgaccaacaatgaagacagcctgagccccaccagcagcaccctgagcaacctggagctggatgctgctgagaaggacaggaagctgcaggagaaggagaagcagatcgaggagctgaagaggaagctggagcaggagcagaagctggtggaggtgctgaagatgcagctggaggtggagaagaggggccagcagcagaggcccctggaggcccagcccagcgcccctggccacagcgtgaagagtgaccagaagcacggcagcctgggcagcagcatcaaggatgaggccagcctgcctgactgcagcagcagccggcagcccatccctgtggccagccatgctgtgggccagcctgtgtccactggaggccagaccctggtggccaagaaggctgtggtgatcaagcaggaggtgcctgtgggccaggccgagcagcagagcgtggtgtcccagttctacaccagcccccaggccggcatgcagacccagccccagatcgccacagctgcccagatccccacagctgccctggccagcggcctggcccccaccgtgccccagacccaggacaccttcccccagcacgtgctgagccagccccagcaggtgaggaaggtgttcaccaacagcgccagcagcaacacagtgctgccctaccagaggcacccagccccagctgtgcagcagcccttcatcaacaaggccagcaacagcgtgctgcagagcagaaatgcccccctgcccagcctgcagaatggccccaacacccccaacaagcccagcagccccccaccaccccagcagtttgtggtgcagcacagcctgtttggcagccctgtggccaagaccaaggacccccccaggtatgaggaggccatcaagcagaccaggagcacccaggcccccctgcctgagatcagcaatgcccacagccagcagatggatgacctgtttgacatcctgatcaagagcggggagatcagcctgcccatcaaggaggagcccagccccatcagcaagatgaggcctgtgacagccagcatcaccaccatgcctgtgaacacagtggtgtcccggcccccaccccaggtgcagatggcccctcctgtgtccctggagcccatgggcagcctgagcgccagcctggagaaccagctggaggccttcctggatggcaccctgcccagcgccaatgagatcccccccctgcagagcagcagcgaggaccgggagcccttcagcctgattgaggacctgcagaatgacctgctgagccacagcggcatgctggaccacagccacagccccatggagaccagcgagacccagtttgctgctggcaccccctgcctgagcctggacctgagtgacagcaacctggacaacatggagtggctggacatcaccatgcccaacagcagcagcggcctgacccccctgagcaccacagcccccagcatgttttctgctgacttcctggacccccaggacctgcccctgccctgggactag

SEQ ID NO: 16102 - DNA, 3267 bp, Artificial Sequence
  Description of Artificial Sequence: Synthetic coding sequence
atgattgacagcagcaagaagcagcagcagggcttccctgagatcctgacagctggggactttgagcccctgaaggagaaggagtgcctggagggcagcaaccagaagagcctgaaggaggtgctgcagctgcggctgcagcagaggaggacccgggagcagctggtggaccagggcatcatgccacccctgaagagccctgctgccttccacgagcagatcaagagcctggagcgggccaggacagagaacttcctgaagcacaagatccgcagcaggccagacagaagtgagctggtgaggatgcacatcctggaggagacctttgctgagcccagcctgcaggccacccagatgaagctgaagagggcccggctggctgatgacctgaatgagaagatcgcccagaggcctggccccatggagctggtggagaagaacatcctgcctgtggacagctctgtgaaggaggccatcatcggcgtgggcaaggaggactacccccacacccagggcgacttctcctttgatgaggacagcagtgatgccctgagcccagaccagcctgccagccaggagagccagggcagcgctgccagccccagcgagcccaaggtgtctgagagccccagccctgtgaccaccaacaccccagcccagtttgcctctgtgagccccaccgtgcctgagttcctgaagaccccacccacagctgaccagcccccacccaggcctgctgcccctgtgctgcccaccaacacagtgtcctctgccaagccaggccctgccctggtgaagcagagccaccccaagaaccccaatgacaagcacaggagcaagaagtgcaaggaccccaagccccgggtgaagaagctgaagtaccaccagtacatccccccagaccagaagggggagaagaatgagccccagatggacagcaactatgcccggctgctgcagcagcagcagctgttcctgcagctgcagatcctgagccagcagaagcagcactacaactaccagaccatcctgcctgcccccttcaagcccctgaatgacaagaacagcaacagcggcaacagcgccctgaacaatgccacccccaacaccccccggcagaacaccagcacccctgtgaggaagccaggccccctgcccagcagcctggatgacctgaaggtgtctgagctgaagacagagctgaagctgcggggcctgcctgtgtctggcaccaagccagacctgattgaaaggctgaagccctaccaggaggtgaacagcagcggcctggccgccggcggcatcgtggccgtgagcagcagcgccatcgtgaccagcaaccctgaggtgacagtggccctgcctgtgaccaccctgcacaacacagtgaccagctctgtgtccaccctgaaggccgagctgcccccaacaggcaccagcaatgccaccagggtggagaatgtgcacagccccctgcccatcagccccagccccagcgagcagagcagcctgagcacagatgacaccaacatggctgacaccttcacagagatcatgaccatgatgagccccagccagttcctgagcagcagccccctgaggatgaccaacaatgaagacagcctgagccccaccagcagcaccctgagcaacctggagctggatgctgctgagaaggacaggaagctgcaggagaaggagaagcagatcgaggagctgaagaggaagctggagcaggagcagaagctggtggaggtgctgaagatgcagctggaggtggagaagaggggccagcagcagaggcccctggaggcccagcccagcgcccctggccacagcgtgaagagtgaccagaagcacggcagcctgggcagcagcatcaaggatgaggccagcctgcctgactgcagcagcagccggcagcccatccctgtggccagccatgctgtgggccagcctgtgtccactggaggccagaccctggtggccaagaaggctgtggtgatcaagcaggaggtgcctgtgggccaggccgagcagcagagcgtggtgtcccagttctacgtgagcagccagggccagcccccacctgctgtggtggcccagccccaggccctgctgaccacccagacagcccagctgctgctgcctgtgtccatccagggcagctctgtgacctctgtgcagctgcctgtgggcagcctgaagctgcagaccagcccccaggccggcatgcagacccagccccagatcgccacagctgcccagatccccacagctgccctggccagcggcctggcccccaccgtgccccagacccaggacaccttcccccagcacgtgctgagccagccccagcaggtgaggaaggtgttcaccaacagcgccagcagcaacacagtgctgccctaccagaggcacccagccccagctgtgcagcagcccttcatcaacaaggccagcaacagcgtgctgcagagcagaaatgcccccctgcccagcctgcagaatggccccaacacccccaacaagcccagcagccccccaccaccccagcagtttgtggtgcagcacagcctgtttggcagccctgtggccaagaccaaggaccccccaagatatgaggaggccatcaagcagaccaggagcacccaggcccccctgcctgagatcagcaatgcccacagccagcagatggatgacctgtttgacatcctgatcaagtctggagagatcagcctgcccatcaaggaggagcccagccccatcagcaagatgaggcctgtgacagccagcatcaccaccatgcctgtgaacacagtggtgtcccggcccccaccccaggtgcagatggcccctcctgtgtccctggagcccatgggcagcctgagcgccagcctggagaaccagctggaggccttcctggatggcaccctgcccagcgccaatgagatcccccccctgcagagcagcagtgaagatcgggagcccttcagcctgattgaggacctgcagaatgacctgctgagccacagcggcatgctggaccacagccacagccccatggagaccagcgagacccagtttgctgctggcaccccctgcctgagcctggacctgagtgacagcaacctggacaacatggagtggctggacatcaccatgcccaacagcagcagcggcctgacccccctgagcaccacagcccccagcatgttttctgctgacttcctggacccccaggacctgcccctgccctgggactag

SEQ ID NO: 16103 - DNA, 1383 bp, Artificial Sequence
  Description of Artificial Sequence: Synthetic coding sequence
atgattgacagcagcaagaagcagcagcagggcttccctgagatcctgacagctggggactttgagcccctgaaggagaaggagtgcctggagggcagcaaccagaagagcctgaaggaggtgctgcagctgcggctgcagcagaggaggacccgggagcagctggtggaccagggcatcatgccacccctgaagagccctgctgccttccacgagcagatcaagagcctggagcgggccaggacagagaacttcctgaagcacaagatccgcagcaggccagacagaagtgagctggtgaggatgcacatcctggaggagacctttgctgagcccagcctgcaggccacccagatgaagctgaagagggcccggctggctgatgacctgaatgagaagatcgcccagaggcctggccccatggagctggtggagaagaacatcctgcctgtggacagctctgtgaaggaggccatcatcggcgtgggcaaggaggactacccccacacccagggcgacttctcctttgatgaggacagcagtgatgccctgagcccagaccagcctgccagccaggagagccagggcagcgctgccagccccagcgagcccaaggtgtctgagagccccagccctgtgaccaccaacaccccagcccagtttgcctctgtgagccccaccgtgcctgagttcctgaagaccccacccacagctgaccagcccccacccaggcctgctgcccctgtgctgcccaccaacacagtgtcctctgccaagccaggccctgccctggtgaagcagagccaccccaagaaccccaatgacaagcacaggagcaagaagtgcaaggaccccaagccccgggtgaagaagctgaagtaccaccagtacatccccccagaccagaagggggagaagaatgagccccagatggacagcaactatgcccggctgctgcagcagcagcagctgttcctgcagctgcagatcctgagccagcagaagcagcactacaactaccagaccatcctgcctgcccccttcaagtatggaggagcccacgccatcctgaatgccggcttcagcgtcttcatgaggaactacaagctgcccaaggtggagtgctgccacctgtttgtgctgagcaatgacttccacttcttcgtcatccgggcctaccacacagtgtctgaggtgcacatggtgcgggtggcctgcatccccttccagttcctgagcagcaagattggcagcgagttcctgcaggtgagaaatgccttcagccagctgttcatccagatctgcctgctgctggagcaccagaacagcacccgctgcagcgagaagtctgtgagcagcatcatccctggcatcaacagctag

SEQ ID NO: 16104 - DNA, 3732 bp, Artificial Sequence
  Description of Artificial Sequence: Synthetic coding sequence
atggagaactgcagcgctgccagcaccttcctgacagacagcctggagctggagctgggcacagagtggtgcaagccaccctacttcagctgtgctgtggacaacagaggaggcggcaagcacttctctggagagagctacctgtgcagcggggccctgaagaggctcatcctgaacctggaccccctgcccaccaactttgaggaggacaccctggagatcttcggcatccagtgggtgacagaaacagccctggtgaacagcagccgggagctgttccacctgttccggcagcagctgtacaacctggagaccctgctgcagagcagctgtgactttgggaaggtgtccaccctgcactgcaaggctgacaacatccggcagcagtgtgtgctcttcctgcactacgtgaaggtgttcatcttccgctacctgaaggtgcagaatgctgagagccacgtgcctgtgcacccctatgaggccctggaggcccagctgcccagcgtgctgattgatgagctgcacggcctgctgctgtacatcggccacctgtctgagctgcccagcgtgaacatcggggcctttgtgaaccagaaccagatcaagctgtttcctccttcctggcacctgctgcacctgcacctggacatccactggctggtgctggagatcctgtacatgctgggggagaagctgaagcaggtggtgtatggccaccagttcatgaacctggccagtgacaacctgaccaacatcagcctgtttgaggagcactgtgagaccctgctgtgtgacctgatcagcctgagcctgaacagatatgacaaggtgcgcagcagcgagagcctgatgtctgaccagtgcccctgcctgtgcatcaaggagctgtgggtgctgctgatccacctgctggaccacaggagcaagtggtttgtgtctgagagcttctggaactggctgaacaagctgctgaagaccctgctggagaagagcagtgacagaagaagaagctccatgcctgtgatccagagccgggaccccctgggcttctcctggtggatcatcacccacgtggccagcttctacaagtttgacagacatggagtgcctgatgagatgaggaaggtggagagcaactggaactttgtggaggagctgctgaagaagagcatctctgtgcagggcgtcatcctggaggagcagctgaggatgtacctgcactgctgcctgaccctgtgtgacttctgggagcccaacatcgccatcgtgaccatcctgtgggagtactacagcaagaacctgaacagcagcttcagcatctcctggctgcccttcaagggcctggccaacaccatgaagagccccctgtccatgctggagatggtgaagacctgctgctgtgacaagcaggaccaggagctgtacaagagcagcagcagctacaccatcttcctgtgcatcctggccaaggtggtgaagaaggccatgaagagcaatggcccccacccctggaagcaggtgaagggccgcatctacagcaagttccaccagaagaggatggaggagctgacagaggtgggcctgcagaacttcttcagcctcttcctgctgctggccgctgtggccgaggtggaggatgtggccagccacgtgctggacctgctgaacttcctgaagccagcctttgtgaccagccagagggccctgatctggaagggccacatggccttcctgctgatgtatgcccagaagaacctggacatcggcgtgctggccgagaagttcagctgtgccttccgggagaaggccaaggagttcctggtgtccaagaatgaggagatggtgcagaggcagaccatctggaccctgctgagcatctacattgatggagtgcaggaggtgtttgagaccagctactgcctgtaccccagccatgagaagctgctgaatgatggcttctccatgctgctgcgggcctgccgggagagcgagctgaggacagtgctgtccttcctgcaggccgtgctggcccgcatccgctccatgcaccagcagctgtgccaggagctgcagagggacaacgtggacctgtttgtgcagagcagcctgagcgccaaggagcggcacctggccgctgtggccagcgccctgtggaggcacttcttctccttcctgaagagccagaggatgagccaggtggtgcccttcagccagctggctgatgctgctgctgacttcaccctgctggccatggacatgcccagcacagcccccagcgacttccagccccagcctgtgatcagcatcatccagctgtttggctgggatgacatcatctgcccccaggtggtggcccgctacctgagccacgtgctgcagaacagcaccctgtgtgaggccctgagccacagcggctacgtgtccttccaggccctgactgtgcgctcctggatccgctgtgtgctgcagatgtacatcaagaacctgagcggcccagatgacctgctgattgacaagaacctggaggaggccgtggagaaggagtacatgaagcagctggtgaagctgacccggctgctcttcaacctgtctgaggtgaagagcatcttcagcaaggcccaggtggagtacctgagcatcagcgaggaccccaagaaggccctggtgcgcttctttgaggccgtgggcgtgacctatggaaatgtgcagaccctgagtgacaagagcgccatggtgaccaagagcctggagtacctgggggaggtgctgaagtacatcaagccctacctgggcaagaaggtgttttctgctggcctgcagctgacctacggcatgatgggcatcctggtgaagtcctgggcccagatctttgccaccagcaaggcccagaagctgctcttccgcatcatcgactgcctgctgctgccccatgctgtgctgcagcaggagaaggagctgcctgcccccatgctgagcgccatccagaagagcctgcccctgtacctgcagggcatgtgcatcgtgtgctgccagagccagaaccccaatgcctacctgaaccagctgctgggcaatgtgattgagcagtacatcggccgcttcctgcctgccagcccctacgtgtctgacctgggccagcaccctgtgctgctggccctgaggaacacagccaccatcccccccatcagcagcctgaagaagtgcatcgtgcaggtgatcaggaagagctacctggagtacaagggcagcagccccccaccccggctggccagcatcctggccttcatcctgcagctgttcaaggagaccaacacagacatctatgaggtggagctgctgctgcccggcatcctgaagtgcctggtgctggtgtctgagccccaggtgaagaggctggccacagagaacctgcagtacatggtgaaggcctgccaggtgggcagcgaggaggagcccagcagccagctgaccagcgtcttccggcagttcatccaggactatggcatgagatactactaccaggtgtacagcatcctggagaccgtggccaccctggaccagcaggtggtgatccacctgatcagcaccctgacccagagcctgaaggacagcgagcagaagtggggcctgggcaggaacatcgcccagcgggaggcctacagcaagctgctgagccacctgggccagatgggccaggatgagatgcagaggctggagaatgacaacacctag

SEQ ID NO: 16105 - DNA, 867 bp, Artificial Sequence
  Description of Artificial Sequence: Synthetic coding sequence
atgagcagcaggaagcagggcagccagccccggggccagcagagcgctgaggaggagaacttcaagaagcccaccaggagcaacatgcagaggagcaagatgagaggagccagcagcggcaagaagacagctggcccccagcagaagaacctggagcccgccctgcccggccgctggggcggccgctctgcagaaaatcctccttctggctctgtgaggaagaccaggaagaacaagcagaagaccccaggaaatggagatggcggcagcaccagcgaggccccccagccccccaggaagaagagggcccgggctgaccccaccgtggagagcgaggaggccttcaagaacaggatggaggtgaaggtgaagatccctgaggagctgaagccctggctggtggaggactgggacctggtgacccggcagaagcagctgttccagctgcctgccaagaagaatgtggatgccatcctggaggagtatgccaactgcaagaagagccagggcaatgtggacaacaaggagtatgctgtgaatgaggtggtggccggcatcaaggagtacttcaacgtgatgctgggcacccagctgctgtacaagtttgagcggccccagtatgcagagatcctgctggcccacccagatgcccccatgagccaggtgtatggagccccccacctgctgcggctgtttgtgagaattggagccatgctggcctacacccccctggatgagaagagcctggccctgctgctgggctacctgcatgacttcctgaagtacctggccaagaacagcgccagcctcttcaccgccagtgactacaaggtggccagcgctgagtaccacaggaaggccctgtag

SEQ ID NO: 16106 - DNA, 813 bp, Artificial Sequence
  Description of Artificial Sequence: Synthetic coding sequence
atgagcagcaggaagcagggcagccagccccggggccagcagagcgctgaggaggagaacttcaagaagcccaccaggagcaacatgcagaagaacctggagcccgccctgcccggccgctggggcggccgctctgcagaaaatcctccttctggctctgtgaggaagaccaggaagaacaagcagaagaccccaggaaatggagatggcggcagcaccagcgaggccccccagccccccaggaagaagagggcccgggctgaccccaccgtggagagcgaggaggccttcaagaacaggatggaggtgaaggtgaagatccctgaggagctgaagccctggctggtggaggactgggacctggtgacccggcagaagcagctgttccagctgcctgccaagaagaatgtggatgccatcctggaggagtatgccaactgcaagaagagccagggcaatgtggacaacaaggagtatgctgtgaatgaggtggtggccggcatcaaggagtacttcaacgtgatgctgggcacccagctgctgtacaagtttgagcggccccagtatgcagagatcctgctggcccacccagatgcccccatgagccaggtgtatggagccccccacctgctgcggctgtttgtgagaattggagccatgctggcctacacccccctggatgagaagagcctggccctgctgctgggctacctgcatgacttcctgaagtacctggccaagaacagcgccagcctcttcaccgccagtgactacaaggtggccagcgctgagtaccacaggaaggccctgtag

SEQ ID NO: 16107 - DNA, 513 bp, Artificial Sequence
  Description of Artificial Sequence: Synthetic coding sequence
atggaggtgaaggtgaagatccctgaggagctgaagccctggctggtggaggactgggacctggtgacccggcagaagcagctgttccagctgcctgccaagaagaatgtggatgccatcctggaggagtatgccaactgcaagaagagccagggcaatgtggacaacaaggagtatgctgtgaatgaggtggtggccggcatcaaggagtacttcaacgtgatgctgggcacccagctgctgtacaagtttgagcggccccagtatgcagagatcctgctggcccacccagatgcccccatgagccaggtgtatggagccccccacctgctgcggctgtttgtgagaattggagccatgctggcctacacccccctggatgagaagagcctggccctgctgctgggctacctgcatgacttcctgaagtacctggccaagaacagcgccagcctcttcaccgccagtgactacaaggtggccagcgctgagtaccacaggaaggccctgtag

SEQ ID NO: 16108 - DNA, 534 bp, Artificial Sequence
  Description of Artificial Sequence: Synthetic coding sequence
atgagcagcaggaagcagggcagccagccccggggccagcagagcgctgaggaggagaacttcaagaagcccaccaggagcaacatgcagaggagcaagatgagaggagccagcagcggcaagaagacagctggcccccagcagaagaacctggagcccgccctgcccggccgctggggcggccgctctgcagaaaatcctccttctggctctgtgaggaagaccaggaagaacaagcagaagaccccaggaaatggagatggcggcagcaccagcgaggccccccagccccccaggaagaagagggcccgggctgaccccaccgtggagagcgaggaggccttcaagaacaggatggaggtgaaggtgaagatccctgaggagctgaagccctggctggtggaggactgggacctggtgacccggcagaagcagctgttccagctgcctgccaagaagaatgtggatgccatcctggaggagtatgccaactgcaagaagagccagggcaatgtggacaacaaggagtactag

SEQ ID NO: 16109 - DNA, 867 bp, Artificial Sequence; identical to SEQ ID NO: 16105
  Description of Artificial Sequence: Synthetic coding sequence

SEQ ID NO: 16110 - DNA, 204 bp, Artificial Sequence
  Description of Artificial Sequence: Synthetic coding sequence
atgagcagcaggaagcagggcagccagccccggggccagcagagcgctgaggaggagaacttcaagaagcccaccaggagcaacatgcagaggagcaagatgagaggagccagcagcggcaagaagacagctggcccccagcagaagaacctggagcccgccctgcccggccgctggggcggccgctctgctgagaacccctag

SEQ ID NO: 16111 - DNA, 867 bp, Artificial Sequence; identical to SEQ ID NO: 16105
  Description of Artificial Sequence: Synthetic coding sequence

SEQ ID NO: 16112 - DNA, 867 bp, Artificial Sequence; identical to SEQ ID NO: 16105
  Description of Artificial Sequence: Synthetic coding sequence

SEQ ID NO: 16113 - DNA, 537 bp, Artificial Sequence
  Description of Artificial Sequence: Synthetic coding sequence
atgagcagcaggaagcagggcagccagccccggggccagcagagcgctgaggaggagaacttcaagaagcccaccaggagcaacatgcagaggagcaagatgagaggagccagcagcggcaagaagacagctggcccccagcagaagaacctggagcccgccctgcccggccgctggggcggccgctctgcagaaaatcctccttctggctctgtgaggaagaccaggaagaacaagcagaagaccccaggaaatggagatggcggcagcaccagcgaggccccccagccccccaggaagaagagggcccgggctgaccccaccgtggagagcgaggaggccttcaagaacaggatggaggtgaaggtgaagatccctgaggagctgaagccctggctggtggaggactgggacctggtgacccggcagaagcagctgttccagctgcctgccaagaagaatgtggatgccatcctggaggagtatgccaactgcaagaagagccagggcaatgtggacaacaaggagtatgcctag

SEQ ID NO: 16114 - DNA, 867 bp, Artificial Sequence; identical to SEQ ID NO: 16105
  Description of Artificial Sequence: Synthetic coding sequence

SEQ ID NO: 16115 - DNA, 477 bp, Artificial Sequence
  Description of Artificial Sequence: Synthetic coding sequence
atgagcagcaggaagcagggcagccagccccggggccagcagagcgctgaggaggagaacttcaagaagcccaccaggagcaacatgcagaggagcaagatgagaggagccagcagcggcaagaagacagctggcccccagcagaagaacctggagcccgccctgcccggccgctggggcggccgctctgcagaaaatcctccttctggctctgtgaggaagaccaggaagaacaagcagaagaccccaggaaatggagatggcggcagcaccagcgaggccccccagccccccaggaagaagagggcccgggctgaccccaccgtggagagcgaggaggccttcaagaacaggatggaggtgaaggtgaagatccctgaggagctgaagccctggctggtggaggactgggacctggtgacccggcagaagcagctgttccagctgcctgccaagaagaatgtggatgccatctag

SEQ ID NO: 16116 - DNA, 867 bp, Artificial Sequence; identical to SEQ ID NO: 16105
  Description of Artificial Sequence: Synthetic coding sequence

SEQ ID NO: 16117 - DNA, 2046 bp, Artificial Sequence
  Description of Artificial Sequence: Synthetic coding sequence
atggccccccaggtgtggaggaggaggaccctggagcgctgcctgacagaggtgggcaaggccaccggccggcctgagtgcttcctgaccatccaggagggcctggccagcaagttcaccagcctgaccaaggtgctgtatgacttcaacaagatcctggagaatggccgcatccacggcagccccctgcagaagctggtgattgaaaattttgatgatgagcagatctggcagcagctggagctgcagaatgagcccatcctgcagtacttccagaatgctgtgtctgagaccatcaatgatgaggacatcagcctgctgcctgagagcgaggagcaggagcgggaggaggatggcagcgagattgaagcagatgacaaggaggacctggaggacctggaggaggaggaggtgtctgacatgggaaatgatgatcctgagatgggagagcgggcagagaacagcagcaagagtgacctgaggaagagccctgtgttcagtgatgaagattctgacctggactttgacatcagcaagctggagcagcagagcaaggtgcagaacaagggccagggcaagccccgggagaagagcatcgtggatgacaagttcttcaagctgtctgagatggaggcctacctggagaacatcgagaaggaggaggagaggaaggatgacaatgatgaggaggaggaggacatcgacttctttgaggacatcgacagtgatgaagatgaaggaggcctgtttggcagcaagaagctgaagagcggcaagagcagcaggaacctgaagtacaaggacttctttgatcctgtggagagtgatgaggacatcaccaacgtgcatgatgatgagctggacagcaacaaggaggatgatgaaattgctgaggaggaggccgaggagctgagcatcagcgagacagatgaagatgatgacctgcaggagaatgaagacaacaagcagcacaaggagagcctgaagagggtgacctttgccctgcctgatgatgctgagacagaggacaccggggtgctgaatgtgaagaagaacagtgatgaggtgaagagcagctttgagaagaggcaggagaagatgaatgagaagatcgccagcctggagaaggagctgctggagaagaagccctggcagctgcagggcgaggtgacagcccagaagaggcctgagaacagcctgctggaggagaccctgcactttgaccatgctgtgaggatggcccctgtgatcacagaggagaccaccctgcagctggaggacatcatcaagcagaggatccgggaccaggcctgggatgatgtggtgaggaaggagaagcccaaggaggatgcctatgagtacaagaagaggctgaccctggaccacgagaagagcaagctgagcctggccgagatctatgagcaggagtacatcaagctgaaccagcagaagacagctgaggaggagaaccctgagcacgtggagatccagaagatgatggacagcctcttcctgaagctggatgccctgagcaacttccacttcatccccaagccccctgtgcctgagatcaaggtggtgagcaacctgcctgccatcaccatggaggaggtggcccctgtgtctgtgtctgatgctgccctgctggcccctgaggagatcaaggagaagaacaaggccggggacatcaagacagctgctgagaagacagccacagacaagaagcgggagaggaggaagaagaagtaccagaagaggatgaagatcaaggagaaggagaagaggaggaagctgctggagaagagctctgtggaccaggccggcaagtacagcaagacagtggccagcgagaagctgaagcagctgaccaagacaggcaaggccagcttcatcaaggatgagggcaaggacaaggccctgaagagcagccaggccttcttcagcaagctgcaggaccaggtgaagatgcagatcaatgatgccaagaagacagagaagaagaagaagaagaggcaggacatctctgtgcacaagctgaagctgtag

SEQ ID NO: 16118 - DNA, 720 bp, Artificial Sequence
  Description of Artificial Sequence: Synthetic coding sequence
atgcccaagagcaagagggacaagaaggtgtccctgaccaagacagccaagaagggcctggagctgaagcagaacctgattgaggagctgaggaaatgtgtggacacctacaagtacctgttcatcttctctgtggccaacatgaggaacagcaagctgaaggacatcagaaatgcctggaagcacagcaggatgttcttcggcaagaacaaggtgatgatggtggccctgggccgcagccccagtgatgagtacaaggacaacctgcaccaggtgtccaagaggctgcggggggaggtgggcctgctcttcaccaacagaaccaaggaggaggtgaatgagtggttcaccaagtacacagagatggactatgcccgggccggcaacaaggccgccttcaccgtgtccctggaccccggccccctggagcagttcccccacagcatggagccccagctgcggcagctgggcctgcccacagccctgaagaggggcgtggtgaccctgctgagtgactatgaggtgtgcaaggagggagatgtgctgaccccagagcaggcccgggtgctgaagctgtttggctatgagatggccgagttcaaggtgaccatcaagtacatgtgggacagccagagcggccgcttccagcagatgggagatgacctgcctgagagcgccagcgagagcacagaggagagtgacagtgaagatgatgactag

SEQ ID NO: 16119 - DNA, 621 bp, Artificial Sequence
  Description of Artificial Sequence: Synthetic coding sequence
atgagcactggatctgtgtctgaccctgaggagatggagctgcggggcctgcagcgggagtaccctgtgcctgccagcaagaggcctcccctgcggggcgtggagaggagctatgccagccccagcgacaacagcagcgctgaggaggaggaccctgatggagaggaggagcgctgtgccctgggcacagctggcagcgctgagggctgcaagaggaagaggccccgggtggccggcggcggcggggccggcggcagcgctgggggcggcggcaagaagcccctgcctgccaagggcagcgctgctgagtgcaagcagagccagagaaatgctgccaatgcccgggagcgggccaggatgagggtgctgagcaaggccttcagccggctgaagaccagcctgccctgggtgcccccagacaccaagctgagcaagctggacaccctgcggctggccagcagctacatcgcccacctgcggcagctgctgcaggaggacagatatgaaaatggctacgtgcaccctgtgaacctgacctggccctttgtggtgtctggccgcccagacagcgacaccaaggaggtgtctgctgccaaccggctgtgtggcaccacagcctag

SEQ ID NO: 16120 - DNA, 249 bp, Artificial Sequence
  Description of Artificial Sequence: Synthetic coding sequence
atgagccaggccggggcccaggaggcccccatcaagaagaagaggcctcctgtgaaggatgaggacctgaagggggcccggggcaacctgaccaagaaccaggagatcaagagcaagacctaccaggtgatgagagaatgtgagcaggccggcagcgctgcccccagcgtcttcagcaggaccaggactggaacagaaacagtgtttgagaagcccaaggccggccccaccaagtctgtgtttggatag

SEQ ID NO: 16121 - DNA, 2508 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgactgtgcgggccctgggcggcctgctgaagttcctgggcagaagaagaattggagtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgcggctgtggttcacccggcccacccatgacctgggggagctgagcagccggctggatgtgatccagttcttcctgctgccccagaacctggacatggcccagatgctgcaccggctgctgggccacatcaagaatgtgcccctcatcctgaagaggatgaagctgagccacaccaaggtgtctgactggcaggtgctgtacaagacagtgtacagcgccctgggcctgagagatgcctgccgcagcctgccccagagcatccagctgttccgggacatcgcccaggagttcagtgatgacctgcaccacatcgccagcctcatcggcaaggtggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccagcaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtgtgagggcgtggccaaggccagccacgccagccacacagctgcccaggccggcctgcctgacaagctggtggcccggggcaaggaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 16122 - DNA, 2469 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgaccccacctggggacctgcgcttcacccccatccccctgctgatccccagccaggtgcgggccctgggcggcctgctgaagttcctgggcagaagacgcatcggcgtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgcggctgtggttcacccggcccacccatgacctgggggagctgagcagccggctggatgtgatccagttcttcctgctgccccagaacctggacatggcccagatgctgcaccggctgctgggccacatcaagaatgtgcccctcatcctgaagaggatgaagctgagccacaccaaggtgtctgactggcaggtgctgtacaagacagtgtacagcgccctgggcctgagagatgcctgccgcagcctgccccagagcatccagctgttccgggacatcgcccaggagttcagtgatgacctgcaccacatcgccagcctgattggcaaggtggtggactttgagggcagcctggctgaaaatcgcttcaccgtgctgcccaacatcgaccctgagattgatgagaagaagaggcggctgatgggcctgcccagcttcctgacagaggtggccaggaaggagctggagaacctggacagccgcatccccagctgcagcgtcatctacatccccctcatcggcttcctgctgagcatcccccggctgcccagcatggtggaggccagtgactttgagatcaatggcctggacttcatgttcctgtctgaggagaagctgcactacagaagtgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagatcggggctgtggatgccatcttcacccgcatccacagctgtgagagcatcagcctgggcctgagcaccttcatgattgacctgaaccagcaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 16123 - DNA, 2556 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgaccccacctggggacctgcgcttcacccccatccccctgctgatccccagccaggtgcgggccctgggcggcctgctgaagttcctgggcagaagacgcatcggcgtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgcggctgtggttcacccggcccacccatgacctgggggagctgagcagccggctggatgtgatccagttcttcctgctgccccagaacctggacatggcccagatgctgcaccggctgctgggccacatcaagaatgtgcccctcatcctgaagaggatgaagctgagccacaccaaggtgtctgactggcaggtgctgtacaagacagtgtacagcgccctgggcctgagagatgcctgccgcagcctgccccagagcatccagctgttccgggacatcgcccaggagttcagtgatgacctgcaccacatcgccagcctgattggcaaggtggtggactttgagggcagcctggctgaaaatcgcttcaccgtgctgcccaacatcgaccctgagattgatgagaagaagaggcggctgatgggcctgcccagcttcctgacagaggtggccaggaaggagctggagaacctggacagccgcatccccagctgcagcgtcatctacatccccctcatcggcttcctgctgagcatcccccggctgcccagcatggtggaggccagtgactttgagatcaatggcctggacttcatgttcctgtctgaggagaagctgcactacagaagtgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagatcggggctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtgtgagggcgtggccaaggccagccacgccagccacacagctgcccaggccggcctgcctgacaagctggtggcccggggcaaggaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 16124 - DNA, 2505 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgactgtgcgggccctgggcggcctgctgaagttcctgggcagaagaagaattggagtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgcggctgtggttcacccggcccacccatgacctgggggagctgagcagccggctggatgtgatccagttcttcctgctgccccagaacctggacatggcccagatgctgcaccggctgctgggccacatcaagaatgtgcccctcatcctgaagaggatgaagctgagccacaccaaggtgtctgactggcaggtgctgtacaagacagtgtacagcgccctgggcctgagagatgcctgccgcagcctgccccagagcatccagctgttccgggacatcgcccaggagttcagtgatgacctgcaccacatcgccagcctcatcggcaaggtggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtgtgaaggagtggccaaggccagccacgccagccacacagctgcccaggccggcctgcctgacaagctggtggcccggggcaaggaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 16125 - DNA, 2505 bp, Artificial Sequence; identical to SEQ ID NO: 16124
  Description of Artificial Sequence: Synthetic coding sequence

SEQ ID NO: 16126 - DNA, 816 bp, Artificial Sequence
  Description of Artificial Sequence: Synthetic coding sequence
atgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctggactggccccgggtgtctggccaggagggcggggactag

SEQ ID NO: 16127 - DNA, 1002 bp, Artificial Sequence
  Description of Artificial Sequence: Synthetic coding sequence
aagatcctcttcctgagcagcatcatcccctttgactgcctgctgactgtgcgggccctgggcggcctgctgaagttcctgggcagaagacgcatcggcgtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgcggctgtggttcacccggcccacccatgacctgggggagctgagcagccggctggatgtgatccagttcttcctgctgccccagaacctggacatggcccagatgctgcaccggctgctgggccacatcaagaatgtgcccctcatcctgaagaggatgaagctgagccacaccaaggtgtctgactggcaggtgctgtacaagacagtgtacagcgccctgggcctgagagatgcctgccgcagcctgccccagagcatccagctgttccgggacatcgcccaggagttcagtgatgacctgcaccacatcgccagcctgattggcaaggtgtacctgagcccccaggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggctag

SEQ ID NO: 16128 - DNA, 1527 bp, Artificial Sequence
  Description of Artificial Sequence: Synthetic coding sequence
atgtggcctgtgctgctgtttgtgttcctgagccagacagtgtacagcgccctgggcctgagagatgcctgccgcagcctgccccagagcatccagctgttccgggacatcgcccaggagttcagtgatgacctgcaccacatcgccagcctcatcggcaaggtggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtgtgaaggagtggccaaggccagccacgccagccacacagctgcccaggccggcctgcctgacaagctggtggcccggggcaaggaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 16129 - DNA, 2505 bp, Artificial Sequence; identical to SEQ ID NO: 16124
  Description of Artificial Sequence: Synthetic coding sequence

SEQ ID NO: 16130 - DNA, 2508 bp, Artificial Sequence; identical to SEQ ID NO: 16121
  Description of Artificial Sequence: Synthetic coding sequence

SEQ ID NO: 16131 - DNA, 585 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgactgtgcgggccctgggcggcctgctgaagttcctgggcagaagaagatag

SEQ ID NO: 16132 - DNA, 585 bp, Artificial Sequence; identical to SEQ ID NO: 16131
  Description of Artificial Sequence: Synthetic coding sequence

SEQ ID NO: 16133 - DNA, 2505 bp, Artificial Sequence; identical to SEQ ID NO: 16124
  Description of Artificial Sequence: Synthetic coding sequence

SEQ ID NO: 16134 - DNA, 585 bp, Artificial Sequence; identical to SEQ ID NO: 16131
  Description of Artificial Sequence: Synthetic coding sequence

SEQ ID NO: 16135 - DNA, 1602 bp, Artificial Sequence
  Description of Artificial Sequence: Synthetic coding sequence
atggcccagatgctgcaccggctgctgggccacatcaagaatgtgcccctcatcctgaagaggatgaagctgagccacaccaaggtgtctgactggcaggtgctgtacaagacagtgtacagcgccctgggcctgagagatgcctgccgcagcctgccccagagcatccagctgttccgggacatcgcccaggagttcagtgatgacctgcaccacatcgccagcctgattggcaaggtggtggactttgagggcagcctggctgaaaatcgcttcaccgtgctgcccaacatcgaccctgagattgatgagaagaagaggcggctgatgggcctgcccagcttcctgacagaggtggccaggaaggagctggagaacctggacagccgcatccccagctgcagcgtcatctacatccccctcatcggcttcctgctgagcatcccccggctgcccagcatggtggaggccagtgactttgagatcaatggcctggacttcatgttcctgtctgaggagaagctgcactacagaagtgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagatcggggctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtgtgagggcgtggccaaggccagccacgccagccacacagctgcccaggccggcctgcctgacaagctggtggcccggggcaaggaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 16136 - DNA, 2508 bp, Artificial Sequence; identical to SEQ ID NO: 16121
  Description of Artificial Sequence: Synthetic coding sequence

SEQ ID NO: 16137 - DNA, 1002 bp, Artificial Sequence; identical to SEQ ID NO: 16127
  Description of Artificial Sequence: Synthetic coding sequence

SEQ ID NO: 16138 - DNA, 2508 bp, Artificial Sequence; identical to SEQ ID NO: 16121
  Description of Artificial Sequence: Synthetic coding sequence

SEQ ID NO: 16139 - DNA, 2466 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgaccccacctggggacctgcgcttcacccccatccccctgctgatccccagccaggtgcgggccctgggcggcctgctgaagttcctgggcagaagacgcatcggcgtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgcggctgtggttcacccggcccacccatgacctgggggagctgagcagccggctggatgtgatccagttcttcctgctgccccagaacctggacatggcccagatgctgcaccggctgctgggccacatcaagaatgtgcccctcatcctgaagaggatgaagctgagccacaccaaggtgtctgactggcaggtgctgtacaagacagtgtacagcgccctgggcctgagagatgcctgccgcagcctgccccagagcatccagctgttccgggacatcgcccaggagttcagtgatgacctgcaccacatcgccagcctgattggcaaggtggtggactttgagggcagcctggctgaaaatcgcttcaccgtgctgcccaacatcgaccctgagattgatgagaagaagaggcggctgatgggcctgcccagcttcctgacagaggtggccaggaaggagctggagaacctggacagccgcatccccagctgcagcgtcatctacatccccctcatcggcttcctgctgagcatcccccggctgcccagcatggtggaggccagtgactttgagatcaatggcctggacttcatgttcctgtctgaggagaagctgcactacagaagtgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagatcggggctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 16140 - DNA, 1527 bp, Artificial Sequence; identical to SEQ ID NO: 16128
  Description of Artificial Sequence: Synthetic coding sequence

SEQ ID NO: 16141 - DNA, 2505 bp, Artificial Sequence; identical to SEQ ID NO: 16124
  Description of Artificial Sequence: Synthetic coding sequence

SEQ ID NO: 16142 - DNA, 2505 bp, Artificial Sequence; identical to SEQ ID NO: 16124
  Description of Artificial Sequence: Synthetic coding sequence

SEQ ID NO: 16143 - DNA, 585 bp, Artificial Sequence; identical to SEQ ID NO: 16131
  Description of Artificial Sequence: Synthetic coding sequence

SEQ ID NO: 16144 - DNA, 2469 bp, Artificial Sequence; identical to SEQ ID NO: 16122
  Description of Artificial Sequence: Synthetic coding sequence

SEQ ID NO: 16145 - DNA, 471 bp, Artificial Sequence
  Description of Artificial Sequence: Synthetic coding sequence
acagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctggtgtgtgaaggagtggccaaggccagccacgccagccacacagctgcccaggccggcctgcctgacaagctggtggcccggggcaaggaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 16146 - DNA, 2505 bp, Artificial Sequence; identical to SEQ ID NO: 16124
  Description of Artificial Sequence: Synthetic coding sequence

SEQ ID NO: 16147 - DNA, 2505 bp, Artificial Sequence; identical to SEQ ID NO: 16124
  Description of Artificial Sequence: Synthetic coding sequence

SEQ ID NO: 16148 - DNA, 471 bp, Artificial Sequence; identical to SEQ ID NO: 16145
  Description of Artificial Sequence: Synthetic coding sequence

SEQ ID NO: 16149 - DNA, 2466 bp, Artificial Sequence; identical to SEQ ID NO: 16139
  Description of Artificial Sequence: Synthetic coding sequence

SEQ ID NO: 16150 - DNA, 2556 bp, Artificial Sequence; identical to SEQ ID NO: 16123
  Description of Artificial Sequence: Synthetic coding sequence

SEQ ID NO: 16151 - DNA, 1602 bp, Artificial Sequence; identical to SEQ ID NO: 16135
  Description of Artificial Sequence: Synthetic coding sequence

SEQ ID NO: 16152 - DNA, 765 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgactgtgcgggccctgggcggcctgctgaagttcctgggcagaagaagaattggagtggagctggaggactacaacgtgtctgtgcccatcctgggcttcaagaagttcatgctgacccacctggtgaacatcgaccaggacacctaccgcctggagtgcaatggagccatcagcgcccagtgcaacctgtgcctgctgggcagcagtgacagccctgccagcgccagctag

SEQ ID NO: 16153 - DNA, 816 bp, Artificial Sequence; identical to SEQ ID NO: 16126
  Description of Artificial Sequence: Synthetic coding sequence

SEQ ID NO: 16154 - DNA, 1602 bp, Artificial Sequence; identical to SEQ ID NO: 16135
  Description of Artificial Sequence: Synthetic coding sequence

SEQ ID NO: 16155 - DNA, 816 bp, Artificial Sequence; identical to SEQ ID NO: 16126
  Description of Artificial Sequence: Synthetic coding sequence

SEQ ID NO: 16156 - DNA, 765 bp, Artificial Sequence; identical to SEQ ID NO: 16152
  Description of Artificial Sequence: Synthetic coding sequence

SEQ ID NO: 16157 - DNA, 765 bp, Artificial Sequence; identical to SEQ ID NO: 16152
  Description of Artificial Sequence: Synthetic coding sequence

SEQ ID NO: 16158 - DNA, 1602 bp, Artificial Sequence; identical to SEQ ID NO: 16135
  Description of Artificial Sequence: Synthetic coding sequence

SEQ ID NO: 16159 - DNA, 2556 bp, Artificial Sequence; identical to SEQ ID NO: 16123
  Description of Artificial Sequence: Synthetic coding sequence

SEQ ID NO: 16160 - DNA, 1200 bp, Artificial Sequence
  Description of Artificial Sequence: Synthetic coding sequence
atggccagcgctgctgctggggaggccgaggagaccacccggctgaggaagccccgcttctcctttgaggagaaccagatcctgatccgggaggtgcgggcccactacccccagctgtatggagcccagagcagaagagtgtctgtggccgagaggagaagagtgtgggatggcattgctgccaagatcaatggcatcacctcctggaagaggacaggccaggaggtgcagaagcgctggaatgacttcaagaggaggaccaaggagaagctggcccgggtgccccacagcacccagggcgccggccctgctgctgaagatgccttctctgctgaggaggagaccatctttgccatcctgggccctggggtggccgcccctggagctggagctggagctgaggagcccccagctgcccccagcagccagcccccaccacccagcgcctgcccccagcgctacgtgctgtctgaggaccggcgggaggaccggcgggctgacaccagcgcccacagcaaggccggcagcagcagccctgagccctgggcccggcccagctgcaccccccaggagggcggctgcccccggcccaaggagcgggagagccccccacccagcgccctgcagcctgtgcagctgccccggctggccctgagccccccacctccagccccacccctgcccccacctccacccctggcccaggtggcccccagcccccccagccccccacctccaccccggcccccacccaccctgagcgccagtgaccccagcctggacttcctgcgggcccagcaggagacagccaatgccatccgggagctggccggcaccctgcggcagggcctggccaagctgtctgaggccctgagcgccctgctgcccctgctgcccggcacccctgtggacagcctgcccccacccctgcccccacctcctcctcctcctcctccacccaggcctgtgctgcccccaccagcccccaaggtggagatcaccccagagcctgtgtctgtggtggccgctgtggtggatggagctgtggtggccgcccggggcgtcatcatcgcccccaggtctgaggagggcgccccccggcccccaccagcccccctgccccctcatgacagccccccccacaagaggaggaagggcttccccaccaggaagaggcggggccgctggaagagcccctag

SEQ ID NO: 16161 - DNA, 708 bp, Artificial Sequence
  Description of Artificial Sequence: Synthetic coding sequence
atgaggacccaggtgtatgagggcctgtgcaagaactacttcagcctggccgtgctgcagagggaccgcatcaagctgctcttctttgacatcctggtgttcctgagcgtcttcctgctcttcctgctcttcctggtggacatcatggccaacaacaccaccagcctgggcagcccctggccagagaacttctgggaggacctgatcatgtccttcaccgtgtccatggccatcggcctggtgctgggcggcttcatctgggccgtgttcatctgcctgagcagaagaagaagagccagcgcccccatcagccagtggagcagcagccgccgcagccgcagcagctacacccacggcctgaacagaacaggcttctaccgccacagcggctgtgaaagaagaagcaacctgagcctggccagcctgaccttccagaggcaggccagcctggagcaggccaacagcttccccaggaagagcagcttccgggccagcaccttccaccccttcctgcagtgcccccccctgcctgtggagacagagagccagctggtgaccctgcccagcagcaacatcagccccaccatcagcaccagccacagcctgagcaggccagactactggagcagcaacagcctgcgggtgggcctgagcaccccacctcctccagcctatgagagcatcatcaaggccttcccagacagctag

SEQ ID NO: 16162 - DNA, 651 bp, Artificial Sequence
  Description of Artificial Sequence: Synthetic coding sequence
tgaagagaccgcatcaagctgctcttctttgacatcctggtgttcctgtctgtgttcctgctcttcctgctcttcctggtggacatcatggccaacaacaccaccagcctgggcagcccctggccagagaacttctgggaggacctgatcatgtccttcaccgtgtccatggccatcggcctggtgctgggcggcttcatctgggccgtgttcatctgcctgagcagaagaagaagagccagcgcccccatcagccagtggagcagcagcagaagaagccgcagcagctacacccacggcctgaacagaacaggcttctaccgccacagcggctgtgagcggcgcagcaacctgagcctggccagcctgaccttccagaggcaggccagcctggagcaggccaacagcttccccaggaagagcagcttccgggccagcaccttccaccccttcctgcagtgcccccccctgcctgtggagacagagagccagctggtgaccctgcccagcagcaacatcagccccaccatcagcaccagccacagcctgagcaggccagactactggagcagcaacagcctgcgggtgggcctgagcaccccacctcctccagcctatgagagcatcatcaaggccttcccagacagctag

SEQ ID NO: 16163 - DNA, 1833 bp, Artificial Sequence
  Description of Artificial Sequence: Synthetic coding sequence
atgcagtacagccaccactgtgagcacctgctggagcggctgaacaagcagcgggaggccggcttcctgtgtgactgcaccatcgtcatcggggagttccagttcaaggcccacagaaatgtgctggccagcttcagcgagtactttggagccatctaccgcagcaccagcgagaacaacgtgttcctggaccagagccaggtgaaggcagatggcttccagaagctgctggagttcatctacacaggcaccctgaacctggacagctggaatgtgaaggagatccaccaggccgctgactacctgaaggtggaggaggtggtgaccaagtgcaagatcaagatggaggactttgccttcatcgccaaccccagcagcacagagatcagcagcatcactggaaacatcgagctgaaccagcagacctgcctgctgaccctgcgggactacaacaaccgggagaagtctgaggtgtccacagacctgatccaggccaaccccaagcagggcgccctggccaagaagagcagccagaccaagaagaagaagaaggccttcaacagccccaagacaggccagaacaagacagtgcagtaccccagcgacatcctggagaatgcctctgtggagctgttcctggatgccaacaagctgcccacccctgtggtggagcaggtggcccagatcaatgacaacagcgagctggagctgacctctgtggtggagaacaccttccctgcccaggacatcgtgcacacagtgacagtgaagaggaagaggggcaagagccagcccaactgtgccctgaaggagcacagcatgagcaacatcgcctctgtgaagagcccctatgaagcagaaaattctggagaggagctggaccagcgctacagcaaggccaagcccatgtgcaacacctgtgggaaggtgttcagcgaggccagcagcctgcggcggcacatgaggatccacaagggcgtgaagccctacgtgtgccacctgtgtgggaaggccttcacccagtgcaaccagctgaagacccacgtgaggacccacactggagagaagccctacaagtgtgagctgtgtgacaagggctttgcccagaagtgccagctggtgttccacagcaggatgcaccacggggaggagaagccctacaagtgtgatgtgtgcaacctgcagtttgccaccagcagcaacctgaagatccacgccaggaagcacagcggggagaagccctacgtgtgtgacagatgtggccagagatttgcccaggccagcaccctgacctaccacgtgagaagacacactggagagaagccctacgtgtgtgacacctgtgggaaggcctttgctgtgagcagcagcctcatcacccacagcaggaagcacactggagagaagccctacatctgtggcatctgtgggaagagcttcatcagcagtggagagctgaacaagcacttccgcagccacactggagagcggcccttcatctgtgagctgtgtggcaacagctacacagacatcaagaacctgaagaagcacaagaccaaggtgcacagcggggctgacaagaccctggacagcagcgctgaggaccacaccctgtctgagcaggacagcatccagaagagccccctgtctgagaccatggatgtgaagcccagcgacatgaccctgcccctggccctgcccctgggcacagaggaccaccacatgctgctgcctgtgacagacacccagagccccaccagtgacaccctgctgcggagcacagtgaatggctacagcgagccccagctgatcttcctgcagcagctgtactag

SEQ ID NO: 16164 - DNA, 1833 bp, Artificial Sequence; identical to SEQ ID NO: 16163
  Description of Artificial Sequence: Synthetic coding sequence

SEQ ID NO: 16165 - DNA, 1503 bp, Artificial Sequence
  Description of Artificial Sequence: Synthetic coding sequence
atgcagtacagccaccactgtgagcacctgctggagcggctgaacaagcagcgggaggccggcttcctgtgtgactgcaccatcgtcatcggggagttccagttcaaggcccacagaaatgtgctggccagcttcagcgagtactttggagccatctaccgcagcaccagcgagaacaacgtgttcctggaccagagccaggtgaaggcagatggcttccagaagctgctggagttcatctacacaggcaccctgaacctggacagctggaatgtgaaggagatccaccaggccgctgactacctgaaggtggaggaggtggtgaccaagtgcaagatcaagatggaggactttgccttcatcgccaaccccagcagcacagagatcagcagcatcactggaaacatcgagctgaaccagcagacctgcctgctgaccctgcgggactacaacaaccgggagaagtctgaggtgtccacagacctgatccaggccaaccccaagcagggcgccctggccaagaagagcagccagaccaagaagaagaagaaggccttcaacagccccaagacaggccagaacaagacagtgcagtaccccagcgacatcctggagaatgcctctgtggagctgttcctggatgccaacaagctgcccacccctgtggtggagcaggtggcccagatcaatgacaacagcgagctggagctgacctctgtggtggagaacaccttccctgcccaggacatcgtgcacacagtgacagtgaagaggaagaggggcaagagccagcccaactgtgccctgaaggagcacagcatgagcaacatcgcctctgtgaagagcccctatgaagcagaaaattctggagaggagctggaccagcgctacagcaaggccaagcccatgtgcaacacctgtgggaaggtgttcagcgaggccagcagcctgcggcggcacatgaggatccacaagggcgtgaagccctacgtgtgccacctgtgtgggaaggccttcacccagtgcaaccagctgaagacccacgtgaggacccacactggagagaagccctacaagtgtgagctgtgtgacaagggctttgcccagaagtgccagctggtgttccacagcaggatgcaccacggggaggagaagccctacaagtgtgatgtgtgcaacctgcagtttgccaccagcagcaacctgaagatccacgccaggaagcacagcggggagaagccctacgtgtgtgacagatgtggccagagatttgcccaggccagcaccctgacctaccacgtgagaagacacactggagagaagccctacgtgtgtgacacctgtgggaaggcctttgctgtgagcagcagcctcatcacccacagcaggaagcacactggagagaagccctacatctgtggcatctgtgggaagagcttcatcagcagtggagagctgaacaagcacttccgcagccacacagtggtgtggagcatgaactag

SEQ ID NO: 16166 - DNA, 1746 bp, Artificial Sequence
  Description of Artificial Sequence: Synthetic coding sequence
atgcagtacagccaccactgtgagcacctgctggagcggctgaacaagcagcgggaggccggcttcctgtgtgactgcaccatcgtcatcggggagttccagttcaaggcccacagaaatgtgctggccagcttcagcgagtactttggagccatctaccgcagcaccagcgagaacaacgtgttcctggaccagagccaggtgaaggcagatggcttccagaagctgctggagttcatctacacaggcaccctgaacctggacagctggaatgtgaaggagatccaccaggccgctgactacctgaaggtggaggaggtggtgaccaagtgcaagatcaagatggaggactttgccttcatcgccaaccccagcagcacagagatcagcagcatcactggaaacatcgagctgaaccagcagacctgcctgctgaccctgcgggactacaacaaccgggagaagtctgaggtgtccacagacctgatccaggccaaccccaagcagggcgccctggccaagaagagcagccagaccaagaagaagaagaaggccttcaacagccccaagacaggccagaacaagacagtgcagtaccccagcgacatcctggagaatgcctctgtggagctgttcctggatgccaacaagctgcccacccctgtggtggagcaggtggcccagatcaatgacaacagcgagctggagctgacctctgtggtggagaacaccttccctgcccaggacatcgtgcacacagtgacagtgaagaggaagaggggcaagagccagcccaactgtgccctgaaggagcacagcatgagcaacatcgcctctgtgaagagcccctatgaagcagaaaattctggagaggagctggaccagcgctacagcaaggccaagcccatgtgcaacacctgtgggaaggtgttcagcgaggccagcagcctgcggcggcacatgaggatccacaagggcgtgaagccctacgtgtgccacctgtgtgggaaggccttcacccagtgcaaccagctgaagacccacgtgaggacccacactggagagaagccctacaagtgtgagctgtgtgacaagggctttgcccagaagtgccagctggtgttccacagcaggatgcaccacggggaggagaagccctacaagtgtgatgtgtgcaacctgcagtttgccaccagcagcaacctgaagatccacgccaggaagcacagcggggagaagccctacgtgtgtgacagatgtggccagagatttgcccaggccagcaccctgacctaccacgtgagaagacacactggagagaagccctacgtgtgtgacacctgtgggaaggcctttgctgtgagcagcagcctcatcacccacagcaggaagcacactggagagaagccctacatctgtggcatctgtgggaagagcttcatcagcagtggagagctgaacaagcacttccgcagccacactggagctgacaagaccctggacagcagcgctgaggaccacaccctgtctgagcaggacagcatccagaagagccccctgtctgagaccatggatgtgaagcccagcgacatgaccctgcccctggccctgcccctgggcacagaggaccaccacatgctgctgcctgtgacagacacccagagccccaccagtgacaccctgctgcggagcacagtgaatggctacagcgagccccagctgatcttcctgcagcagctgtactag

SEQ ID NO: 16167 - DNA, 1167 bp, Artificial Sequence
  Description of Artificial Sequence: Synthetic coding sequence
atgctgaaggtgaagaggctggaggagttcaacacctgctacaacagcaaccagctggagaagatggccttcttccagtgccgggaggaggtggagaaggtgaagtgcttcctggagaagaacagcggggaccaggacagccgcagcggccacaatgaggccaaggaggtgtggagcaatgctgacctgacagagaggatgcctgtgaagagcaagaggaccagcgccctggccgtggacatcccagcccccccagccccctttgaccaccgcatcgtgacagccaagcagggcgctgtgaacagcttctacacagtgtccaagacagagatcctgggcggcggccgcttcggccaggtgcacaagtgtgaggagacagccaccggcctgaagctggccgccaagatcatcaagacccggggcatgaaggacaaggaggaggtgaagaatgagatctctgtgatgaaccagctggaccacgccaacctgatccagctgtatgatgcctttgagagcaagaatgacatcgtgctggtgatggagtatgtggatggaggagagctgtttgaccgcatcattgatgagagctacaacctgacagagctggacaccatcctcttcatgaagcagatctgtgagggcatccgccacatgcaccagatgtacatcctgcacctggacctgaagaccaccagcttccagtgcagccgcttcctgattgacaccagcatcctgcccctgtgcctgctgaactgccgctacaagccccgggagaagctgaaggtgaactttggcaccccagagttcctggcccctgaggtggtgaactatgactttgtgtccttccccacagacatgtggagcgtgggcgtcatcgcctacatgctgctgagcggcctgagccccttcctgggggacaatgatgctgagaccctgaacaacatcctggcctgccgctgggacctggaggatgaggagttccaggacatcagcgaggaggccaaggagttcatcagcaagctgctgatcaaggagaagtcctggaggatcagcgccagcgaggccctgaagcacccctggctgagtgaccacaagctgcacagccggctgaatgcccagaagaagaagaacagaggaagtgatgcccaggactttgtgaccaagtag

SEQ ID NO: 16168 - DNA, 1167 bp, Artificial Sequence
  Description of Artificial Sequence: Synthetic coding sequence
atgctgaaggtgaagaggctggaggagttcaacacctgctacaacagcaaccagctggagaagatggccttcttccagtgccgggaggaggtggagaaggtgaagtgcttcctggagaagaacagcggggaccaggacagccgcagcggccacaatgaggccaaggaggtgtggagcaatgctgacctgacagagaggatgcctgtgaagagcaagaggaccagcgccctggccgtggacatcccagcccccccagccccctttgaccaccgcatcgtgacagccaagcagggcgctgtgaacagcttctacacagtgtccaagacagagatcctgggcggcggccgcttcggccaggtgcacaagtgtgaggagacagccaccggcctgaagctggccgccaagatcatcaagacccggggcatgaaggacaaggaggaggtgaagaatgagatctctgtgatgaaccagctggaccacgccaacctgatccagctgtatgatgcctttgagagcaagaatgacatcgtgctggtgatggagtatgtggatggaggagagctgtttgaccgcatcattgatgagagctacaacctgacagagctggacaccatcctcttcatgaagcagatctgtgagggcatccgccacatgcaccagatgtacatcctgcacctggacctgaagccagagaacatcctgtgtgtgaacagagatgccaagcagatcaagatcatcgactttggcctggcccggcgctacaagccccgggagaagctgaaggtgaactttggcaccccagagttcctggcccctgaggtggtgaactatgactttgtgtccttccccacagacatgtggagcgtgggcgtcatcgcctacatgctgctgagcggcctgagccccttcctgggggacaatgatgctgagaccctgaacaacatcctggcctgccgctgggacctggaggatgaggagttccaggacatcagcgaggaggccaaggagttcatcagcaagctgctgatcaaggagaagtcctggaggatcagcgccagcgaggccctgaagcacccctggctgagtgaccacaagctgcacagccggctgaatgcccagaagaagaagaacagaggaagtgatgcccaggactttgtgaccaagtag

SEQ ID NO: 16169 - DNA, 576 bp, Artificial Sequence
  Description of Artificial Sequence: Synthetic coding sequence
atggccatgcacaacaaggccgccccaccccagatcccagacacccggcgggagctggccgagctggtgaagaggaagcaggagctggccgagaccctggccaacctggagcggcagatctatgcctttgagggcagctacctggaggacacccagatgtatggcaacatcatccggggctgggaccgctacctgaccaaccagaagaacagcaacagcaagaatgacagaagaaacaggaagttcaaggaggccgagcggctcttcagcaagagctctgtgaccagcgctgctgctgtgtctgccctggccggcgtgcaggaccagctgattgagaagcgggagcccggcagcggcacagaaagtgacaccagcccagacttccacaaccaggagaatgagcccagccaggaggaccctgaggacctggatggctctgtgcagggcgtgaagccccagaaggccgccagcagcaccagcagcggcagccaccacagcagccacaagaagaggaagaacaagaacagacacagaattgacctgaagctgaacaagaagcccagggctgactactag

SEQ ID NO: 16170 - DNA, 579 bp, Artificial Sequence
  Description of Artificial Sequence: Synthetic coding sequence
atggccatgcacaacaaggccgccccaccccagatcccagacacccggcgggagctggccgagctggtgaagaggaagcaggagctggccgagaccctggccaacctggagcggcagatctatgcctttgagggcagctacctggaggacacccagatgtatggcaacatcatccggggctgggaccgctacctgaccaaccagaagaacagcaacagcaagaatgacagaagaaacaggaagttcaaggaggccgagcggctcttcagcaagagctctgtgaccagcgctgctgctgtgtctgccctggccggcgtgcaggaccagctgattgagaagcgggagcccggcagcggcacagaaagtgacaccagcccagacttccacaaccaggagaatgagcccagccaggaggaccctgaggacctggatggctctgtgcagggcgtgaagccccagaaggccgccagcagcaccagcagcggcagccaccacagcagccacaagaagaggaagaacaagaacagacacaggatgaatgtgagccccaagacaggctggcaccagctgcacctgtag

SEQ ID NO: 16171 - DNA, 510 bp, Artificial Sequence
  Description of Artificial Sequence: Synthetic coding sequence
atgagcctcttcttcatcagccaggagaccctggccaacctggagcggcagatctatgcctttgagggcagctacctggaggacacccagatgtatggcaacatcatccggggctgggaccgctacctgaccaaccagaagaacagcaacagcaagaatgacagaagaaacaggaagttcaaggaggccgagcggctcttcagcaagagctctgtgaccagcgctgctgctgtgtctgccctggccggcgtgcaggaccagctgattgagaagcgggagcccggcagcggcacagaaagtgacaccagcccagacttccacaaccaggagaatgagcccagccaggaggaccctgaggacctggatggctctgtgcagggcgtgaagccccagaaggccgccagcagcaccagcagcggcagccaccacagcagccacaagaagaggaagaacaagaacagacacagaattgacctgaagctgaacaagaagcccagggctgactactag

SEQ ID NO: 16172 - DNA, 606 bp, Artificial Sequence
  Description of Artificial Sequence: Synthetic coding sequence
atggccatgcacaacaaggccgccccaccccagatcccagacacccggcgggagctggccgagctggtgaagaggaagcaggagctggccgagaccctggccaacctggagcggcagatctatgcctttgagggcagctacctggaggacacccagatgtatggcaacatcatccggggctgggaccgctacctgaccaaccagaagaacagcaacagcaagaatgacagaagaaacaggaagttcaaggaggccgagcggctcttcagcaagagctctgtgaccagcgctgctgctgtgtctgccctggccggcgtgcaggaccagctgattgagaagcgggagcccggcagcggcacagaaagtgacaccagcccagacttccacaaccaggagaatgagcccagccaggaggaccctgaggacctggatggctctgtgcagggcgtgaagccccagaaggccgccagcagcaccagcagcggcagccaccacagcagccacaagaagaggaagaacaagaacagacacagccccagcggcatgtttgattatgactttgaaattgacctgaagctgaacaagaagcccagggctgactactag

SEQ ID NO: 16173 - DNA, 576 bp, Artificial Sequence
  Description of Artificial Sequence: Synthetic coding sequence
atggccatgcacaacaaggccgccccaccccagatcccagacacccggcgggagctggccgagctggtgaagaggaagcaggagctggccgagaccctggccaacctggagcggcagatctatgcctttgagggcagctacctggaggacacccagatgtatggcaacatcatccggggctgggaccgctacctgaccaaccagaagaacagcaacagcaagaatgacagaagaaacaggaagttcaaggaggccgagcggctcttcagcaagagctctgtgaccagcgctgctgctgtgtctgccctggccggcgtgcaggaccagctgattgagaagcgggagcccggcagcggcacagaaagtgacaccagcccagacttccacaaccaggagaatgagcccagccaggaggaccctgaggacctggatggctctgtgcagggcgtgaagccccagaaggccgccagcagcaccagcagcggcagccaccacagcagccacaagaagaggaagaacaagaacagacacagccccagcggcatgtttgattatgactttgaatatgtgtactag

SEQ ID NO: 16174 - DNA, 291 bp, Artificial Sequence
  Description of Artificial Sequence: Synthetic coding sequence
atgaccagcgccctggagaactacatcaacagaacagtggccgtcatcaccagtgatggccgcatgattgtgggcaccctgaagggctttgaccagaccatcaacctgatcctggatgagagccatgagagggtcttcagcagcagccagggcgtggagcaggtggtgctgggcctgtacatcgtgcggggggacaacgtggccgtcatcggggagattgatgaggagacagattctgccctggacctgggcaacatccgggcagagcccctgaacagcgtggcccactag

SEQ ID NO: 16175 - DNA, 1764 bp, Artificial Sequence
  Description of Artificial Sequence: Synthetic coding sequence
atgagccagatgctgcacatcgagatccccaactttggaaacacagtgctgggctgcctgaatgagcagaggctgctgggcctgtactgtgatgtgtccatcgtggtgaagggccaggccttcaaggcccacagagctgtgctggccgccagcagcctgtacttccgggacctcttcagcggcaacagcaagagcgcctttgagctgcccggctctgtgcccccagcctgcttccagcagatcctgtccttctgctacacaggccgcctgaccatgacagccagcgagcagctggtggtgatgtacacagctggcttcctgcagatccagcacatcgtggagcggggcacagacctgatgttcaaggtgagcagcccccactgtgacagccagacagctgtgattgaagatgctggcagcgagccccagagcccctgcaaccagctgcagcctgctgctgctgctgctgccccctacgtggtgagccccagcgtgcccatccccctgctgaccagggtgaagcatgaggccatggagctgcccccagctggccctggcctggcccccaagaggcccctggagaccggccccagagatggagtggccgtggccgccggggctgctgtggccgccggcacagcccccctgaagctgccccgggtgtcctactacggcgtgcccagcctggccaccctcatccctggcatccagcagatgccctacccccagggcgagaggaccagccctggggccagcagcctgcccaccacagacagccccaccagctaccacaatgaagaagatgaggaggatgatgaggcctatgacaccatggtggaggagcagtatggccagatgtacatcaaggccagcggcagctatgctgtgcaggagaagccagagcctgtgcccctggagagccgcagctgtgtgctgatccggcgggacctggtggccctgcctgccagcctcatcagccagatcggctaccgctgccaccccaagctgtacagcgagggggaccccggggagaagctggagctggtggccggcagcggcgtgtacatcacccggggccagctgatgaactgccacctgtgtgccggcgtgaagcacaaggtgctgctgcggcggctgctggccaccttctttgacaggaacaccctggccaacagctgtggcaccggcatccgcagcagcaccagtgaccccagcaggaagcccctggacagccgggtgctgaatgctgtgaagctgtactgccagaactttgcccccagcttcaaggagagcgagatgaatgtgattgctgctgacatgtgcaccaatgccaggagagtgaggaagcgctggctgcccaagatcaagtccatgctgcctgagggcgtggagatgtacagaacagtgatgggcagcgctgctgcctctgtgcccctggaccctgagttccccccagctgctgcccaggtgtttgagcagaggatctatgcagagaggagaggagatgctgccaccatcgtggccctgaggacagatgctgtgaatgtggacctgtctgctgctgccaacccagcctttgatgctggggaggaggtggatggagctggcagcgtcatccaggaggtggccgcccctgagcccctgcctgcagatggccagagccccccccagccctttgagcagggcggcggcggccccagccggccccagaccccagctgctgctgcccggcggcctgagggcacctacgccggcaccctgtag

SEQ ID NO: 16176 - DNA, 1764 bp, Artificial Sequence; identical to SEQ ID NO: 16175
  Description of Artificial Sequence: Synthetic coding sequence

SEQ ID NO: 16177 - DNA, 3078 bp, Artificial Sequence
  Description of Artificial Sequence: Synthetic coding sequence
atgcacaggaagaaggtggacaaccgcatccgcatcctgattgaaaatggagtggccgagcggcagaggagcctgtttgtggtggtgggggaccggggcaaggaccaggtggtgatcctgcaccacatgctgagcaaggccaccgtgaaggcccggcccagcgtgctgtggtgctacaagaaggagctgggcttcagcagccacaggaagaagaggatgaggcagctgcagaagaagatcaagaatggcaccctgaacatcaagcaggatgacccctttgagctgttcatcgccgccaccaacatccgctactgctactacaatgagacccacaagatcctgggcaacaccttcggcatgtgtgtgctgcaggactttgaggccctgacccccaacctgctggccaggacagtggagaccgtggagggcggcggcctggtggtgatcctgctgcggaccatgaacagcctgaagcagctgtacacagtgaccatggatgtgcacagccgctacagaacagaggcccaccaggatgtggtgggccgcttcaatgaacgcttcatcctgagcctggccagctgcaagaagtgcctggtgattgatgaccagctgaacatcctgcccatcagcagccacgtggccaccatggaggccctgcccccccagaccccagatgagagcctgggccccagcgacctggagctgcgggagctgaaggagagcctgcaggacacccagcctgtgggcgtgctggtggactgctgcaagaccctggaccaggccaaggctgtgctgaagttcatcgagggcatcagcgagaagaccctgcggagcacagtggccctgacagctgcccggggccggggcaagtctgctgccctgggcctggccatcgccggggctgtggccttcggctacagcaacatctttgtgaccagccccagcccagacaacctgcacaccctgtttgaatttgtgttcaagggctttgatgccctgcagtaccaggagcacctggactatgagatcatccagagcctgaaccctgagttcaacaaggccgtcatccgggtgaatgtgttccgggagcaccggcagaccatccagtacatccacccagcagatgctgtgaagctgggccaggccgagctggtggtgattgatgaggccgccgccatccccctgcccctggtgaagagcctgctgggcccctacctggtgttcatggccagcaccatcaatggctatgagggcaccggccgcagcctgagcctgaagctgatccagcagctgcggcagcagagcgcccagagccaggtgtccaccacagctgagaacaagaccaccaccacagcccggctggccagcgcccggaccctgtatgaggtgtccctgcaggagagcatccgctatgcccctggagatgctgtggagaagtggctgaatgacctgctgtgcctggactgcctgaacatcaccagaattgtgtctggctgccccctgcctgaggcctgtgagctgtactacgtgaacagagacaccctcttctgctaccacaaggccagcgaggtgttcctgcagaggctgatggccctgtatgtggccagccactacaagaacagccccaatgacctgcagatgctgagtgatgccccagcccaccacctgttctgcctgctgccccctgtgccccccacccagaatgccctgcctgaggtgctggccgtcatccaggtgtgcctggagggggagatcagccggcagagcatcctgaacagcctgagccggggcaagaaggccagcggggacctgatcccctggacagtgtctgagcagttccaggaccctgactttggaggcctgagcggcggccgggtggtgagaattgctgtgcacccagactaccagggcatgggctacggcagccgggccctgcagctgctgcagatgtactatgagggccgcttcccctgcctggaggagaaggtgctggagaccccccaggagatccacacagtgtcctctgaggccgtgtccctgctggaggaggtgatcacccccaggaaggacctgccccccctgctgctgaagctgaatgaaagacctgctgagcggctggactacctgggcgtgtcctatggcctgaccccccggctgctgaagttctggaagagagctggctttgtgcctgtgtacctgcggcagaccccaaatgacctgactggagagcacagctgcatcatgctgaagaccctgacagatgaagatgaggccgaccagggcggctggctggccgccttctggaaggacttcagaagacgcttcctggccctgctgagctaccagttcagcaccttcagccccagcctggccctgaacatcatccagaacagaaacatgggcaagccagcccagcctgccctgagccgggaggagctggaggccctcttcctgccctatgacctgaagaggctggagatgtacagcaggaacatggtggactaccacctgatcatggacatgatcccagccatcagccgcatctacttcctgaaccagctgggggacctggccctgtctgctgcccagagcgccctgctgctgggcatcggcctgcagcacaagtctgtggaccagctggagaaggagattgagctgcccagcggccagctgatgggcctcttcaaccgcatcatcaggaaggtggtgaagctgttcaatgaggtgcaggagaaggccatcgaggagcagatggtggccgccaaggatgtggtgatggagcccaccatgaagaccctgagtgatgacctggatgaggccgccaaggagttccaggagaagcacaagaaggaggtgggcaagctgaagtccatggacctgtctgagtacatcatcagaggagatgatgaggagtggaatgaggtgctgaacaaggccggccccaatgccagcatcatcagcctgaagagtgacaagaagaggaagctggaggccaagcaggagcccaagcagagcaagaagctgaagaaccgggagaccaagaacaagaaggacatgaagctgaagaggaagaagtag

SEQ ID NO: 16178 - DNA, 2862 bp, Artificial Sequence
  Description of Artificial Sequence: Synthetic coding sequence
atgaggcagctgcagaagaagatcaagaatggcaccctgaacatcaagcaggatgacccctttgagctgttcatcgccgccaccaacatccgctactgctactacaatgagacccacaagatcctgggcaacaccttcggcatgtgtgtgctgcaggactttgaggccctgacccccaacctgctggccaggacagtggagaccgtggagggcggcggcctggtggtgatcctgctgcggaccatgaacagcctgaagcagctgtacacagtgaccatggatgtgcacagccgctacagaacagaggcccaccaggatgtggtgggccgcttcaatgaacgcttcatcctgagcctggccagctgcaagaagtgcctggtgattgatgaccagctgaacatcctgcccatcagcagccacgtggccaccatggaggccctgcccccccagaccccagatgagagcctgggccccagcgacctggagctgcgggagctgaaggagagcctgcaggacacccagcctgtgggcgtgctggtggactgctgcaagaccctggaccaggccaaggctgtgctgaagttcatcgagggcatcagcgagaagaccctgcggagcacagtggccctgacagctgcccggggccggggcaagtctgctgccctgggcctggccatcgccggggctgtggccttcggctacagcaacatctttgtgaccagccccagcccagacaacctgcacaccctgtttgaatttgtgttcaagggctttgatgccctgcagtaccaggagcacctggactatgagatcatccagagcctgaaccctgagttcaacaaggccgtcatccgggtgaatgtgttccgggagcaccggcagaccatccagtacatccacccagcagatgctgtgaagctgggccaggccgagctggtggtgattgatgaggccgccgccatccccctgcccctggtgaagagcctgctgggcccctacctggtgttcatggccagcaccatcaatggctatgagggcaccggccgcagcctgagcctgaagctgatccagcagctgcggcagcagagcgcccagagccaggtgtccaccacagctgagaacaagaccaccaccacagcccggctggccagcgcccggaccctgtatgaggtgtccctgcaggagagcatccgctatgcccctggagatgctgtggagaagtggctgaatgacctgctgtgcctggactgcctgaacatcaccagaattgtgtctggctgccccctgcctgaggcctgtgagctgtactacgtgaacagagacaccctcttctgctaccacaaggccagcgaggtgttcctgcagaggctgatggccctgtatgtggccagccactacaagaacagccccaatgacctgcagatgctgagtgatgccccagcccaccacctgttctgcctgctgccccctgtgccccccacccagaatgccctgcctgaggtgctggccgtcatccaggtgtgcctggagggggagatcagccggcagagcatcctgaacagcctgagccggggcaagaaggccagcggggacctgatcccctggacagtgtctgagcagttccaggaccctgactttggaggcctgagcggcggccgggtggtgagaattgctgtgcacccagactaccagggcatgggctacggcagccgggccctgcagctgctgcagatgtactatgagggccgcttcccctgcctggaggagaaggtgctggagaccccccaggagatccacacagtgtcctctgaggccgtgtccctgctggaggaggtgatcacccccaggaaggacctgccccccctgctgctgaagctgaatgaaagacctgctgagcggctggactacctgggcgtgtcctatggcctgaccccccggctgctgaagttctggaagagagctggctttgtgcctgtgtacctgcggcagaccccaaatgacctgactggagagcacagctgcatcatgctgaagaccctgacagatgaagatgaggccgaccagggcggctggctggccgccttctggaaggacttcagaagacgcttcctggccctgctgagctaccagttcagcaccttcagccccagcctggccctgaacatcatccagaacagaaacatgggcaagccagcccagcctgccctgagccgggaggagctggaggccctcttcctgccctatgacctgaagaggctggagatgtacagcaggaacatggtggactaccacctgatcatggacatgatcccagccatcagccgcatctacttcctgaaccagctgggggacctggccctgtctgctgcccagagcgccctgctgctgggcatcggcctgcagcacaagtctgtggaccagctggagaaggagattgagctgcccagcggccagctgatgggcctcttcaaccgcatcatcaggaaggtggtgaagctgttcaatgaggtgcaggagaaggccatcgaggagcagatggtggccgccaaggatgtggtgatggagcccaccatgaagaccctgagtgatgacctggatgaggccgccaaggagttccaggagaagcacaagaaggaggtgggcaagctgaagtccatggacctgtctgagtacatcatcagaggagatgatgaggagtggaatgaggtgctgaacaaggccggccccaatgccagcatcatcagcctgaagagtgacaagaagaggaagctggaggccaagcaggagcccaagcagagcaagaagctgaagaaccgggagaccaagaacaagaaggacatgaagctgaagaggaagaagtag

SEQ ID NO: 16179 - DNA, 711 bp, Artificial Sequence
  Description of Artificial Sequence: Synthetic coding sequence
atgaccagcgagaagggccccagcactggagaccccaccctgcggcggcgcatcgagccctgggagtttgatgtgttctatgacccccgggagctgaggaaggaggcctgcctgctgtatgagatcaagtggggcatgagcaggaagatctggaggagcagcggcaagaacaccaccaaccacgtggaggtgaacttcatcaagaagttcaccagcgagcgggacttccaccccagcatgagctgcagcatcacctggttcctgtcctggagcccctgctgggagtgcagccaggccatccgggagttcctgagccgccaccctggggtgaccctggtgatctacgtggcccggctcttctggcacatggaccagcagaaccggcagggcctgcgggacctggtgaacagcggcgtgaccatccagatcatgagggccagcgagtactaccactgctggaggaactttgtgaactacccacctggagatgaggcccactggccccagtacccacccctgtggatgatgctgtatgccctggagctgcactgcatcatcctgagcctgcccccctgcctgaagatcagccgccgctggcagaaccacctgaccttcttccggctgcacctgcagaactgccactaccagaccatccccccccacatcctgctggccaccggcctcatccaccccagcgtggcctggaggtag

SEQ ID NO: 16180 - DNA, 870 bp, Artificial Sequence
  Description of Artificial Sequence: Synthetic coding sequence
atgtctgtggaccctgcctgcccccagagcctgccctgctttgaggccagtgactgcaaggagagcagccccatgcctgtgatctgtggccctgaggagaactaccccagcctgcagatgagcagcgctgagatgccccacacagagaccgtgagccccctgcccagctccatggacctgctgatccaggacagcccagacagcagcaccagccccaagggcaagcagcccaccagcgctgagaagtctgtggccaagaaggaggacaaggtgcctgtgaagaagcagaagaccaggacagtgttcagcagcacccagctgtgtgtgctgaatgaccgcttccagaggcagaagtacctgagcctgcagcagatgcaggagctgagcaacatcctgaacctgagctacaagcaggtgaagacctggttccagaaccagaggatgaagagcaagcgctggcagaagaacaactggcccaagaacagcaatggagtgacccagggctgcctggtgaaccccaccggcaacctgcccatgtggagcaaccagacctggaacaacagcacctggagcaaccagacccagaacatccagagctggagcaaccacagctggaacacccagacctggtgcacccagagctggaacaaccaggcctggaacagccccttctacaactgtggggaggagagcctgcagagctgcatgcagttccagcccaacagccctgccagtgacctggaggccgccctggaggccgccggggagggcctgaatgtcatccagcagaccacccgctacttcagcaccccccagaccatggacctcttcctgaactacagcatgaacatgcagccagaagatgtgtag

SEQ ID NO: 16181 - DNA, 567 bp, Artificial Sequence
  Description of Artificial Sequence: Synthetic coding sequence
atgcaccgggcccgctggctgacccctgtgatcccagccctgtgggaggccgaggccggccgcagccggggccaggagattgagaccatcctggccaacaagaagcagagcgccatgccctgggaccaggaccctgagcagagcactggaaactacagtgaagatgagcagaatggcaagcagaagtggagggaggagggggaggccggcaggaagcgggagcgggagaaggaggagaagaatgagaaggagctgcaggatgagcaggagaacaagaggaagcgggagaatgagaagcagaagcagtacccagagaagaggctggtgtccaagagcctgatgcacaccctgtgggccaagttcaagctgaaccgctgccccaccatccaggagagcctgagcctgagctttgaatttgacatgacccacaagcagatcagccagtggttctgcaagaccaggaagaagtacaacaaggagatgagcaagaggaagcacaagaagaagcacatgcgctggaggagcctgtgctgccagggctggagcaggaccccagccctgaagtag

SEQ ID NO: 16182 - DNA, 2691 bp, Artificial Sequence
  Description of Artificial Sequence: Synthetic coding sequence
atggccgcccgggctgtgctggatgagttcaccgccccagctgagaaggccgagctgctggagcagagccggggcagaattgagggcctgtttggagtgtccctggccgtgctgggcgccctgggcgctgaggagcccctgcctgcccgcatctggctgcagctgtgtggggcccaggaggccgtgcacagcgccaaggagtacatcaagggcatctgtgagcctgagctggaggagcgggagtgctaccccaaggacatgcactgcatctttgtgggcgctgagagcctcttcctgaagagcctcatccaggacacctgtgccgacctgtgcatcctggacatcggcctgctgggcatccggggcagcgctgaggccgtggtgatggcccggagccacatccagcagtttgtgaagctgtttgagaacaaggagaacctgcccagcagccagaaggagagcgaggtgaagcgggagttcaagcagtttgtggaggcccacgccgacaactacaccatggacctgctgatcctgcccaccagcctgaagaaggagctgctgaccctgacccagggcgaggagaacctgtttgaaacaggagatgatgaggtgattgagatgagggacagccagcagacagagttcacccagaatgctgccaccggcctgaacatcagcagagatgagaccgtgctgcaggaggaggccaggaacaaggccggcacccctgtgtctgagctgaccaagcagatggacacagtgctgagcagcagcccagatgtgctgtttgaccccatcaatggcctgaccccagatgaggaggccctgagcaatgaaagaatctgccagaagaggcgcttcagtgacagcgaggagcggcacaccaagaagcagttcagcctggagaatgtgcaggagggggagatcctgcatgatgccaagaccctggccggaaatgtgattgctgacctgagtgacagcagcgctgacagcgagaacctgagcccagacatcaaggagaccacagaggagatggagtacaacatcctggtgaacttcttcaagaccatgggctacagccaggagatcgtggagaaggtgatcaaggtgtatggccccagcacagagcccctgctgctgctggaggagattgagaaggagaacaagcgcttccaggaggaccgggagttctctgctggcaccgtgtacccagagaccaacaagaccaagaacaagggcgtgtacagcagcaccaatgagctgaccacagacagcacccccaagaagacccaggcccacacccagcagaacatggtggagaagttcagccagctgcccttcaaggtggaggccaagccctgcaccagcaactgccgcatcaacaccttcagaacagtgcccatcgagcagaagcatgaggtgtggggcagcaaccagaactacatctgcaacacagatcctgagacagatggcctgagccccagcgtggccagccccagccccaaggaggtgaactttgtgtccagaggagccagcagccaccagccccgggtgcccctcttcccagaaaatggcctgcaccagcagcctgagcccctgctgcccaacaacatgaagagcgcctgtgagaagaggctgggctgctgcagcagcccccacagcaagcccaactgcagcaccctgagcccccccatgcccctgccccagctgctgcccagcgtgacagatgcccggtctgctggccccagcgaccacatcgacagctctgtgactggagtgcagcgcttccgggacaccctgaagatcccctacaagctggagctgaagaatgagcccggccgcacagacctgaagcacatcgtgattgatggcagcaatgtggccatcacccacggcctgaagaagttcttcagctgccggggcatcgccatcgctgtggagtacttctggaagctgggcaacagaaacatcaccgtgtttgtgccccagtggaggacccggcgggaccccaacgtgacagagcagcacttcctgacccagctgcaggagctgggcatcctgagcctgaccccagccaggatggtgtttggagagcgcatcgccagccatgatgaccgcttcctgctgcacctggccgacaagacaggaggcatcatcgtgaccaatgacaacttccgggagtttgtgaatgaatctgtgtcctggagggagatcatcaccaagaggctgctgcagtacacctttgtgggggacatcttcatggtgcctgatgaccccctgggccgcagcggcccccggctggaggagttcctgcagaaggaggtgtgcctgcgggacatgcagcccctgctgagcgccctgcccaacgtgggcatgtttgaccccagcttccgggtgcccggcacccaggccgccagcaccagccaccagccccccacccgcatccagggcgcccccagcagccactggctgccccagcagccccacttccccctgctgcctgccctgcccagcctgcagcagaacctgcccatgcctgcccagaggagcagcgctgagaccaatgagctgcgggaggccctgctgaagatcttcccagacagcgagcagaggctgaagattgaccagatcctggtggcccacccctacatgaaggacctgaatgccctgagcgccatggtgctggactag

SEQ ID NO: 16183 - DNA, 1848 bp, Artificial Sequence
  Description of Artificial Sequence: Synthetic coding sequence
atggcccagaagaagtacctgcaggccaagctgacccagttcctgagagaagatcgcatccagctgtggaagccaccctacacagatgagaacaagaaggtgggcctggccctgaaggacctggccaagcagtacagcgaccggctggagtgctgtgaaaatgaggtggagaaggtgattgaggagatccgctgcaaggccatcgagcggggcactggaaatgacaactaccgcaccaccggcatcgccaccatcgaggtgttcctgcccccccggctgaagaaggacaggaagaacctgctggagacccggctgcacatcaccggccgggagctgcggagcaagattgctgagaccttcggcctgcaggagaactacatcaagatcgtcatcaacaagaagcagctgcagctgggcaagaccctggaggagcagggcgtggcccacaacgtgaaggccatggtgctggagctgaagcagagtgaagaagatgccaggaagaacttccagctggaggaggaggagcagaatgaggccaagctgaaggagaagcagatccagaggaccaagaggggcctggagatcctggccaagagagctgctgagaccgtggtggaccctgagatgaccccctacctggacatcgccaaccagacaggccgcagcatccgcatcccccccagcgagaggaaggccctgatgctggccatgggctaccacgagaagggccgggccttcctgaagaggaaggagtatggcatcgccctgccctgcctgctggatgctgacaagtacttctgtgagtgctgccgggagctgctggacacagtggacaactatgctgtgctgcagctggacatcgtgtggtgctacttccggctggagcagctggagtgcctggatgatgctgagaagaagctgaacctggcccagaagtgcttcaagaactgctacggggagaaccaccagaggctggtgcacatcaagggcaactgtgggaaggagaaggtgctcttcctgcggctgtacctgctgcagggcatccggaactaccacagcggaaatgatgtggaggcctatgagtacctgaacaaggcccggcagctgttcaaggagctgtacatcgaccccagcaaggtggacaacctgctgcagctgggcttcaccgcccaggaggcccggctgggcctgcgggcctgtgatggaaatgtggaccatgctgccacccacatcaccaacagaagagaggagctggcccagatcaggaaggaggagaaggagaagaagagaagaaggctggagaacatccgcttcctgaagggcatgggctacagcacccacgccgcccagcaggtgctgcatgctgccagcggcaacctggatgaggccctgaagatcctgctgagcaacccccagatgtggtggctgaatgacagcaaccctgagacagacaaccggcaggagagccccagccaggagaacatcgaccggctggtgtacatgggctttgatgccctggtggccgaggccgccctgcgggtcttcagaggaaatgtgcagctggccgcccagaccctggcccacaatggaggcagcctgcccccagagctgcccctgagccctgaggacagcctgagccccccagccaccagccccagcgacagcgctggcaccagcagcgccagcacagatgaggacatggagacagaagctgtgaatgagatcctggaggacatccctgagcacgaggaggactacctggacagcaccctggaggatgaggagatcatcatcgccgagtacctgtcctatgtggagaacaggaagagcgccaccaagaagaactag

SEQ ID NO: 16184 - DNA, 1806 bp, Artificial Sequence
  Description of Artificial Sequence: Synthetic coding sequence
atggcccagaagaagtacctgcaggccaagctgacccagttcctgagagaagatcgcatccagctgtggaagccaccctacacagatgagaacaagaaggtgggcctggccctgaaggacctggccaagcagtacagcgaccggctggagtgctgtgaaaatgaggtggagaaggtgattgaggagatccgctgcaaggccatcgagcggggcactggaaatgacaactaccgcaccaccggcatcgccaccatcgaggtgttcctgcccccccggctgaagaaggacaggaagaacctgctggagacccggctgcacatcaccggccgggagctgcggagcaagattgctgagaccttcggcctgcaggagaactacatcaagatcgtcatcaacaagaagcagctgcagctgggcaagaccctggaggagcagggcgtggcccacaacgtgaaggccatggtgctggagctgaagcagagtgaagaagatgccaggaagaacttccagctggaggaggaggagcagaatgaggccaagctgaaggagaagcagatccagaggaccaagaggggcctggagatcctggccaagagagctgctgagaccgtggtggaccctgagatgaccccctacctggacatcgccaaccagacaggccgcagcatccgcatcccccccagcgagaggaaggccctgatgctggccatgggctaccacgagaagggccgggccttcctgaagaggaaggagtatggcatcgccctgccctgcctgctggatgctgacaagtacttctgtgagtgctgccgggagctgctggacacagtggacaactatgctgtgctgcagctggacatcgtgtggtgctacttccggctggagcagctggagtgcctggatgatgctgagaagaagctgaacctggcccagaagtgcttcaagaactgctacggggagaaccaccagaggctggtgcacatcaagggcaactgtgggaaggagaaggtgctcttcctgcggctgtacctgctgcagggcatccggaactaccacagcggaaatgatgtggaggcctatgagtacctgaacaaggcccggcagctgttcaaggagctgtacatcgaccccagcaaggtggacaacctgctgcagctgggcttcaccgcccaggaggcccggctgggcctgcgggcctgtgatggaaatgtggaccatgctgccacccacatcaccaacagaagagaggagctggcccagatcaggaaggaggagaaggagaagaagagaagaaggctggagaacatccgcttcctgaagggcatgggctacagcacccacgccgcccagcagatcctgctgagcaacccccagatgtggtggctgaatgacagcaaccctgagacagacaaccggcaggagagccccagccaggagaacatcgaccggctggtgtacatgggctttgatgccctggtggccgaggccgccctgcgggtcttcagaggaaatgtgcagctggccgcccagaccctggcccacaatggaggcagcctgcccccagagctgcccctgagccctgaggacagcctgagccccccagccaccagccccagcgacagcgctggcaccagcagcgccagcacagatgaggacatggagacagaagctgtgaatgagatcctggaggacatccctgagcacgaggaggactacctggacagcaccctggaggatgaggagatcatcatcgccgagtacctgtcctatgtggagaacaggaagagcgccaccaagaagaactag

SEQ ID NO: 16185 - DNA, 465 bp, Artificial Sequence
  Description of Artificial Sequence: Synthetic coding sequence
atggcccagaagaagtacctgcaggccaagctgacccagttcctgagagaagatcgcatccagctgtggaagccaccctacacagatgagaacaagaaggtgggcctggccctgaaggacctggccaagcagtacagcgaccggctggagtgctgtgaaaatgaggtggagaaggtgattgaggagatccgctgcaaggccatcgagcggggcactggaaatgacaactaccgcaccaccggcatcgccaccatcgaggtgttcctgcccccccggctgaagaaggacaggaagaacctgctggagacccggctgcacatcaccggccgggagctgcggagcaagattgctgagaccttcggcctgcaggagaactacatcaagatcgtcatcaacaagaagcagctgcagctgggcaagaccctggaggagcagggcgtggcccacaacgtgaaggccatgtag

SEQ ID NO: 16186 - DNA, 765 bp, Artificial Sequence
  Description of Artificial Sequence: Synthetic coding sequence
atggcccagaagaagtacctgcaggccaagctgacccagttcctgagagaagatcgcatccagctgtggaagccaccctacacagatgagaacaagaaggtgggcctggccctgaaggacctggccaagcagtacagcgaccggctggagtgctgtgaaaatgaggtggagaaggtgattgaggagatccgctgcaaggccatcgagcggggcactggaaatgacaactaccgcaccaccggcatcgccaccatcgaggtgttcctgcccccccggctgaagaaggacaggaagaacctgctggagacccggctgcacatcaccggccgggagctgcggagcaagattgctgagaccttcggcctgcaggagaactacatcaagatcgtcatcaacaagaagcagctgcagctgggcaagaccctggaggagcagggcgtggcccacaacgtgaaggccatggtgctggagctgaagcagagtgaagaagatgccaggaagaacttccagctggaggaggaggagcagaatgaggccaagctgaaggagaagcagatccagaggaccaagaggggcctggagatcctggccaagagagctgctgagaccgtggtggaccctgagatgaccccctacctggacatcgccaaccagacaggccgcagcatccgcatcccccccagcgagaggaaggccctgatgctggccatgggctaccacgagaagggccgggccttcctgaagaggaaggagtatggcatctag

SEQ ID NO: 16187 - DNA, 495 bp, Artificial Sequence
  Description of Artificial Sequence: Synthetic coding sequence
atggcccagaagaagtacctgcaggccaagctgacccagttcctgagagaagatcgcatccagctgtggaagccaccctacacagatgagaacaagaaggtgggcctggccctgaaggacctggccaagcagtacagcgaccggctggagtgctgtgaaaatgaggtggagaaggtgattgaggagatccgctgcaaggccatcgagcggggcactggaaatgacaactaccgcaccaccggcatcgccaccatcgaggtgttcctgcccccccggctgaagaaggacaggaagaacctgctggagacccggctgcacatcaccggccgggagctgcggagcaaggctgtgcggggcggcttcaggaagtggcacgccacccacatgagaagaagaattgctgagaccttcggcctgcaggagaactacatcaagatcgtcatcaacaagaagcagctgcagctgggcccctacgtgtcctatggcatctcctag

SEQ ID NO: 16188 - DNA, 1806 bp, Artificial Sequence; identical to SEQ ID NO: 16184
  Description of Artificial Sequence: Synthetic coding sequence

SEQ ID NO: 16189 - DNA, 1920 bp, Artificial Sequence
  Description of Artificial Sequence: Synthetic coding sequence
atgaagaccaacggcggccgctgccgcatccgggccctgtgctggagcagaagagagtggagaggagctggcatggcccagaagaagtacctgcaggccaagctgacccagttcctgagagaagatcgcatccagctgtggaagccaccctacacagatgagaacaagaaggtgggcctggccctgaaggacctggccaagcagtacagcgaccggctggagtgctgtgaaaatgaggtggagaaggtgattgaggagatccgctgcaaggccatcgagcggggcactggaaatgacaactaccgcaccaccggcatcgccaccatcgaggtgttcctgcccccccggctgaagaaggacaggaagaacctgctggagacccggctgcacatcaccggccgggagctgcggagcaagattgctgagaccttcggcctgcaggagaactacatcaagatcgtcatcaacaagaagcagctgcagctgggcaagaccctggaggagcagggcgtggcccacaacgtgaaggccatggtgctggagctgaagcagagtgaagaagatgccaggaagaacttccagctggaggaggaggagcagaatgaggccaagctgaaggagaagcagatccagaggaccaagaggggcctggagatcctggccaagagagctgctgagaccgtggtggaccctgagatgaccccctacctggacatcgccaaccagacaggccgcagcatccgcatcccccccagcgagaggaaggccctgatgctggccatgggctaccacgagaagggccgggccttcctgaagaggaaggagtatggcatcgccctgccctgcctgctggatgctgacaagtacttctgtgagtgctgccgggagctgctggacacagtggacaactatgctgtgctgcagctggacatcgtgtggtgctacttccggctggagcagctggagtgcctggatgatgctgagaagaagctgaacctggcccagaagtgcttcaagaactgctacggggagaaccaccagaggctggtgcacatcaagggcaactgtgggaaggagaaggtgctcttcctgcggctgtacctgctgcagggcatccggaactaccacagcggaaatgatgtggaggcctatgagtacctgaacaaggcccggcagctgttcaaggagctgtacatcgaccccagcaaggtggacaacctgctgcagctgggcttcaccgcccaggaggcccggctgggcctgcgggcctgtgatggaaatgtggaccatgctgccacccacatcaccaacagaagagaggagctggcccagatcaggaaggaggagaaggagaagaagagaagaaggctggagaacatccgcttcctgaagggcatgggctacagcacccacgccgcccagcaggtgctgcatgctgccagcggcaacctggatgaggccctgaagatcctgctgagcaacccccagatgtggtggctgaatgacagcaaccctgagacagacaaccggcaggagagccccagccaggagaacatcgaccggctggtgtacatgggctttgatgccctggtggccgaggccgccctgcgggtcttcagaggaaatgtgcagctggccgcccagaccctggcccacaatggaggcagcctgcccccagagctgcccctgagccctgaggacagcctgagccccccagccaccagccccagcgacagcgctggcaccagcagcgccagcacagatgaggacatggagacagaagctgtgaatgagatcctggaggacatccctgagcacgaggaggactacctggacagcaccctggaggatgaggagatcatcatcgccgagtacctgtcctatgtggagaacaggaagagcgccaccaagaagaactag

SEQ ID NO: 16190 - DNA, 246 bp, Artificial Sequence
  Description of Artificial Sequence: Synthetic coding sequence
atgctgatcaaggtgaagaccctgaccgggaaggagattgaaattgatattgagcccacagacaaggtggagcgcatcaaggagcgggtggaggagaaggagggcatccccccccagcagcagaggctcatctacagcggcaagcagatgaatgatgagaagacagctgctgactacaagatcctgggcggctctgtgctgcacctggtgctggccctgcggggcggcggcggcctgcggcagtag

SEQ ID NO: 16191 - DNA, 819 bp, Artificial Sequence
  Description of Artificial Sequence: Synthetic coding sequence
atgtttgtgaagtctgagaccctggagctgaaggaggaggaggatgtgctggtgctgctgggcagcgccagccctgccctggccgccctgacccccctgagcagcagcgcagatgaggaggaggaggaggagcccggggccagcggcggggcccggcggcagagaggagctgaggccggccagggcgcccggggcggcgtggccgccggggctgagggctgcaggcctgcccggctgctgggcctggtgcatgactgcaagaggcggcccagccgggcccgggctgtgtccagaggagccaagacagctgagaccgtgcagaggatcaagaagacccggcggctgaaggccaacaaccgggagaggaacaggatgcacaacctgaatgctgccctggatgccctgcgggaggtgctgcccaccttcccagaagatgccaagctgaccaagattgagaccctgcgctttgcccacaactacatctgggccctgacagagaccctgcggctggccgaccactgcggcggcggcggcggcggcctgcccggggccctcttcagcgaggccgtgctgctgagccctgggggcgccagcgctgccctgagcagcagcggggacagccccagccctgccagcacctggagctgcaccaacagccctgcccccagcagctctgtgagcagcaacagcaccagcccctacagctgcaccctgagccctgccagccctgctggcagtgacatggactactggcagcccccacctccagacaagcacagatatgccccccacctgcccatcgcccgggactgcatctag

SEQ ID NO: 16192 - DNA, 1158 bp, Artificial Sequence
  Description of Artificial Sequence: Synthetic coding sequence
atgccccagaatgtggccaagacagagcctgtgtccatcctgcagccccagaccaccgtgaacccagaccgcatcaagcagaccctgcccagcagccccaccaccaccaagagcagccccagcgaccccatgaccaccagccgggccaaccaggtgaagatcatcgtgcccaacagcacagctggcctcatcattggaaaaggaggagccaccgtgaaggctgtgatggagcagagcggggcctgggtgcagctgagccagaagccagatggcatcaacctgcaggagcgggtggtgacagtgtctggagagcctgagcagaacaggaaggctgtggagctgatcatccagaagatccaggaggacccccagagcggcagctgcctgaacatctcctatgccaacgtgactggacctgtggccaacagcaaccccaccggcagcccctatgccaacacagctgaggtgctgcccacagctgctgctgctgctggcctgctgggccacgccaacctggccggcgtggccgccttccctgctgtgctgagcggcttcaccggaaatgacctggtggccatcaccagcgccctgaacaccctggccagctatggctacaacctgaacaccctgggcctgggcctgagccaggccgccgccaccggggccctggccgctgctgctgccagcgccaacccagctgctgctgctgccaacctgctggccacctacgccagcgaggccagcgccagcggcagcacagctgggggcacagctggcacctttgccctgggcagcctggccgccgccacagctgccaccaacggctactttggagctgccagccccctggccgccagcgccatcctgggcacagagaagagcacagatggcagcaaggatgtggtggagattgctgtgcctgagaacctggtgggcgccatcctgggcaaaggaggcaagaccctggtggagtaccaggagctgactggagcccgcatccagatcagcaagaagggggagtttgtgcccggcaccaggaacaggaaggtgaccatcaccggcaccccagctgccacccaggccgcccagtacctgatcacccagaggatcacctatgagcagggcgtgcgggccgccaacccccagaaggtgggctag

SEQ ID NO: 16193 - DNA, 546 bp, Artificial Sequence
  Description of Artificial Sequence: Synthetic coding sequence
atgatggccgccgcccccatccagcagaatggcacccacactggagtgcccatcgacctggaccccccagacagcaggaagaggcccctggaggcccctcctgaggccggcagcaccaagaggaccaacacaggagaagatggccagtacttcctgaaggtgctgatccccagctatgctgctggcagcatcattggaaaaggaggccagaccatcgtgcagctgcagaaggagactggagccaccatcaagctgagcaagagcaaggacttctacccaggcaccacagagcgggtgtgcctgatccagggcaccgtggaggccctgaatgctgtgcacggcttcatcgccgagaagatccgggagatgccccagaatgtggccaagacagagcctgtgtccatcctgcagccccagaccaccgtgaacccagaccgcatcaagcagaccctgcccagcagccccaccaccaccaagagcagccccagcgaccccatgaccaccagccgggccaaccagaagcacaacatctcctggatctcctag

SEQ ID NO: 16194 - DNA, 1452 bp, Artificial Sequence
  Description of Artificial Sequence: Synthetic coding sequence
atgatggccgccgcccccatccagcagaatggcacccacactggagtgcccatcgacctggaccccccagacagcaggaagaggcccctggaggcccctcctgaggccggcagcaccaagaggaccaacacaggagaagatggccagtacttcctgaaggtgctgatccccagctatgctgctggcagcatcattggaaaaggaggccagaccatcgtgcagctgcagaaggagactggagccaccatcaagctgagcaagagcaaggacttctacccaggcaccacagagcgggtgtgcctgatccagggcaccgtggaggccctgaatgctgtgcacggcttcatcgccgagaagatccgggagatgccccagaatgtggccaagacagagcctgtgtccatcctgcagccccagaccaccgtgaacccagaccgcatcaagcaggtgaagatcatcgtgcccaacagcacagctggcctcatcattggaaaaggaggagccaccgtgaaggctgtgatggagcagagcggggcctgggtgcagctgagccagaagccagatggcatcaacctgcaggagcgggtggtgacagtgtctggagagcctgagcagaacaggaaggctgtggagctgatcatccagaagatccaggaggacccccagagcggcagctgcctgaacatctcctatgccaacgtgactggacctgtggccaacagcaaccccaccggcagcccctatgccaacacagctgaggtgctgcccacagctgctgctgctgctggcctgctgggccacgccaacctggccggcgtggccgccttccctgctgtgctgagcggcttcaccggaaatgacctggtggccatcaccagcgccctgaacaccctggccagctatggctacaacctgaacaccctgggcctgggcctgagccaggccgccgccaccggggccctggccgctgctgctgccagcgccaacccagctgctgctgctgccaacctgctggccacctacgccagcgaggccagcgccagcggcagcacagctgggggcacagctggcacctttgccctgggcagcctggccgccgccacagctgccaccaacggctactttggagctgccagccccctggccgccagcgccatcctgggcacagagaagagcacagatggcagcaaggatgtggtggagattgctgtgcctgagaacctggtgggcgccatcctgggcaaaggaggcaagaccctggtggagtaccaggagctgactggagcccgcatccagatcagcaagaagggggagtttgtgcccggcaccaggaacaggaaggtgaccatcaccggcaccccagctgccacccaggccgcccagtacctgatcacccagaggatcacctatgagcagggcgtgcgggccgccaacccccagaaggtgggctag

SEQ ID NO: 16195 - DNA, 1524 bp, Artificial Sequence
  Description of Artificial Sequence: Synthetic coding sequence
atgatggccgccgcccccatccagcagaatggcacccacactggagtgcccatcgacctggaccccccagacagcaggaagaggcccctggaggcccctcctgaggccggcagcaccaagaggaccaacacaggagaagatggccagtacttcctgaaggtgctgatccccagctatgctgctggcagcatcattggaaaaggaggccagaccatcgtgcagctgcagaaggagactggagccaccatcaagctgagcaagagcaaggacttctacccaggcaccacagagcgggtgtgcctgatccagggcaccgtggaggccctgaatgctgtgcacggcttcatcgccgagaagatccgggagatgccccagaatgtggccaagacagagcctgtgtccatcctgcagccccagaccaccgtgaacccagaccgcatcaagcagaccctgcccagcagccccaccaccaccaagagcagccccagcgaccccatgaccaccagccgggccaaccaggtgaagatcatcgtgcccaacagcacagctggcctcatcattggaaaaggaggagccaccgtgaaggctgtgatggagcagagcggggcctgggtgcagctgagccagaagccagatggcatcaacctgcaggagcgggtggtgacagtgtctggagagcctgagcagaacaggaaggctgtggagctgatcatccagaagatccaggaggacccccagagcggcagctgcctgaacatctcctatgccaacgtgactggacctgtggccaacagcaaccccaccggcagcccctatgccaacacagctgaggtgctgcccacagctgctgctgctgctggcctgctgggccacgccaacctggccggcgtggccgccttccctgctgtgctgagcggcttcaccggaaatgacctggtggccatcaccagcgccctgaacaccctggccagctatggctacaacctgaacaccctgggcctgggcctgagccaggccgccgccaccggggccctggccgctgctgctgccagcgccaacccagctgctgctgctgccaacctgctggccacctacgccagcgaggccagcgccagcggcagcacagctgggggcacagctggcacctttgccctgggcagcctggccgccgccacagctgccaccaacggctactttggagctgccagccccctggccgccagcgccatcctgggcacagagaagagcacagatggcagcaaggatgtggtggagattgctgtgcctgagaacctggtgggcgccatcctgggcaaaggaggcaagaccctggtggagtaccaggagctgactggagcccgcatccagatcagcaagaagggggagtttgtgcccggcaccaggaacaggaaggtgaccatcaccggcaccccagctgccacccaggccgcccagtacctgatcacccagaggatcacctatgagcagggcgtgcgggccgccaacccccagaaggtgggctag

SEQ ID NO: 16196 - DNA, 1479 bp, Artificial Sequence
  Description of Artificial Sequence: Synthetic coding sequence
atggagcctgaggccccagacagcaggaagaggcccctggagaccccacctgaggtggtgtgcaccaagaggagcaacacaggagaggagggggagtacttcctgaaggtgctgatccccagctatgctgctggcagcatcatcggcaagggcggccagaccatcgtgcagctgcagaaggagaccggggccaccatcaagctgagcaagagcaaggacttctacccaggcaccacagagcgggtgtgcctggtgcagggcacagctgaggccctgaatgctgtgcacagcttcatcgccgagaaggtgcgggagatcccccaggccatgaccaagccagaggtggtgaacatcctgcagccccagaccaccatgaacccagaccgggccaagcaggccaagctgattgtgcccaacagcacagctggcctcatcatcggcaagggcggggccaccgtgaaggctgtgatggagcagagcggggcctgggtgcagctgagccagaagccagagggcatcaacctgcaggagcgggtggtgacagtgtctggagagcctgagcaggtgcacaaggctgtgtctgccatcgtgcagaaggtgcaggaggacccccagagcagcagctgcctgaacatctcctatgccaacgtggccggccctgtggccaacagcaaccccaccggcagcccctatgccagccctgcagatgtgctgcctgctgctgctgctgccagcgctgctgctgccagcggcctgctgggccctgctggcctggccggcgtgggcgccttccctgctgccctgcctgccttcagcggcacagacctgctggccatcagcacagccctgaacaccctggccagctatggctacaacaccaacagcctgggcctgggcctgaacagcgctgctgccagcggcgtgctggccgctgtggccgccggggccaacccagctgctgctgctgctgccaacctgctggccagctatgctggggaggccggggccggccctgctggaggagctgcccctcctcctcctcctcctcctggggccctgggcagctttgccctggccgctgctgccaacggctacctgggcgctggggccggcggcggggccggcggcggcggcggccccctggtggccgctgctgctgctgctggagctgctgggggcttcctgacagctgagaagctggccgctgagagcgccaaggagctggtggagattgctgtgcctgagaacctggtgggcgccatcctgggcaagggcggcaagaccctggtggagtaccaggagctgaccggggcccgcatccagatcagcaagaagggggagttcctgcccggcaccaggaacagaagagtgaccatcaccggcagccctgctgccacccaggccgcccagtacctgatcagccagagggtgacctatgagcagggcgtgcgggccagcaacccccagaaggtgggctag

SEQ ID NO: 16197 - DNA, 840 bp, Artificial Sequence
  Description of Artificial Sequence: Synthetic coding sequence
atggagaacagcgagaagacagaggtggtgctgctggcctgtggcagcttcaaccccatcaccaacatgcacctgcggctgtttgagctggccaaggactacatgaatggcaccggccgctacacagtggtgaagggcatcatcagccctgtgggagatgcctacaagaagaagggcctcatcccagcctaccacagggtcatcatggccgagctggccaccaagaacagcaagtgggtggaggtggacacctgggagagcctgcagaaggagtggaaggagaccctgaaggtgctgcggcaccaccaggagaagctggaggccagtgactgtgaccaccagcagaacagccccaccctggagaggcctggcaggaagaggaagtggacagagacccaggacagcagccagaagaagagcctggagcccaagaccaaggctgtgcccaaggtgaagctgctgtgtggggctgacctgctggagagctttgctgtgcccaacctgtggaagtctgaggacatcacccagatcgtggccaactacggcctcatctgtgtgaccagggctggaaatgatgcccagaagttcatctatgaaagtgatgtgctgtggaagcacaggagcaacatccacgtggtgaatgagtggatcgccaatgacatcagcagcaccaagatcagaagagccctgcggcggggccagagcatccgctacctggtgcctgacctggtgcaggagtacatcgagaagcacaacctgtacagcagcgagagtgaagatagaaatgctggggtcatcctggcccccctgcagaggaacacagctgaggccaagacctag

SEQ ID NO: 16198 - DNA, 483 bp, Artificial Sequence
  Description of Artificial Sequence: Synthetic coding sequence
atggagaacagcgagaagacagaggtggtgctgctggcctgtggcagcttcaaccccatcaccaacatgcacctgcggctgtttgagctggccaaggactacatgaatggcaccggccgctacacagtggtgaagggcatcatcagccctgtgggagatgcctacaagaagaagggcctcatcccagcctaccacagggtcatcatggccgagctggccaccaagaacagcaagtgggtggaggtggacacctgggagagcctgcagaaggagtggaaggagaccctgaaggtgctgcggcaccaccaggagaagctggaggccagtgactgtgaccaccagcagaacagccccaccctggagaggcctggcaggaagaggaagtggacagagacccaggacagcagccagaagaagagcctggagcccaagaccaaggatggagtgtccctgtaccaccctggctggagcgctgtggcctag

SEQ ID NO: 16199 - DNA, 840 bp, Artificial Sequence; identical to SEQ ID NO: 16197
  Description of Artificial Sequence: Synthetic coding sequence

SEQ ID NO: 16200 - DNA, 1239 bp, Artificial Sequence
  Description of Artificial Sequence: Synthetic coding sequence
atggcccctgtggagcacgtggtggctgatgctggggccttcctgcggcatgctgccctgcaggacatcggcaagaacatctacaccatccgggaggtggtgacagagatccgggacaaggccacccggcggcggctggccgtgctgccctatgagctgcgcttcaaggagcccctgcctgaatatgtgcggctggtgacagagttcagcaagaagacaggagactaccccagcctgagcgccacagacatccaggtgctggccctgacctaccagctggaggccgagtttgtgggcgtgagccacctgaagcaggagccccagaaggtgaaggtgagcagcagcatccagcaccctgagacccccctgcacatcagcggcttccacctgccctacaagcccaagccaccccaggagacagagaagggccacagcgcctgtgagcctgagaacctggagttcagcagcttcatgttctggaggaaccccctgcccaacatcgaccacgagctgcaggagctgctgattgacagaggagaagatgtgcccagcgaggaggaggaggaggaggagaatggatttgaggacaggaaggatgacagtgatgatgatggcggcggctggatcacccccagcaacatcaagcagatccagcaggagctggagcagtgtgatgtgcctgaagatgtgcgggtgggctgcctgaccacagactttgccatgcagaatgtgctgctgcagatgggcctgcacgtgctggccgtgaatggcatgctgatccgggaggcccggagctacatcctgcgctgccacggctgcttcaagaccaccagtgacatgagcagggtcttctgcagccactgcggcaacaagaccctgaagaaggtgtctgtgacagtgtctgatgatggcaccctgcacatgcacttcagcaggaaccccaaggtgctgaacccccggggcctgcgctacagcctgcccacccccaagggcggcaagtatgccatcaacccccacctgacagaggaccagcgcttcccccagctgcggctgagccagaaggcccggcagaagaccaacgtgtttgccccagactacatcgccggcgtgagcccctttgtggagaatgacatcagcagccgcagcgccaccctgcaggtgcgggacagcaccctgggcgccggcagaagaaggctgaaccccaatgccagcaggaagaagtttgtgaagaagaggtag

SEQ ID NO: 16201 - DNA, 1236 bp, Artificial Sequence
  Description of Artificial Sequence: Synthetic coding sequence
atggatggccgggcagagctgcctgccttccccagggctggggccccacccctggccgccagtgacacagtgcctgctgcccctgagggcgctggggccgcccggcctgctgcccccctgcggcccaccagcttctctgtgctggacatcctggaccccaacaagttcaacagcagaagaagaagatgtgtgctgctgggccctgtggccccagctgcctgtgccccctgtgccagcgccccctgtgccccagccccagctgccagcggccggccccccagggctgaggagctggagcggcgggccctggccggggccggcggcgtgggcgccgccggggctgagcccccaaatgctggggaccccttcaaggccggggaggccgagaccaatgacaccaacggctacagcagcggcggcggcggccacagccccagcgctgacagcggagatgaggtgcctgatgatgaagatgatgatgaagatgaggcccctgagacagaagctgcccggggagctgaggaggcccggggcggcggcggcggcctgggcgcccggggcagcggctgccagggcgctgctgagacagatgccagccctggggccaccgtggatgaagctgctgcccctggcccccgggagaacagccctgtggcccagggccccccaggaggagctgctgcccctggaggagctggcaccaccccccagggcacagccacagctgccaagcccaagaggaagaggacaggcagtgacagcaagagcggcaagccccggcgggccaggacagccttcacctatgagcagctggtggccctggagaacaagttcaaggccacccgctacctgtctgtgtgtgagcggctgaacctggccctgagcctgagcctgacagagacccaggtgaagatctggttccagaacagaaggaccaagtggaagaagcagaaccctggagctgacaccagcgcccccactggaggcggcggcggccctggccctggagctggccctggcaccggcctgcccggcggcctgagccccctgagccccagcccccccatgggcgcccccctgggcatgcacggccctgctggctacccagcccacggccctgggggcctggtgtgtgccgcccagctgcccttcctgagcagccctgctgtgctgagcccctttgtgctgggcagccagacctatggagccccagccttctacgccccccacctgtag

SEQ ID NO: 16202 - DNA, 1095 bp, Artificial Sequence
  Description of Artificial Sequence: Synthetic coding sequence
atgatgctgcccagccctgtgaccagcacccccttctctgtgaaggacatcctgaacctggagcagcagcaccagcacttccacggggcccacctgcaggccgacctggagcaccacttccacagcgccccctgcatgctggccgctgctgagggcacccagttcagtgatggaggagaagaagatgaggaggatgaaggagagaagctgagctacctgaacagcctggccgctgctgatggccacggggacagcggcctgtgcccccagggctacgtgcacacagtgctgcgggacagctgcagcgagcccaaggagcacgaggaggagcctgaggtggtgcgggacaggagccagaagagctgccagctgaagaagagcctggagacagctggggactgcaaggctgctgaggagagcgagcggcccaagcccaggagcaggaggaagccccgggtgctcttcagccaggcccaggtgtttgagctggagcggcgcttcaagcagcagcgctacctgagcgcccctgagcgggagcacctggccagcagcctgaagctgaccagcacccaggtgaagatctggttccagaacagacgctacaagtgcaagaggcagaggcaggacaagagcctggagctgggcgcccacgcccctcctcctccaccccggcgggtggccgtgcctgtgctggtgagagatggcaagccctgtgtgacccccagcgcccaggcctacggggccccctacagcgtgggcgccagcgcctacagctacaacagcttccctgcctacggctacggcaacagcgctgctgctgctgctgctgctgctgctgctgctgctgctgctgctgcctacagcagcagctatggctgtgcctacccagctgggggcggcggcggcggcggcggcaccagcgctgccaccacagccatgcagcctgcctgcagcgctgctgggggcggcccctttgtgaatgtgagcaacctgggcggcttcggcagcggcggcagcgcccagcccctgcaccagggcacagctgctggagctgcctgtgcccagggcaccctgcagggcatccgggcctggtag

SEQ ID NO: 16203 - DNA, 1104 bp, Artificial Sequence
  Description of Artificial Sequence: Synthetic coding sequence
atgctggccgtgggcgccatggagggcacccggcagagcgccttcctgctgagcagcccccccctggccgccctgcacagcatggccgagatgaagacccccctgtacccagctgcctacccacccctgcctgctggcccccccagcagcagcagcagcagcagcagcagcagcagccccagcccccccctgggcacccacaaccctgggggcctgaagcccccagccactggaggcctgagcagcctgggcagccccccccagcagctgtctgctgccaccccccacggcatcaatgacatcctgagccggcccagcatgcctgtggccagcggggccgccctgcccagcgccagccccagcggcagcagcagcagcagcagcagcagcgccagcgccagcagcgccagcgctgctgctgctgctgctgctgctgctgctgctgctgccagcagccctgctggcctgctggccggcctgccccgcttcagcagcctgagccccccacctcctcctcctggcctgtacttcagccccagcgctgctgctgtggccgctgtgggccgctaccccaagcccctggccgagctgcccggccgcacccccatcttctggccaggagtgatgcagagccccccctggagagatgcccggctggcctgcaccccccaccagggcagcatcctgctggacaaggatggcaagaggaagcacacccggcccaccttcagcggccagcagatctttgccctggagaagacctttgagcagaccaagtacctggccggccctgagcgggcccggctggcctacagcctgggcatgacagagagccaggtgaaggtgtggttccagaacagaaggaccaagtggaggaagaagcacgccgctgagatggccacagccaagaagaagcaggacagcgagacagagcggctgaagggggcctctgaaaatgaggaggaggatgatgactacaacaagcccctggaccccaacagtgatgatgagaagatcacccagctgctgaagaagcacaagagcagcagcggcggcggcggcggcctgctgctgcacgccagcgagcctgagagcagcagctag

SEQ ID NO: 16204 - DNA, 834 bp, Artificial Sequence
  Description of Artificial Sequence: Synthetic coding sequence
atggacaccaacagacctggggcctttgtgctgagcagcgcccccctggccgccctgcacaacatggccgagatgaagaccagcctcttcccctatgccctgcagggccctgctggcttcaaggccccagccctgggcggcctgggcgcccagctgcccctgggcaccccccacggcatcagtgacatcctgggccggcctgtgggcgctgctgggggcggcctgctgggcggcctgccccggctgaatggcctggccagcagcgctggggtgtactttggacctgctgctgctgtggcccggggctaccccaagcccctggccgagctgcccggccggccccccatcttctggccaggagtggtgcagggcgccccctggagggacccccggctggccggccctgccccagctgggggcgtgctggacaaggatggcaagaagaagcacagccggcccaccttcagcggccagcagatctttgccctggagaagacctttgagcagaccaagtacctggccggccctgagcgggcccggctggcctacagcctgggcatgacagagagccaggtgaaggtgtggttccagaacagaaggaccaagtggaggaagagacatgctgtggagatggccagcgccaagaagaagcaggacagtgatgctgagaagctgaaggtgggcggcagtgatgctgaagatgatgatgagtacaaccggcccctggaccccaacagtgatgatgagaagatcacccggctgctgaagaagcacaagcccagcaacctggccctggtgagcccctgtggcggcggcgctggagatgccctgtag

SEQ ID NO: 16205 - DNA, 225 bp, Artificial Sequence
  Description of Artificial Sequence: Synthetic coding sequence
atggtggccctgcggggcctgggcagcggcctgcagccctggtgccccctggacctgcggctggagtgggtggacacagtgtgggagctggacttcacagaaacagagcccctggaccccagcattgaggccgagatcattgaaacaggcctggccgccttcaccaagctgtatgagagcctgctgccctttgccaccggggagcacggctccatggaggtgtag

SEQ ID NO: 16206 - DNA, 108 bp, Artificial Sequence
  Description of Artificial Sequence: Synthetic coding sequence
atggtggccctgcggggcctgggcagcggcctgcagccctggtgccccctggacctgcggctggagtgggtggacacagtgtgggagctggacttcacagagacctag

SEQ ID NO: 16207 - DNA, 4497 bp, Artificial Sequence
  Description of Artificial Sequence: Synthetic coding sequence
atggtggccctgcggggcctgggcagcggcctgcagccctggtgccccctggacctgcggctggagtgggtggacacagtgtgggagctggacttcacagaaacagagcccctggaccccagcattgaggccgagatcattgaaacaggcctggccgccttcaccaagctgtatgagagcctgctgccctttgccaccggggagcacggctccatggagagcatctggaccttcttcattgaaaataatgtgagccacagcaccctggtggccctcttctaccactttgtgcagatcgtgcacaagaagaatgtgtctgtgcagtaccgggagtatggcctgcacgccgccggcctgtacttcctgctgctggaggtgcccggctctgtggccaaccaggtgttccaccctgtgatgtttgacaagtgcatccagaccctgaagaagtcctggccccaggagagcaacctgaacaggaagaggaagaaggagcagcccaagagcagccaggccaaccctggccgccacaggaagaggggcaagccaccccggcgggaggacatcgagatggatgagatcatcgaggagcaggaggatgagaacatctgcttcagcgcccgggacctgagccagatcagaaatgccatcttccacctgctgaagaacttcctgcggctgctgcccaagttcagcctgaaggagaagccccagtgtgtgcagaactgcatcgaggtgtttgtgtccctgaccaactttgagcctgtgctgcacgagtgccacgtgacccaggcccgggccctgaaccaggccaagtacatccctgagctggcctactacggcctgtacctgctgtgcagccccatccatggagagggggacaaggtgatcagctgtgtgttccaccagatgctgagcgtcatcctgatgctggaggtgggggagggcagccaccgggcccccctggccgtgaccagccaggtgatcaactgcaggaaccaggccgtgcagttcatcagcgccctggtggatgagctgaaggagagcatcttccctgtggtgcgcatcctgctgcagcacatctgtgccaaggtggtggacaagtctgagtaccgcacctttgctgcccagagcctggtgcagctgctgagcaagctgccctgtggggagtatgccatgttcatcgcctggctgtacaagtacagccgcagcagcaagatcccccacagggtcttcaccctggatgtggtgctggccctgctggagctgcctgagcgggaggtggacaacaccctgagcctggagcaccagaagttcctgaagcacaagttcctggtgcaggagatcatgtttgaccgctgcctggacaaggcccccaccgtgcgcagcaaggccctgagcagctttgcccactgcctggagctgactgtgaccagcgccagcgagagcatcctggagctgctgatcaacagccccaccttcagcgtcatcgagagccaccctggcaccctgctgaggaacagcagcgccttctcctaccagaggcagaccagcaacagaagtgagcccagcggggagatcaacatcgacagcagtggagagaccgtgggcagcggggagcgctgtgtgatggccatgctgcggcggcgcatcagagatgagaagaccaacgtgaggaagagcgccctgcaggtgctggtgtccatcctgaagcactgtgatgtgtctggcatgaaggaggacctgtggatcctgcaggaccagtgccgggaccctgctgtgtctgtgaggaagcaggccctgcagagcctgacagagctgctgatggcccagccccgctgtgtgcagatccagaaggcctggctgcggggcgtggtgcctgtggtgatggactgtgagagcacagtgcaggagaaggccctggagttcctggaccagctgctgctgcagaacatccgccaccacagccacttccacagcggagatgacagccaggtgctggcctgggccctgctgaccctgctgaccacagagagccaggagctgagccgctacctgaacaaggccttccacatctggagcaagaaggagaagttcagccccaccttcatcaacaacgtcatcagccacactggaacagagcacagcgccccagcctggatgctgctgagcaagattgctggcagcagcccccggctggactacagccgcatcatccagagctgggagaagatcagcagccagcagaaccccaacagcaacaccctgggccacatcctgtgtgtgattggccacatcgccaagcacctgcccaagagcacccgggacaaggtgacagatgctgtgaagtgcaagctgaatggcttccagtggagcctggaggtgatcagcagcgctgtggatgccctgcagaggctgtgccgggccagcgctgagaccccagctgaggagcaggagctgctgacccaggtgtgtggagatgtgctgagcacctgtgagcaccggctgagcaacatcgtgctgaaggaaaatggaactggaaacatggatgaggacctgctggtgaagtacatcttcaccctgggggacatcgcccagctgtgcccagcccgggtggagaagaggatcttcctgctgatccagagcgtgctggccagcagcgcagatgctgaccacagccccagcagccagggcagcagcgaggccccagccagccagcccccaccccaggtgcggggctctgtgatgcccagcgtcatccgggcccacgccatcatcaccctgggcaagctgtgcctgcagcacgaggacctggccaagaagagcatcccagccctggtgcgggagctggaggtgtgtgaagatgtggccgtgaggaacaacgtcatcatcgtgatgtgtgacctgtgcatccgctacaccatcatggtggacaagtacatccccaacatctccatgtgcctgaaggacagcgaccccttcatcaggaagcagaccctcatcctgctgaccaacctgctgcaggaggagtttgtgaagtggaagggcagcctcttcttccgctttgtgtccaccctgattgacagccacccagacatcgccagctttggagagttctgcctggcccacctgctgctgaagagaaatcctgtgatgttcttccagcacttcatcgagtgcatcttccacttcaacaactatgagaagcatgagaagtacaacaagttcccccagagcgagcgggagaagaggctcttcagcctgaagggcaagagcaacaaggagaggaggatgaagatctacaagttcctgctggagcacttcacagatgagcagcgcttcaacatcaccagcaagatctgcctgagcatcctggcctgctttgctgatggcatcctgcccctggacctggatgccagcgagctgctgagtgacacctttgaggtgctgagcagcaaggagatcaagctgctggccatgaggagcaagccagacaaggacctgctgatggaggaggatgacatggccctggccaacgtggtgatgcaggaggcccagaagaagctgatcagccaggtgcagaagaggaacttcatcgagaacatcatccccatcatcatcagcctgaagacagtgctggagaagaacaagatcccagccctgcgggagctgatgcactacctgcgggaggtgatgcaggactacagagatgagctgaaggacttctttgctgtggacaagcagctggccagcgagctggagtatgacatgaagaagtaccaggagcagctggtgcaggagcaggagctggccaagcatgctgatgtggccggcacagctggaggagctgaggtggcccctgtggcccaggtggccctgtgcctggagaccgtgcctgtgcctgctggccaggagaacccagccatgagccctgctgtgtcccagccctgcaccccccgggccagcgctggccacgtggccgtgagcagccccaccccagagaccggccccctgcagaggctgctgcccaaggcccggcccatgagcctgagcaccatcgccatcctgaacagcgtgaagaaggctgtggagagcaagagccgccacaggagccgcagcctgggcgtgctgcccttcaccctgaacagcggcagccctgagaagacctgcagccaggtgagcagctacagcctggagcaggagagcaatggagaaattgaacatgtgaccaagagggccatcagcaccccagagaagagcatcagtgatgtgacctttggagctggggtgtcctacatcggcacccccaggacccccagcagcgccaaggagaagattgagggccgcagccagggcaatgacatcctgtgcctgagcctgcctgacaagcccccaccccagccccagcagtggaatgtgcgcagccctgccaggaacaaggacaccccagcctgcagccgccgcagcctgaggaagacccccctgaagacagccaactag

SEQ ID NO: 16208 - DNA, 2667 bp, Artificial Sequence
  Description of Artificial Sequence: Synthetic coding sequence
atgctgctggagtgcttcatcaacatcaactacatcaagaaggaggagggccgccgcttcctgagctgcctcttcaactggaacatcaacttcatcaagatgatccacggcaccatcaagaaccagctgcagggcctgcagaagagcctgatggtgtacatcgccgagatctacttccgggcctggaagaaggccagcggcaagatcctggaggccattgaaaatgactgcatccaggacttcatgttccacggcatccacctgccccggcgcagccctgtgcacagcaaggtgcgggaggtgctgagctacttccaccaccagaagaaggtgcggcagggcgtggaggagatgctgtaccgcctgtacaagcccatcctgtggaggggcctgaaggccaggaacagcgaggtgcgcagcaatgctgccctgctgtttgtggaggccttccccatccgggaccccaacctgcacgccatcgagatggacagcgagatccagaagcagtttgaggagctgtacagcctgctggaggacccctaccccatggtgcgcagcacaggcatcctgggcgtgtgcaagatcaccagcaagtactgggagatgatgccacccaccatcctgattgacctgctgaagaaggtgactggagagctggcctttgacaccagcagcgcagatgtgcgctgcagcgtcttcaagtgcctgcccatgatcctggacaacaagctgagccaccccctgctggagcagctgctgcctgccctgcgctacagcctgcatgacaacagcgagaaggtgcgggtggcctttgtggacatgctgctgaagatcaaggctgtgcgggccgccaagttctggaagatctgccccatggagcacatcctggtgcggctggagacagacagcaggcctgtgtcccggcggctggtgtccctcatcttcaacagcttcctgcctgtgaaccagcctgaggaggtgtggtgtgagcgctgtgtgaccctggtgcagatgaaccacgccgccgcccggcgcttctaccagtatgcccacgagcacacagcctgcaccaacatcgccaagctgatccacgtgatccgccactgcctgaatgcctgcatccagagagctgtgcgggagcccccagaagatgaggaggaggaggatggccgggagaaggaaaatgtgacagtgctggacaagaccctgtctgtgaatgatgtggcctgcatggccggcctgctggagatcatcgtcatcctgtggaagagcattgaccgctccatggagaacaacaaggaggccaagctgtacaccatcaacaagtttgcctctgtgctgcctgagtacctgaaggtgttcaaggatgaccgctgcaagatccccctcttcatgctgatgtccttcatgcctgccagcgctgtgccccccttcagctgtggggtcatcagcaccctgcggagccgggaggagggcgctgtggacaagagctactgcaccctgctggactgcctgtgctcctggggccaggtgggccacatcctggagctggtggacaactggctgcccacagagcacgcccaggccaagagcaacacagccagcaagggccgggtgcagatccatgacaccaggcctgtgaagccagagctggccctggtgtacatcgagtacctgctgacccaccccaagaacagagaatgtctgctgagcgcccccaggaagaagctgaaccacctgctgaaggccctggagaccagcaaggctgacctggagagcctgctgcagacccctgggggcaagccccggggcttcagcgaggccgccgccccccgggccttcggcctgcactgccgcctgagcatccacctgcagcacaagttctgcagcgagggcaaggtgtacctgtccatgctggaggacaccggcttctggctggagagcaagatcctgtccttcatccaggaccaggaggaggactacctgaagctgcacagggtcatctaccagcagatcatccagacctacctgactgtgtgcaaggatgtggtgatggtgggcctgggggaccaccagttccagatgcagctgctgcagaggagcctgggcatcatgcagacagtgaagggcttcttctacgtgtccctgctgctggacatcctgaaggagatcaccggcagcagcctcatccagaagacagacagtgatgaggaggtggccatgctgctggacacagtgcagaaggtgttccagaagatgctggagtgcatcgcccggagcttcaggaagcagcctgaggagggcctgcgggtgtctgatgtggaggagctgaccccacctgagcacctgagtgacctgccccccttcagccgctgcctgattggcatcatcatcaagagcagcaatgtggtgcgctccttcctggatgagctgaaggcctgtgtggccagcaatgacatcgagggcatcgtgtgcctgacagctgctgtgcacatcatcctggtgatcaatgctgggaagcacaagagcagcaaggtgcgggaggtggccgccaccgtgcacaggaagctgaagaccttcatggagatcaccctggaggaggacagcattgagcgcttcctgtatgagagcagcagcaggaccctgggggagctgctgaacagctag

SEQ ID NO: 16209 - DNA, 3432 bp, Artificial Sequence
  Description of Artificial Sequence: Synthetic coding sequence
atggagaagcgggagacctttgtgcaggccgtgtccaaggagctggtgggggagttcctgcagtttgtgcagctggacaaggaggccagtgaccccttcagcctgaatgagctgctggatgagctgagcaggaagcagaaggaggagctgtggcagaggctgaagaacctgctgacagatgtgctgctggagagccctgtggatggctggcaggtggtggaggcccagggcgaggacaacatggagacagaacatggcagcaagatgaggaagagcattgagatcatctatgccatcaccagcgtcatcctggcctctgtgtctgtcatcaatgaaagtgagaactatgaggccctgctggagtgtgtgatcatcctgaatggcatcctgtatgccctgcctgagagcgagaggaagctgcagagcagcatccaggacctgtgtgtgacctggtgggagaagggcctgcctgccaaggaggacaccgggaagacagcctttgtgatgctgctgcggcgcagcctggagaccaagacaggagcagatgtgtgccgcctgtggaggatccaccaggccctgtactgctttgattatgacctggaggagagcggggagatcaaggacatgctgctggagtgcttcatcaacatcaactacatcaagaaggaggagggccgccgcttcctgagctgcctcttcaactggaacatcaacttcatcaagatgatccacggcaccatcaagaaccagctgcagggcctgcagaagagcctgatggtgtacatcgccgagatctacttccgggcctggaagaaggccagcggcaagatcctggaggccattgaaaatgactgcatccaggacttcatgttccacggcatccacctgccccggcgcagccctgtgcacagcaaggtgcgggaggtgctgagctacttccaccaccagaagaaggtgcggcagggcgtggaggagatgctgtaccgcctgtacaagcccatcctgtggaggggcctgaaggccaggaacagcgaggtgcgcagcaatgctgccctgctgtttgtggaggccttccccatccgggaccccaacctgcacgccatcgagatggacagcgagatccagaagcagtttgaggagctgtacagcctgctggaggacccctaccccatggtgcgcagcacaggcatcctgggcgtgtgcaagatcaccagcaagtactgggagatgatgccacccaccatcctgattgacctgctgaagaaggtgactggagagctggcctttgacaccagcagcgcagatgtgcgctgcagcgtcttcaagtgcctgcccatgatcctggacaacaagctgagccaccccctgctggagcagctgctgcctgccctgcgctacagcctgcatgacaacagcgagaaggtgcgggtggcctttgtggacatgctgctgaagatcaaggctgtgcgggccgccaagttctggaagatctgccccatggagcacatcctggtgcggctggagacagacagcaggcctgtgtcccggcggctggtgtccctcatcttcaacagcttcctgcctgtgaaccagcctgaggaggtgtggtgtgagcgctgtgtgaccctggtgcagatgaaccacgccgccgcccggcgcttctaccagtatgcccacgagcacacagcctgcaccaacatcgccaagctgatccacgtgatccgccactgcctgaatgcctgcatccagagagctgtgcgggagcccccagaagatgaggaggaggaggatggccgggagaaggaaaatgtgacagtgctggacaagaccctgtctgtgaatgatgtggcctgcatggccggcctgctggagatcatcgtcatcctgtggaagagcattgaccgctccatggagaacaacaaggaggccaagctgtacaccatcaacaagtttgcctctgtgctgcctgagtacctgaaggtgttcaaggatgaccgctgcaagatccccctcttcatgctgatgtccttcatgcctgccagcgctgtgccccccttcagctgtggggtcatcagcaccctgcggagccgggaggagggcgctgtggacaagagctactgcaccctgctggactgcctgtgctcctggggccaggtgggccacatcctggagctggtggacaactggctgcccacagagcacgcccaggccaagagcaacacagccagcaagggccgggtgcagatccatgacaccaggcctgtgaagccagagctggccctggtgtacatcgagtacctgctgacccaccccaagaacagagaatgtctgctgagcgcccccaggaagaagctgaaccacctgctgaaggccctggagaccagcaaggctgacctggagagcctgctgcagacccctgggggcaagccccggggcttcagcgaggccgccgccccccgggccttcggcctgcactgccgcctgagcatccacctgcagcacaagttctgcagcgagggcaaggtgtacctgtccatgctggaggacaccggcttctggctggagagcaagatcctgtccttcatccaggaccaggaggaggactacctgaagctgcacagggtcatctaccagcagatcatccagacctacctgactgtgtgcaaggatgtggtgatggtgggcctgggggaccaccagttccagatgcagctgctgcagaggagcctgggcatcatgcagacagtgaagggcttcttctacgtgtccctgctgctggacatcctgaaggagatcaccggcagcagcctcatccagaagacagacagtgatgaggaggtggccatgctgctggacacagtgcagaaggtgttccagaagatgctggagtgcatcgcccggagcttcaggaagcagcctgaggagggcctgcggctgctgtacagcgtgcagaggcccctgcacgagttcatcacagctgtgcagagccgccacacagacacccctgtgcaccggggcgtgctgagcaccctgattgctggccctgtggtggagatcagccaccagctgaggaaggtgtctgatgtggaggagctgaccccacctgagcacctgagtgacctgccccccttcagccgctgcctgattggcatcatcatcaagagcagcaatgtggtgcgctccttcctggatgagctgaaggcctgtgtggccagcaatgacatcgagggcatcgtgtgcctgacagctgctgtgcacatcatcctggtgatcaatgccggcaagcacaagagcagcaaggtgcgggaggtggccgccaccgtgcacaggaagctgaagaccttcatggagatcaccctggaggaggacagcattgagcgcttcctgtatgagagcagcagcaggaccctgggggagctgctgaacagctag

SEQ ID NO: 16210 - DNA, 3471 bp, Artificial Sequence
  Description of Artificial Sequence: Synthetic coding sequence
atggagaagcgggagacctttgtgcaggccgtgtccaaggagctggtgggggagttcctgcagtttgtgcagctggacaaggaggccagtgaccccttcagcctgaatgagctgctggatgagctgagcaggaagcagaaggaggagctgtggcagaggctgaagaacctgctgacagatgtgctgctggagagccctgtggatggctggcaggtggtggaggcccagggcgaggacaacatggagacagaacatggcagcaagatgaggaagagcattgagatcatctatgccatcaccagcgtcatcctggcctctgtgtctgtcatcaatgaaagtgagaactatgaggccctgctggagtgtgtgatcatcctgaatggcatcctgtatgccctgcctgagagcgagaggaagctgcagagcagcatccaggacctgtgtgtgacctggtgggagaagggcctgcctgccaaggaggacaccgggaagacagcctttgtgatgctgctgcggcgcagcctggagaccaagacaggagcagatgtgtgccgcctgtggaggatccaccaggccctgtactgctttgattatgacctggaggagagcggggagatcaaggacatgctgctggagtgcttcatcaacatcaactacatcaagaaggaggagggccgccgcttcctgagctgcctcttcaactggaacatcaacttcatcaagatgatccacggcaccatcaagaaccagctgcagggcctgcagaagagcctgatggtgtacatcgccgagatctacttccgggcctggaagaaggccagcggcaagatcctggaggccattgaaaatgactgcatccaggacttcatgttccacggcatccacctgccccggcgcagccctgtgcacagcaaggtgcgggaggtgctgagctacttccaccaccagaagaaggtgcggcagggcgtggaggagatgctgtaccgcctgtacaagcccatcctgtggaggggcctgaaggccaggaacagcgaggtgcgcagcaatgctgccctgctgtttgtggaggccttccccatccgggaccccaacctgcacgccatcgagatggacagcgagatccagaagcagtttgaggagctgtacagcctgctggaggacccctaccccatggtgcgcagcacaggcatcctgggcgtgtgcaagatcaccagcaagtactgggagatgatgccacccaccatcctgattgacctgctgaagaaggtgactggagagctggcctttgacaccagcagcgcagatgtgcgctgcagcgtcttcaagtgcctgcccatgatcctggacaacaagctgagccaccccctgctggagcagctgctgcctgccctgcgctacagcctgcatgacaacagcgagaaggtgcgggtggcctttgtggacatgctgctgaagatcaaggctgtgcgggccgccaagttctggaagatctgccccatggagcacatcctggtgcggctggagacagacagcaggcctgtgtcccggcggctggtgtccctcatcttcaacagcttcctgcctgtgaaccagcctgaggaggtgtggtgtgagcgctgtgtgaccctggtgcagatgaaccacgccgccgcccggcgcttctaccagtatgcccacgagcacacagcctgcaccaacatcgccaagctgatccacgtgatccgccactgcctgaatgcctgcatccagagagctgtgcgggagcccccagaagatgaggaggaggaggatggccgggagaaggaaaatgtgacagtgctggacaagaccctgtctgtgaatgatgtggcctgcatggccggcctgctggagatcatcgtcatcctgtggaagagcattgaccgctccatggagaacaacaaggaggccaagctgtacaccatcaacaagtttgcctctgtgctgcctgagtacctgaaggtgttcaaggatgaccgctgcaagatccccctcttcatgctgatgtccttcatgcctgccagcgctgtgccccccttcagctgtggggtcatcagcaccctgcggagccgggaggagggcgctgtggacaagagctactgcaccctgctggactgcctgtgctcctggggccaggtgggccacatcctggagctggtggacaactggctgcccacagagcacgcccaggccaagagcaacacagccagcaagggccgggtgcagatccatgacaccaggcctgtgaagccagagctggccctggtgtacatcgagtacctgctgacccaccccaagaacagagaatgtctgctgagcgcccccaggaagaagctgaaccacctgctgaaggccctggagaccagcaaggctgacctggagagcctgctgcagacccctgggggcaagccccggggcttcagcgaggccgccgccccccgggccttcggcctgcactgccgcctgagcatccacctgcagcacaagttctgcagcgagggcaaggtgtacctgtccatgctggaggacaccggcttctggctggagagcaagatcctgtccttcatccaggaccaggaggaggactacctgaagctgcacagggtcatctaccagcagatcatccagacctacctgactgtgtgcaaggatgtggtgatggtgggcctgggggaccaccagttccagatgcagctgctgcagaggagcctgggcatcatgcagacagtgaagggcttcttctacgtgtccctgctgctggacatcctgaaggagatcaccggcagcagcctcatccagaagacagacagtgatgaggaggtggccatgctgctggacacagtgcagaaggtgttccagaagatgctggagtgcatcgcccggagcttcaggaagcagcctgaggagggcctgcggctgctgtacagcgtgcagaggcccctgcacgagttcatcacagctgtgcagagccgccacacagacacccctgtgcaccggggcgtgctgagcaccctgattgctggccctgtggtggagatcagccaccagctgaggaaggtgtctgatgtggaggagctgaccccacctgagcacctgagtgacctgccccccttcagccgctgcctgattggcatcatcatcaagagcagcaatgtggtgcgctccttcctggatgagctgaaggcctgtgtggccagcaatgacatcgagggcatcgtgtgcctgacagctgctgtgcacatcatcctggtgatcaatgccggcaagcacaagagcagcaaggtgcgggaggtggccgccaccgtgcacaggaagctgaagaccttcatggagatcaccctggaggaggacagcattgaaagatatgaggacctgctgtgctgccccggctgggccctgaccccaggcctgctggacagcatctaccccagcgcctctgtgcccatcggctag

SEQ ID NO: 16211 - DNA, 3432 bp, Artificial Sequence; identical to SEQ ID NO: 16209
  Description of Artificial Sequence: Synthetic coding sequence

SEQ ID NO: 16212 - DNA, 2697 bp, Artificial Sequence
  Description of Artificial Sequence: Synthetic coding sequence
tgactggaggagagcggggagatcaaggacatgctgctggagtgcttcatcaacatcaactacatcaagaaggaggagggccgccgcttcctgagctgcctcttcaactggaacatcaacttcatcaagatgatccacggcaccatcaagaaccagctgcagggcctgcagaagagcctgatggtgtacatcgccgagatctacttccgggcctggaagaaggccagcggcaagatcctggaggccattgaaaatgactgcatccaggacttcatgttccacggcatccacctgccccggcgcagccctgtgcacagcaaggtgcgggaggtgctgagctacttccaccaccagaagaaggtgcggcagggcgtggaggagatgctgtaccgcctgtacaagcccatcctgtggaggggcctgaaggccaggaacagcgaggtgcgcagcaatgctgccctgctgtttgtggaggccttccccatccgggaccccaacctgcacgccatcgagatggacagcgagatccagaagcagtttgaggagctgtacagcctgctggaggacccctaccccatggtgcgcagcacaggcatcctgggcgtgtgcaagatcaccagcaagtactgggagatgatgccacccaccatcctgattgacctgctgaagaaggtgactggagagctggcctttgacaccagcagcgcagatgtgcgctgcagcgtcttcaagtgcctgcccatgatcctggacaacaagctgagccaccccctgctggagcagctgctgcctgccctgcgctacagcctgcatgacaacagcgagaaggtgcgggtggcctttgtggacatgctgctgaagatcaaggctgtgcgggccgccaagttctggaagatctgccccatggagcacatcctggtgcggctggagacagacagcaggcctgtgtcccggcggctggtgtccctcatcttcaacagcttcctgcctgtgaaccagcctgaggaggtgtggtgtgagcgctgtgtgaccctggtgcagatgaaccacgccgccgcccggcgcttctaccagtatgcccacgagcacacagcctgcaccaacatcgccaagctgatccacgtgatccgccactgcctgaatgcctgcatccagagagctgtgcgggagcccccagaagatgaggaggaggaggatggccgggagaaggaaaatgtgacagtgctggacaagaccctgtctgtgaatgatgtggcctgcatggccggcctgctggagatcatcgtcatcctgtggaagagcattgaccgctccatggagaacaacaaggaggccaagctgtacaccatcaacaagtttgcctctgtgctgcctgagtacctgaaggtgttcaaggatgaccgctgcaagatccccctcttcatgctgatgtccttcatgcctgccagcgctgtgccccccttcagctgtggggtcatcagcaccctgcggagccgggaggagggcgctgtggacaagagctactgcaccctgctggactgcctgtgctcctggggccaggtgggccacatcctggagctggtggacaactggctgcccacagagcacgcccaggccaagagcaacacagccagcaagggccgggtgcagatccatgacaccaggcctgtgaagccagagctggccctggtgtacatcgagtacctgctgacccaccccaagaacagagaatgtctgctgagcgcccccaggaagaagctgaaccacctgctgaaggccctggagaccagcaaggctgacctggagagcctgctgcagacccctgggggcaagccccggggcttcagcgaggccgccgccccccgggccttcggcctgcactgccgcctgagcatccacctgcagcacaagttctgcagcgagggcaaggtgtacctgtccatgctggaggacaccggcttctggctggagagcaagatcctgtccttcatccaggaccaggaggaggactacctgaagctgcacagggtcatctaccagcagatcatccagacctacctgactgtgtgcaaggatgtggtgatggtgggcctgggggaccaccagttccagatgcagctgctgcagaggagcctgggcatcatgcagacagtgaagggcttcttctacgtgtccctgctgctggacatcctgaaggagatcaccggcagcagcctcatccagaagacagacagtgatgaggaggtggccatgctgctggacacagtgcagaaggtgttccagaagatgctggagtgcatcgcccggagcttcaggaagcagcctgaggagggcctgcgggtgtctgatgtggaggagctgaccccacctgagcacctgagtgacctgccccccttcagccgctgcctgattggcatcatcatcaagagcagcaatgtggtgcgctccttcctggatgagctgaaggcctgtgtggccagcaatgacatcgagggcatcgtgtgcctgacagctgctgtgcacatcatcctggtgatcaatgctgggaagcacaagagcagcaaggtgcgggaggtggccgccaccgtgcacaggaagctgaagaccttcatggagatcaccctggaggaggacagcattgagcgcttcctgtatgagagcagcagcaggaccctgggggagctgctgaacagctag

SEQ ID NO: 16213 - DNA, 3471 bp, Artificial Sequence; identical to SEQ ID NO: 16210
  Description of Artificial Sequence: Synthetic coding sequence

SEQ ID NO: 16214 - DNA, 1794 bp, Artificial Sequence
  Description of Artificial Sequence: Synthetic coding sequence
atggagcacatcctggtgcggctggagacagacagcaggcctgtgtcccggcggctggtgtccctcatcttcaacagcttcctgcctgtgaaccagcctgaggaggtgtggtgtgagcgctgtgtgaccctggtgcagatgaaccacgccgccgcccggcgcttctaccagtatgcccacgagcacacagcctgcaccaacatcgccaagctgattcatgtgatccgccactgcctgaatgcctgcatccagagagctgtgcgggagcccccagaagatgaggaggaggaggatggccgggagaaggaaaatgtgacagtgctggacaagaccctgtctgtgaatgatgtggcctgcatggccggcctgctggagatcatcgtcatcctgtggaagagcattgaccgctccatggagaacaacaaggaggccaagctgtacaccatcaacaagtttgcctctgtgctgcctgagtacctgaaggtgttcaaggatgaccgctgcaagatccccctcttcatgctgatgtccttcatgcctgccagcgctgtgccccccttcagctgtggggtcatcagcaccctgcggagccgggaggagggcgctgtggacaagagctactgcaccctgctggactgcctgtgctcctggggccaggtgggccacatcctggagctggtggacaactggctgcccacagaacatgcccaggccaagagcaacacagccagcaagggccgggtgcagatccatgacaccaggcctgtgaagccagagctggccctggtgtacatcgagtacctgctgacccaccccaagaaccgggagtgcctgctgagcgcccccaggaagaagctgaaccacctgctgaaggccctggagaccagcaaggctgacctggagagcctgctgcagaccccaggcggcaagccccggggcttcagcgaggccgccgccccccgggccttcggcctgcactgccgcctgagcatccacctgcagcacaagttctgcagcgagggcaaggtgtacctgtccatgctggaggacaccggcttctggctggagagcaagatcctgtccttcatccaggaccaggaggaggactacctgaagctgcacagggtcatctaccagcagatcatccagacctacctgactgtgtgcaaggatgtggtgatggtgggcctgggggaccaccagttccagatgcagctgctgcagaggagcctgggcatcatgcagacagtgaagggcttcttctacgtgtccctgctgctggacatcctgaaggagatcaccggcagcagcctcatccagaagacagacagtgatgaggaggtggccatgctgctggacacagtgcagaaggtgttccagaagatgctggagtgcatcgcccgctccttcaggaagcagcctgaggagggcctgcgggtgtctgatgtggaggagctgaccccacctgagcacctgagtgacctgccccccttcagccgctgcctgattggcatcatcatcaagagcagcaatgtggtgcgctccttcctggatgagctgaaggcctgtgtggccagcaatgacatcgagggcatcgtgtgcctgacagctgctgtgcacatcatcctggtgatcaatgccggcaagcacaagagcagcaaggtgcgggaggtggccgccaccgtgcacaggaagctgaagaccttcatggagatcaccctggaggaggacagcattgagcgcttcctgtatgagagcagcagcaggaccctgggggagctgctgaacagctag

SEQ ID NO: 16215 - DNA, 1716 bp, Artificial Sequence
  Description of Artificial Sequence: Synthetic coding sequence
atggagcacatcctggtgcggctggagacagacagcaggcctgtgtcccggcggctggtgtccctcatcttcaacagcttcctgcctgtgaaccagcctgaggaggtgtggtgtgagcgctgtgtgaccctggtgcagatgaaccacgccgccgcccggcgcttctaccagtatgcccacgagcacacagcctgcaccaacatcgccaagctgattcatgtgatccgccactgcctgaatgcctgcatccagagagctgtgcgggagcccccagaagatgaggaggaggaggatggccgggagaaggaaaatgtgacagatgaccgctgcaagatccccctcttcatgctgatgtccttcatgcctgccagcgctgtgccccccttcagctgtggggtcatcagcaccctgcggagccgggaggagggcgctgtggacaagagctactgcaccctgctggactgcctgtgctcctggggccaggtgggccacatcctggagctggtggacaactggctgcccacagaacatgcccaggccaagagcaacacagccagcaagggccgggtgcagatccatgacaccaggcctgtgaagccagagctggccctggtgtacatcgagtacctgctgacccaccccaagaaccgggagtgcctgctgagcgcccccaggaagaagctgaaccacctgctgaaggccctggagaccagcaaggctgacctggagagcctgctgcagaccccaggcggcaagccccggggcttcagcgaggccgccgccccccgggccttcggcctgcactgccgcctgagcatccacctgcagcacaagttctgcagcgagggcaaggtgtacctgtccatgctggaggacaccggcttctggctggagagcaagatcctgtccttcatccaggaccaggaggaggactacctgaagctgcacagggtcatctaccagcagatcatccagacctacctgactgtgtgcaaggatgtggtgatggtgggcctgggggaccaccagttccagatgcagctgctgcagaggagcctgggcatcatgcagacagtgaagggcttcttctacgtgtccctgctgctggacatcctgaaggagatcaccggcagcagcctcatccagaagacagacagtgatgaggaggtggccatgctgctggacacagtgcagaaggtgttccagaagatgctggagtgcatcgcccgctccttcaggaagcagcctgaggagggcctgcggctgctgtacagcgtgcagaggcccctgcacgagttcatcacagctgtgcagagccgccacacagacacccctgtgcacagaggagtgctgagcaccctgattgctggccctgtggtggagatcagccaccagctgaggaaggtgtctgatgtggaggagctgaccccacctgagcacctgagtgacctgccccccttcagccgctgcctgattggcatcatcatcaagagcagcaatgtggtgcgctccttcctggatgagctgaaggcctgtgtggccagcaatgacatcgagggcatcgtgtgcctgacagctgctgtgcacatcatcctggtgatcaatgctgggaagcacaagagcagcaaggtgcgggaggtggccgccaccgtgcacaggaagctgaagaccttcatggagatcaccctggaggaggacagcattgaaagaatttag

SEQ ID NO: 16216 - DNA, 1821 bp, Artificial Sequence
  Description of Artificial Sequence: Synthetic coding sequence
atggaggatgtggaggccaggtttgcccacctgctgcagcccatccgggacctgaccaagaactgggaggtggatgtggccgcccagctgggggagtacctggaggagctggaccagatctgcatcagctttgatgagggcaagaccaccatgaacttcatcgaggccgccctgctgatccagggcagcgcctgtgtgtacagcaagaaggtggagtacctgtacagcctggtgtaccaggccctggacttcatcagcggcaagagaagagccaagcagctgagctctgtgcaggaggaccgggccaatggagtggccagcagcggcgtgccccaggaggctgaaaatgagttcctgagcctggatgacttcccagacagcaggaccaacgtggacctgaagaatgaccagacccccagcgaggtgctgatcatccccctgctgcccatggccctggtggccccagatgagatggagaagaacaacaaccccctgtacagccggcagggcgaggtgctggccagcaggaaggacttcaggatgaacacctgtgtgccccaccccaggggggccttcatgctggagcctgagggcatgagccccatggagcctgctggggtgagccccatgcctggcacccagaaggacaccggccgcacagaggagcagcccatggaggtgtctgtgtgccgcagccctgtgcctgccctgggcttcagccaggagcccggccccagccctgagggccccatgcccctgggcggcggagaagatgaagatgctgaggaggccgtggagctgcctgaggccagcgcccccaaggccgccctggagcccaaggagagccgcagcccccagcagagcgctgccctgccccggcgctacatgctgcgggagcgggagggcgcccctgagcccgccagctgtgtgaaggagaccccagacccctggcagagcctggacccctttgacagcctggagagcaagcccttcaagaagggccggccctacagcgtgcccccctgtgtggaggaggccctgggccagaagaggaagaggaagggggccgccaagctgcaggacttccaccagtggtacctggccgcctatgctgaccacgccgacagccggcggctgcggaggaagggccccagctttgctgacatggaggtgctgtactggacccacgtgaaggagcagctggagaccctgaggaagctgcagaggcgggaggtggccgagcagtggctgcggcctgctgaggaggaccacctggaggacagcctggaggacctgggcgctgctgctgatgacttcctggagcctgaggagtacatggagcctgagggcgctgacccccgggaggccgctgacctggatgctgtgcccatgagcctgtcctatgaggagctggtgagaagaaatgtggagctgttcatcgccaccagccagaagtttgtgcaggagacagagctgagccagaggatccgggactgggaggacacagtgcagcccctgctgcaggagcaggagcagcacgtgccctttgacatccacacctatggagaccagctggtgagccgcttcccccagctgaatgagtggtgcccctttgctgagctggtggccggccagcctgcctttgaggtgtgccgctccatgctggccagcctgcagctggccaatgactacacagtggagatcacccagcagcccggcctggagatggctgtggacaccatgagcctgcggctgctgacccaccagagggcccacaagcgcttccagacctatgctgcccccagcatggcccagccctag

SEQ ID NO: 16217 - DNA, 900 bp, Artificial Sequence
  Description of Artificial Sequence: Synthetic coding sequence
atggaggatgtggaggccaggtttgcccacctgctgcagcccatccgggacctgaccaagaactgggaggtggatgtggccgcccagctgggggagtacctggaggagctggaccagatctgcatcagctttgatgagggcaagaccaccatgaacttcatcgaggccgccctgctgatccagggcagcgcctgtgtgtacagcaagaaggtggagtacctgtacagcctggtgtaccaggccctggacttcatcagcggcaagagaagagccaagcagctgagctctgtgcaggaggaccgggccaatggagtggccagcagcggcgtgccccaggaggctgaaaatgagttcctgagcctggatgacttcccagacagcaggaccaacgtggacctgaagaatgaccagacccccagcgaggtgctgatcatccccctgctgcccatggccctggtggccccagatgagatggagaagaacaacaaccccctgtacagccggcagggcgaggtgctggccagcaggaaggacttcaggatgaacacctgtgtgccccaccccaggggggccttcatgctggagcctgagggcatgagccccatggagcctgctggggtgagccccatgcctggcacccagaaggacaccggccgcacagaggagcagcccatggaggtgtctgtgtgccgcagccctgtgcctgccctgggcttcagccaggagcccggccccagccctgagggccccatgcccctgggcggcggagaagatgaagatgctgaggaggccgtggagctgcctgaggccagcgcccccaaggccgccctggagcccaaggagagccgcagcccccagcaggtgggccccacctggaggcctgctgagcctgagctgtag

SEQ ID NO: 16218 - DNA, 1818 bp, Artificial Sequence
  Description of Artificial Sequence: Synthetic coding sequence
atggaggatgtggaggccaggtttgcccacctgctgcagcccatccgggacctgaccaagaactgggaggtggatgtggccgcccagctgggggagtacctggaggagctggaccagatctgcatcagctttgatgagggcaagaccaccatgaacttcatcgaggccgccctgctgatccagggcagcgcctgtgtgtacagcaagaaggtggagtacctgtacagcctggtgtaccaggccctggacttcatcagcggcaagagaagagccaagcagctgagctctgtgcaggaggaccgggccaatggagtggccagcagcggcgtgccccaggaggctgaaaatgagttcctgagcctggatgacttcccagacagcaggaccaacgtggacctgaagaatgaccagacccccagcgaggtgctgatcatccccctgctgcccatggccctggtggccccagatgagatggagaagaacaacaaccccctgtacagccggcagggcgaggtgctggccagcaggaaggacttcaggatgaacacctgtgtgccccaccccaggggggccttcatgctggagcctgagggcatgagccccatggagcctgctggggtgagccccatgcctggcacccagaaggacaccggccgcacagaggagcagcccatggaggtgtctgtgtgccgcagccctgtgcctgccctgggcttcagccaggagcccggccccagccctgagggccccatgcccctgggcggcggagaagatgaagatgctgaggaggccgtggagctgcctgaggccagcgcccccaaggccgccctggagcccaaggagagccgcagcccccagcagagcgctgccctgccccggcgctacatgctgcgggagcgggagggcgcccctgagcccgccagctgtgtgaaggagaccccagacccctggcagagcctggacccctttgacagcctggagagcaagcccttcaagaagggccggccctacagcgtgcccccctgtgtggaggaggccctgggccagaagaggaagaggaagggggccgccaagctgcaggacttccaccagtggtacctggccgcctatgctgaccacgccgacagccggcggctgcggaggaagggccccagctttgctgacatggaggtgctgtactggacccacgtgaaggagcagctggagaccctgaggaagctgcagaggcgggaggtggccgagcagtggctgcggcctgctgaggaggaccacctggaggacagcctggaggacctgggcgctgctgatgacttcctggagcctgaggagtacatggagcctgagggcgctgacccccgggaggccgctgacctggatgctgtgcccatgagcctgtcctatgaggagctggtgagaagaaatgtggagctgttcatcgccaccagccagaagtttgtgcaggagacagagctgagccagaggatccgggactgggaggacacagtgcagcccctgctgcaggagcaggagcagcacgtgccctttgacatccacacctacggggaccagctggtgagccgcttcccccagctgaatgagtggtgcccctttgctgagctggtggccggccagcctgcctttgaggtgtgccgctccatgctggccagcctgcagctggccaatgactacacagtggagatcacccagcagcccggcctggagatggctgtggacaccatgagcctgcggctgctgacccaccagagggcccacaagcgcttccagacctacgccgcccccagcatggcccagccctag

SEQ ID NO: 16219 - DNA, 801 bp, Artificial Sequence
  Description of Artificial Sequence: Synthetic coding sequence
atgcagggcagcaccaggaggatgggcgtgatgacagatgtgcaccggcgcttcctgcagctgctgatgacccatggagtgctggaggagtgggatgtgaagaggctgcagacccactgctacaaggtgcatgacagaaatgccaccgtggacaagctggaggacttcatcaacaacatcaacagcgtgctggagagcctgtacatcgagatcaagaggggcgtgacagaagatgatggccggcccatctatgccctggtgaacctggccaccaccagcatcagcaagatggccacagactttgctgaaaatgagctggacctcttcaggaaggccctggagctgatcattgattctgaaacaggctttgccagcagcaccaacatcctgaacctggtggaccagctgaagggcaagaagatgaggaagaaggaggccgagcaggtgctgcagaagtttgtgcagaacaagtggctgattgagaaggagggggagttcaccctgcacggccgggccatcctggagatggagcagtacatccgggagacctacccagatgctgtgaagatctgcaacatctgccacagcctgctgatccagggccagagctgtgagacctgtggcatccgcatgcacctgccctgtgtggccaagtacttccagagcaatgctgagccccgctgcccccactgcaatgactactggccccatgagatccccaaggtgtttgatcctgagaaggagcgggagagcggcgtgctgaagagcaacaagaagagcctgcggagccggcagcactag

SEQ ID NO: 16220 - DNA, 744 bp, Artificial Sequence
  Description of Artificial Sequence: Synthetic coding sequence
atgcctggccgcagcagcagcaacagcggcagcacaggcttcatctccttcagcggcgtggagagcgccctgagcagcctgaagaacttccaggcctgcatcaacagcggcatggacacagccagctctgtggccctggacctggtggagagccagacagaggtgtcctctgagtacagcatggacaaggccatggtggagtttgccaccctggaccggcagctgaaccactacgtgaaggctgtgcagagcaccatcaaccacgtgaaggaggagaggcctgagaagatcccagacctgaagctgctggtggagaagaagttcctggccctgcagagcaagaacagtgatgctgacttccagaacaatgagaagtttgtgcagttcaagcagcagctgaaggagctgaagaagcagtgtggcctgcaggccgaccgggaggctgatggaacagaaggagtggatgaggacatcatcgtgacccagagccagaccaacttcacctgccccatcaccaaggaggagatgaagaagcctgtgaagaacaaggtgtgtggccacacctatgaagaagatgccatcgtgaggatgattgagagccggcagaagaggaagaagaaggcctactgcccccagatcggctgcagccacacagacatcaggaagagtgacctgatccaggatgaggccctgcggcgggccatcgagaaccacaacaagaagaggcaccgccacagcgagtag

SEQ ID NO: 16221 - DNA, 582 bp, Artificial Sequence
  Description of Artificial Sequence: Synthetic coding sequence
atgcctggccgcagcagcagcaacagcggcagcacaggcttcatctccttcagcggcgtggagagcgccctgagcagcctgaagaacttccaggcctgcatcaacagcggcatggacacagccagctctgtggccctggacctggtggagagccagacagaggtgtcctctgagtacagcatggacaaggccatggtggagtttgccaccctggaccggcagctgaaccactacgtgaaggctgtgcagagcaccatcaaccacgtgaaggaggagaggcctgagaagatcccagacctgaagctgctggtggagaagaagttcctggccctgcagagcaagaacagtgatgctgacttccagaacaatgagaagtttgtgcagttcaagcagcagctgaaggagctgaagaagcagtgtggcctgcaggccgaccgggaggctgatggaacagaaggagtggatgaggacatcatcgtgacccagagccagaccaacttcacctgccccatcaccaaggaggagatgaagaagcctgtgaagaacaaggtgtgtggccacacctatgaagaagatgcctag

SEQ ID NO: 16222 - DNA, 138 bp, Artificial Sequence
  Description of Artificial Sequence: Synthetic coding sequence
atgcctggccgcagcagcagcaacagcggcagcacaggcttcatctccttcagcggcgtggagagcgccctgagcagcctgaagaacttccaggcctgcatcaacagcggcatggacacagccagctctgtggcctag

SEQ ID NO: 16223 - DNA, 744 bp, Artificial Sequence; identical to SEQ ID NO: 16220
  Description of Artificial Sequence: Synthetic coding sequence

SEQ ID NO: 16224 - DNA, 420 bp, Artificial Sequence
  Description of Artificial Sequence: Synthetic coding sequence
atgcctggccgcagcagcagcaacagcggcagcacaggcttcatctccttcagcggcgtggagagcgccctgagcagcctgaagaacttccaggcctgcatcaacagcggcatggacacagccagctctgtggccctggacctggtggagagccagacagaggtgtcctctgagtacagcatggacaaggccatggtggagtttgccaccctggaccggcagctgaaccactacgtgaaggctgtgcagagcaccatcaaccacgtgaaggaggagaggcctgagaagatcccagacctgaagctgctggtggagaagaagttcctggccctgcagagcaagaacagtgatgctgacttccagaacaatgagaagtttgtgcagttcaagcagcagctgaaggagctgaagaagcagtag

SEQ ID NO: 16225 - DNA, 705 bp, Artificial Sequence
  Description of Artificial Sequence: Synthetic coding sequence
atgctggatggccggcagaggcggggcagcaatgcccccaccagtgacatgcctggcaccaccctgaacagatatggccgcacctggccccgctggggctggctgtggacccccactggaggagccctgaggaagaggaaggtgaaggccatggaggtggacatcgaggagcggcccaaggagctggtgaggaagccctacgtgctgaatgacctggaggccgaggccagcctgcctgagaagaagggcaacaccctgagccgggacctgattgattatgtgcgctacatggtggagaaccacggggaggactacaaggccatggctgtgatgaggcgcatcaccatcaagatcccccagaacagatttggagtgcgcagcaccagcatcaatgccttcacccagcagagcggcaagaccagcagcatcctgtgccggcggggccgctggcgctggagcgactggttcaccagccagctgccccaggccgaggccagccctggccctgtgaagctggagcccggctgcaaggcccggcgctgctgcgtggcccctgaggagctggcccggagccacggcatccggcggctgcacgtgcacacccccaggtctggagagggcaccgtgctgcggggcagcaacctgtacagcagcggcggcagcaggaagagccagaacctgctcttcagcggctgggtgatgtag

SEQ ID NO: 16226 - DNA, 537 bp, Artificial Sequence
  Description of Artificial Sequence: Synthetic coding sequence
atgcccaaggccaagggcaagacccggcggcagaagtttggctacagcgtgaacaggaagaggctgaacagaaatgcccggaggaaggccgcccccagaattgaatgtagccacatcagacatgcctgggaccacgccaagtctgtgcggcagaacctggccgagatgggcctggccgtggaccccaacagagctgtgcccctgaggaagaggaaggtgaaggccatggaggtggacatcgaggagcggcccaaggagctggtgaggaagccctacgtgctgaatgacctggaggccgaggccagcctgcctgagaagaagggcaacaccctgagccgggacctgattgattatgtgcgctacatggtggagaaccacggggaggactacaaggccatggccagagatgagaagaactactaccaggacacccccaagcagatccgcagcaagatcaacgtgtacaagcgcttctacccagctgagtggcaggacttcctggacagcctgcagaagaggaagatggaggtggagtag

SEQ ID NO: 16227 - DNA, 696 bp, Artificial Sequence
  Description of Artificial Sequence: Synthetic coding sequence
atgcccaaggccaagggcaagacccggcggcagaagtttggctacagcgtgaacaggaagaggctgaacagaaatgcccggaggaaggccgcccccagaattgaatgtagccacatcagacatgcctgggaccacgccaagtctgtgcggcagaacctggccgagatgggcctggccgtggaccccaacagagctgtgcccctgaggaagaggaaggtgaaggccatggaggtggacatcgaggagcggcccaaggagctggtgaggaagccctacgtgctgaatgacctggaggccgaggccagcctgcctgagaagaagggcaacaccctgagccgggacctgattgattatgtgcgctacatggtggagaaccacggggaggactacaagcagagcggcaagaccagcagcatcctgtgccggcggggccgctggcgctggagcgactggttcaccagccagctgccccaggccgaggccagccctggccctgtgaagctggagcccggctgcaaggcccggcgctgctgcgtggcccctgaggagctggcccggagccacggcatccggcggctgcaccacgtgcacacccccaggtctggagagggcaccgtgctgcggggcagcaacctgtacagcagcggcggcagcaggaagagccagaacctgctcttcagcggctgggtgatgtag

SEQ ID NO: 16228 - DNA, 711 bp, Artificial Sequence
  Description of Artificial Sequence: Synthetic coding sequence
atgcccaaggccaagggcaagacccggcggcagaagtttggctacagcgtgaacaggaagaggctgaacagaaatgcccggaggaaggccgcccccagaattgaatgtagccacatcagacatgcctgggaccacgccaagtctgtgcggcagaacctggccgagatgggcctggccgtggaccccaacagagctgtgcccctgaggaagaggaaggtgaaggccatggaggtggacatcgaggagcggcccaaggagctggtgaggaagccctacgtgctgaatgacctggaggccgaggccagcctgcctgagaagaagggcaacaccctgagccgggacctgattgattatgtgcgctacatggtggagaaccacggggaggactacaagagcggcaagaccagcagcatcctgtgcagaagaggccgctggcgctggagcgactggttcaccagccagctgccccaggccgaggccagccctggccctgtgaagctggagcccggctgcaaggcccggcgctgctgcgtggcccctgaggagctggcccggagccacggcatccggcggctgcacacccgggcccacagccccctgtggggcaggaactgcagccagaggctgcagttcatcttcatctggggcttcacagagaagccagagcctgctgtgttccgggtgggagatgtgaacatcgtgtgcacctag

SEQ ID NO: 16229 - DNA, 2439 bp, Artificial Sequence
  Description of Artificial Sequence: Synthetic coding sequence
atgggcaggaagctggaccccaccaaggagaagaggggccctggcaggaaggccaggaagcagaagggagctgagacagagctggtgcgcttcctgcctgctgtgtctgatgagaacagcaagaggctgagcagccgggccaggaagagagctgccaagaggcggctgggctctgtggaggcccccaagaccaacaagagccctgaggccaagcccctgcccgggaagctgcccaagggcatctctgctggagctgtgcagacagctgggaagaagggcccccagagcctcttcaatgccccccggggcaagaagaggcctgcccctggcagtgatgaggaggaggaggaggaggacagcgaggaggatggcatggtgaaccacggggacctgtggggctctgaagatgatgctgacacagtggatgattatggagctgacagcaacagtgaagatgaggaggagggggaggccctgctgcccatcgagagagctgccaggaagcagaaggcccgggaggccgccgccggcatccagtggagcgaggaggagacagaagatgaggaggaggagaaggaggtgaccccagagagcggcccccccaaggtggaggaggctgatggcggcctgcagatcaacgtggatgaggagccctttgtgctgcccccagctggggagatggagcaggatgcccaggccccagacctgcagagggtgcacaagaggatccaggacatcgtgggcatcctgcgggactttggagcccagcgggaggagggccgcagccgctctgagtacctgaaccggctgaagaaggacctggccatctactacagctatggagacttcctgctgggcaagctgatggacctcttccccctgtctgagctggtggagttcctggaggccaatgaggtgcccaggcctgtgaccctgcggaccaacaccctgaagaccaggagaagagacctggcccaggccctgatcaacagaggagtgaacctggaccccctgggcaagtggagcaagacaggcctggtggtgtatgacagctctgtgcccatcggggccaccccagagtacctggccggccactacatgctgcagggcgccagctccatgctgcctgtgatggccctggccccccaggagcacgagcgcatcctggacatgtgctgtgcccctgggggcaagaccagctacatggcccagctgatgaagaacacaggagtcatcctggccaatgatgccaatgctgagcggctgaagtctgtggtgggcaacctgcaccggctgggcgtgaccaacaccatcatcagccactatgatggccggcagttccccaaggtggtgggcggctttgacagagtgctgctggatgccccctgcagcggcaccggggtcatcagcaaggaccctgctgtgaagaccaacaaggatgagaaggacatcctgcgctgtgcccacctgcagaaggagctgctgctgagcgccattgattctgtgaatgccaccagcaagacaggaggctacctggtgtactgcacctgcagcatcaccgtggaggagaatgagtgggtggtggactatgccctgaagaagagaaatgtgcggctggtgcccaccggcctggactttggccaggagggcttcacccgcttccgggagcggcgcttccaccccagcctgcggagcacccggcgcttctacccccacacccacaacatggatggcttcttcatcgccaagttcaagaagttcagcaacagcatcccccagagccagacaggcaacagcgagacagccacccccaccaacgtggacctgccccaggtgatccccaagtctgagaacagcagccagcctgccaagaaggccaagggagctgccaagaccaagcagcagctgcagaagcagcagcaccccaagaaggccagcttccagaagctgaatggcatcagcaaaggagctgacagcgagctgagcacagtgcccagcgtgaccaagacccaggccagcagcagcttccaggacagcagccagcctgctgggaaggccgagggcatccgggagcccaaggtgacaggcaagctgaagcagaggagccccaagctgcagagcagcaagaaggtggccttcctgcggcagaatgccccacccaagggcacagacacccagaccccagctgtgctgagccccagcaagacccaggccaccctgaagcccaaggaccaccaccagcccctgggccgggccaagggcgtggagaagcagcagctgcctgagcagccctttgagaaggccgccttccagaagcagaatgacacccccaagggcccccagccccccaccgtgagccccatccgcagcagcaggcctcctccagccaagaggaagaagagccagagccggggcaacagccagctgctgctgtcctag

SEQ ID NO: 16230 - DNA, 2427 bp, Artificial Sequence
  Description of Artificial Sequence: Synthetic coding sequence
atgggcaggaagctggaccccaccaaggagaagaggggccctggcaggaaggccaggaagcagaagggagctgagacagagctggtgcgcttcctgcctgctgtgtctgatgagaacagcaagaggctgagcagccgggccaggaagagagctgccaagaggcggctgggctctgtggaggcccccaagaccaacaagagccctgaggccaagcccctgcccgggaagctgcccaagggagctgtgcagacagctgggaagaagggcccccagagcctcttcaatgccccccggggcaagaagaggcctgcccctggcagtgatgaggaggaggaggaggaggacagcgaggaggatggcatggtgaaccacggggacctgtggggctctgaagatgatgctgacacagtggatgattatggagctgacagcaacagtgaagatgaggaggagggggaggccctgctgcccatcgagagagctgccaggaagcagaaggcccgggaggccgccgccggcatccagtggagcgaggaggagacagaagatgaggaggaggagaaggaggtgaccccagagagcggcccccccaaggtggaggaggctgatggcggcctgcagatcaacgtggatgaggagccctttgtgctgcccccagctggggagatggagcaggatgcccaggccccagacctgcagagggtgcacaagaggatccaggacatcgtgggcatcctgcgggactttggagcccagcgggaggagggccgcagccgctctgagtacctgaaccggctgaagaaggacctggccatctactacagctatggagacttcctgctgggcaagctgatggacctcttccccctgtctgagctggtggagttcctggaggccaatgaggtgcccaggcctgtgaccctgcggaccaacaccctgaagaccaggagaagagacctggcccaggccctgatcaacagaggagtgaacctggaccccctgggcaagtggagcaagacaggcctggtggtgtatgacagctctgtgcccatcggggccaccccagagtacctggccggccactacatgctgcagggcgccagctccatgctgcctgtgatggccctggccccccaggagcacgagcgcatcctggacatgtgctgtgcccctgggggcaagaccagctacatggcccagctgatgaagaacacaggagtcatcctggccaatgatgccaatgctgagcggctgaagtctgtggtgggcaacctgcaccggctgggcgtgaccaacaccatcatcagccactatgatggccggcagttccccaaggtggtgggcggctttgacagagtgctgctggatgccccctgcagcggcaccggggtcatcagcaaggaccctgctgtgaagaccaacaaggatgagaaggacatcctgcgctgtgcccacctgcagaaggagctgctgctgagcgccattgattctgtgaatgccaccagcaagacaggaggctacctggtgtactgcacctgcagcatcaccgtggaggagaatgagtgggtggtggactatgccctgaagaagagaaatgtgcggctggtgcccaccggcctggactttggccaggagggcttcacccgcttccgggagcggcgcttccaccccagcctgcggagcacccggcgcttctacccccacacccacaacatggatggcttcttcatcgccaagttcaagaagttcagcaacagcatcccccagagccagacaggcaacagcgagacagccacccccaccaacgtggacctgccccaggtgatccccaagtctgagaacagcagccagcctgccaagaaggccaagggagctgccaagaccaagcagcagctgcagaagcagcagcaccccaagaaggccagcttccagaagctgaatggcatcagcaaaggagctgacagcgagctgagcacagtgcccagcgtgaccaagacccaggccagcagcagcttccaggacagcagccagcctgctgggaaggccgagggcatccgggagcccaaggtgacaggcaagctgaagcagaggagccccaagctgcagagcagcaagaaggtggccttcctgcggcagaatgccccacccaagggcacagacacccagaccccagctgtgctgagccccagcaagacccaggccaccctgaagcccaaggaccaccaccagcccctgggccgggccaagggcgtggagaagcagcagctgcctgagcagccctttgagaaggccgccttccagaagcagaatgacacccccaagggcccccagccccccaccgtgagccccatccgcagcagcaggcctcctccagccaagaggaagaagagccagagccggggcaacagccagctgctgctgtcctag

SEQ ID NO: 16231 - DNA, 2439 bp, Artificial Sequence; identical to SEQ ID NO: 16229
  Description of Artificial Sequence: Synthetic coding sequence

SEQ ID NO: 16232 - DNA, 2427 bp, Artificial Sequence; identical to SEQ ID NO: 16230
  Description of Artificial Sequence: Synthetic coding sequence

SEQ ID NO: 16233 - DNA, 2538 bp, Artificial Sequence
  Description of Artificial Sequence: Synthetic coding sequence
atgggcaggaagctggaccccaccaaggagaagaggggccctggcaggaaggccaggaagcagaagggagctgagacagagctggtgcgcttcctgcctgctgtgtctgatgagaacagcaagaggctgagcagccgggccaggaagagagctgccaagaggcggctgggctctgtggaggcccccaagaccaacaagagccctgaggccaagcccctgcccgggaagctgcccaagggcatctctgctggagctgtgcagacagctgggaagaagggcccccagagcctcttcaatgccccccggggcaagaagaggcctgcccctggcagtgatgaggaggaggaggaggaggacagcgaggaggatggcatggtgaaccacggggacctgtggggctctgaagatgatgctgacacagtggatgattatggagctgacagcaacagtgaagatgaggaggagggggaggccgccggcgtgcagtggctgggcctgggcagcctgcagcccccacctcctggcttcaagcagttcagctgcctgtccttccccagctcctgggacctgcagctgctgcccatcgagcgggccgccaggaagcagaaggcccgggaggccgctgctggcatccagtggagcgaggaggagacagaagatgaggaggaggagaaggaggtgaccccagagagcggcccccccaaggtggaggaggctgatggcggcctgcagatcaacgtggatgaggagccctttgtgctgcccccagctggggagatggagcaggatgcccaggccccagacctgcagagggtgcacaagaggatccaggacatcgtgggcatcctgcgggactttggagcccagcgggaggagggccgcagccgctctgagtacctgaaccggctgaagaaggacctggccatctactacagctatggagacttcctgctgggcaagctgatggacctcttccccctgtctgagctggtggagttcctggaggccaatgaggtgcccaggcctgtgaccctgcggaccaacaccctgaagacccggcggcgggacctggcccaggccctgatcaacagaggagtgaacctggaccccctgggcaagtggagcaagacaggcctggtggtgtatgacagctctgtgcccatcggggccaccccagagtacctggccggccactacatgctgcagggcgccagctccatgctgcctgtgatggccctggccccccaggagcacgagcgcatcctggacatgtgctgtgcccctgggggcaagaccagctacatggcccagctgatgaagaacacaggagtcatcctggccaatgatgccaatgctgagcggctgaagtctgtggtgggcaacctgcaccggctgggcgtgaccaacaccatcatcagccactatgatggccggcagttccccaaggtggtgggcggctttgacagagtgctgctggatgccccctgcagcggcactggagtcatcagcaaggaccctgctgtgaagaccaacaaggatgagaaggacatcctgcgctgtgcccacctgcagaaggagctgctgctgagcgccatcgacagcgtgaatgccaccagcaagacaggaggctacctggtgtactgcacctgcagcatcaccgtggaggagaatgagtgggtggtggactatgccctgaagaagagaaatgtgcggctggtgcccaccggcctggactttggccaggagggcttcacccgcttccgggagcggcgcttccaccccagcctgcggagcacccggcgcttctacccccacacccacaacatggatggcttcttcatcgccaagttcaagaagttcagcaacagcatcccccagagccagacaggcaacagcgagacagccacccccaccaacgtggacctgccccaggtgatccccaagtctgagaacagcagccagcctgccaagaaggccaagggggccgccaagaccaagcagcagctgcagaagcagcagcaccccaagaaggccagcttccagaagctgaatggcatcagcaaaggagctgacagcgagctgagcacagtgcccagcgtgaccaagacccaggccagcagcagcttccaggacagcagccagcctgctgggaaggccgagggcatccgggagcccaaggtgacaggcaagctgaagcagaggagccccaagctgcagagcagcaagaaggtggccttcctgcggcagaatgccccacccaagggcacagacacccagaccccagctgtgctgagccccagcaagacccaggccaccctgaagcccaaggaccaccaccagcccctgggccgggccaagggcgtggagaagcagcagctgcctgagcagccctttgagaaggccgccttccagaagcagaatgacacccccaagggcccccagcccccaacagtgagccccatccgcagcagccggcccccaccagccaagaggaagaagagccagagccggggcaacagccagctgctgctgtcctag

SEQ ID NO: 16234 - DNA, 1887 bp, Artificial Sequence
  Description of Artificial Sequence: Synthetic coding sequence
atgggcaggaagctggaccccaccaaggagaagaggggccctggcaggaaggccaggaagcagaagggagctgagacagagctggtgcgcttcctgcctgctgtgtctgatgagaacagcaagaggctgagcagccgggccaggaagagagctgccaagaggcggctgggctctgtggaggcccccaagaccaacaagagccctgaggccaagcccctgcccgggaagctgcccaagggagctgtgcagacagctgggaagaagggcccccagagcctcttcaatgccccccggggcaagaagaggcctgcccctggcagtgatgaggaggaggaggaggaggacagcgaggaggatggcatggtgaaccacggggacctgtggggctctgaagatgatgctgacacagtggatgattatggagctgacagcaacagtgaagatgaggaggagggggaggccctgctgcccatcgagagagctgccaggaagcagaaggcccgggaggccgccgccggcatccagtggagcgaggaggagacagaagatgaggaggaggagaaggaggtgaccccagagagcggcccccccaaggtggaggaggctgatggcggcctgcagatcaacgtggatgaggagccctttgtgctgcccccagctggggagatggagcaggatgcccaggccccagacctgcagagggtgcacaagaggatccaggacatcgtgggcatcctgcgggactttggagcccagcgggaggagggccgcagccgctctgagtacctgaaccggctgaagaaggacctggccatctactacagctatggagacttcctgctgggcaagctgatggacctcttccccctgtctgagctggtggagttcctggaggccaatgaggtgcccaggcctgtgaccctgcggaccaacaccctgaagaccaggagaagagacctggcccaggccctgatcaacagaggagtgaacctggaccccctgggcaagtggagcaagacaggcctggtggtgtatgacagctctgtgcccatcggggccaccccagagtacctggccggccactacatgctgcagggcgccagctccatgctgcctgtgatggccctggccccccaggagcacgagcgcatcctggacatgtgctgtgcccctgggggcaagaccagctacatggcccagctgatgaagaacacaggagtcatcctggccaatgatgccaatgctgagcggctgaagtctgtggtgggcaacctgcaccggctgggcgtgaccaacaccatcatcagccactatgatggccggcagttccccaaggtggtgggcggctttgacagagtgctgctggatgccccctgcagcggcaccggggtcatcagcaaggaccctgctgtgaagaccaacaaggatgagaaggacatcctgcgctgtgcccacctgcagaaggagctgctgctgagcgccattgattctgtgaatgccaccagcaagacaggaggctacctggtgtactgcacctgcagcatcaccgtggaggagaatgagtgggtggtggactatgccctgaagaagagaaatgtgcggctggtgcccaccggcctggactttggccaggagggcttcacccgcttccgggagcggcgcttccaccccagcctgcggagcacccggcgcttctacccccacacccacaacatggatggcttcttcatcgccaagttcaagaagttcagcaacagcatcccccagagccagacagatggagtgctgctgtgccgcagcggctggacagctgtggtgcagagccagctgattgccaccagcaccttccaggtgcaggccatcctggtgccccagacccccaagtag

SEQ ID NO: 16235 - DNA, 582 bp, Artificial Sequence
  Description of Artificial Sequence: Synthetic coding sequence
atggccctgagcacagattatgccctgaggactggagcctttgagcctgctgaggcctctgtgaacccccaggacctgcagggcagcctgcaggagctgaaggagcgggccctgagccgctacaacctggtgcggggccagggccctgagcggctggtgtctggcagtgatgacttcaccctcttcctgtggagccctgctgaggacaagaagcccctgaccaggatgacaggccaccaggccctgatcaaccaggtgctcttctccccagacagccgcatcgtggccagcgccagctttgacaagagcatcaagctgtgggatggccgcacaggcaagtacctggccagcctgcggggccacgtggccgctgtgtaccagatcgcctggagcgctgacagccggctgctggtgtctggcagcagtgacagcaccctgaaggtgtgggatgtgaaggcccagaagctggccatggacctgcccggccacgcagatgaggtgtatgctgtggactggagcccagatggccagagggtggccagcggcggcaaggacaagtgcctgcgcatctggaggaggtag

SEQ ID NO: 16236 - DNA, 915 bp, Artificial Sequence
  Description of Artificial Sequence: Synthetic coding sequence
tgaagcagcaaggatggctctgtgcgcatctgggacaccacagctggccgctgtgagcgcatcctgaccggccacacccagagcgtgacctgcctgcgctggggcggagatggcctgctgtacagcgccagccaggacaggaccatcaaggtgtggagggcccatgatggagtgctgtgcaggaccctgcagggccacggccactgggtgaacaccatggccctgagcacagattatgccctgaggactggagcctttgagcctgctgaggcctctgtgaacccccaggacctgcagggcagcctgcaggagctgaaggagcgggccctgagccgctacaacctggtgcggggccagggccctgagcggctggtgtctggcagtgatgacttcaccctcttcctgtggagccctgctgaggacaagaagcccctgaccaggatgacaggccaccaggccctgatcaaccaggtgctcttctccccagacagccgcatcgtggccagcgccagctttgacaagagcatcaagctgtgggatggccgcacaggcaaggatgacttccacagcgtgacctggtgcagcagcggcagcagcgctgctgcccgctcctggctgatcaccaccagcgcctcctgggtgcaggtgatcctgctgccccagcccccacgctacctggccagcctgcggggccacgtggccgctgtgtaccagatcgcctggagcgctgacagccggctgctggtgtctggcagcagtgacagcaccctgaaggtgtgggatgtgaaggcccagaagctggccatggacctgcccggccatgctgatgaggtgtatgctgtggactggagcccagatggccagagggtggccagcggcggcaaggacaagtgcctgcgcatctggaggaggtag

SEQ ID NO: 16237 - DNA, 1458 bp, Artificial Sequence
  Description of Artificial Sequence: Synthetic coding sequence
atggctgctgctgtgcctgatgaagctgtggccagagatgtgcagaggctgctggtgcagttccaggatgaaggaggccagctgctgggcagcccctttgatgtgcctgtggacatcaccccagaccggctgcagctggtgtgcaatgccctgctggcccaggaggaccccctgcccctggccttctttgtgcatgatgctgagatcgtgagcagcctgggcaagaccctggagagccaggccgtggagacagagaaggtgctggacatcatctaccagccccaggccatcttccgggtgcgggctgtgacccgctgcaccagcagcctggagggccacagcgaggccgtcatctctgtggccttcagccccaccgggaagtacctggccagcggcagcggggacaccaccgtgcgcttctgggacctgagcacagagaccccccacttcacctgcaagggccaccgccactgggtgctgagcatctcctggagcccagatggcaggaagctggccagcggctgcaagaatggccagatcctgctgtgggaccccagcacaggcaagcaggtgggccgcaccctggccggccacagcaagtggatcaccggcctgtcctgggagcccctgcacgccaacccagaatgtcgctacgtggccagcagcagcaaggatggctctgtgcgcatctgggacaccacagctggccgctgtgagcgcatcctgaccggccacacccagagcgtgacctgcctgcgctggggcggagatggcctgctgtacagcgccagccaggacaggaccatcaaggtgtggagggcccatgatggagtgctgtgcaggaccctgcagggccacggccactgggtgaacaccatggccctgagcacagattatgccctgaggactggagcctttgagcctgctgaggcctctgtgaacccccaggacctgcagggcagcctgcaggagctgaaggagcgggccctgagccgctacaacctggtgcggggccagggccctgagcggctggtgtctggcagtgatgacttcaccctcttcctgtggagccctgctgaggacaagaagcccctgaccaggatgacaggccaccaggccctgatcaaccaggtgctcttctccccagacagccgcatcgtggccagcgccagctttgacaagagcatcaagctgtgggatggccgcacaggcaagtacctggccagcctgcggggccacgtggccgctgtgtaccagatcgcctggagcgctgacagccggctgctggtgtctggcagcagtgacagcaccctgaaggtgtgggatgtgaaggcccagaagctggccatggacctgcccggccacgcagatgaggtgtatgctgtggactggagcccagatggccagagggtggccagcggcggcaaggacaagtgcctgcgcatctggaggaggtag

SEQ ID NO: 16238 - DNA, 1386 bp, Artificial Sequence
  Description of Artificial Sequence: Synthetic coding sequence
atggctgctgctgtgcctgatgaagctgtggccagagatgtgcagaggctgctggtgcagttccaggatgaaggaggccagctgctgggcagcccctttgatgtgcctgtggacatcaccccagaccggctgcagctggtgtgcaatgccctgctggcccaggaggaccccctgcccctggccttctttgtgcatgatgctgagatcgtgagcagcctgggcaagaccctggagagccaggccgtggagacagagaaggtgctggacatcatctaccagccccaggccatcttccgggtgcgggctgtgacccgctgcaccagcagcctggagggccacagcgaggccgtcatctctgtggccttcagccccaccgggaagtacctggccagcggcagcggggacaccaccgtgcgcttctgggacctgagcacagagaccccccacttcacctgcaagggccaccgccactgggtgctgagcatctcctggagcccagatggcaggaagctggccagcggctgcaagaatggccagatcctgctgtgggagcccctgcacgccaacccagaatgtcgctacgtggccagcagcagcaaggatggctctgtgcgcatctgggacaccacagctggccgctgtgagcgcatcctgaccggccacacccagagcgtgacctgcctgcgctggggcggagatggcctgctgtacagcgccagccaggacaggaccatcaaggtgtggagggcccatgatggagtgctgtgcaggaccctgcagggccacggccactgggtgaacaccatggccctgagcacagattatgccctgaggactggagcctttgagcctgctgaggcctctgtgaacccccaggacctgcagggcagcctgcaggagctgaaggagcgggccctgagccgctacaacctggtgcggggccagggccctgagcggctggtgtctggcagtgatgacttcaccctcttcctgtggagccctgctgaggacaagaagcccctgaccaggatgacaggccaccaggccctgatcaaccaggtgctcttctccccagacagccgcatcgtggccagcgccagctttgacaagagcatcaagctgtgggatggccgcacaggcaagtacctggccagcctgcggggccacgtggccgctgtgtaccagatcgcctggagcgctgacagccggctgctggtgtctggcagcagtgacagcaccctgaaggtgtgggatgtgaaggcccagaagctggccatggacctgcccggccacgcagatgaggtgtatgctgtggactggagcccagatggccagagggtggccagcggcggcaaggacaagtgcctgcgcatctggaggaggtag

SEQ ID NO: 16239 - DNA, 582 bp, Artificial Sequence; identical to SEQ ID NO: 16235
  Description of Artificial Sequence: Synthetic coding sequence

SEQ ID NO: 16240 - DNA, 756 bp, Artificial Sequence
  Description of Artificial Sequence: Synthetic coding sequence
atgcccagcccccggccccggggcagccccccaccagcccccagcggcagccgggtgcggcccccaagaagtggccgcagccctgcccccaggagccccaccggccccaacaccccccgggcccctggccgctttgagagccccttctctgtggaggccatcctggcccggccagacccctgtgccccagctgccagccagcccagcggcagcgcctgtgtgcacccagccttctggacagctgccagcctgtgtgccactggaggcctgccctgggcctgccccacctcctggctgcctgcctacctgtctgtgggcttctaccctgtgcccggcccccgggtggcccctgtgtgtggcctgctgggcttcggcgtgacaggcctggagctggcccactgcagcggcctgtgggccttcccagactgggcccccacagaggacctgcaggacacagagcggcagcagaagagggtgaggaccatgttcaacctggagcagctggaggagctggagaaggtgtttgccaagcagcacaacctggtgggcaagaagagggcccagctggccgcccggctgaagctgacagagaaccaggtgcgggtgtggttccagaacagaagagtgaagtaccagaagcagcagaagctgcgggctgctgtgaccagcgctgaggccgccagcctggatgagcccagcagcagcagcatcgccagcatccagagtgatgatgctgagagcggcgtggatggatag

SEQ ID NO: 16241 - DNA, 1110 bp, Artificial Sequence
  Description of Artificial Sequence: Synthetic coding sequence
atgttctgctgcctgggctatgagtggctgagcggcggctgcaagacctggcacagcgcctgggtgatcaacaccctggccgaccaccgccaccggggcacagactttggaggcagcccctggctgctgatcatcaccgtcttcctgcggagctacaagtttgccatcagcctgtgcaccagctacctgtgtgtgtccttcctgaagaccatcttccccagccagaatggacatgatggcagcacagatgtgcagcagagggcccggcgcagcaactgccggcggcaggagggcatcaagatcgtgctggaggacatcttcaccctgtggaggcaggtggagaccaaggtgcgggccaagatcaggaagatgaaggtgaccaccaaggtgaacagacatgacaagatcaatggcaagaggaagacagccaaggagcacctgaggaagctgtccatgaaggagcgggagcacggggagaaggagcggcaggtgtctgaggccgaggagaatggcaagctggacatgaaggagatccacacctacatggagatgttccagagggcccaggccctgcggaggagagctgaggactactaccgctgcaagatcacccccagcgccaggaagcccctgtgcaacagagtgaggatggctgctgtggagcaccgccacagcagcggcctgccctactggccctacctgacagctgagaccctgaagaacaggatgggccaccagcccccaccacccacccagcagcacagcatcatcgacaacagcctgagcctgaagaccccatctgaatgtgtgctgtaccccctgcccccatctgcagatgacaacctgaagaccccaccagaatgtctgctgacccccctgccccccagcgccctgcccagcgcagatgacaacctgaagaccccagctgagtgcctgctgtaccccctgcccccatctgcagatgacaacctgaagaccccaccagaatgtctgctgacccccctgccccccagcgccccacccagcgcagatgacaacctgaagaccccaccagaatgtgtgtgcagcctgcccttccacccccagaggatgatcatcagcaggaactag

SEQ ID NO: 16242 - DNA, 1110 bp, Artificial Sequence; identical to SEQ ID NO: 16241
  Description of Artificial Sequence: Synthetic coding sequence

SEQ ID NO: 16243 - DNA, 1110 bp, Artificial Sequence; identical to SEQ ID NO: 16241
  Description of Artificial Sequence: Synthetic coding sequence

SEQ ID NO: 16244 - DNA, 699 bp, Artificial Sequence
  Description of Artificial Sequence: Synthetic coding sequence
atgttctgctgcctgggctatgagtggctgagcggcggctgcaagacctggcacagcgcctgggtgatcaacaccctggccgaccaccgccaccggggcacagactttggaggcagcccctggctgctgatcatcaccgtcttcctgcggagctacaagtttgccatcagcctgtgcaccagctacctgtgtgtgtccttcctgaagaccatcttccccagccagaatggacatgatggcagcacagatgtgcagcagagggcccggcgcagcaactgccggcggcaggagggcatcaagatcgtgctggaggacatcttcaccctgtggaggcaggtggagaccaaggtgcgggccaagatcaggaagatgaaggtgaccaccaaggtgaacagacatgacaagatcaatggcaagaggaagacagccaaggagcacctgaggaagctgtccatgaaggagcgggagcacggggagaaggagcggcaggtgtctgaggccgaggagaatggcaagctggacatgaaggagatccacacctacatggagatgttccagagggcccaggccctgcggaggagagctgaggactactaccgctgcaagatcacccccagcgccaggaagcccctgtgcaaccgctgcacctacaacctggtgctgcccggcagcgagaagaagtactacagccacgcctag

SEQ ID NO: 16245 - DNA, 699 bp, Artificial Sequence; identical to SEQ ID NO: 16244
  Description of Artificial Sequence: Synthetic coding sequence

SEQ ID NO: 16246 - DNA, 1110 bp, Artificial Sequence; identical to SEQ ID NO: 16241
  Description of Artificial Sequence: Synthetic coding sequence

SEQ ID NO: 16247 - DNA, 2067 bp, Artificial Sequence
  Description of Artificial Sequence: Synthetic coding sequence
atggagaatggagtgctgggcaatgccctggagggcgtgcacgtggaggaggaggagggggagaagacagaagatgagagcctggtggagaacaatgacaacattgatgaggaggcccgggaggagctgcgggagcaggtgtatgatgccatgggagagaaggaggaggccaagaagacagaggacaagagcctggccaagccagagacagacaaggagcaggacagcgagatggagaagggcggccgggaggacatggacatcagcaagtctgctgaggagccccaggagaaggtggacctgaccctggactggctgacagagaccagcgaggaggccaagggcggggccgcccctgagggccccaatgaagctgaggtgaccagcggcaagccagagcaggaggtgcctgatgctgaggaggagaagtctgtgtctggaacagatgtgcaggaggagtgccgggagaagggcggccaggagaagcagggcgaggtgattgtgtccattgaggagaagcccaaggaggtgtctgaggagcagcctgtggtgaccctggagaagcagggcacagctgtggaggtggaggccgagagcctggaccccaccgtgaagcctgtggatgtgggcggagatgagcctgaggagaaggtggtgaccagtgaaaatgaagctgggaaggctgtgctggagcagctggtgggccaggaggtgcccccagctgaggagagccctgaggtgaccacagaagctgctgaggccagcgctgtggaggccggcagcgaggtgtctgagaagccaggccaggaggcccctgtgctgcccaaggatggagctgtgaatggccccagcgtggtgggggaccagacccccatcgagccccagaccagcattgaaaggctgacagagaccaaggatggcagcggcctggaggagaaggtgcgggccaagctggtgcccagccaggaggagaccaagctgtctgtggaggagagcgaggccgctggagatggagtggacaccaaggtggcccagggcgccacagagaagagccctgaggacaaggtgcagattgctgccaatgaggagacccaggagcgggaggagcagatgaaggagggggaggagacagagggcagcgaggaggatgacaaggaaaatgacaagacagaggagatgcccaatgattctgtgctggagaacaagagcctgcaggagaatgaggaggaggagatcggcaacctggagctggcctgggacatgctggacctggccaagatcatcttcaagaggcaggagaccaaggaggcccagctgtatgctgcccaggcccacctgaagctgggggaggtgtctgtggagagcgagaactacgtgcaggccgtggaggagttccagagctgcctgaacctgcaggagcagtacctggaggcccatgaccggctgctggccgagacccactaccagctgggcctggcctacggctacaacagccagtatgatgaagctgtggcccagttcagcaagagcattgaggtgattgaaaataggatggctgtgctgaatgagcaggtgaaggaggccgagggcagcagcgctgagtacaagaaggagattgaggagctgaaggagctgctgcctgagatccgggagaagattgaagatgccaaggagagccagaggtctggaaatgtggccgagctggccctgaaggccaccctggtggagagcagcaccagcggcttcacccctgggggcggcggcagctctgtgtccatgattgccagcaggaagcccacagatggagccagcagcagcaactgtgtgacagacatcagccacctggtgaggaagaagaggaagccagaggaggagagccccaggaaggatgatgccaagaaggccaagcaggagcctgaggtgaatggaggcagcggagatgctgtgcccagcggaaatgaggtgtctgagaacatggaggaggaggccgagaaccaggccgagagcagagctgctgtggagggcaccgtggaggccggggccaccgtggagagcacagcctgctag

SEQ ID NO: 16248 - DNA, 2367 bp, Artificial Sequence
  Description of Artificial Sequence: Synthetic coding sequence
atggccatggagagcacagccacagctgctgtggccgctgagctggtgtctgctgacaagattgaagatgtgcctgcccccagcaccagcgctgacaaggtggagagcctggatgtggacagcgaggccaagaagctgctgggcctgggccagaagcacctggtgatgggagacatcccagctgctgtgaatgccttccaggaggccgccagcctgctgggcaagaagtatggagaaacagccaatgaatgtggggaggccttcttcttctacggcaagagcctgctggagctggccaggatggagaatggagtgctgggcaatgccctggagggcgtgcacgtggaggaggaggagggggagaagacagaagatgagagcctggtggagaacaatgacaacattgatgaggaggcccgggaggagctgcgggagcaggtgtatgatgccatgggagagaaggaggaggccaagaagacagaggacaagagcctggccaagccagagacagacaaggagcaggacagcgagatggagaagggcggccgggaggacatggacatcagcaagtctgctgaggagccccaggagaaggtggacctgaccctggactggctgacagagaccagcgaggaggccaagggcggggccgcccctgagggccccaatgaagctgaggtgaccagcggcaagccagagcaggaggtgcctgatgctgaggaggagaagtctgtgtctggaacagatgtgcaggaggagtgccgggagaagggcggccaggagaagcagggcgaggtgattgtgtccattgaggagaagcccaaggaggtgtctgaggagcagcctgtggtgaccctggagaagcagggcacagctgtggaggtggaggccgagagcctggaccccaccgtgaagcctgtggatgtgggcggagatgagcctgaggagaaggtggtgaccagtgaaaatgaagctgggaaggctgtgctggagcagctggtgggccaggaggtgcccccagctgaggagagccctgaggtgaccacagaagctgctgaggccagcgctgtggaggccggcagcgaggtgtctgagaagccaggccaggaggcccctgtgctgcccaaggatggagctgtgaatggccccagcgtggtgggggaccagacccccatcgagccccagaccagcattgaaaggctgacagagaccaaggatggcagcggcctggaggagaaggtgcgggccaagctggtgcccagccaggaggagaccaagctgtctgtggaggagagcgaggccgctggagatggagtggacaccaaggtggcccagggcgccacagagaagagccctgaggacaaggtgcagattgctgccaatgaggagacccaggagcgggaggagcagatgaaggagggggaggagacagagggcagcgaggaggatgacaaggaaaatgacaagacagaggagatgcccaatgattctgtgctggagaacaagagcctgcaggagaatgaggaggaggagatcggcaacctggagctggcctgggacatgctggacctggccaagatcatcttcaagaggcaggagaccaaggaggcccagctgtatgctgcccaggcccacctgaagctgggggaggtgtctgtggagagcgagaactacgtgcaggccgtggaggagttccagagctgcctgaacctgcaggagcagtacctggaggcccatgaccggctgctggccgagacccactaccagctgggcctggcctacggctacaacagccagtatgatgaagctgtggcccagttcagcaagagcattgaggtgattgaaaataggatggctgtgctgaatgagcaggtgaaggaggccgagggcagcagcgctgagtacaagaaggagattgaggagctgaaggagctgctgcctgagatccgggagaagattgaagatgccaaggagagccagaggtctggaaatgtggccgagctggccctgaaggccaccctggtggagagcagcaccagcggcttcacccctgggggcggcggcagctctgtgtccatgattgccagcaggaagcccacagatggagccagcagcagcaactgtgtgacagacatcagccacctggtgaggaagaagaggaagccagaggaggagagccccaggaaggatgatgccaagaaggccaagcaggagcctgaggtgaatggaggcagcggagatgctgtgcccagcggaaatgaggtgtctgagaacatggaggaggaggccgagaaccaggccgagagcagagctgctgtggagggcaccgtggaggccggggccaccgtggagagcacagcctgctag

SEQ ID NO: 16249 - DNA, 1350 bp, Artificial Sequence
  Description of Artificial Sequence: Synthetic coding sequence
atggccatggagagcacagccacagctgctgtggccgctgagctggtgtctgctgacaagattgaagatgtgcctgcccccagcaccagcgctgacaaggtggagagcctggatgtggacagcgaggccaagaagctgctgggcctgggccagaagcacctggtgatgggagacatcccagctgctgtgaatgccttccaggaggccgccagcctgctgggcaagaagtatggagaaacagccaatgaatgtggggaggccttcttcttctacggcaagagcctgctggagctggccaggatggagaatggagtgctgggcaatgccctggagggcgtgcacgtggaggaggaggagggggagaagacagaagatgagagcctggtggagaacaatgacaacattgatgaaacagagggctctgaagaagatgacaaggaaaatgacaagacagaggagatgcccaatgacagcgtgctggagaacaagagcctgcaggagaatgaggaggaggagatcggcaacctggagctggcctgggacatgctggacctggccaagatcatcttcaagaggcaggagaccaaggaggcccagctgtatgctgcccaggcccacctgaagctgggggaggtgtctgtggagagtgaaaattatgtgcaggccgtggaggagttccagagctgcctgaacctgcaggagcagtacctggaggcccatgaccggctgctggccgagacccactaccagctgggcctggcctacggctacaacagccagtatgatgaggccgtggcccagttcagcaagagcattgaggtgattgagaacaggatggctgtgctgaatgagcaggtgaaggaggccgagggcagcagcgctgagtacaagaaggagattgaggagctgaaggagctgctgcctgagatccgggagaagattgaagatgccaaggagagccagaggtctggaaatgtggccgagctggccctgaaggccaccctggtggagagcagcaccagcggcttcaccccaggcggcggcggcagctctgtgtccatgattgccagcaggaagcccacagatggagccagcagcagcaactgtgtgacagacatcagccacctggtgaggaagaagaggaagccagaggaggagagccccaggaaggatgatgccaagaaggccaagcaggagcctgaggtgaatggaggcagcggagatgctgtgcccagcggaaatgaggtgtctgagaacatggaggaggaggccgagaaccaggccgagagcagagctgctgtggagggcaccgtggaggccggggccaccgtggagagcacagcctgctag

SEQ ID NO: 16250 - DNA, 2373 bp, Artificial Sequence
  Description of Artificial Sequence: Synthetic coding sequence
atgttcctgctgctgctgcacctgcagatcaagtggagggccaccatcaacctgctgtctgtgacagaagatggcctgcactttgtggagtactacctgaaccgcatcatccacctggatgtggacagcgaggccaagaagctgctgggcctgggccagaagcacctggtgatgggagacatcccagctgctgtgaatgccttccaggaggccgccagcctgctgggcaagaagtatggagaaacagccaatgaatgtggggaggccttcttcttctacggcaagagcctgctggagctggccaggatggagaatggagtgctgggcaatgccctggagggcgtgcacgtggaggaggaggagggggagaagacagaagatgagagcctggtggagaacaatgacaacattgatgaggaggcccgggaggagctgcgggagcaggtgtatgatgccatgggagagaaggaggaggccaagaagacagaggacaagagcctggccaagccagagacagacaaggagcaggacagcgagatggagaagggcggccgggaggacatggacatcagcaagtctgctgaggagccccaggagaaggtggacctgaccctggactggctgacagagaccagcgaggaggccaagggcggggccgcccctgagggccccaatgaagctgaggtgaccagcggcaagccagagcaggaggtgcctgatgctgaggaggagaagtctgtgtctggaacagatgtgcaggaggagtgccgggagaagggcggccaggagaagcagggcgaggtgattgtgtccattgaggagaagcccaaggaggtgtctgaggagcagcctgtggtgaccctggagaagcagggcacagctgtggaggtggaggccgagagcctggaccccaccgtgaagcctgtggatgtgggcggagatgagcctgaggagaaggtggtgaccagtgaaaatgaagctgggaaggctgtgctggagcagctggtgggccaggaggtgcccccagctgaggagagccctgaggtgaccacagaagctgctgaggccagcgctgtggaggccggcagcgaggtgtctgagaagccaggccaggaggcccctgtgctgcccaaggatggagctgtgaatggccccagcgtggtgggggaccagacccccatcgagccccagaccagcattgaaaggctgacagagaccaaggatggcagcggcctggaggagaaggtgcgggccaagctggtgcccagccaggaggagaccaagctgtctgtggaggagagcgaggccgctggagatggagtggacaccaaggtggcccagggcgccacagagaagagccctgaggacaaggtgcagattgctgccaatgaggagacccaggagcgggaggagcagatgaaggagggggaggagacagagggcagcgaggaggatgacaaggaaaatgacaagacagaggagatgcccaatgattctgtgctggagaacaagagcctgcaggagaatgaggaggaggagatcggcaacctggagctggcctgggacatgctggacctggccaagatcatcttcaagaggcaggagaccaaggaggcccagctgtatgctgcccaggcccacctgaagctgggggaggtgtctgtggagagcgagaactacgtgcaggccgtggaggagttccagagctgcctgaacctgcaggagcagtacctggaggcccatgaccggctgctggccgagacccactaccagctgggcctggcctacggctacaacagccagtatgatgaagctgtggcccagttcagcaagagcattgaggtgattgaaaataggatggctgtgctgaatgagcaggtgaaggaggccgagggcagcagcgctgagtacaagaaggagattgaggagctgaaggagctgctgcctgagatccgggagaagattgaagatgccaaggagagccagaggtctggaaatgtggccgagctggccctgaaggccaccctggtggagagcagcaccagcggcttcacccctgggggcggcggcagctctgtgtccatgattgccagcaggaagcccacagatggagccagcagcagcaactgtgtgacagacatcagccacctggtgaggaagaagaggaagccagaggaggagagccccaggaaggatgatgccaagaaggccaagcaggagcctgaggtgaatggaggcagcggagatgctgtgcccagcggaaatgaggtgtctgagaacatggaggaggaggccgagaaccaggccgagagcagagctgctgtggagggcaccgtggaggccggggccaccgtggagagcacagcctgctag

SEQ ID NO: 16251 - DNA, 771 bp, Artificial Sequence
  Description of Artificial Sequence: Synthetic coding sequence
atggccatggagagcacagccacagctgctgtggccgctgagctggtgtctgctgacaagattgaagatgtgcctgcccccagcaccagcgctgacaaggtggagagcctggatgtggacagcgaggccaagaagctgctgggcctgggccagaagcacctggtgatgggagacatcccagctgctgtgaatgccttccaggaggccgccagcctgctgggcaagaagtatggagaaacagccaatgaatgtggggaggccttcttcttctacggcaagagcctgctggagctggccaggatggagaatggagtgctgggcaatgccctggagggcgtgcacgtggaggaggaggagggggagaagacagaagatgagagcctggtggagaacaatgacaacattgatgaaacagagggctctgaagaagatgacaaggaaaatgacaagacagaggagatgcccaatgacagcgtgctggagaacaagagcctgcaggagaatgaggaggaggagatcggcaacctggagctggcctgggacatgctggacctggccaagatcatcttcaagaggcaggagaccaaggaggcccagctgtatgctgcccaggcccacctgaagctgggggaggtgtctgtggagagtgaaaattatgtgcaggccgtggaggagttccagagctgcctgaacctgcaggagcagtacctggaggcccatgaccggctgctggccgagacccactaccagctgggcctggcctatggatag

SEQ ID NO: 16252 - DNA, 2175 bp, Artificial Sequence
  Description of Artificial Sequence: Synthetic coding sequence
atggccatggagagcacagccacagctgctgtggccgctgagctggtgtctgctgacaagattgaagatgtgcctgcccccagcaccagcgctgacaaggtggagaggatggagaatggagtgctgggcaatgccctggagggcgtgcacgtggaggaggaggagggggagaagacagaagatgagagcctggtggagaacaatgacaacattgatgaggaggcccgggaggagctgcgggagcaggtgtatgatgccatgggagagaaggaggaggccaagaagacagaggacaagagcctggccaagccagagacagacaaggagcaggacagcgagatggagaagggcggccgggaggacatggacatcagcaagtctgctgaggagccccaggagaaggtggacctgaccctggactggctgacagagaccagcgaggaggccaagggcggggccgcccctgagggccccaatgaagctgaggtgaccagcggcaagccagagcaggaggtgcctgatgctgaggaggagaagtctgtgtctggaacagatgtgcaggaggagtgccgggagaagggcggccaggagaagcagggcgaggtgattgtgtccattgaggagaagcccaaggaggtgtctgaggagcagcctgtggtgaccctggagaagcagggcacagctgtggaggtggaggccgagagcctggaccccaccgtgaagcctgtggatgtgggcggagatgagcctgaggagaaggtggtgaccagtgaaaatgaagctgggaaggctgtgctggagcagctggtgggccaggaggtgcccccagctgaggagagccctgaggtgaccacagaagctgctgaggccagcgctgtggaggccggcagcgaggtgtctgagaagccaggccaggaggcccctgtgctgcccaaggatggagctgtgaatggccccagcgtggtgggggaccagacccccatcgagccccagaccagcattgaaaggctgacagagaccaaggatggcagcggcctggaggagaaggtgcgggccaagctggtgcccagccaggaggagaccaagctgtctgtggaggagagcgaggccgctggagatggagtggacaccaaggtggcccagggcgccacagagaagagccctgaggacaaggtgcagattgctgccaatgaggagacccaggagcgggaggagcagatgaaggagggggaggagacagagggcagcgaggaggatgacaaggaaaatgacaagacagaggagatgcccaatgattctgtgctggagaacaagagcctgcaggagaatgaggaggaggagatcggcaacctggagctggcctgggacatgctggacctggccaagatcatcttcaagaggcaggagaccaaggaggcccagctgtatgctgcccaggcccacctgaagctgggggaggtgtctgtggagagcgagaactacgtgcaggccgtggaggagttccagagctgcctgaacctgcaggagcagtacctggaggcccatgaccggctgctggccgagacccactaccagctgggcctggcctacggctacaacagccagtatgatgaagctgtggcccagttcagcaagagcattgaggtgattgaaaataggatggctgtgctgaatgagcaggtgaaggaggccgagggcagcagcgctgagtacaagaaggagattgaggagctgaaggagctgctgcctgagatccgggagaagattgaagatgccaaggagagccagaggtctggaaatgtggccgagctggccctgaaggccaccctggtggagagcagcaccagcggcttcacccctgggggcggcggcagctctgtgtccatgattgccagcaggaagcccacagatggagccagcagcagcaactgtgtgacagacatcagccacctggtgaggaagaagaggaagccagaggaggagagccccaggaaggatgatgccaagaaggccaagcaggagcctgaggtgaatggaggcagcggagatgctgtgcccagcggaaatgaggtgtctgagaacatggaggaggaggccgagaaccaggccgagagcagagctgctgtggagggcaccgtggaggccggggccaccgtggagagcacagcctgctag

SEQ ID NO: 16253 - DNA, 453 bp, Artificial Sequence
  Description of Artificial Sequence: Synthetic coding sequence
atgaggagctgctgcgtggtgcaggccggcctgcagctgctggccagcagtgacccccccagcagcgccagccagagcgcccgcatcaccggggtgaaccacaggaccccaccccgggagatcaagagcaacaagacagtgctgcacctggccgtgcaggccgccaaccccaccctggtgcagctgctgctggagctgcccaggggggacctgcggacctttgtgaacatgaaggcccacggcaacacagccctgcacatggctgctgccctgcccccaggccctgcccaggaggccatcgtgcgccacctgctggccgccggggctgaccccaccctgaggaacctggagaatgagcagcctgtgcacctgctgcggcccggccctggccctgagggcctgcggcagctgctgaagaggagccgggtggcccctcctggcctgagcagctag

SEQ ID NO: 16254 - DNA, 1398 bp, Artificial Sequence
  Description of Artificial Sequence: Synthetic coding sequence
atgtgggtgtgcctgcggggcatcctggacagccaggccttctggcatgagaccctgcggcgctgggagtgcctgctggccgagatgaaggtgtccagaggagagaggagccactgccccacccagacagtgaagaagctgctggaggagcagaggcggcggcagcagcagcagccagatgctggaggagtgcagggccagttcctgcccccacctgagcagcccctgaccccatctgtgaatgaagctgtgacaggccacccccccttccctgcccacagcgagaccgtgggcagcggccccagcagcctgggcttcccagactgggaccccaacacccatgctgcctacacagacagcccctacagctgcccagccagcgctgctgagaacttcctgcccccagacttctacccacccagcgaccccggccagccctgccccttcccccagggcatggaggccggcccctggagggtgtctgcccctccttctggccccccccagtttcctgctgtggtgcccggccccagcctggaggtggcccgggcccacatgctggccctgggcccccagcagctgctggcccaggatgaggagggggacaccctgctgcacctgtttgctgcccggggcctgcgctgggccgcctatgctgctgctgaggtgctgcaggtgtaccgccgcctggacatccgggagcacaagggcaagacccccctgctggtggccgccgccgccaaccagcccctcatcgtggaggacctgctgaacctgggcgctgagcccaatgctgctgaccaccagggccgctctgtgctgcacgtggccgccacctacggcctgcccggggtgctgctggccgtgctgaacagcggcgtgcaggtggacctggaggcccgggactttgagggcctgacccccctgcacacagccatcctggccctgaatgtggccatgaggcccagcgacctgtgcccccgggtgctgagcacccaggcccgggaccggctggactgtgtgcacatgctgctgcagatgggcgccaaccacaccagccaggagatcaagagcaacaagacagtgctgcacctggccgtgcaggccgccaaccccaccctggtgcagctgctgctggagctgcccaggggggacctgcggacctttgtgaacatgaaggcccacggcaacacagccctgcacatggccgccgccctgcccccaggccctgcccaggaggccatcgtgcgccacctgctggccgccggggctgaccccaccctgaggaacctggagaatgagcagcctgtgcacctgctgcggcccggccctggccctgagggcctgcggcagctgctgaagaggagccgggtggcccctcctggcctgagcagctag

SEQ ID NO: 16255 - DNA, 942 bp, Artificial Sequence
  Description of Artificial Sequence: Synthetic coding sequence
atggaggccggcccctggagggtgtctgcccctccttctggccccccccagtttcctgctgtggtgcccggccccagcctggaggtggcccgggcccacatgctggccctgggcccccagcagctgctggcccaggatgaggagggggacaccctgctgcacctgtttgctgcccggggcctgcgctgggccgcctatgctgctgctgaggtgctgcaggtgtaccgccgcctggacatccgggagcacaagggcaagacccccctgctggtggccgccgccgccaaccagcccctcatcgtggaggacctgctgaacctgggcgctgagcccaatgctgctgaccaccagggccgctctgtgctgcacgtggccgccacctacggcctgcccggggtgctgctggccgtgctgaacagcggcgtgcaggtggacctggaggcccgggactttgagggcctgacccccctgcacacagccatcctggccctgaatgtggccatgaggcccagcgacctgtgcccccgggtgctgagcacccaggcccgggaccggctggactgtgtgcacatgctgctgcagatgggcgccaaccacaccagccaggagatcaagagcaacaagacagtgctgcacctggccgtgcaggccgccaaccccaccctggtgcagctgctgctggagctgcccaggggggacctgcggacctttgtgaacatgaaggcccacggcaacacagccctgcacatggccgccgccctgcccccaggccctgcccaggaggccatcgtgcgccacctgctggccgccggggctgaccccaccctgaggaacctggagaatgagcagcctgtgcacctgctgcggcccggccctggccctgagggcctgcggcagctgctgaagaggagccgggtggcccctcctggcctgagcagctag

SEQ ID NO: 16256 - DNA, 543 bp, Artificial Sequence
  Description of Artificial Sequence: Synthetic coding sequence
atgaggcccctgacagaggaggagaccagggtgatgtttgagaagatcgccaagtacatcggggagaacctgcagctgctggtggacagaccagatggcacctactgcttccggctgcacaatgacagagtgtactacgtgtctgagaagatcatgaagctggccgccaacatcagcggggacaagctggtgtccctgggcacctgcttcggcaagttcaccaagacccacaagttccggctgcacgtgacagccctggactacctggccccctatgccaagtacaaggtgtggatcaagccaggagctgagcagagcttcctgtatggcaaccacgtgctgaagagcggcctgggccgcatcacagagaacaccagccagtaccagggcgtggtggtgtacagcatggctgacatccccctgggctttggagtggccgccaagagcacccaggactgcaggaaggtggaccccatggccatcgtggtgttccaccaggccgacattggagaatatgtgagacatgaggagaccctgacctag

SEQ ID NO: 16257 - DNA, 402 bp, Artificial Sequence
  Description of Artificial Sequence: Synthetic coding sequence
atgaggcccctgacagaggaggagaccagggtgatgtttgagaagatcgccaagtacatcggggagaacctgcagctgctggtggacagaccagatggcacctactgcttccggctgcacaatgacagagtgtactacgtgtctgagaagatcatgaagctggccgccaacatcagcggggacaagctggtgtccctgggcacctgcttcggcaagttcaccaagacccacaagttccggctgcacgtgacagccctggactacctggccccctatgccaagggcttcggcgtggccgccaagagcacccaggactgcaggaaggtggaccccatggccatcgtggtgttccaccaggccgacatcggggagtatgtgagacatgaggagaccctgacctag

SEQ ID NO: 16258 - DNA, 249 bp, Artificial Sequence
  Description of Artificial Sequence: Synthetic coding sequence
atggccaccttccccccagccaccagcgccccccagcagcccccaggcccagaagatgaggacagcagcctggatgaaagtgacctgtacagcctggcccacagctacctgggcggcggcggcaggaaaggaagaaccaagcgggaggccgccgccaacaccaaccggcccagccctgggggccacgagaggaagctggtgaccaagctgcagaacagcgagaggaagaagagaggagcccggaggtag

SEQ ID NO: 16259 - DNA, 303 bp, Artificial Sequence
  Description of Artificial Sequence: Synthetic coding sequence
atggccaccttccccccagccaccagcgccccccagcagcccccaggcccagaagatgaggacagcagcctggatgaaagtgacctgtacagcctggcccacagctacctgggccccctcatcatgcccatgcccaccagccccctgaccccagccctggtgactggaggcggcggcaggaaaggaagaaccaagcgggaggccgccgccaacaccaaccggcccagccctgggggccacgagaggaagctggtgaccaagctgcagaacagcgagaggaagaagagaggagcccggaggtag

SEQ ID NO: 16260 - DNA, 420 bp, Artificial Sequence
  Description of Artificial Sequence: Synthetic coding sequence
atgacccacagcctggtgtgcccagagaccgtgtcccgggtgtcctctgtgctgaacagaaacacccggcagtttgggaagaagcacctgtttgaccaggatgaggagacctgctggaacagcgaccagggccccagccagtgggtgaccctggagttcccccagctgatccgggtgtcccagctgcagatccagttccagggcggcttcagcagcagaagaggctgcctggagggcagccagggcacccaggccctgcacaagatcgtggacttctacccagaggacaacaacagcctgcagaccttccccatcccagctgctgaggtggaccggctgaaggtgacctttgaagatgccacagacttcttcggccgggtggtgatctaccacctgcgggtgctgggggagaaggtgtag

SEQ ID NO: 16261 - DNA, 1740 bp, Artificial Sequence
  Description of Artificial Sequence: Synthetic coding sequence
atgaacacagcccccagccggcccagccccacccggcgggacccctacggctttggagacagccgggacagcagaagagacaggagccccatccggggcagcccccggcgggagcccagagatggaagaaatggaagagatgcccgggacagccgggacatccgggacccccgggacctgcgggaccaccgccacagccgggacctgcgggaccaccgggacagccgctctgtgagagatgtgagagatgtgcgggacctgcgggacttccgggacctgcgggacagccgggacttccgggaccagagggaccccatgtatgaccgctacagagacatgagggacagccgggaccccatgtaccgccgggagggcagctatgaccgctacctgaggatggatgactactgcaggaggaaggatgacagctactttgaccgctacagagacagctttgatggccggggccccccaggccctgagagccagagccgggccaaggagcggctgaagcgggaggagcggcggcgggaggagctgtaccggcagtactttgaggagatccagaggagatttgatgctgagaggcctgtggactgcagcgtgattgtggtgaacaagcagaccaaggactatgcagagagcgtgggcaggaaggtgcgggacctgggcatggtggtggacctgatcttcctgaacacagaggtgtccctgagccaggccctggaggatgtgtcccggggcggcagcccctttgccatcgtcatcacccagcagcaccagatccacaggagctgcaccgtgaacatcatgtttggcaccccccaggagcacaggaacatgccccaggctgatgccatggtgctggtggccaggaactatgaaagatacaagaatgaatgtcgggagaaggagcgggaggagatcgcccggcaggccgccaagatggctgatgaggccatcctgcaggagcgggagcggggcggccctgaggagggcgtgcggggcggccaccccccagccatccagagcctcatcaacctgctggccgacaaccgctacctgacagctgaggagacagacaagatcatcaactacctgcgggagaggaaggagcggctgatgaggagcagcacagacagcctgcccggccccatcagccggcagcccctgggcgccaccagcggggccagcctgaagacccagcccagcagccagcccctgcagagcggccaggtgctgcccagcgccacccccacccccagcgccccacccaccagccagcaggagctgcaggccaagatcctgagcctcttcaacagcggcaccgtgacagccaacagcagcagcgccagccccagcgtggccgccggcaacacccccaaccagaacttcagcacagctgccaacagccagccccagcagaggagccaggccagcggcaaccagccccccagcatcctgggccagggcggcagcgcccagaacatgggccccaggcctggggcccccagccagggcctgtttggccagcccagcagccggctggccccagccagcaacatgaccagccagaggcctgtgagcagcacaggcatcaactttgacaaccccagcgtgcagaaggccctggacaccctcatccagagcggccctgccctgagccacctggtgtcccagaccacagcccagatgggccagccccaggcccccatgggcagctaccagaggcactactag

SEQ ID NO: 16262 - DNA, 315 bp, Artificial Sequence
  Description of Artificial Sequence: Synthetic coding sequence
atgtatgaccgctacagagacatgagggacagccgggaccccatgtacagaagagagggcagctatgaccgctacctgaggatggatgactactgcaggaggaaggatgacagctactttgaccgctacagagacagctttgatggccggggccccccaggccctgagagccagagccgggccaaggagcggctgaagcgggaggagaggagaagagaggagctgtaccggcagtactttgaggagatccagaggagatttgatgctgagaggcctgtggactgcagcgtcatcgtggtgaacaagcagacctag

SEQ ID NO: 16263 - DNA, 1278 bp, Artificial Sequence
  Description of Artificial Sequence: Synthetic coding sequence
atgggcagcaagatgaacctgattgagcacagccacctgcccaccacagatgagttctccttcagcgagaacctgtttggagtgctgacagagcaggtggccggccccctgggccagaacctggaggtggagccctacagccagtacagcaatgtgcagttcccccaggtgcagccccagatcagcagcagcagctactacagcaacctgggcttctacccccagcagcctgaggagtggtacagccctggcatctatgagctgcggaggatgcctgctgagaccctgtaccagggcgagacagaggtggccgagatgcctgtgaccaagaagcccaggatgggcgccagcgctggccgcatcaagggagatgagctgtgtgtggtgtgtggggaccgggccagcggctaccactacaatgccctgacctgtgagggctgcaagggcctgctgacagagatccagtgcaagagcaagaggctgaggaagaatgtgaagcagcacgccgaccagacagtgaatgaagattctgagggccgggacctgcggcaggtgaccagcaccaccaagagctgccgggagaagacagagctgaccccagaccagcagaccctgctgcacttcatcatggacagctacaacaagcagaggatgccccaggagatcaccaacaagatcctgaaggaggagttctctgctgaggagaacttcctgatcctgacagagatggccaccaaccacgtgcaggtgctggtggagttcaccaagaagctgcccggcttccagaccctggaccacgaggaccagatcgccctgctgaagggcagcgctgtggaggccatgttcctgcggtctgctgagatcttcaacaagaagctgcccagcggccacagcgacctgctggaggagcgcatccggaacagcggcatcagtgatgagtacatcacccccatgttctccttctacaagagcattggagagctgaagatgacccaggaggagtatgccctgctgacagccatcgtcatcctgagcccagaccggcagtacatcaaggaccgggaggccgtggagaagctgcaggagcccctgctggatgtgctgcagaagctgtgcaagatccaccagcctgagaacccccagcactttgcctgcctgctgggccgcctgacagagctgcggaccttcaaccaccaccacgccgagatgctgatgtcctggagggtgaatgaccacaagttcacccccctgctgtgtgagatctgggatgtgcagtag

SEQ ID NO: 16264 - DNA, 1740 bp, Artificial Sequence
  Description of Artificial Sequence: Synthetic coding sequence
atggaggtgaatgctgggggcgtgattgcctacatcagcagcagcagcagcgccagcagccctgccagctgccacagcgagggcagcgagaacagcttccagagcagcagcagctctgtgcccagcagccccaacagcagcaacagcgacaccaacggcaaccccaagaatggagacctggccaacatcgagggcatcctgaagaatgacagaattgactgcagcatgaagaccagcaagagcagcgcccctggcatgaccaagagccacagcggcgtgaccaagttcagcggcatggtgctgctgtgcaaggtgtgtggagatgtggccagcggcttccactatggagtgcacgcctgtgagggctgcaagggcttcttccgccgcagcatccagcagaacatccagtacaagaagtgcctgaagaatgaaaactgcagcatcatgaggatgaacagaaaccgctgccagcagtgccgcttcaagaagtgcctgtctgtgggcatgagcagagatgctgtgcgcttcggccgcatccccaagcgggagaagcagaggatgctgattgagatgcagagcgccatgaagaccatgatgaacagccagttcagcggccacctgcagaatgacaccctggtggagcaccacgagcagacagccctgcctgcccaggagcagctgcggcccaagccccagctggagcaggagaacatcaagagcagcagcccccccagcagtgactttgccaaggaggaggtgattggcatggtgacccgggcccacaaggacaccttcatgtacaaccaggagcagcaggagaacagcgctgagagcatgcagccccagagaggagagcgcatccccaagaacatggagcagtacaacctgaaccacgaccactgtggaaatggcctgagcagccacttcccctgcagcgagagccagcagcacctgaatggccagttcaagggcaggaacatcatgcactaccccaacggccacgccatctgcatcgccaacggccactgcatgaacttcagcaatgcctacacccagagggtgtgtgacagagtgcccattgatggcttcagccagaatgaaaacaagaacagctacctgtgcaacacaggaggccgcatgcacctggtgtgccccctgagcaagagcccctacgtggacccccacaagagcggccacgagatctgggaggagttctccatgtccttcaccccagctgtgaaggaggtggtggagtttgccaagagaattcctggcttccgggacctgagccagcacgaccaggtgaacctgctgaaggccggcacctttgaggtgctgatggtgcgctttgccagcctgtttgatgccaaggagaggacagtgaccttcctgagcggcaagaagtacagcgtggatgacctgcacagcatgggcgctggggacctgctgaacagcatgtttgagttcagcgagaagctgaatgccctgcagctgagtgatgaggagatgagcctcttcaccgctgtggtgctggtgtctgctgacagaagtggcattgaaaatgtgaacagcgtggaggccctgcaggagaccctcatccgggccctgcggaccctcatcatgaagaaccaccccaatgaggccagcatcttcaccaagctgctgctgaagctgcctgacctgcggagcctgaacaacatgcacagcgaggagctgctggccttcaaggtgcacccctag

SEQ ID NO: 16265 - DNA, 1227 bp, Artificial Sequence
  Description of Artificial Sequence: Synthetic coding sequence
atggaggtgaatgctgggggcgtgattgcctacatcagcagcagcagcagcgccagcagccctgccagctgccacagcgagggcagcgagaacagcttccagagcagcagcagctctgtgcccagcagccccaacagcagcaacagcgacaccaacggcaaccccaagaatggagacctggccaacatcgagggcatcctgaagaatgacagaattgactgcagcatgaagaccagcaagagcagcgcccctggcatgaccaagagccacagcggcgtgaccaagttcagcggcatggtgctgctgtgcaaggtgtgtggagatgtggccagcggcttccactatggagtgcacgcctgtgagggctgcaagggcttcttccgccgcagcatccagcagaacatccagtacaagaagtgcctgaagaatgaaaactgcagcatcatgaggatgaacagaaaccgctgccagcagtgccgcttcaagaagtgcctgtctgtgggcatgagcagagatgctgtgcgcttcggccgcatccccaagcgggagaagcagaggatgctgattgagatgcagagcgccatgaagaccatgatgaacagccagttcagcggccacctgcagaatgacaccctggtggagcaccacgagcagacagccctgcctgcccaggagcagctgcggcccaagccccagctggagcaggagaacatcaagagcagcagcccccccagcagtgactttgccaaggaggaggtgattggcatggtgacccgggcccacaaggacaccttcatgtacaaccaggagcagcaggagaacagcgctgagagcatgcagccccagagaggagagcgcatccccaagaacatggagcagtacaacctgaaccacgaccactgtggaaatggcctgagcagccacttcccctgcagcgagagccagcagcacctgaatggccagttcaagggcaggaacatcatgcactaccccaacggccacgccatctgcatcgccaacggccactgcatgaacttcagcaatgcctacacccagagggtgtgtgacagagtgcccattgatggcttcagccagaatgaaaacaagaacagctacctgtgcaacacaggaggccgcatgcacctgtacagcgtgcacatccagcccaagttccaccagaagcagcagtaccacaccatcagcagcctgaaccacgaggtgctgtag

SEQ ID NO: 16266 - DNA, 1740 bp, Artificial Sequence; identical to SEQ ID NO: 16264
  Description of Artificial Sequence: Synthetic coding sequence

SEQ ID NO: 16267 - DNA, 1449 bp, Artificial Sequence
  Description of Artificial Sequence: Synthetic coding sequence
atggtgatgcagttccagggcctggagaaccccatccagatcagcccccactgcagctgcaccccatctggcttcttcatggagatgatgtccatgaagccagccaagggcgtgctgacagagcaggtggccggccccctgggccagaacctggaggtggagccctacagccagtacagcaatgtgcagttcccccaggtgcagccccagatcagcagcagcagctactacagcaacctgggcttctacccccagcagcctgaggagtggtacagccctggcatctatgagctgcggaggatgcctgctgagaccctgtaccagggcgagacagaggtggccgagatgcctgtgaccaagaagcccaggatgggcgccagcgctggccgcatcaagggagatgagctgtgtgtggtgtgtggggaccgggccagcggctaccactacaatgccctgacctgtgagggctgcaagggcttcttccgccgcagcatcaccaagaatgctgtgtacaagtgcaagaatggaggcaactgtgtgatggacatgtacatgaggaggaagtgccaggagtgccgcctgaggaagtgcaaggagatgggcatgctggctgaatgtctgctgacagagatccagtgcaagagcaagaggctgaggaagaatgtgaagcagcacgccgaccagacagtgaatgaagacagcgagggccgggacctgcggcaggtgaccagcaccaccaagagctgccgggagaagacagagctgaccccagaccagcagaccctgctgcacttcatcatggacagctacaacaagcagaggatgccccaggagatcaccaacaagatcctgaaggaggagttctctgctgaggagaacttcctgatcctgacagagatggccaccaaccacgtgcaggtgctggtggagttcaccaagaagctgcccggcttccagaccctggaccacgaggaccagatcgccctgctgaagggcagcgctgtggaggccatgttcctgcggtctgctgagatcttcaacaagaagctgcccagcggccacagcgacctgctggaggagcgcatcagaaattctggcatcagtgatgagtacatcacccccatgttctccttctacaagagcatcggggagctgaagatgacccaggaggagtatgccctgctgacagccatcgtcatcctgagcccagaccggcagtacatcaaggaccgggaggccgtggagaagctgcaggagcccctgctggatgtgctgcagaagctgtgcaagatccaccagcctgagaacccccagcactttgcctgcctgctgggccgcctgacagagctgcggaccttcaaccaccaccacgccgagatgctgatgtcctggagggtgaatgaccacaagttcacccccctgctgtgtgagatctgggatgtgcagtag

SEQ ID NO: 16268 - DNA, 1431 bp, Artificial Sequence
  Description of Artificial Sequence: Synthetic coding sequence
atgggcagcaagatgaacctgattgagcacagccacctgcccaccacagatgagttctccttcagcgagaacctgtttggagtgctgacagagcaggtggccggccccctgggccagaacctggaggtggagccctacagccagtacagcaatgtgcagttcccccaggtgcagccccagatcagcagcagcagctactacagcaacctgggcttctacccccagcagcctgaggagtggtacagccctggcatctatgagctgcggaggatgcctgctgagaccctgtaccagggcgagacagaggtggccgagatgcctgtgaccaagaagcccaggatgggcgccagcgctggccgcatcaagggagatgagctgtgtgtggtgtgtggggaccgggccagcggctaccactacaatgccctgacctgtgagggctgcaagggcttcttccgccgcagcatcaccaagaatgctgtgtacaagtgcaagaatggaggcaactgtgtgatggacatgtacatgaggaggaagtgccaggagtgccgcctgaggaagtgcaaggagatgggcatgctggccgagtgcatgtacacaggcctgctgacagagatccagtgcaagagcaagaggctgaggaagaatgtgaagcagcacgccgaccagacagtgaatgaagacagcgagggccgggacctgcggcaggtgaccagcaccaccaagagctgccgggagaagacagagctgaccccagaccagcagaccctgctgcacttcatcatggacagctacaacaagcagaggatgccccaggagatcaccaacaagatcctgaaggaggagttctctgctgaggagaacttcctgatcctgacagagatggccaccaaccacgtgcaggtgctggtggagttcaccaagaagctgcccggcttccagaccctggaccacgaggaccagatcgccctgctgaagggcagcgctgtggaggccatgttcctgcggtctgctgagatcttcaacaagaagctgcccagcggccacagcgacctgctggaggagcgcatcagaaattctggcatcagtgatgagtacatcacccccatgttctccttctacaagagcatcggggagctgaagatgacccaggaggagtatgccctgctgacagccatcgtcatcctgagcccagaccggcagtacatcaaggaccgggaggccgtggagaagctgcaggagcccctgctggatgtgctgcagaagctgtgcaagatccaccagcctgagaacccccagcactttgcctgcctgctgggccgcctgacagagctgcggaccttcaaccaccaccacgccgagatgctgatgtcctggagggtgaatgaccacaagttcacccccctgctgtgtgagatctgggatgtgcagtag

SEQ ID NO: 16269 - DNA, 1419 bp, Artificial Sequence
  Description of Artificial Sequence: Synthetic coding sequence
atgggcagcaagatgaacctgattgagcacagccacctgcccaccacagatgagttctccttcagcgagaacctgtttggagtgctgacagagcaggtggccggccccctgggccagaacctggaggtggagccctacagccagtacagcaatgtgcagttcccccaggtgcagccccagatcagcagcagcagctactacagcaacctgggcttctacccccagcagcctgaggagtggtacagccctggcatctatgagctgcggaggatgcctgctgagaccctgtaccagggcgagacagaggtggccgagatgcctgtgaccaagaagcccaggatgggcgccagcgctggccgcatcaagggagatgagctgtgtgtggtgtgtggggaccgggccagcggctaccactacaatgccctgacctgtgagggctgcaagggcttcttccgccgcagcatcaccaagaatgctgtgtacaagtgcaagaatggaggcaactgtgtgatggacatgtacatgaggaggaagtgccaggagtgccgcctgaggaagtgcaaggagatgggcatgctggctgaatgtctgctgacagagatccagtgcaagagcaagaggctgaggaagaatgtgaagcagcacgccgaccagacagtgaatgaagacagcgagggccgggacctgcggcaggtgaccagcaccaccaagagctgccgggagaagacagagctgaccccagaccagcagaccctgctgcacttcatcatggacagctacaacaagcagaggatgccccaggagatcaccaacaagatcctgaaggaggagttctctgctgaggagaacttcctgatcctgacagagatggccaccaaccacgtgcaggtgctggtggagttcaccaagaagctgcccggcttccagaccctggaccacgaggaccagatcgccctgctgaagggcagcgctgtggaggccatgttcctgcggtctgctgagatcttcaacaagaagctgcccagcggccacagcgacctgctggaggagcgcatcagaaattctggcatcagtgatgagtacatcacccccatgttctccttctacaagagcatcggggagctgaagatgacccaggaggagtatgccctgctgacagccatcgtcatcctgagcccagaccggcagtacatcaaggaccgggaggccgtggagaagctgcaggagcccctgctggatgtgctgcagaagctgtgcaagatccaccagcctgagaacccccagcactttgcctgcctgctgggccgcctgacagagctgcggaccttcaaccaccaccacgccgagatgctgatgtcctggagggtgaatgaccacaagttcacccccctgctgtgtgagatctgggatgtgcagtag

SEQ ID NO: 16270 - DNA, 1461 bp, Artificial Sequence
  Description of Artificial Sequence: Synthetic coding sequence
atggtgatgcagttccagggcctggagaaccccatccagatcagcccccactgcagctgcaccccatctggcttcttcatggagatgatgtccatgaagccagccaagggcgtgctgacagagcaggtggccggccccctgggccagaacctggaggtggagccctacagccagtacagcaatgtgcagttcccccaggtgcagccccagatcagcagcagcagctactacagcaacctgggcttctacccccagcagcctgaggagtggtacagccctggcatctatgagctgcggaggatgcctgctgagaccctgtaccagggcgagacagaggtggccgagatgcctgtgaccaagaagcccaggatgggcgccagcgctggccgcatcaagggagatgagctgtgtgtggtgtgtggggaccgggccagcggctaccactacaatgccctgacctgtgagggctgcaagggcttcttccgccgcagcatcaccaagaatgctgtgtacaagtgcaagaatggaggcaactgtgtgatggacatgtacatgaggaggaagtgccaggagtgccgcctgaggaagtgcaaggagatgggcatgctggccgagtgcatgtacacaggcctgctgacagagatccagtgcaagagcaagaggctgaggaagaatgtgaagcagcacgccgaccagacagtgaatgaagacagcgagggccgggacctgcggcaggtgaccagcaccaccaagagctgccgggagaagacagagctgaccccagaccagcagaccctgctgcacttcatcatggacagctacaacaagcagaggatgccccaggagatcaccaacaagatcctgaaggaggagttctctgctgaggagaacttcctgatcctgacagagatggccaccaaccacgtgcaggtgctggtggagttcaccaagaagctgcccggcttccagaccctggaccacgaggaccagatcgccctgctgaagggcagcgctgtggaggccatgttcctgcggtctgctgagatcttcaacaagaagctgcccagcggccacagcgacctgctggaggagcgcatcagaaattctggcatcagtgatgagtacatcacccccatgttctccttctacaagagcatcggggagctgaagatgacccaggaggagtatgccctgctgacagccatcgtcatcctgagcccagaccggcagtacatcaaggaccgggaggccgtggagaagctgcaggagcccctgctggatgtgctgcagaagctgtgcaagatccaccagcctgagaacccccagcactttgcctgcctgctgggccgcctgacagagctgcggaccttcaaccaccaccacgccgagatgctgatgtcctggagggtgaatgaccacaagttcacccccctgctgtgtgagatctgggatgtgcagtag

SEQ ID NO: 16271 - DNA, 1074 bp, Artificial Sequence
  Description of Artificial Sequence: Synthetic coding sequence
atggccagcagagaagatgagctgaggaactgtgtggtgtgtggggaccaggccaccggctaccacttcaatgccctgacctgtgagggctgcaagggcttcttccggaggacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcccgtcttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggtgagccccaccgtgggcttccaggtggagttcctggagctgctcttccacttccacggcaccctgaggaagctgcagctgcaggagccagaatatgtgctgctggccgccatggccctcttcagccctgccccctacctgacagacaggcctggggtgacccagagagatgaaattgaccagctgcaggaggagatggccctgaccctgcagagctacatcaagggccagcagaggcggccccgggaccgcttcctgtatgccaagctgctgggcctgctggccgagctgcggagcatcaatgaggcctacggctaccagatccagcacatccagggcctgagcgccatgatgcccctgctgcaggagatctgcagctag

SEQ ID NO: 16272 - DNA, 1074 bp, Artificial Sequence; identical to SEQ ID NO: 16271
  Description of Artificial Sequence: Synthetic coding sequence

SEQ ID NO: 16273 - DNA, 975 bp, Artificial Sequence
  Description of Artificial Sequence: Synthetic coding sequence
atgctgcccaagaggagcagaagaacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcctgtgttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggtgggcttccaggtggagttcctggagctgctcttccacttccacggcaccctgaggaagctgcagctgcaggagccagaatatgtgctgctggccgccatggccctcttctccccagccccctacctgacagacaggcctggggtgacccagagagatgaaattgaccagctgcaggaggagatggccctgaccctgcagagctacatcaagggccagcagaggcggccccgggaccgcttcctgtatgccaagctgctgggcctgctggccgagctgcggagcatcaatgaggcctacggctaccagatccagcacatccagggcctgagcgccatgatgcccctgctgcaggagatctgcagctag

SEQ ID NO: 16274 - DNA, 1059 bp, Artificial Sequence
  Description of Artificial Sequence: Synthetic coding sequence
atggccagcagagaagatgagctgaggaactgtgtggtgtgtggggaccaggccaccggctaccacttcaatgccctgacctgtgagggctgcaagggcttcttccggaggacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcccgtcttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggtgagccccaccgtgggcttccaggtggagttcctggagctgctcttccacttccacggcaccctgaggaagctgcagctgcaggagccagaatatgtgctgctggccgccatggccctcttctccccagacaggcctggggtgacccagagagatgaaattgaccagctgcaggaggagatggccctgaccctgcagagctacatcaagggccagcagaggcggccccgggaccgcttcctgtatgccaagctgctgggcctgctggccgagctgcggagcatcaatgaggcctacggctaccagatccagcacatccagggcctgagcgccatgatgcccctgctgcaggagatctgcagctag

SEQ ID NO: 16275 - DNA, 1047 bp, Artificial Sequence
  Description of Artificial Sequence: Synthetic coding sequence
atggccagcagagaagatgagctgaggaactgtgtggtgtgtggggaccaggccaccggctaccacttcaatgccctgacctgtgagggctgcaagggcttcttccggaggacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcccgtcttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggtgggcttccaggtggagttcctggagctgctcttccacttccacggcaccctgaggaagctgcagctgcaggagccagaatatgtgctgctggccgccatggccctcttctccccagacaggcctggggtgacccagagagatgaaattgaccagctgcaggaggagatggccctgaccctgcagagctacatcaagggccagcagaggcggccccgggaccgcttcctgtatgccaagctgctgggcctgctggccgagctgcggagcatcaatgaggcctacggctaccagatccagcacatccagggcctgagcgccatgatgcccctgctgcaggagatctgcagctag

SEQ ID NO: 16276 - DNA, 930 bp, Artificial Sequence
  Description of Artificial Sequence: Synthetic coding sequence
atggccagcagagaagatgagctgaggaactgtgtggtgtgtggggaccaggccaccggctaccacttcaatgccctgacctgtgagggctgcaagggcttcttccggaggacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcccgtcttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggacaggcctggggtgacccagagagatgaaattgaccagctgcaggaggagatggccctgaccctgcagagctacatcaagggccagcagaggcggccccgggaccgcttcctgtatgccaagctgctgggcctgctggccgagctgcggagcatcaatgaggcctacggctaccagatccagcacatccagggcctgagcgccatgatgcccctgctgcaggagatctgcagctag

SEQ ID NO: 16277 - DNA, 945 bp, Artificial Sequence
  Description of Artificial Sequence: Synthetic coding sequence
atggccagcagagaagatgagctgaggaactgtgtggtgtgtggggaccaggccaccggctaccacttcaatgccctgacctgtgagggctgcaagggcttcttccggaggacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcccgtcttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggccccctacctgacagacaggcctggggtgacccagagagatgaaattgaccagctgcaggaggagatggccctgaccctgcagagctacatcaagggccagcagaggcggccccgggaccgcttcctgtatgccaagctgctgggcctgctggccgagctgcggagcatcaatgaggcctacggctaccagatccagcacatccagggcctgagcgccatgatgcccctgctgcaggagatctgcagctag

SEQ ID NO: 16278 - DNA, 948 bp, Artificial Sequence
  Description of Artificial Sequence: Synthetic coding sequence
atgctgcccaagaggagcagaagaacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcctgtgttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggtgagccccaccgtgggcttccaggtggagttcctggagctgctcttccacttccacggcaccctgaggaagctgcagctgcaggagccagaatatgtgctgctggccgccatggccctcttctccccagccccctacctgacagacaggcctggggtgacccagagagatgaaattgaccagctgcaggaggagatggccctgaccctgcagagctacatcaagggccagcagaggcggccccgggacaggagccctggcaccccctggatccactggagcggcaagatgctgggccccaagattggccctggcagcaaaggagcccagtggctgcagtag

SEQ ID NO: 16279 - DNA, 1023 bp, Artificial Sequence
  Description of Artificial Sequence: Synthetic coding sequence
atggccagcagagaagatgagctgaggaactgtgtggtgtgtggggaccaggccaccggctaccacttcaatgccctgacctgtgagggctgcaagggcttcttccggaggacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcccgtcttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggtgggcttccaggtggagttcctggagctgctcttccacttccacggcaccctgaggaagctgcagctgcaggagccagaatatgtgctgctggccgccatggccctcttcagccctgccccctacctgacagacaggcctggggtgacccagagagatgaaattgaccagctgcaggaggagatggccctgaccctgcagagctacatcaagggccagcagaggcggccccgggacaggagccctggcaccccctggatccactggagcggcaagatgctgggccccaagattggccctggcagcaagggggcccagtggctgcagtag

SEQ ID NO: 16280 - DNA, 921 bp, Artificial Sequence
  Description of Artificial Sequence: Synthetic coding sequence
atgctgcccaagaggagcagaagaacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcctgtgttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggtgggcttccaggtggagttcctggagctgctcttccacttccacggcaccctgaggaagctgcagctgcaggagccagaatatgtgctgctggccgccatggccctcttctccccagacaggcctggggtgacccagagagatgaaattgaccagctgcaggaggagatggccctgaccctgcagagctacatcaagggccagcagaggcggccccgggacaggagccctggcaccccctggatccactggagcggcaagatgctgggccccaagattggccctggcagcaagggggcccagtggctgcagtag

SEQ ID NO: 16281 - DNA, 1020 bp, Artificial Sequence
  Description of Artificial Sequence: Synthetic coding sequence
atggccagcagagaagatgagctgaggaactgtgtggtgtgtggggaccaggccaccggctaccacttcaatgccctgacctgtgagggctgcaagggcttcttccggaggacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcccgtcttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggtgagccccaccgtgggcttccaggtggagttcctggagctgctcttccacttccacggcaccctgaggaagctgcagctgcaggagccagaatatgtgctgctggccgccatggccctcttctccccagacaggcctggggtgacccagagagatgaaattgaccagctgcaggaggagatggccctgaccctgcagagctacatcaagggccagcagaggcggccccgggacaggagccctggcaccccctggatccactggagcggcaagatgctgggccccaagattggccctggcagcaaaggagcccagtggctgcagtag

SEQ ID NO: 16282 - DNA, 360 bp, Artificial Sequence
  Description of Artificial Sequence: Synthetic coding sequence
atggccagcagagaagatgagctgaggaactgtgtggtgtgtggggaccaggccaccggctaccacttcaatgccctgacctgtgagggctgcaagggcttcttccggaggacagtgtccaagagcatcggccccacctgcccctttgctggcagctgtgaggtgtccaagacccagaggaggcactgcccagcctgccgcctgcagaagtgcctggatgctggcatgaggaaggacaccagcagcagctctgtgcaccccagccctgccctggcccaccctggcccctgtgccgccagcggccacaccctgcggcggcaccagcacttccatggaacagccagccaccaggtgtactag

SEQ ID NO: 16283 - DNA, 444 bp, Artificial Sequence
  Description of Artificial Sequence: Synthetic coding sequence
atggccagcagagaagatgagctgaggaactgtgtggtgtgtggggaccaggccaccggctaccacttcaatgccctgacctgtgagggctgcaagggcttcttccggaggacagtgtccaagagcatcggccccacctgcccctttgctggcagctgtgaggtgtccaagacccagaggaggcactgcccagcctgccgcctgcagaagtgcctggatgctggcatgaggaaggacatcccctgccccctgaagaccaggagccccttcagccgggagcagctgtggaagtctgtgaccagctacagcatccccctgtctgtgtccaagcacaagaccagcagcgctggcctgtttgccacccagctgaagatggagcctgtgacagacctggagctgccccgggagatgaggctcatcagctgcaagaggcgctggcactag

SEQ ID NO: 16284 - DNA, 843 bp, Artificial Sequence
  Description of Artificial Sequence: Synthetic coding sequence
atgctgcccaagaggagcagaagaacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcctgtgttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggacaggcctggggtgacccagagagatgaaattgaccagctgcaggaggagatggccctgaccctgcagagctacatcaagggccagcagaggcggccccgggaccgcttcctgtatgccaagctgctgggcctgctggccgagctgcggagcatcaatgaggcctacggctaccagatccagcacatccagggcctgagcgccatgatgcccctgctgcaggagatctgcagctag

SEQ ID NO: 16285 - DNA, 891 bp, Artificial Sequence
  Description of Artificial Sequence: Synthetic coding sequence
atggccagcagagaagatgagctgaggaactgtgtggtgtgtggggaccaggccaccggctaccacttcaatgccctgacctgtgagggctgcaagggcttcttccggaggacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcccgtcttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggacaggcctggggtgacccagagagatgaaattgaccagctgcaggaggagatggccctgaccctgcagagctacatcaagggccagcagaggcggccccgggacaggagccctggcaccccctggatccactggagcggcaagatgctgggccccaagattggccctggcagcaagggggcccagtggctgcagtag

SEQ ID NO: 16286 - DNA, 825 bp, Artificial Sequence
  Description of Artificial Sequence: Synthetic coding sequence
atgctgcccaagaggagcagaagaacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcctgtgttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggtgagccccaccgtgggcttccaggtggagttcctggagctgctcttccacttccacggcaccctgaggaagctgcagctgcaggagccagaatatgtgctgctggccgccatggccctcttcagccctggagagcacctgcccaagccccgggccttctgctgcaccaccagcgcccagatcctgagcagcctgagccccagcacccaggccttctag

SEQ ID NO: 16287 - DNA, 273 bp, Artificial Sequence
  Description of Artificial Sequence: Synthetic coding sequence
atgctgcccaagaggagcagaagaacagtgtccaagagcatcggccccacctgcccctttgctggcagctgtgaggtgtccaagacccagaggaggcactgcccagcctgccgcctgcagaagtgcctggatgctggcatgaggaaggacaccagcagcagctctgtgcaccccagccctgccctggcccaccctggcccctgtgccgccagcggccacaccctgcggcggcaccagcacttccacggcacagccagccaccaggtgtactag

SEQ ID NO: 16288 - DNA, 357 bp, Artificial Sequence
  Description of Artificial Sequence: Synthetic coding sequence
atgctgcccaagaggagcagaagaacagtgtccaagagcatcggccccacctgcccctttgctggcagctgtgaggtgtccaagacccagaggaggcactgcccagcctgccgcctgcagaagtgcctggatgctggcatgaggaaggacatcccctgccccctgaagaccaggagccccttcagccgggagcagctgtggaagtctgtgaccagctacagcatccccctgtctgtgtccaagcacaagaccagcagcgctggcctgtttgccacccagctgaagatggagcctgtgacagacctggagctgccccgggagatgaggctcatcagctgcaagaggcgctggcactag

SEQ ID NO: 16289 - DNA, 936 bp, Artificial Sequence
  Description of Artificial Sequence: Synthetic coding sequence
atgctgcccaagaggagcagaagaacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcctgtgttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggtgggcttccaggtggagttcctggagctgctcttccacttccacggcaccctgaggaagctgcagctgcaggagccagaatatgtgctgctggccgccatggccctcttctccccagccccctacctgacagacaggcctggggtgacccagagagatgaaattgaccagctgcaggaggagatggccctgaccctgcagagctacatcaagggccagcagaggcggccccgggacaggagccctggcaccccctggatccactggagcggcaagatgctgggccccaagattggccctggcagcaaaggagcccagtggctgcagtag

SEQ ID NO: 16290 - DNA, 273 bp, Artificial Sequence; identical to SEQ ID NO: 16287
  Description of Artificial Sequence: Synthetic coding sequence

SEQ ID NO: 16291 - DNA, 960 bp, Artificial Sequence
  Description of Artificial Sequence: Synthetic coding sequence
atgctgcccaagaggagcagaagaacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcctgtgttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggtgggcttccaggtggagttcctggagctgctcttccacttccacggcaccctgaggaagctgcagctgcaggagccagaatatgtgctgctggccgccatggccctcttctccccagacaggcctggggtgacccagagagatgaaattgaccagctgcaggaggagatggccctgaccctgcagagctacatcaagggccagcagaggcggccccgggaccgcttcctgtatgccaagctgctgggcctgctggccgagctgcggagcatcaatgaggcctacggctaccagatccagcacatccagggcctgagcgccatgatgcccctgctgcaggagatctgcagctag

SEQ ID NO: 16292 - DNA, 357 bp, Artificial Sequence; identical to SEQ ID NO: 16288
  Description of Artificial Sequence: Synthetic coding sequence

SEQ ID NO: 16293 - DNA, 444 bp, Artificial Sequence; identical to SEQ ID NO: 16283
  Description of Artificial Sequence: Synthetic coding sequence

SEQ ID NO: 16294 - DNA, 273 bp, Artificial Sequence; identical to SEQ ID NO: 16287
  Description of Artificial Sequence: Synthetic coding sequence

SEQ ID NO: 16295 - DNA, 804 bp, Artificial Sequence
  Description of Artificial Sequence: Synthetic coding sequence
atgctgcccaagaggagcagaagaacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcctgtgttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccgggacaggcctggggtgacccagagagatgaaattgaccagctgcaggaggagatggccctgaccctgcagagctacatcaagggccagcagaggcggccccgggacaggagccctggcaccccctggatccactggagcggcaagatgctgggccccaagattggccctggcagcaaaggagcccagtggctgcagtag

SEQ ID NO: 16296 - DNA, 717 bp, Artificial Sequence
  Description of Artificial Sequence: Synthetic coding sequence
atggccagcagagaagatgagctgaggaactgtgtggtgtgtggggaccaggccaccggctaccacttcaatgccctgacctgtgagggctgcaagggcttcttccggaggacagtgtccaagagcatcggccccacctgcccctttgctggcagctgtgaggtgtccaagacccagaggaggcactgcccagcctgccgcctgcagaagtgcctggatgctggcatgaggaaggacatgatcctgtctgctgaggccctggccctgcggcgggccaagcaggcccagaggcgggcccagcagacccctgtgcagctgagcaaggagcaggaggagctgatccgcaccctgctgggcgcccacaccaggcacatgggcaccatgtttgagcagtttgtgcagttccggcccccagcccacctgttcatccaccaccagcccctgcccaccctggcccctgtgctgcccctggtgacccactttgctgacatcaacaccttcatggtgctgcaggtgatcaagttcaccaaggacctgcccgtcttccgcagcctgcccatcgaggaccagatcagcctgctgaagggagctgctgtggagatctgccacatcgtgctgaacaccaccttctgcctgcagacccagaacttcctgtgtggccccctgcgctacaccattgaagatggagcccggggggagatggtgctggagcagtag

SEQ ID NO: 16297 - DNA, 1452 bp, Artificial Sequence
  Description of Artificial Sequence: Synthetic coding sequence
atggccaccatcgaggagatcgcccaccagatcatcgagcagcagatgggagaaattgtgacagagcagcagacaggccagaagatccagatcgtgacagccctggaccacaacacccagggcaagcagttcatcctgaccaaccatgatggcagcacccccagcaaggtgatcctggcccggcaggacagcacccctgggaaggtgttcctgaccaccccagatgctgctggggtgaaccagctgttcttcaccaccccagacctgagcgcccagcacctgcagctgctgacagacaacagcccagaccagggccccaacaaggtgtttgacctgtgtgtggtgtgtggggacaaggccagcggccgccactatggagctgtgacctgtgagggctgcaagggcttcttcaagaggagcatcaggaagaacctggtgtacagctgccggggcagcaaggactgcatcatcaacaagcaccacaggaaccgctgccagtactgccgcctgcagcgctgcatcgccttcggcatgaagcaggacagcgtgcagtgtgagaggaagcccatcgaggtgtcccgggagaagagcagcaactgtgccgccagcacagagaagatctacatcaggaaggacctgcggagccccctgacagccacccccacctttgtgacagattctgagagcaccaggagcacaggcctgctggacagcggcatgttcatgaacatccaccccagcggcgtgaagacagaatctgctgtgctgatgaccagtgacaaggccgagagctgccagggcgacctgagcaccctggccaacgtggtgaccagcctggccaacctgggcaagaccaaggacctgagccagaacagcaatgagatgtccatgattgagagcctgagcaatgatgacaccagcctgtgtgagttccaggagatgcagaccaatggagatgtgtcccgggcctttgacaccctggccaaggccctgaaccctggagagagcacagcctgccagagctctgtggccggcatggagggctctgtgcacctgatcaccggggacagcagcatcaactacacagagaaggagggccccctgctgagtgacagccacgtggccttccggctgaccatgcccagccccatgcctgagtacctgaatgtgcactacatcggggagagcgccagccggctgctcttcctgtccatgcactgggccctgagcatccccagcttccaggccctgggccaggagaacagcatcagcctggtgaaggcctactggaatgaactcttcaccctgggcctggcccagtgctggcaggtgatgaatgtggccaccatcctggccacctttgtgaactgcctgcacaacagcctgcagcaggatgccaaggtgattgctgccctgatccacttcacccggcgggccatcacagacctgtag

SEQ ID NO: 16298 - DNA, 1812 bp, Artificial Sequence
  Description of Artificial Sequence: Synthetic coding sequence
atggccaccatcgaggagatcgcccaccagatcatcgagcagcagatgggagaaattgtgacagagcagcagacaggccagaagatccagatcgtgacagccctggaccacaacacccagggcaagcagttcatcctgaccaaccatgatggcagcacccccagcaaggtgatcctggcccggcaggacagcacccctgggaaggtgttcctgaccaccccagatgctgctggggtgaaccagctgttcttcaccaccccagacctgagcgcccagcacctgcagctgctgacagacaacagcccagaccagggccccaacaaggtgtttgacctgtgtgtggtgtgtggggacaaggccagcggccgccactatggagctgtgacctgtgagggctgcaagggcttcttcaagaggagcatcaggaagaacctggtgtacagctgccggggcagcaaggactgcatcatcaacaagcaccacaggaaccgctgccagtactgccgcctgcagcgctgcatcgccttcggcatgaagcaggacagcgtgcagtgtgagaggaagcccatcgaggtgtcccgggagaagagcagcaactgtgccgccagcacagagaagatctacatcaggaaggacctgcggagccccctgacagccacccccacctttgtgacagattctgagagcaccaggagcacaggcctgctggacagcggcatgttcatgaacatccaccccagcggcgtgaagacagaatctgctgtgctgatgaccagtgacaaggccgagagctgccagggcgacctgagcaccctggccaacgtggtgaccagcctggccaacctgggcaagaccaaggacctgagccagaacagcaatgagatgtccatgattgagagcctgagcaatgatgacaccagcctgtgtgagttccaggagatgcagaccaatggagatgtgtcccgggcctttgacaccctggccaaggccctgaaccctggagagagcacagcctgccagagctctgtggccggcatggagggctctgtgcacctgatcaccggggacagcagcatcaactacacagagaaggagggccccctgctgagtgacagccacgtggccttccggctgaccatgcccagccccatgcctgagtacctgaatgtgcactacatcggggagagcgccagccggctgctcttcctgtccatgcactgggccctgagcatccccagcttccaggccctgggccaggagaacagcatcagcctggtgaaggcctactggaatgaactcttcaccctgggcctggcccagtgctggcaggtgatgaatgtggccaccatcctggccacctttgtgaactgcctgcacaacagcctgcagcaggacaagatgagcacagaaagaaggaagctgctgatggagcacatcttcaagctgcaggagttctgcaacagcatggtgaagctgtgcattgatggctatgaatatgcctacctgaaggccatcgtgctcttctccccagaccaccccagcctggagaacatggagcagatcgagaagttccaggagaaggcctacgtggagttccaggactacatcaccaagacctacccagatgacacctaccgcctgagccggctgctgctgcggctgcctgccctgcggctgatgaatgccaccatcacagaggagctgttcttcaagggcctcatcggcaacatcagaattgattctgtcatcccccacatcctgaagatggagcctgctgactacaacagccagatcatcggccacagcatctag

SEQ ID NO: 16299 - DNA, 1404 bp, Artificial Sequence
  Description of Artificial Sequence: Synthetic coding sequence
atggccaccatcgaggagatcgcccaccagatcatcgagcagcagatgggagaaattgtgacagagcagcagacaggccagaagatccagatcgtgacagccctggaccacaacacccagggcaagcagttcatcctgaccaaccatgatggcagcacccccagcaaggtgatcctggcccggcaggacagcacccctgggaaggtgttcctgaccaccccagatgctgctggggtgaaccagctgttcttcaccaccccagacctgagcgcccagcacctgcagctgctgacagacaacagcccagaccagggccccaacaaggtgtttgacctgtgtgtggtgtgtggggacaaggccagcggccgccactatggagctgtgacctgtgagggctgcaagggcttcttcaagaggagcatcaggaagaacctggtgtacagctgccggggcagcaaggactgcatcatcaacaagcaccacaggaaccgctgccagtactgccgcctgcagcgctgcatcgccttcggcatgaagcaggacagcgtgcagtgtgagaggaagcccatcgaggtgtcccgggagaagagcagcaactgtgccgccagcacagagaagatctacatcaggaaggacctgcggagccccctgacagccacccccacctttgtgacagattctgagagcaccaggagcacaggcctgctggacagcggcatgttcatgaacatccaccccagcggcgtgaagacagaatctgctgtgctgatgaccagtgacaaggccgagagctgccagggcgacctgagcaccctggccaacgtggtgaccagcctggccaacctgggcaagaccaaggacctgagccagaacagcaatgagatgtccatgattgagagcctgagcaatgatgacaccagcctgtgtgagttccaggagatgcagaccaatggagatgtgtcccgggcctttgacaccctggccaaggccctgaaccctggagagagcacagcctgccagagctctgtggccggcatggagggctctgtgcacctgatcaccggggacagcagcatcaactacacagagaaggagggccccctgctgagtgacagccacgtggccttccggctgaccatgcccagccccatgcctgagtacctgaatgtgcactacatcggggagagcgccagccggctgctcttcctgtccatgcactgggccctgagcatccccagcttccaggccctgggccaggagaacagcatcagcctggtgaaggcctactggaatgaactcttcaccctgggcctggcccagtgctggcaggtgatgaatgtggccaccatcctggccacctttgtgaactgcctgcacaacagcctgcagcaggccgagggctag

SEQ ID NO: 16300 - DNA, 51 bp, Artificial Sequence; identical to SEQ ID NO: 8896
  Description of Artificial Sequence: Synthetic coding sequence

SEQ ID NO: 16301 - DNA, 969 bp, Artificial Sequence
  Description of Artificial Sequence: Synthetic coding sequence
atgtgccctgtggacaaggcccacaggaaccagtgccaggcctgccgcctgaagaagtgcctgcaggccggcatgaaccaggatgctgtgcagaatgaaaggcagcccaggagcacagcccaggtgcacctggacagcatggagagcaacacagagagcaggcctgagagcctggtggcccccccagccccagctggccgcagcccccggggccccacccccatgtctgctgcccgggccctgggccaccacttcatggccagcctcatcacagctgagacctgtgccaagctggagccagaagatgctgatgaaaatattgatgtgaccagcaatgaccctgagttccccagcagcccctacagcagcagcagcccctgtggcctggacagcatccacgagaccagcgcccggctgctcttcatggctgtgaagtgggccaagaacctgcctgtgttcagcagcctgcccttccgggaccaggtgatcctgctggaggaggcctggagcgagctgttcctgctgggcgccatccagtggagcctgcccctggacagctgccccctgctggcccctcctgaggccagcgctgctgggggcgcccagggccgcctgaccctggcctccatggagaccagggtgctgcaggagaccatcagccgcttccgggccctggccgtggaccccacagaatttgcctgcatgaaggccctggtgctcttcaagccagagacccggggcctgaaggaccctgagcacgtggaggccctgcaggaccagagccaggtgatgctgagccagcacagcaaggcccaccaccccagccagcctgtgcgctttgggaagctgctgctgctgctgcccagcctgcgcttcatcacagctgagcgcatcgagctgctcttcttcaggaagaccatcggcaacacccccatggagaagctgctgtgtgacatgttcaagaactag

SEQ ID NO: 16302 - DNA, 1104 bp, Artificial Sequence
  Description of Artificial Sequence: Synthetic coding sequence
atggagacccggcccacagccctgatgagcagcacagtggccgccgccgccccagctgctggggccgccagcaggaaggagagccctggccgctggggcctgggggaggaccccactggagtgagccccagcctgcagtgccgggtgtgtggggacagcagcagcggcaagcactacggcatctatgcctgcaatggctgcagcggcttcttcaagaggtctgtgagaagaagactcatctaccgctgccaggtgggcgccggcatgtgccctgtggacaaggcccacaggaaccagtgccaggcctgccgcctgaagaagtgcctgcaggccggcatgaaccaggatgctgtgcagaatgaaaggcagcccaggagcacagcccaggtgcacctggacagcatggagagcaacacagagagcaggcctgagagcctggtggcccccccagccccagctggccgcagcccccggggccccacccccatgtctgctgcccgggccctgggccaccacttcatggccagcctcatcacagctgagacctgtgccaagctggagccagaagatgctgatgaaaatattgatgtgaccagcaatgaccctgagttccccagcagcccctacagcagcagcagcccctgtggcctggacagcatccacgagaccagcgcccggctgctcttcatggctgtgaagtgggccaagaacctgcctgtgttcagcagcctgcccttccgggaccaggtgatcctgctggaggaggcctggagcgagctgttcctgctgggcgccatccagtggagcctgcccctggacagctgccccctgctggcccctcctgaggccagcgctgctgggggcgcccagggccgcctgaccctggcctccatggagaccagggtgctgcaggagaccatcagccgcttccgggccctggccgtggaccccacagaatttgcctgcatgaaggccctggtgctcttcaagccagagacccggggcctgaaggaccctgagcacgtggaggccctgcaggaccagagccaggtgatgctgagccagcacagcaaggcccaccaccccagccagcctgtgaggtag

SEQ ID NO: 16303 - DNA, 1431 bp, Artificial Sequence
  Description of Artificial Sequence: Synthetic coding sequence
atggagagagatgagcccccaccttctgggggcggcggcggcggcggcagcgctggcttcctggagcccccagctgccctgcccccacctccaagaaatggcttctgccaggatgagctggccgagctggaccccggcaccaatgacagagctgagcagaggacctgcctgatctgtggggaccgggccaccggcctgcactacggcatcatcagctgtgagggctgcaagggcttcttcaagaggagcatctgcaacaagagggtgtaccgctgcagccgggacaagaactgtgtgatgagcaggaagcagaggaaccgctgccagtactgccgcctgctgaagtgcctgcagatgggcatgaacaggaaggccatccgggaggatggcatgcctgggggcaggaacaagagcatcggccctgtgcagatcagcgaggaggagattgagcgcatcatgagcggccaggagtttgaggaggaggccaaccactggagcaaccacggggacagcgaccacagcagccctggcaacagagccagcgagagcaaccagcccagccctggcagcaccctgagcagcagccgctctgtggagctgaatggcttcatggccttccgggagcagtacatgggcatgtctgtgcccccccactaccagtacatcccccacctgttctcctacagcggccacagccccctgctgccccagcaggcccggagcctggacccccagagctacagcctcatccaccagctgctgtctgctgaggacctggagcccctgggcacccccatgctgattgaagatggctatgctgtgacccaggccgagctgtttgccctgctgtgccgcctggctgatgagctgctcttccggcagatcgcctggatcaagaagctgcccttcttctgtgagctgagcatcaaggactacacctgcctgctgagcagcacctggcaggagctgatcctgctgagcagcctgactgtgtacagcaagcagatctttggagagctggctgatgtgacagccaagtacagccccagtgatgaggagctgcaccgcttcagtgatgagggcatggaggtgattgagcggctcatctacctgtaccacaagttccaccagctgaaggtgtccaatgaggagtatgcctgcatgaaggccatcaacttcctgaaccaggacatccggggcctgaccagcgccagccagctggagcagctgaacaagcgctactggtacatctgccaggacttcacagagtacaagtacacccaccagcccaaccgcttcccagacctgatgatgtgcctgcctgagatccgctacatcgccggcaagatggtgaatgtgcccctggagcagctgcccctgctcttcaaggtggtgctgcacagctgcaagacctctgtgggcaaggagtag

SEQ ID NO: 16304 - DNA, 1428 bp, Artificial Sequence
  Description of Artificial Sequence: Synthetic coding sequence
atggagagagatgagcccccaccttctgggggcggcggcggcggcggcagcgctggcttcctggagcccccagctgccctgcccccacctccaagaaatggcttctgccaggatgagctggccgagctggaccccggcaccaatgacagagctgagcagaggacctgcctgatctgtggggaccgggccaccggcctgcactacggcatcatcagctgtgagggctgcaagggcttcttcaagaggagcatctgcaacaagagggtgtaccgctgcagccgggacaagaactgtgtgatgagcaggaagcagaggaaccgctgccagtactgccgcctgctgaagtgcctgcagatgggcatgaacaggaaggccatccgggaggatggcatgcctgggggcaggaacaagagcatcggccctgtgcagatcagcgaggaggagattgagcgcatcatgagcggccaggagtttgaggaggaggccaaccactggagcaaccacggggacagcgaccacagcagccctggcaacagagccagcgagagcaaccagcccagccctggcagcaccctgagcagccgctctgtggagctgaatggcttcatggccttccgggagcagtacatgggcatgtctgtgcccccccactaccagtacatcccccacctgttctcctacagcggccacagccccctgctgccccagcaggcccggagcctggacccccagagctacagcctcatccaccagctgctgtctgctgaggacctggagcccctgggcacccccatgctgattgaagatggctatgctgtgacccaggccgagctgtttgccctgctgtgccgcctggctgatgagctgctcttccggcagatcgcctggatcaagaagctgcccttcttctgtgagctgagcatcaaggactacacctgcctgctgagcagcacctggcaggagctgatcctgctgagcagcctgactgtgtacagcaagcagatctttggagagctggctgatgtgacagccaagtacagccccagtgatgaggagctgcaccgcttcagtgatgagggcatggaggtgattgaaagactcatctacctgtaccacaagttccaccagctgaaggtgtccaatgaggagtatgcctgcatgaaggccatcaacttcctgaaccaggacatccggggcctgaccagcgccagccagctggagcagctgaacaagcgctactggtacatctgccaggacttcacagagtacaagtacacccaccagcccaaccgcttcccagacctgatgatgtgcctgcctgagatccgctacatcgccggcaagatggtgaatgtgcccctggagcagctgcccctgctcttcaaggtggtgctgcacagctgcaagacctctgtgggcaaggagtag

SEQ ID NO: 16305 - DNA, 1443 bp, Artificial Sequence
  Description of Artificial Sequence: Synthetic coding sequence
atggagagagatgagcccccaccttctgggggcggcggcggcggcggcagcgctggcttcctggagcccccagctgccctgcccccacctccaagaaatggcttctgccaggatgagctggccgagctggaccccggcaccatctctgtgtctgatgacagagctgagcagaggacctgcctgatctgtggggaccgggccaccggcctgcactacggcatcatcagctgtgagggctgcaagggcttcttcaagaggagcatctgcaacaagagggtgtaccgctgcagccgggacaagaactgtgtgatgagcaggaagcagaggaaccgctgccagtactgccgcctgctgaagtgcctgcagatgggcatgaacaggaaggccatccgggaggatggcatgcctgggggcaggaacaagagcatcggccctgtgcagatcagcgaggaggagattgagcgcatcatgagcggccaggagtttgaggaggaggccaaccactggagcaaccacggggacagcgaccacagcagccctggcaacagagccagcgagagcaaccagcccagccctggcagcaccctgagcagcagccgctctgtggagctgaatggcttcatggccttccgggagcagtacatgggcatgtctgtgcccccccactaccagtacatcccccacctgttctcctacagcggccacagccccctgctgccccagcaggcccggagcctggacccccagagctacagcctcatccaccagctgctgtctgctgaggacctggagcccctgggcacccccatgctgattgaagatggctatgctgtgacccaggccgagctgtttgccctgctgtgccgcctggctgatgagctgctcttccggcagatcgcctggatcaagaagctgcccttcttctgtgagctgagcatcaaggactacacctgcctgctgagcagcacctggcaggagctgatcctgctgagcagcctgactgtgtacagcaagcagatctttggagagctggctgatgtgacagccaagtacagccccagtgatgaggagctgcaccgcttcagtgatgagggcatggaggtgattgagcggctcatctacctgtaccacaagttccaccagctgaaggtgtccaatgaggagtatgcctgcatgaaggccatcaacttcctgaaccaggacatccggggcctgaccagcgccagccagctggagcagctgaacaagcgctactggtacatctgccaggacttcacagagtacaagtacacccaccagcccaaccgcttcccagacctgatgatgtgcctgcctgagatccgctacatcgccggcaagatggtgaatgtgcccctggagcagctgcccctgctcttcaaggtggtgctgcacagctgcaagacctctgtgggcaaggagtag

SEQ ID NO: 16306 - DNA, 1677 bp, Artificial Sequence
  Description of Artificial Sequence: Synthetic coding sequence
atggccatccctggccggcagtatggcctcatcctgcccaagaagacccagcagctgcaccctgtgctgcagaagcccagcgtgtttggaaatgacagtgatgatgatgatgagacctctgtgtctgagagcctgcagcgggaggccgccaagaagcaggccatgaagcagaccaagctggagatccagaaggccctggccgaggatgccaccgtgtatgaatatgacagcatctatgatgagatgcagaagaagaaggaggagaacaaccccaagctgctgctgggcaaggacaggaagcccaagtacatccacaacctgctgaaggctgtggagatcaggaagaaggagcaggagaagaggatggagaagaagatccagcgggagcgggagatggagaagggggagtttgatgacaaggaggcctttgtgaccagcgcctacaagaagaagctgcaggagcgggcagaggaggaggagcgggagaagagagctgctgccctggaggcctgcctggatgtgaccaagcagaaggacctgagcggcttctaccgccacctgctgaaccaggccgtgggggaggaggaggtgcccaagtgcagcttccgggaggcccggagcggcatcaaggaggagaagagccggggcttcagcaatgaggtgagcagcaagaaccgcatcccccaggagaagtgcatcctgcagacagatgtgaaggtggaggagaacccagatgctgacagcgactttgatgccaagagcagcgcagatgatgaaattgaggagaccagggtgaactgccggcgggagaaggtgattgagaccccagaaaatgacttcaagcaccacaggagccagaaccacagccgcagccccagcgaggagcggggccacagcaccaggcaccacaccaagggcagcaggaccagccggggccacgagaagcgggaggaccagcaccagcagaagcagagccgggaccaggagaaccactacacagaccgggactacaggaaggagcgggacagccaccgccaccgggaggccagccaccgggacagccactggaagagacatgagcaggaggacaagccccgggcccgggaccagcgggagaggagtgacagagtgtggaagcgggagaaggaccgggagaagtacagccagcgggagcaggagcgggaccggcagcagaatgaccagaaccggcccagcgagaagggggagaaggaggagaagagcaaggccaaggaggagcacatgaaggtgaggaaggagagatatgaaaataatgacaagtacagagaccgggagaagcgggaggtgggcgtgcagagcagcgagaggaaccaggacaggaaggagagcagccccaacagccgggccaaggacaagttcctggaccaggagaggagcaacaagatgaggaacatggccaaggacaaggagaggaaccaggagaagcccagcaacagcgagagcagcctgggcgccaagcaccggctgacagaggagggccaggagaagggcaaggagcaggagcggcccccagaggccgtgtccaagtttgccaagaggaacaatgaggagaccgtgatgtctgcccgggaccgctacctggcccggcagatggcccgggtgaatgccaagacctacatcgagaaggaggatgactag

SEQ ID NO: 16307 - DNA, 1062 bp, Artificial Sequence
  Description of Artificial Sequence: Synthetic coding sequence
ctgaagatgaccaagctggagatccagaaggccctggccgaggatgccaccgtgtatgaatatgacagcatctatgatgagatgcagaagaagaaggaggagaacaaccccaagctgctgctgggcaaggacaggaagcccaagtacatccacaacctgctgaaggctgtggagatcaggaagaaggagcaggagaagaggatggagaagaagatccagcgggagcgggagatggagaagggggagtttgatgacaaggaggcctttgtgaccagcgcctacaagaagaagctgcaggagcgggcagaggaggaggagcgggagaagagagctgctgccctggaggcctgcctggatgtgaccaagcagaaggacctgagcggcttctaccgccacctgctgaaccaggccgtgggggaggaggaggtgcccaagtgcagcttccgggaggcccggagcggcatcaaggaggagaagagccggggcttcagcaatgaggtgagcagcaagaaccgcatcccccaggagaagtgcatcctgcagacagatgtgaaggtggaggagaacccagatgctgacagcgactttgatgccaagagcagcgcagatgatgaaattgaggagaccagggtgaactgccggcgggagaaggtgattgagaccccagaaaatgacttcaagcaccacaggagccagaaccacagccgcagccccagcgaggagcggggccacagcaccaggcaccacaccaagggcagcaggaccagccggggccacgagaagcgggaggaccagcaccagcagaagcagagccgggaccaggagaaccactacacagaccgggactacaggaaggagcgggacagccaccgccaccgggaggccagccaccgggacagccactggaagagacatgagcaggaggacaagccccgggcccgggaccagcgggagaggagtgacagagtgtggaagcgggagaaggaccgggagaagtacagccagcgggagcaggagcgggaccggcagcagaatgaccagaaccggcccagcgagaagtag

SEQ ID NO: 16308 - DNA, 1470 bp, Artificial Sequence
  Description of Artificial Sequence: Synthetic coding sequence
atgctgctgtgcatgaacatgaccgtcttcatgatgaagtgcaggaagaaggaggagaacaaccccaagctgctgctgggcaaggacaggaagcccaagtacatccacaacctgctgaaggctgtggagatcaggaagaaggagcaggagaagaggatggagaagaagatccagcgggagcgggagatggagaagggggagtttgatgacaaggaggcctttgtgaccagcgcctacaagaagaagctgcaggagagagctgaggaggaggagcgggagaagagagctgctgccctggaggcctgcctggatgtgaccaagcagaaggacctgagcggcttctaccgccacctgctgaaccaggccgtgggggaggaggaggtgcccaagtgcagcttccgggaggcccggagcggcatcaaggaggagaagagccggggcttcagcaatgaggtgagcagcaagaaccgcatcccccaggagaagtgcatcctgcagacagatgtgaaggtggaggagaacccagatgctgacagcgactttgatgccaagagcagcgcagatgatgaaattgaggagaccagggtgaactgcagaagagagaaggtgattgagaccccagaaaatgacttcaagcaccacaggagccagaaccacagccgcagccccagcgaggagcggggccacagcaccaggcaccacaccaagggcagcaggaccagccggggccacgagaagcgggaggaccagcaccagcagaagcagagccgggaccaggagaaccactacacagaccgggactacaggaaggagcgggacagccaccgccaccgggaggccagccaccgggacagccactggaagagacatgagcaggaggacaagccccgggcccgggaccagcgggagaggagtgacagagtgtggaagcgggagaaggaccgggagaagtacagccagcgggagcaggagcgggaccggcagcagaatgaccagaaccggcccagcgagaagggggagaaggaggagaagagcaaggccaaggaggagcacatgaaggtgaggaaggagagatatgagaacaatgacaagtacagagaccgggagaagcgggaggtgggcgtgcagagcagcgagaggaaccaggacaggaaggagagcagccccaacagccgggccaaggacaagttcctggaccaggagaggagcaacaagatgaggaacatggccaaggacaaggagaggaaccaggagaagcccagcaacagcgagagcagcctgggcgccaagcaccggctgacagaggagggccaggagaagggcaaggagcaggagaggcctcctgaggccgtgtccaagtttgccaagagaaataatgaggagaccgtgatgtctgcccgggaccgctacctggcccggcagatggcccgggtgaatgccaagacctacatcgagaaggaggatgactag

SEQ ID NO: 16309 - DNA, 474 bp, Artificial Sequence
  Description of Artificial Sequence: Synthetic coding sequence
atgggcaagcatgagttccgcagcaacatcccctgccacctggtggacatcagctgtggcctgccctgcagcgccaccctgccctgtggcatgcacaagtgccagaggctgtgccacaagggggagtgcctggtggatgagccctgcaagcagccctgcaccacccccagggctgactgtggccacccctgcatggccccctgccacaccagcagcccctgccctgtgacagcctgcaaggccaaggtggtggagctgcagtgtgaatgtggccgcaggaaggagatggtgatctgcagcgaggccagcagcacctaccagaggctggtgattgctgccatctccatggccagcaagatcacagacatgcagctgggcggctctgtggagatcagcaagctgatcaccaagaaggaggtgcaccaggcccggctggagtgtgatgaggagtgcagcgccctggagaggaagtag

SEQ ID NO: 16310 - DNA, 2502 bp, Artificial Sequence
  Description of Artificial Sequence: Synthetic coding sequence
atggccgaggcccctcctgtgtctggcaccttcaagttcaacacagatgctgctgagttcatcccccaggagaagaagaacagcggcctgaactgtggcacccagaggcggctggacagcaacagaattggaagaagaaactacagcagccccccaccctgccacctgagccggcaggtgccctatgatgagatctctgctgtgcaccagcacagctaccaccccagcggcagcaagcccaagagccagcagaccagcttccagagcagcccctgcaacaagagccccaagagccacggcctgcagaaccagccctggcagaagctgagaaatgagaagcaccacatccgggtgaagaaggcccagagcctggccgagcagaccagtgacacagctggcctggagagcagcaccaggtctgagagcggcacagacctgcgggagcacagccccagcgagagcgagaaggaggtggtgggcgctgaccccaggggggccaagcccaagaaggccacccagtttgtgtacagctatggccggggccccaaggtgaagggcaagctgaagtgtgagtggagcaacagaaccacccccaagccagaagatgctggccctgagagcaccaagcctgtgggcgtcttccacccagacagcagcgaggccagcagcaggaaaggagtgctggatggctatggagccaggagaaatgagcagaggcgctacccccagaagaggcctccctgggaggtggagggcgcccggcccaggcctggaagaaatccacccaagcaggagggccaccgccacaccaatgccggccacaggaacaacatgggccccatccccaaggatgacctgaatgaaagacctgccaagagcacctgtgacagcgagaacctggccgtcatcaacaagagcagccggcgggtggaccaggagaagtgcaccgtgcggcggcaggacccccaggtggtgagccccttcagccggggcaagcagaaccacgtgctgaagaatgtggagacccacacaggcagcctcatcgagcagctgaccacagagaagtatgagtgcatggtgtgctgtgagctggtgcgggtgacagcccctgtgtggagctgccagagctgctaccacgtgttccacctgaactgcatcaagaagtgggcccggagccctgccagccaggctgatggccagagcggctggcgctgcccagcctgccagaatgtgtctgcccacgtgcccaacacctacacctgcttctgtgggaaggtgaagaaccctgagtggagcagaaatgagatcccccacagctgtggggaggtgtgcaggaagaagcagcccggccaggactgcccccacagctgcaacctgctgtgccaccctggcccctgccccccctgcccagccttcatgaccaagacctgtgaatgtggccgcaccaggcacacagtgcgctgtggccaggccgtgtctgtgcactgcagcaacccctgtgagaacatcctgaactgtggccagcaccagtgtgccgagctgtgccacggcggccagtgccagccctgccagatcatcctgaaccaggtgtgctactgcggcagcaccagcagagatgtgctgtgtggcacagatgtgggcaagagtgatggctttggagacttcagctgcctgaagatctgtgggaaggacctgaagtgtggcaaccacacctgcagccaggtgtgccacccccagccctgccagcagtgcccccggctgccccagctggtgcgctgctgcccctgtggccagacccccctgagccagctgctggagctgggcagcagcagcaggaagacctgcatggaccctgtgcccagctgtgggaaggtgtgtgggaagcccctgccctgtggcagcctggacttcatccacacctgtgagaagctgtgccacgagggggactgtggcccctgcagcaggaccagcgtcatcagctgccgctgcagcttccgcaccaaggagctgccctgcaccagcctgaagtcagaagatgccaccttcatgtgtgacaagcgctgcaacaagaagaggctgtgtggccgccacaagtgcaatgagatctgctgcgtggacaaggagcacaagtgccccctcatctgtggcaggaagctgcgctgtggcctgcaccgctgtgaggagccctgccaccggggcaactgccagacctgctggcaggccagctttgatgagctgacctgccactgtggggccagcgtcatctacccacctgtgccctgtggcacccggcccccagaatgtacccagacctgtgcccgggtgcatgaatgtgaccaccctgtgtaccacagctgccacagcgaggagaagtgccccccctgcaccttcctgacccagaagtggtgcatgggcaagcatgagcagagccactactgggccagcacccagaagaagaggagccactacatgaagaagatcccagcccacgcctgcctgtag

SEQ ID NO: 16311 - DNA, 3075 bp, Artificial Sequence
  Description of Artificial Sequence: Synthetic coding sequence
atggccgaggcccctcctgtgtctggcaccttcaagttcaacacagatgctgctgagttcatcccccaggagaagaagaacagcggcctgaactgtggcacccagaggcggctggacagcaacagaattggaagaagaaactacagcagccccccaccctgccacctgagccggcaggtgccctatgatgagatctctgctgtgcaccagcacagctaccaccccagcggcagcaagcccaagagccagcagaccagcttccagagcagcccctgcaacaagagccccaagagccacggcctgcagaaccagccctggcagaagctgagaaatgagaagcaccacatccgggtgaagaaggcccagagcctggccgagcagaccagtgacacagctggcctggagagcagcaccaggtctgagagcggcacagacctgcgggagcacagccccagcgagagcgagaaggaggtggtgggcgctgaccccaggggggccaagcccaagaaggccacccagtttgtgtacagctatggccggggccccaaggtgaagggcaagctgaagtgtgagtggagcaacagaaccacccccaagccagaagatgctggccctgagagcaccaagcctgtgggcgtcttccacccagacagcagcgaggccagcagcaggaaaggagtgctggatggctatggagccaggagaaatgagcagaggcgctacccccagaagaggcctccctgggaggtggagggcgcccggcccaggcctggaagaaatccacccaagcaggagggccaccgccacaccaatgccggccacaggaacaacatgggccccatccccaaggatgacctgaatgaaagacctgccaagagcacctgtgacagcgagaacctggccgtcatcaacaagagcagccggcgggtggaccaggagaagtgcaccgtgcggcggcaggacccccaggtggtgagccccttcagccggggcaagcagaaccacgtgctgaagaatgtggagacccacacaggcagcctcatcgagcagctgaccacagagaagtatgagtgcatggtgtgctgtgagctggtgcgggtgacagcccctgtgtggagctgccagagctgctaccacgtgttccacctgaactgcatcaagaagtgggcccggagccctgccagccaggctgatggccagagcggctggcgctgcccagcctgccagaatgtgtctgcccacgtgcccaacacctacacctgcttctgtgggaaggtgaagaaccctgagtggagcagaaatgagatcccccacagctgtggggaggtgtgcaggaagaagcagcccggccaggactgcccccacagctgcaacctgctgtgccaccctggcccctgccccccctgcccagccttcatgaccaagacctgtgaatgtggccgcaccaggcacacagtgcgctgtggccaggccgtgtctgtgcactgcagcaacccctgtgagaacatcctgaactgtggccagcaccagtgtgccgagctgtgccacggcggccagtgccagccctgccagatcatcctgaaccaggtgtgctactgcggcagcaccagcagagatgtgctgtgtggcacagatgtgggcaagagtgatggctttggagacttcagctgcctgaagatctgtgggaaggacctgaagtgtggcaaccacacctgcagccaggtgtgccacccccagccctgccagcagtgcccccggctgccccagctggtgcgctgctgcccctgtggccagacccccctgagccagctgctggagctgggcagcagcagcaggaagacctgcatggaccctgtgcccagctgtgggaaggtgtgtgggaagcccctgccctgtggcagcctggacttcatccacacctgtgagaagctgtgccacgagggggactgtggcccctgcagcaggaccagcgtcatcagctgccgctgcagcttccgcaccaaggagctgccctgcaccagcctgaagtcagaagatgccaccttcatgtgtgacaagcgctgcaacaagaagaggctgtgtggccgccacaagtgcaatgagatctgctgcgtggacaaggagcacaagtgccccctcatctgtggcaggaagctgcgctgtggcctgcaccgctgtgaggagccctgccaccggggcaactgccagacctgctggcaggccagctttgatgagctgacctgccactgtggggccagcgtcatctacccacctgtgccctgtggcacccggcccccagaatgtacccagacctgtgcccgggtgcatgaatgtgaccaccctgtgtaccacagctgccacagcgaggagaagtgccccccctgcaccttcctgacccagaagtggtgcatgggcaagcatgagttccgcagcaacatcccctgccacctggtggacatcagctgtggcctgccctgcagcgccaccctgccctgtggcatgcacaagtgccagaggctgtgccacaagggagaatgtctggtggatgagccctgcaagcagccctgcaccacccccagggctgactgtggccacccctgcatggccccctgccacaccagcagcccctgccctgtgacagcctgcaaggccaaggtggagctgcagtgtgaatgtggccgcaggaaggagatggtgatctgcagcgaggccagcagcacctaccagagaattgctgccatctccatggccagcaagatcacagacatgcagctgggcggctctgtggagatcagcaagctgatcaccaagaaggaggtgcaccaggcccggctggagtgtgatgaggagtgcagcgccctggagaggaagaagaggctggccgaggccttccacatcagcgaggacagcgaccccttcaacatccgcagcagcggcagcaagttcagtgacagcctgaaggaggatgccaggaaggacctgaagtttgtgtctgatgtggagaaggagatggagaccctggtggaggccgtgaacaaggtggaggtggagaccagccactggaccttcctgtag

SEQ ID NO: 16312 - DNA, 3363 bp, Artificial Sequence
  Description of Artificial Sequence: Synthetic coding sequence
atggccgaggcccctcctgtgtctggcaccttcaagttcaacacagatgctgctgagttcatcccccaggagaagaagaacagcggcctgaactgtggcacccagaggcggctggacagcaacagaattggaagaagaaactacagcagccccccaccctgccacctgagccggcaggtgccctatgatgagatctctgctgtgcaccagcacagctaccaccccagcggcagcaagcccaagagccagcagaccagcttccagagcagcccctgcaacaagagccccaagagccacggcctgcagaaccagccctggcagaagctgagaaatgagaagcaccacatccgggtgaagaaggcccagagcctggccgagcagaccagtgacacagctggcctggagagcagcaccaggtctgagagcggcacagacctgcgggagcacagccccagcgagagcgagaaggaggtggtgggcgctgaccccaggggggccaagcccaagaaggccacccagtttgtgtacagctatggccggggccccaaggtgaagggcaagctgaagtgtgagtggagcaacagaaccacccccaagccagaagatgctggccctgagagcaccaagcctgtgggcgtcttccacccagacagcagcgaggccagcagcaggaaaggagtgctggatggctatggagccaggagaaatgagcagaggcgctacccccagaagaggcctccctgggaggtggagggcgcccggcccaggcctggaagaaatccacccaagcaggagggccaccgccacaccaatgccggccacaggaacaacatgggccccatccccaaggatgacctgaatgaaagacctgccaagagcacctgtgacagcgagaacctggccgtcatcaacaagagcagccggcgggtggaccaggagaagtgcaccgtgcggcggcaggacccccaggtggtgagccccttcagccggggcaagcagaaccacgtgctgaagaatgtggagacccacacaggcagcctcatcgagcagctgaccacagagaagtatgagtgcatggtgtgctgtgagctggtgcgggtgacagcccctgtgtggagctgccagagctgctaccacgtgttccacctgaactgcatcaagaagtgggcccggagccctgccagccaggctgatggccagagcggctggcgctgcccagcctgccagaatgtgtctgcccacgtgcccaacacctacacctgcttctgtgggaaggtgaagaaccctgagtggagcagaaatgagatcccccacagctgtggggaggtgtgcaggaagaagcagcccggccaggactgcccccacagctgcaacctgctgtgccaccctggcccctgccccccctgcccagccttcatgaccaagacctgtgaatgtggccgcaccaggcacacagtgcgctgtggccaggccgtgtctgtgcactgcagcaacccctgtgagaacatcctgaactgtggccagcaccagtgtgccgagctgtgccacggcggccagtgccagccctgccagatcatcctgaaccaggtgtgctactgcggcagcaccagcagagatgtgctgtgtggcacagatgtgggcaagagtgatggctttggagacttcagctgcctgaagatctgtgggaaggacctgaagtgtggcaaccacacctgcagccaggtgtgccacccccagccctgccagcagtgcccccggctgccccagctggtgcgctgctgcccctgtggccagacccccctgagccagctgctggagctgggcagcagcagcaggaagacctgcatggaccctgtgcccagctgtgggaaggtgtgtgggaagcccctgccctgtggcagcctggacttcatccacacctgtgagaagctgtgccacgagggggactgtggcccctgcagcaggaccagcgtcatcagctgccgctgcagcttccgcaccaaggagctgccctgcaccagcctgaagtcagaagatgccaccttcatgtgtgacaagcgctgcaacaagaagaggctgtgtggccgccacaagtgcaatgagatctgctgcgtggacaaggagcacaagtgccccctcatctgtggcaggaagctgcgctgtggcctgcaccgctgtgaggagccctgccaccggggcaactgccagacctgctggcaggccagctttgatgagctgacctgccactgtggggccagcgtcatctacccacctgtgccctgtggcacccggcccccagaatgtacccagacctgtgcccgggtgcatgaatgtgaccaccctgtgtaccacagctgccacagcgaggagaagtgccccccctgcaccttcctgacccagaagtggtgcatgggcaagcatgagttccgcagcaacatcccctgccacctggtggacatcagctgtggcctgccctgcagcgccaccctgccctgtggcatgcacaagtgccagaggctgtgccacaagggagaatgtctggtggatgagccctgcaagcagccctgcaccacccccagggctgactgtggccacccctgcatggccccctgccacaccagcagcccctgccctgtgacagcctgcaaggccaaggtggagctgcagtgtgaatgtggccgcaggaaggagatggtgatctgcagcgaggccagcagcacctaccagagaattgctgccatctccatggccagcaagatcacagacatgcagctgggcggctctgtggagatcagcaagctgatcaccaagaaggaggtgcaccaggcccggctggagtgtgatgaggagtgcagcgccctggagaggaagaagaggctggccgaggccttccacatcagcgaggacagcgaccccttcaacatccgcagcagcggcagcaagttcagtgacagcctgaaggaggatgccaggaaggacctgaagtttgtgtctgatgtggagaaggagatggagaccctggtggaggccgtgaacaagggcaagaacagcaagaagagccacagcttcccccccatgaacagagaccaccggcgcatcatccatgacctggcccaggtgtatggcctggagagcgtgtcctatgacagcgagcccaagagaaatgtggtggtgacagccatccggggcaagtctgtgtgcccccccaccaccctgactggagtgctggagcgggagatgcaggcccggcccccaccacccatcccccaccaccgccaccagagcgacaagaaccctggcagcagcaacctgcagaagatcaccaaggagcccatcatcgactactttgatgtgcaggactag

SEQ ID NO: 16313 - DNA, 2391 bp, Artificial Sequence
  Description of Artificial Sequence: Synthetic coding sequence
atggccgaggcccctcctgtgtctggcaccttcaagttcaacacagatgctgctgagttcatcccccaggagaagaagaacagcggcctgaactgtggcacccagaggcggctggacagcaacagaattggaagaagaaactacagcagccccccaccctgccacctgagccggcaggtgccctatgatgagatctctgctgtgcaccagcacagctaccaccccagcggcagcaagcccaagagccagcagaccagcttccagagcagcccctgcaacaagagccccaagagccacggcctgcagaaccagccctggcagaagctgagaaatgagaagcaccacatccgggtgaagaaggcccagagcctggccgagcagaccagtgacacagctggcctggagagcagcaccaggtctgagagcggcacagacctgcgggagcacagccccagcgagagcgagaaggaggtggtgggcgctgaccccaggggggccaagcccaagaaggccacccagtttgtgtacagctatggccggggccccaaggtgaagggcaagctgaagtgtgagtggagcaacagaaccacccccaagccagaagatgctggccctgagagcaccaagcctgtgggcgtcttccacccagacagcagcgaggccagcagcaggaaaggagtgctggatggctatggagccaggagaaatgagcagaggcgctacccccagaagaggcctccctgggaggtggagggcgcccggcccaggcctggaagaaatccacccaagcaggagggccaccgccacaccaatgccggccacaggaacaacatgggccccatccccaaggatgacctgaatgaaagacctgccaagagcacctgtgacagcgagaacctggccgtcatcaacaagagcagccggcgggtggaccaggagaagtgcaccgtgcggcggcaggacccccaggtggtgagccccttcagccggggcaagcagaaccacgtgctgaagaatgtggagacccacacaggcagcctcatcgagcagctgaccacagagaagtatgagtgcatggtgtgctgtgagctggtgcgggtgacagcccctgtgtggagctgccagagctgctaccacgtgttccacctgaactgcatcaagaagtgggcccggagccctgccagccaggctgatggccagagcggctggcgctgcccagcctgccagaatgtgtctgcccacgtgcccaacacctacacctgcttctgtgggaaggtgaagaaccctgagtggagcagaaatgagatcccccacagctgtggggaggtgtgcaggaagaagcagcccggccaggactgcccccacagctgcaacctgctgtgccaccctggcccctgccccccctgcccagccttcatgaccaagacctgtgaatgtggccgcaccaggcacacagtgcgctgtggccaggccgtgtctgtgcactgcagcaacccctgtgagaacatcctgaactgtggccagcaccagtgtgccgagctgtgccacggcggccagtgccagccctgccagatcatcctgaaccaggtgtgctactgcggcagcaccagcagagatgtgctgtgtggcacagatgtgggcaagagtgatggctttggagacttcagctgcctgaagatctgtgggaaggacctgaagtgtggcaaccacacctgcagccaggtgtgccacccccagccctgccagcagtgcccccggctgccccagctggtgcgctgctgcccctgtggccagacccccctgagccagctgctggagctgggcagcagcagcaggaagacctgcatggaccctgtgcccagctgtgggaaggtgtgtgggaagcccctgccctgtggcagcctggacttcatccacacctgtgagaagctgtgccacgagggggactgtggcccctgcagcaggaccagcgtcatcagctgccgctgcagcttccgcaccaaggagctgccctgcaccagcctgaagtcagaagatgccaccttcatgtgtgacaagcgctgcaacaagaagaggctgtgtggccgccacaagtgcaatgagatctgctgcgtggacaaggagcacaagtgccccctcatctgtggcaggaagctgcgctgtggcctgcaccgctgtgaggagccctgccaccggggcaactgccagacctgctggcaggccagctttgatgagctgacctgccactgtggggccagcgtcatctacccacctgtgccctgtggcacccggcccccagaatgtacccagacctgtgcccgggtgcatgaatgtgaccaccctgtgtaccacagctgccacagccgctctgtgcccctggccctgtcctag

SEQ ID NO: 16314 - DNA, 1917 bp, Artificial Sequence
  Description of Artificial Sequence: Synthetic coding sequence
atgcaggtgagcagcctgaatgaggtgaagatctacagcctgagctgtgggaagagcctgcctgagtggctgagtgacaggaagaagagggccctgcagaagaaggatgtggatgtgagaagaagaattgagctgatccaggactttgagatgcccaccgtgtgcaccaccatcaaggtgtccaaggatggccagtacatcctggccaccggcacctacaagccccgggtgcgctgctatgacacctaccagctgagcctgaagtttgagcgctgcctggacagcgaggtggtgacctttgagatcctgagtgatgactacagcaagatcgtgttcctgcacaatgaccgctacatcgagttccacagccagagcggcttctactacaagacccgcatccccaagtttggccgggacttctcctaccactaccccagctgtgacctgtactttgtgggcgccagcagcgaggtgtaccgcctgaacctggagcagggccgctacctgaaccccctgcagacagatgctgctgagaacaacgtgtgtgacatcaacagcgtgcacggcctgtttgccaccggcaccatcgagggccgggtggagtgctgggaccccaggaccaggaacagagtgggcctgctggactgtgccctgaacagcgtgacagctgacagcgagatcaacagcctgcccaccatcagcgccctgaagttcaatggagccctgaccatggctgtgggcaccaccaccggccagggcaagatcttcaccagcctggagcctgagcatgacctgaatgatgtgtgcctgtaccccaacagcggcatgctgctgacagccaatgagacccccaagatgggcatctactacatccctgtgctgggccctgccccccgctggtgcagcttcctggacaacctgacagaggagctggaggagaaccctgagagcacagtgtatgatgactacaagtttgtgaccaagaaggacctggagaacctgggcctgacccacctgattggcagccccttcctgcgggcctacatgcacggcttcttcatggacatccggctgtaccacaaggtgaagctgatggtgaacccctttgcctatgaggagtacaggaaggacaagatccggcagaagattgaggagacccgggcccagagggtgcagctgaagaagctgcccaaggtgaacaaggagctggccctgaagctgattgaggaggaggaggagaagcagaagagcacctggaagaagaaggtgaagagcctgcccaacatcctgacagatgaccgcttcaaggtgatgtttgagaacccagacttccaggtggatgaggagagcgaggagttccggctgctgaaccccctggtgtccaagatcagcgagaagaggaagaagaagctgcggctgctggagcagcaggagctgcgggagaaggaggaggaggaggagcctgagggcaagcccagtgatgctgagagcagcgagagcagtgatgatgagaaggcctgggtggaggaggtgaggaagcagaggcggctgctgcagcaggaggagaaggtgaagaggcaggagcggctgaaggaggaccagcagacagtgctgaagccccagttctatgagatcaaggccggggaggagttccgctccttcaaggacagcgccaccaagcagaagctgatgaacaagaccctggaggaccggctgaagattgaggccaagaatggcaccctgtctgtgtctgacaccaccgtgggcagcaagcagctgaccttcaccctgaagaggtctgagcagcagaagaagcagcaggaggccgagaagctgcaccggcaggagaggaagaggctgcggcgctctgctggccacctgaagagccgccacaagaggggccgctccttccactag

SEQ ID NO: 16315 - DNA, 2067 bp, Artificial Sequence
  Description of Artificial Sequence: Synthetic coding sequence
atgcaggtgagcagcctgaatgaggtgaagatctacagcctgagctgtgggaagagcctgcctgagtggctgagtgacaggaagaagagggccctgcagaagaaggatgtggatgtgagaagaagaattgagctgatccaggactttgagatgcccaccgtgtgcaccaccatcaaggtgtccaaggatggccagtacatcctggccaccggcacctacaagccccgggtgcgctgctatgacacctaccagctgagcctgaagtttgagcgctgcctggacagcgaggtggtgacctttgagatcctgagtgatgactacagcaagatcgtgttcctgcacaatgaccgctacatcgagttccacagccagagcggcttctactacaagacccgcatccccaagtttggccgggacttctcctaccactaccccagctgtgacctgtactttgtgggcgccagcagcgaggtgtaccgcctgaacctggagcagggccgctacctgaaccccctgcagacagatgctgctgagaacaacgtgtgtgacatcaacagcgtgcacggcctgtttgccaccggcaccatcgagggccgggtggagtgctgggaccccaggaccaggaacagagtgggcctgctggactgtgccctgaacagcgtgacagctgacagcgagatcaacagcctgcccaccatcagcgccctgaagttcaatggagccctgaccatggctgtgggcaccaccaccggccaggtgctgctgtatgacctgcggagtgacaagcccctgctggtgaaggaccaccagtatggcctgcccatcaagtctgtgcacttccaggacagcctggacctgatcctgtctgctgacagccgcatcgtgaagatgtggaacaagaacagcggcaagatcttcaccagcctggagcctgagcatgacctgaatgatgtgtgcctgtaccccaacagcggcatgctgctgacagccaatgagacccccaagatgggcatctactacatccctgtgctgggccctgccccccgctggtgcagcttcctggacaacctgacagaggagctggaggagaaccctgagagcacagtgtatgatgactacaagtttgtgaccaagaaggacctggagaacctgggcctgacccacctgattggcagccccttcctgcgggcctacatgcacggcttcttcatggacatccggctgtaccacaaggtgaagctgatggtgaacccctttgcctatgaggagtacaggaaggacaagatccggcagaagattgaggagacccgggcccagagggtgcagctgaagaagctgcccaaggtgaacaaggagctggccctgaagctgattgaggaggaggaggagaagcagaagagcacctggaagaagaaggtgaagagcctgcccaacatcctgacagatgaccgcttcaaggtgatgtttgagaacccagacttccaggtggatgaggagagcgaggagttccggctgctgaaccccctggtgtccaagatcagcgagaagaggaagaagaagctgcggctgctggagcagcaggagctgcgggagaaggaggaggaggaggagcctgagggcaagcccagtgatgctgagagcagcgagagcagtgatgatgagaaggcctgggtggaggaggtgaggaagcagaggcggctgctgcagcaggaggagaaggtgaagaggcaggagcggctgaaggaggaccagcagacagtgctgaagccccagttctatgagatcaaggccggggaggagttccgctccttcaaggacagcgccaccaagcagaagctgatgaacaagaccctggaggaccggctgaagattgaggccaagaatggcaccctgtctgtgtctgacaccaccgtgggcagcaagcagctgaccttcaccctgaagaggtctgagcagcagaagaagcagcaggaggccgagaagctgcaccggcaggagaggaagaggctgcggcgctctgctggccacctgaagagccgccacaagaggggccgctccttccactag

SEQ ID NO: 16316 - DNA, 1989 bp, Artificial Sequence
  Description of Artificial Sequence: Synthetic coding sequence
atgcaggtgagcagcctgaatgaggtgaagatctacagcctgagctgtgggaagagcctgcctgagtggctgagtgacaggaagaagagggccctgcagaagaaggatgtggatgtgagaagaagaattgagctgatccaggactttgagatgcccaccgtgtgcaccaccatcaaggtgtccaaggatggccagtacatcctggccaccgtggtgacctttgagatcctgagtgatgactacagcaagatcgtgttcctgcacaatgaccgctacatcgagttccacagccagagcggcttctactacaagacccgcatccccaagtttggccgggacttctcctaccactaccccagctgtgacctgtactttgtgggcgccagcagcgaggtgtaccgcctgaacctggagcagggccgctacctgaaccccctgcagacagatgctgctgagaacaacgtgtgtgacatcaacagcgtgcacggcctgtttgccaccggcaccatcgagggccgggtggagtgctgggaccccaggaccaggaacagagtgggcctgctggactgtgccctgaacagcgtgacagctgacagcgagatcaacagcctgcccaccatcagcgccctgaagttcaatggagccctgaccatggctgtgggcaccaccaccggccaggtgctgctgtatgacctgcggagtgacaagcccctgctggtgaaggaccaccagtatggcctgcccatcaagtctgtgcacttccaggacagcctggacctgatcctgtctgctgacagccgcatcgtgaagatgtggaacaagaacagcggcaagatcttcaccagcctggagcctgagcatgacctgaatgatgtgtgcctgtaccccaacagcggcatgctgctgacagccaatgagacccccaagatgggcatctactacatccctgtgctgggccctgccccccgctggtgcagcttcctggacaacctgacagaggagctggaggagaaccctgagagcacagtgtatgatgactacaagtttgtgaccaagaaggacctggagaacctgggcctgacccacctgattggcagccccttcctgcgggcctacatgcacggcttcttcatggacatccggctgtaccacaaggtgaagctgatggtgaacccctttgcctatgaggagtacaggaaggacaagatccggcagaagattgaggagacccgggcccagagggtgcagctgaagaagctgcccaaggtgaacaaggagctggccctgaagctgattgaggaggaggaggagaagcagaagagcacctggaagaagaaggtgaagagcctgcccaacatcctgacagatgaccgcttcaaggtgatgtttgagaacccagacttccaggtggatgaggagagcgaggagttccggctgctgaaccccctggtgtccaagatcagcgagaagaggaagaagaagctgcggctgctggagcagcaggagctgcgggagaaggaggaggaggaggagcctgagggcaagcccagtgatgctgagagcagcgagagcagtgatgatgagaaggcctgggtggaggaggtgaggaagcagaggcggctgctgcagcaggaggagaaggtgaagaggcaggagcggctgaaggaggaccagcagacagtgctgaagccccagttctatgagatcaaggccggggaggagttccgctccttcaaggacagcgccaccaagcagaagctgatgaacaagaccctggaggaccggctgaagattgaggccaagaatggcaccctgtctgtgtctgacaccaccgtgggcagcaagcagctgaccttcaccctgaagaggtctgagcagcagaagaagcagcaggaggccgagaagctgcaccggcaggagaggaagaggctgcggcgctctgctggccacctgaagagccgccacaagaggggccgctccttccactag

SEQ ID NO: 16317 - DNA, 1917 bp, Artificial Sequence
  Description of Artificial Sequence: Synthetic coding sequence
atgcccaccgtgtgcaccaccatcaaggtgtccaaggatggccagtacatcctggccaccggcacctacaagccccgggtgcgctgctatgacacctaccagctgagcctgaagtttgagcgctgcctggacagcgaggtggtgacctttgagatcctgagtgatgactacagcaagatcgtgttcctgcacaatgaccgctacatcgagttccacagccagagcggcttctactacaagacccgcatccccaagtttggccgggacttctcctaccactaccccagctgtgacctgtactttgtgggcgccagcagcgaggtgtaccgcctgaacctggagcagggccgctacctgaaccccctgcagacagatgctgctgagaacaacgtgtgtgacatcaacagcgtgcacggcctgtttgccaccggcaccatcgagggccgggtggagtgctgggaccccaggaccaggaacagagtgggcctgctggactgtgccctgaacagcgtgacagctgacagcgagatcaacagcctgcccaccatcagcgccctgaagttcaatggagccctgaccatggctgtgggcaccaccaccggccaggtgctgctgtatgacctgcggagtgacaagcccctgctggtgaaggaccaccagtatggcctgcccatcaagtctgtgcacttccaggacagcctggacctgatcctgtctgctgacagccgcatcgtgaagatgtggaacaagaacagcggcaagatcttcaccagcctggagcctgagcatgacctgaatgatgtgtgcctgtaccccaacagcggcatgctgctgacagccaatgagacccccaagatgggcatctactacatccctgtgctgggccctgccccccgctggtgcagcttcctggacaacctgacagaggagctggaggagaaccctgagagcacagtgtatgatgactacaagtttgtgaccaagaaggacctggagaacctgggcctgacccacctgattggcagccccttcctgcgggcctacatgcacggcttcttcatggacatccggctgtaccacaaggtgaagctgatggtgaacccctttgcctatgaggagtacaggaaggacaagatccggcagaagattgaggagacccgggcccagagggtgcagctgaagaagctgcccaaggtgaacaaggagctggccctgaagctgattgaggaggaggaggagaagcagaagagcacctggaagaagaaggtgaagagcctgcccaacatcctgacagatgaccgcttcaaggtgatgtttgagaacccagacttccaggtggatgaggagagcgaggagttccggctgctgaaccccctggtgtccaagatcagcgagaagaggaagaagaagctgcggctgctggagcagcaggagctgcgggagaaggaggaggaggaggagcctgagggcaagcccagtgatgctgagagcagcgagagcagtgatgatgagaaggcctgggtggaggaggtgaggaagcagaggcggctgctgcagcaggaggagaaggtgaagaggcaggagcggctgaaggaggaccagcagacagtgctgaagccccagttctatgagatcaaggccggggaggagttccgctccttcaaggacagcgccaccaagcagaagctgatgaacaagaccctggaggaccggctgaagattgaggccaagaatggcaccctgtctgtgtctgacaccaccgtgggcagcaagcagctgaccttcaccctgaagaggtctgagcagcagaagaagcagcaggaggccgagaagctgcaccggcaggagaggaagaggctgcggcgctctgctggccacctgaagagccgccacaagaggggccgctccttccactag

SEQ ID NO: 16318 - DNA, 2160 bp, Artificial Sequence
  Description of Artificial Sequence: Synthetic coding sequence
atggccgccctggaggaggagttcaccctgagctctgtggtgctgtctgctggccctgagggcctgctgggcgtggagcagagcgacaagacagaccagttcctggtgacagattctggccgcaccgtcatcctgtacaaggtgtctgaccagaagcccctgggctcctggagcgtgaagcagggccagatcatcacctgcccagctgtgtgcaacttccagacaggagaatatgtggtggtgcatgacaacaaggtgctgcgcatctggaacaatgaagatgtgaacctggacaaggtgttcaaggccaccctgtctgctgaggtgtaccgcatcctgtctgtgcagggcacagagcccctggtgctcttcaaggagggcgctgtgcggggcctggaggccctgctggccgacccccagcagaagattgaaacagtcatcagtgatgaggaggtgatcaagtggaccaagttctttgtggtgttccgccaccctgtgctgatcttcatcacagagaagcacggcaactactttgcctacgtgcagatgttcaacagccgcatcctgaccaagtacaccctgctgctgggccaggatgagaacagcgtcatcaagagcttcaccgcctctgtggacaggaagttcatcagcctgatgagcctgagcagtgatggctgcatctatgagaccctcatccccatccggcctgctgaccctgagaagaaccagagcctggtgaagagcctgctgctgaaggctgtggtgtctggaaatgccagaaatggagtggccctgacagccctggaccaggaccacgtggccgtgctgggcagccccctggccgccagcaaagaatgtctgtctgtgtggaacatcaagttccagaccctgcagaccagcaaggagctgccccagggcaccagcggccagctgtggtactacggggagcacctgttcatgctgcacggcaagagcctgaccgtcatcccctacaagtgtgaggtgagcagcctggccggggccctgggcaagctgaagcacagccaggaccccggcacccacgtggtgagccactttgtgaactgggagaccccccagggctgcggcctgggcttccagaacagcgagcagagccgccgcatcctgcggcggaggaagattgaggtgtccctgcagcctgaggtgccccccagcaagcagctgctgagcaccatcatgaaggacagcgagaagcacatcgaggtggaggtgaggaagttcctggccctgaagcagaccccagacttccacacagtgattggagacacagtgacaggcctgctggagcgctgcaaggccgagcccagcttctaccccaggaactgcctgatgcagctgatccagacccacgtgctgagctacagcctgtgcccagacctgatggagatcgccctgaagaagaaggatgtgcagctgctgcagctgtgcctgcagcagttcccagacatccctgagagcgtgacctgtgcctgcctgaagatcttcctgagcattggagatgacagcctgcaggagacagatgtgaacatggagagcgtgtttgactacagcatcaacagcgtgcatgatgagaagatggaggagcagacagagatcctgcagaatggcttcaaccctgaggaggacaagtgcaacaactgtgaccaggagctgaacaagaagccccaggatgagaccaaggagagcaccagctgccctgtggtgcagaagagagctgccctgctgaatgccatcctgcacagcgcctacagcgagaccttcctgctgccccacctgaaggacatcccagcccagcacatcaccctcttcctgaagtacctgtacttcctgtacctgaagtgcagtgaaaatgccaccatgaccctgcccggcatccacccccccaccctgaaccagatcatggactggatctgcctgctgctggatgccaacttcaccgtggtggtgatgatgcctgaggccaagaggctgctgatcaacctgtacaagctggtgaagagccagatctctgtgtacagcgagctgaacaagattgaggtgtccttccgggagctgcagaagctgaaccaggagaagaacaacagaggcctgtacagcattgaggtgctggagctgttctag

SEQ ID NO: 16319 - DNA, 1614 bp, Artificial Sequence
  Description of Artificial Sequence: Synthetic coding sequence
atgttcaacagccgcatcctgaccaagtacaccctgctgctgggccaggatgagaacagcgtcatcaagagcttcaccgcctctgtggacaggaagttcatcagcctgatgagcctgagcagtgatggctgcatctatgagaccctcatccccatccggcctgctgaccctgagaagaaccagagcctggtgaagagcctgctgctgaaggctgtggtgtctggaaatgccagaaatggagtggccctgacagccctggaccaggaccacgtggccgtgctgggcagccccctggccgccagcaaagaatgtctgtctgtgtggaacatcaagttccagaccctgcagaccagcaaggagctgccccagggcaccagcggccagctgtggtactacggggagcacctgttcatgctgcacggcaagagcctgaccgtcatcccctacaagtgtgaggtgagcagcctggccggggccctgggcaagctgaagcacagccaggaccccggcacccacgtggtgagccactttgtgaactgggagaccccccagggctgcggcctgggcttccagaacagcgagcagagccgccgcatcctgcggcggaggaagattgaggtgtccctgcagcctgaggtgccccccagcaagcagctgctgagcaccatcatgaaggacagcgagaagcacatcgaggtggaggtgaggaagttcctggccctgaagcagaccccagacttccacacagtgattggagacacagtgacaggcctgctggagcgctgcaaggccgagcccagcttctaccccaggaactgcctgatgcagctgatccagacccacgtgctgagctacagcctgtgcccagacctgatggagatcgccctgaagaagaaggatgtgcagctgctgcagctgtgcctgcagcagttcccagacatccctgagagcgtgacctgtgcctgcctgaagatcttcctgagcattggagatgacagcctgcaggagacagatgtgaacatggagagcgtgtttgactacagcatcaacagcgtgcatgatgagaagatggaggagcagacagagatcctgcagaatggcttcaaccctgaggaggacaagtgcaacaactgtgaccaggagctgaacaagaagccccaggatgagaccaaggagagcaccagctgccctgtggtgcagaagagagctgccctgctgaatgccatcctgcacagcgcctacagcgagaccttcctgctgccccacctgaaggacatcccagcccagcacatcaccctcttcctgaagtacctgtacttcctgtacctgaagtgcagtgaaaatgccaccatgaccctgcccggcatccacccccccaccctgaaccagatcatggactggatctgcctgctgctggatgccaacttcaccgtggtggtgatgatgcctgaggccaagaggctgctgatcaacctgtacaagctggtgaagagccagatctctgtgtacagcgagctgaacaagattgaggtgtccttccgggagctgcagaagctgaaccaggagaagaacaacagaggcctgtacagcattgaggtgctggagctgttctag

SEQ ID NO: 16320 - DNA, 642 bp, Artificial Sequence
  Description of Artificial Sequence: Synthetic coding sequence
atgggcaggaacaagaagaagaagagagatggagatgaccggcggccccggctggtgctgagctttgatgaggagaagagaagagagtacctgaccggcttccacaagaggaaggtggagaggaagaaggccgccatcgaggagatcaagcagaggctgaaggaggagcagaggaagctgcgggaggagcggcaccaggagtacctgaagatgctggccgagcgggaggaggccctggaggaggctgatgagctggaccggctggtgacagccaagacagaatctgtgcagtatgaccaccccaaccacacagtgacagtgaccaccatcagtgacctggacctgagcggggcccggctgctgggcctgaccccacctgagggcggggccggggacagaagtgaggaggaggccagcagcacagagaagcccaccaaggccctgcccaggaagagccgggaccccctgctgagccagaggatcagcagcctgacagccagcctgcacgcccacagcaggaagaaggtgaagaggaagcacccccggcgggcccaggacagcaagaagccaccccgggcccccaggaccagcaaggcccagaggcggcggctgaccgggaaggcccggcacagcggggagtag

SEQ ID NO: 16321 - DNA, 642 bp, Artificial Sequence; identical to SEQ ID NO: 16320
  Description of Artificial Sequence: Synthetic coding sequence

SEQ ID NO: 16322 - DNA, 1917 bp, Artificial Sequence
  Description of Artificial Sequence: Synthetic coding sequence
atggagagcgagcgggacatgtaccggcagttccaggactggtgcctgcggacctatggagacagcggcaagaccaagacagtgaccaggaagaagtatgagcgcatcgtgcagctgctgaatggaagtgagagcagcagcacagacaatgccaagttcaagttctgggtgaagagcaagggcttccagctgggccagccagatgaggtgcggggcggcggcggcggggccaagcaggtgctgtatgtgcctgtgaagaccacagatggagtgggcgtggatgagaagctgagcctgcggcgggtggccgtggtggaggacttctttgacatcatctacagcatgcacgtggagaccggccccaacggggagcagatcaggaagcacgccggccagaagaggacctacaaggccatcagcgagagctatgccttcctgccccgggaggccgtgacccgcttcctgatgagctgcagcgagtgccagaagaggatgcacctgaacccagatggaacagaccacaaggacaatggcaagccacccaccctggtgacctccatgattgactacaacatgcccatcaccatggcctacatgaagcacatgaagctgcagctgctgaacagccagcaggatgaagatgagagcagcattgaaagtgatgaatttgacatgtctgacagcaccaggatgtctgctgtgaacagcgacctgagcagcaacctggaggagaggatgcagagcccccagaacctgcacggccagcaggatgatgacagcgctgctgagagcttcaatggaaatgagaccctgggccacagcagcatcgccagcggcggcacccacagccgggagatgggagacagcaacagtgatggcaagacaggcctggagcaggatgagcagcccctgaacctgagtgacagccccctgagcgcccagctgaccagcgagtacagaattgatgaccacaacagcaatggcaagaacaagtacaagaacctgctgatcagtgacctgaagatggagcgggaggcccgggagaatggcagcaagagccctgcccacagctacagcagctatgattctgggaagaatgaatctgtggacagaggagctgaggacctgagcctgaacagaggagatgaagatgaagatgaccatgaagatcatgatgacagcgagaaggtgaatgaaacagatggagtggaggccgagcggctgaaggccttcaacatgtttgtgcggctgtttgtggatgagaacctggacaggatggtgcccatcagcaagcagcccaaggagaagatccaggccatcatcgacagctgccggcggcagtttcctgagtaccaggagcgggccaggaagaggatccgcacctacctgaagagctgcaggaggatgaagaggagcggctttgagatgagccggcccatccccagccacctgaccagcgctgtggccgagagcatcctggccagcgcctgtgagagcgagagcagaaatgctgccaagaggatgaggctggagcggcagcaggatgaaagtgccccagctgacaagcagtgcaagccagaggccacccaggccacctacagcaccagcgctgtgcccggcagccaggatgtgctgtacatcaatggaaatggcacctacagctaccacagctaccggggcctgggcggcggcctgctgaacctgaatgatgccagcagcagcggccccacagacctgtccatgaagaggcagctggccaccagcagcggcagcagcagcagcagcaacagccggccccagctgagccccacagagatcaatgctgtgcggcagctggtggccggctaccgggagagcgctgccttcctgctgcggtctgcagatgagctggagaacctgatcctgcagcagaactag

SEQ ID NO: 16323 - DNA, 1269 bp, Artificial Sequence
  Description of Artificial Sequence: Synthetic coding sequence
atgcacgtggagaccggccccaacggggagcagatcaggaagcacgccggccagaagaggacctacaaggccatcagcgagagctatgccttcctgccccgggaggccgtgacccgcttcctgatgagctgcagcgagtgccagaagaggatgcacctgaacccagatggaacagaccacaaggacaatggcaagccacccaccctggtgacctccatgattgactacaacatgcccatcaccatggcctacatgaagcacatgaagctgcagctgctgaacagccagcaggatgaagatgagagcagcattgaaagtgatgaatttgacatgtctgacagcaccaggatgtctgctgtgaacagcgacctgagcagcaacctggaggagaggatgcagagcccccagaacctgcacggccagcaggatgatgacagcgctgctgagagcttcaatggaaatgagaccctgggccacagcagcatcgccagcggcggcacccacagccgggagatgggagacagcaacagtgatggcaagacaggcctggagcaggatgagcagcccctgaacctgagtgacagccccctgagcgcccagctgaccagcgagtacagaattgatgaccacaacagcaatggcaagaacaagtacaagaacctgctgatcagtgacctgaagatggagcgggaggcccgggagaatggcagcaagagccctgcccacagctacagcagctatgattctgggaagaatgaatctgtggacagaggagctgaggacctgagcctgaacagaggagatgaagatgaagatgaccatgaagatcatgatgacagcgagaaggtgaatgaaacagatggagtggaggccgagcggctgaaggccttcaatgatgaaagtgccccagctgacaagcagtgcaagccagaggccacccaggccacctacagcaccagcgctgtgcccggcagccaggatgtgctgtacatcaatggaaatggcacctacagctaccacagctaccggggcctgggcggcggcctgctgaacctgaatgatgccagcagcagcggccccacagacctgtccatgaagaggcagctggccaccagcagcggcagcagcagcagcagcaacagccggccccagctgagccccacagagatcaatgctgtgcggcagctggtggccggctaccgggagagcgctgccttcctgctgcggtctgcagatgagctggagaacctgatcctgcagcagaactag

SEQ ID NO: 16324 - DNA, 600 bp, Artificial Sequence
  Description of Artificial Sequence: Synthetic coding sequence
atggaccagaccatgctggatgattctgctgctgagagcttcaatggaaatgagaccctgggccacagcagcatcgccagcggcggcacccacagccgggagatgggagacagcaacagtgatggcaagacaggcctggagcaggatgagcagcccctgaacctgagtgacagccccctgagcgcccagctgaccagcgagtacagaattgatgaccacaacagcaatggcaagaacaagtacaagaacctgctgatcagtgacctgaagatggagcgggaggccagagaaaatggcagcaagagccctgcccacagctacagcagctatgacagcggcaagaatgaatctgtggacagaggagctgaggacctgagcctgaacagaggagatgaagatgaagatgaccacgaggaccatgatgattctgagaaggtgaatgaaacagatggagtggaggccgagcggctgaaggccttcaacagccggcccatccccagccacctgaccagcgctgtggccgagagcatcctggccagcgcctgtgagagcgagagcagaaatgctgccaagaggatgaggctggagcggcagcagtag

SEQ ID NO: 16325 - DNA, 1062 bp, Artificial Sequence
  Description of Artificial Sequence: Synthetic coding sequence
atgggagacagcaacagtgatggcaagacaggcctggagcaggatgagcagcccctgaacctgagtgacagccccctgagcgcccagctgaccagcgagtacagaattgatgaccacaacagcaatggcaagaacaagtacaagaacctgctgatcagtgacctgaagatggagcgggaggccagagaaaatggcagcaagagccctgcccacagctacagcagctatgacagcggcaagaatgaatctgtggacagaggagctgaggacctgagcctgaacagaggagatgaagatgaagatgaccacgaggaccatgatgattctgagaaggtgaatgaaacagatggagtggaggccgagcggctgaaggccttcaacatgtttgtgcggctgtttgtggatgagaacctggacaggatggtgcccatcagcaagcagcccaaggagaagatccaggccatcatcgacagctgccggcggcagtttcctgagtaccaggagcgggccaggaagaggatccgcacctacctgaagagctgcaggaggatgaagaggagcggctttgagatgagccggcccatccccagccacctgaccagcgctgtggccgagagcatcctggccagcgcctgtgagagcgagagcagaaatgctgccaagaggatgaggctggagcggcagcaggatgagagcgccccagctgacaagcagtgcaagccagaggccacccaggccacctacagcaccagcgctgtgcccggcagccaggatgtgctgtacatcaatggaaatggcacctacagctaccacagctaccggggcctgggcggcggcctgctgaacctgaatgatgccagcagcagcggccccacagacctgtccatgaagaggcagctggccaccagcagcggcagcagcagcagcagcaacagccggccccagctgagccccacagagatcaatgctgtgcggcagctggtggccggctaccgggagagcgctgccttcctgctgcggtctgcagatgagctggagaacctgatcctgcagcagaactag

SEQ ID NO: 16326 - DNA, 1260 bp, Artificial Sequence
  Description of Artificial Sequence: Synthetic coding sequence
atgagctgcagcgagtgccagaagaggatgcacctgaacccagatggaacagaccacaaggacaacgggaagccacccaccctggtgacctccatgattgactacaacatgcccatcaccatggcctacatgaagcacatgaagctgcagctgctgaacagccagcaggatgaagatgagagcagcattgaaagtgatgaatttgacatgtctgacagcaccaggatgtctgctgtgaacagcgacctgagcagcaacctggaggagaggatgcagagcccccagaacctgcacggccagcaggatgatgattctgctgctgagagcttcaatggaaatgagaccctgggccacagcagcatcgccagcggcggcacccacagccgggagatgggagacagcaacagtgatggcaagacaggcctggagcaggatgagcagcccctgaacctgagtgacagccccctgagcgcccagctgaccagcgagtacagaattgatgaccacaacagcaatggcaagaacaagtacaagaacctgctgatcagtgacctgaagatggagcgggaggccagagaaaatggcagcaagagccctgcccacagctacagcagctatgacagcggcaagaatgaatctgtggacagaggagctgaggacctgagcctgaacagaggagatgaagatgaagatgaccacgaggaccatgatgattctgagaaggtgaatgaaacagatggagtggaggccgagcggctgaaggccttcaacagccggcccatccccagccacctgaccagcgctgtggccgagagcatcctggccagcgcctgtgagagcgagagcagaaatgctgccaagaggatgaggctggagcggcagcaggatgagagcgccccagctgacaagcagtgcaagccagaggccacccaggccacctacagcaccagcgctgtgcccggcagccaggatgtgctgtacatcaatggaaatggcacctacagctaccacagctaccggggcctgggcggcggcctgctgaacctgaatgatgccagcagcagcggccccacagacctgtccatgaagaggcagctggccaccagcagcggcagcagcagcagcagcaacagccggccccagctgagccccacagagatcaatgctgtgcggcagctggtggccggctaccgggagagcgctgccttcctgctgcggtctgcagatgagctggagaacctgatcctgcagcagaactag

SEQ ID NO: 16327 - DNA, 1695 bp, Artificial Sequence
  Description of Artificial Sequence: Synthetic coding sequence
atggctgacctgatgcaggagaccttcctgcaccacgccacagatggagtgggcgtggatgagaagctgagcctgcggcgggtggccgtggtggaggacttctttgacatcatctacagcatgcacgtggagaccggccccaacggggagcagatcaggaagcacgccggccagaagaggacctacaaggccatcagcgagagctatgccttcctgccccgggaggccgtgacccgcttcctgatgagctgcagcgagtgccagaagaggatgcacctgaacccagatggaacagaccacaaggacaatggcaagccacccaccctggtgacctccatgattgactacaacatgcccatcaccatggcctacatgaagcacatgaagctgcagctgctgaacagccagcaggatgaagatgagagcagcattgaaagtgatgaatttgacatgtctgacagcaccaggatgtctgctgtgaacagcgacctgagcagcaacctggaggagaggatgcagagcccccagaacctgcacggccagcaggatgatgacagcgctgctgagagcttcaatggaaatgagaccctgggccacagcagcatcgccagcggcggcacccacagccgggagatgggagacagcaacagtgatggcaagacaggcctggagcaggatgagcagcccctgaacctgagtgacagccccctgagcgcccagctgaccagcgagtacagaattgatgaccacaacagcaatggcaagaacaagtacaagaacctgctgatcagtgacctgaagatggagcgggaggcccgggagaatggcagcaagagccctgcccacagctacagcagctatgattctgggaagaatgaatctgtggacagaggagctgaggacctgagcctgaacagaggagatgaagatgaagatgaccatgaagatcatgatgacagcgagaaggtgaatgaaacagatggagtggaggccgagcggctgaaggccttcaacatgtttgtgcggctgtttgtggatgagaacctggacaggatggtgcccatcagcaagcagcccaaggagaagatccaggccatcatcgacagctgccggcggcagtttcctgagtaccaggagcgggccaggaagaggatccgcacctacctgaagagctgcaggaggatgaagaggagcggctttgagatgagccggcccatccccagccacctgaccagcgctgtggccgagagcatcctggccagcgcctgtgagagcgagagcagaaatgctgccaagaggatgaggctggagcggcagcaggatgaaagtgccccagctgacaagcagtgcaagccagaggccacccaggccacctacagcaccagcgctgtgcccggcagccaggatgtgctgtacatcaatggaaatggcacctacagctaccacagctaccggggcctgggcggcggcctgctgaacctgaatgatgccagcagcagcggccccacagacctgtccatgaagaggcagctggccaccagcagcggcagcagcagcagcagcaacagccggccccagctgagccccacagagatcaatgctgtgcggcagctggtggccggctaccgggagagcgctgccttcctgctgcggtctgcagatgagctggagaacctgatcctgcagcagaactag

SEQ ID NO: 16328 - DNA, 2109 bp, Artificial Sequence
  Description of Artificial Sequence: Synthetic coding sequence
atggctgacagcggcctgctgctgaagaggggcagctgccgcagcacctggctgcgggtgaggaaggcccggccccagctgatcctgagcagaagaccccggcggcggctgggcagcctgcgctggtgtggcagaagaaggctgcgctggaggctgctgcaggcccaggccagcggcgtggactggagggagggcgcccggcaggtgtccagagctgctgctgcccggcggcccaacacagccacccccagccccatccccagccccaccccagccagcgagcctgagagcgagcctgagctggagagcgccagcagctgccaccggcccctgctgatcccccctgtgcggcctgtgggccctggccgggccctgctgctgctgcctgtggagcagggcttcaccttcagcggcatctgccgggtgacctgcctgtatggccaggtgcaggtgtttggcttcaccatcagccagggccagcctgcccaggacatcttctctgtgtacacccacagctgcctgagcatccacgccctgcactacagccagcctgagaagagcaagaaggagctgaagcgggaggccaggaacctgctgaagagccacctgaacctggatgaccggcgctggagcatgcagaacttcagcccccagtgcagcatcgtgctgctggagcacctgaagacagccaccgtgaacttcatcaccagctacccaggcagcagctacatctttgtgcaggagagccccaccccccagatcaagccagagtacctggccctgcggtctgtgggcatcagaagagagaagaagaggaagggcctgcagctgacagagagcaccctgagcgccctggaggagctggtgaatgtgtcctgtgaggaggtggatggctgccctgtgatcctggtgtgtggcagccaggatgtgggcaagagcaccttcaaccgctacctgatcaaccacctgctgaacagcctgccctgtgtggactacctggagtgtgacctgggccagacagagttcaccccacctggctgcatcagcctgctgaacatcacagagcctgtgctgggcccccccttcacccacctgcggaccccccagaagatggtgtactacggcaagcccagctgcaagaacaactatgagaactacattgatattgtgaagtatgtgttttctgcctacaagcgggagagccccctcatcgtgaacaccatgggctgggtgtctgaccagggcctgctgctgctgattgacctgatccggctgctgagccccagccacgtggtgcagttcagaagtgaccacagcaagtacatgccagacctgaccccccagtatgtggatgacatggatggcctgtacaccaagagcaagaccaagatgaggaacagacgcttccggctggccgcctttgctgatgccctggagtttgctgatgaggagaaggagagccctgtggagttcaccggccacaagctgattggagtgtacacagactttgccttccgcatcacccccaggaaccgggagagccacaacaagatcctgcgggacctgagcatcctgagctacctgagccagctgcagccccccatgcccaagcccctgagccccctgcacagcctgaccccctaccaggtgcccttcaatgctgtggccctgcgcatcacccacagtgatgtggcccccacccacatcctgtatgctgtgaatgcctcctgggtgggcctgtgcaagatccaggatgatgtgcggggctacaccaacggccccatcctgctggcccagacccccatctgtgactgcctgggcttcggcatctgccggggcatcgacatggagaagaggctgtaccacatcctgacccctgtgcccccagaggagctgaggacagtgaactgcctgctggtgggcgccatcgccatcccccactgtgtgctgaagtgccagaggggcatcgagggcaccgtgccctacgtgaccacagactacaacttcaagctgcccggggccagcgagaagatcggggcccgggagcctgaggaggcccacaaggagaagccctacagaagacccaagttctgcaggaagatgaagtag

SEQ ID NO: 16329 - DNA, 2583 bp, Artificial Sequence
  Description of Artificial Sequence: Synthetic coding sequence
atggccgccagccgctctgctggggaggccggccctgggggcagccagggccgggtggtgaggatgaagaggcggggcggccggggcccccggcggggccctgctgggggcggggagaaggccctgaagaggctgaagctggccgtggaggagtttgtgcacgccaccagcgagggggaggcccctgggggctgtgagggccgcggggcccctgtgtccttccggcctgggggcaggaagagcaggaaggagctgaggaaggagaagaggcacctgaggaaggcccggcggctgcagaggacagctggccctgagcagggccctggcctgggcggccgcagcggggctgaggaggccagcggccaccggcaggacacagaggagcgggcccggcctgcccccagccgggaccccagcccccccaggaagccccggcccagccgggtgaaggccaaggccacagctgccacagccaagacccggcccagcgctgctgccacagctgctgccaggaagagggccctgctggccgccaatgaggaggaggaccgggagatcaggaagctggagcgctgcctgggcctgaacaagaggaagaagaaggatggcagcagctctgtgcccctgagctttgccagagatggcctggactacatcctgggcgccctggagagcggcaagaacagcggcctgtatgacagcagtggagaggaggaggaggatgctggccagaccctgcctgagagtgacctggagagtgacagccaggatgaaagtgaggaggaggaggagggagatgtggagaaggagaagaaggcccaggaggccgaggcccagagtgaagatgatgatgaggacacagaggaggagcagggcgaggagaaggagaagggggcccaggagaagagaagaggcaagagggtgcgctttgctgaagatgaggagaagtctgagaacagcagtgaagatggagacatcacagacaagagcctgtgtggcagcggggagaagtacatccccccccacgtgcggcaggccgaggagaccgtggacttcaagaagaaggaggagctggagcggctgaagaagcacgtgaagggcctgctgaaccggctgtctgagcccaacatggccagcatcagcggccagctggaggagctgtacatggcccacagcaggaaggacatgaatgacaccctgaccagcgccctgatgggcgcctgtgtgacagccagcgccatgcccagccggctgatgatggagcacgtgctgctggtgtccatcctgcaccacacagtgggcatcgaggtgggcgcccacttcctggaggccgtggtgaggaagtttgatgccatctacaagtatggcagcgagggcaaggaatgtgacaacctcttcaccgtgattgcccacctgtacaacttccacgtggtgcagagcctgctgatctttgacatcctgaagaagctgattggcaccttcacagagaaggacatcgagctgatcctgctgatgctgaagaatgtgggcttcagcctgaggaaggatgatgccctgagcctgaaggagctgatcacagaggcccagaccaaggccagcggggccggcagcgagttccaggaccagacccgcatccgcttcatgctggagaccatgctggccctgaagaacaatgacatgaggaagatccctggctatgaccctgagcctgtggagaagctgaggaagctgcagagggccctggtgagaaatgccggcagcggcagcgagacccagctgcgggtgtcctgggacagcgtgctgtctgctgagcagacaggccgctggtggatcgtgggcagcgcctggagcggggcccccatgattgacaacagccaccacacccacctgcagaagcagctggtgggcaccgtgagcagcaagatcctggagctggccaggaagcagaggatgaacacagacatcagaagaaacatcttctgcaccatcatgaccagcgaggacttcctggatgcctttgagaagctgctgaagctgggcctgaaggaccagcaggagcgggagatcatccacgtgctgatggactgctgcctgcaggagaagacctacaaccccttctacgccttcctggccagcaagttctgtgaatatgaaagacgcttccagatgaccttccagttcagcatctgggacaagttccgggacctggagaacctgcctgccaccaacttcagcaacctggtgcacctggtggcccacctgctgaagaccaagagcctgagcctgagcatcctgaaggtggtggagttcagcgagctggacaagccccgggtgcgcttcctgaggaaggtgctgagcatcctgctgatggagacagaggtggaggacctgagcctcatcttcaccagggtgtctgacaaccccaagctgggcgtgctgcgggagggcctgaagctgttcatcagccacttcctgctgaagaatgcccaggcccacaggtctgcagatgaggccaacgtgctgcgggagaaggctgacctggccaccaagtgcctgcagggcaaggccagcctgaggatgtag

SEQ ID NO: 16330 - DNA, 4917 bp, Artificial Sequence
  Description of Artificial Sequence: Synthetic coding sequence
atggctgctgctgctgggggcccctgtgtgcgcagcagccgggagctgtggaccatcctgctgggccgcagcgccctgcgggagctgagccagatcgaggccgagctgaacaagcactggaggcggctgctggagggcctgagctactacaagccacccagccccagcagcgctgagaaggtgaaggccaacaaggatgtggccagccccctgaaggagctgggcctgcgcatcagcaagttcctgggcctggatgaggagcagagcgtgcagctgctgcagtgctacctgcaggaggactaccggggcacccgggacagcgtgaagacagtgctgtactttgagatggcccccagcgacctgctggtgctgaccaagatgttcaaggagcagggcttcggcagccggcagaccaacagacacctggtggatgagaccatggacccctttgtggaccgcatcggctacttcagcgccctgatcctggtggagggcatggacatcgagagcctgcacaagtgtgccctggatgacagaagagagctgcaccagtttgcccaggacggcctcatctgccaggacatggactgcctgatgctgaccttcggggacatcccccaccacgcccctgtgctgctggcctgggccctgctgcggcacaccctgaaccctgaggagaccagctctgtggtgaggaagattggaggaacagccatccagctgaatgtgttccagtacctgacccggctgctgcagagcctggccagcggcggcaatgactgcaccaccagcacagcctgcatgtgtgtgtatggcctgctgagctttgtgctgaccagcctggagctgcacaccctgggcaaccagcaggacatcatcgacacagcctgtgaggtgctggccgaccccagcctgcctgagctgttctggggcacagagcccaccagcggcctgggcatcatcctggacagcgtgtgtggcatgttcccccacctgctgagccccctgctgcagctgctgcgggccctggtgtctgggaagagcacagccaagaaggtgtacagcttcctggacaagatgtccttctacaatgagctgtacaagcacaagccccatgatgtgatcagccatgaagatggcaccctgtggaggcggcagacccccaagctgctgtaccccctgggcggccagaccaacctgcgcatcccccagggcaccgtgggccaggtgatgctggatgaccgggcctacctggtgcgctgggagtacagctacagctcctggaccctcttcacctgtgaaattgagatgctgctgcacgtggtgtccacagcagatgtgatccagcactgccagagggtgaagcccatcatcgacctggtgcacaaggtgatcagcacagacctgagcattgctgactgcctgctgcccatcaccagccgcatctacatgctgctgcagaggctgaccaccgtcatcagcccccctgtggatgtgattgccagctgtgtgaactgcctgactgtgctggccgccagaaatcctgccaaggtgtggacagacctgcggcacacaggcttcctgccctttgtggcccaccctgtgagcagcctgagccagatgatctctgctgagggcatgaatgccggcggctacggcaacctgctgatgaacagcgagcagccccagggcgagtatggagtgaccatcgccttcctgcggctcatcaccaccctggtgaagggccagctgggcagcacccagagccagggcctggtgccctgtgtgatgtttgtgctgaaggagatgctgcccagctaccacaagtggagatacaacagccatggagtgcgggagcagatcggctgcctgatcctggagctgatccacgccatcctgaacctgtgccatgaaacagacctgcacagcagccacacccccagcctgcagttcctgtgcatctgcagcctggcctacacagaggccggccagaccgtcatcaacatcatgggcatcggcgtggacaccatcgacatggtgatggccgcccagcccaggagtgatggagctgagggccagggccagggccagctgctgatcaagacagtgaagctggccttctctgtgaccaacaacgtcatccggctgaagccacccagcaatgtggtgagccccctggagcaggccctgagccagcacggggcccacggcaacaacctgattgctgtgctggccaagtacatctaccacaagcatgaccctgccctgccccggctggccatccagctgctgaagaggctggccaccgtggcccccatgtctgtgtatgcctgcctgggcaatgatgctgctgccatcagagatgccttcctgacccggctgcagagcaagattgaggacatgaggatcaaggtgatgatcctggagttcctgactgtggccgtggagacccagcccggcctcatcgagctgttcctgaacctggaggtgaaggatggcagtgatggcagcaaggagttcagcctgggcatgtggagctgcctgcatgctgtgctggagctgattgacagccagcagcaggaccgctactggtgcccccccctgctgcaccgggccgccatcgccttcctgcacgccctgtggcaggaccggcgggacagcgccatgctggtgctgcggaccaagcccaagttctgggagaacctgaccagccccctgtttggcaccctgagcccccccagcgagaccagcgagcccagcatcctggagacctgtgccctgatcatgaagatcatctgcctggagatctactacgtggtgaagggcagcctggaccagagcctgaaggacaccctgaagaagttcagcattgagaagagatttgcctactggagcggctacgtgaagagcctggccgtgcacgtggccgagacagagggcagcagctgcaccagcctgctggagtaccagatgctggtgtctgcctggaggatgctgctgatcatcgccaccacccatgctgacatcatgcacctgacagattctgtggtgcggcggcagctgttcctggatgtgctggatggcaccaaggccctgctgctggtgcctgcctctgtgaactgcctgcggctgggctccatgaagtgcaccctgctgctgatcctgctgcggcagtggaagcgggagctgggctctgtggatgagatcctgggccccctgacagagatcctggagggcgtgctgcaggccgaccagcagctgatggagaagaccaaggccaaggtgttttctgccttcatcaccgtgctgcagatgaaggagatgaaggtgtctgacatcccccagtacagccagctggtgctgaatgtgtgtgagaccctgcaggaggaggtgattgccctgtttgaccagaccaggcacagcctggccctgggcagcgccacagaggacaaggacagcatggagacagatgactgcagccgcagccgccaccgggaccagagagatggagtgtgtgtgctgggcctgcacctggccaaggagctgtgtgaggtggatgaagatggagacagctggctgcaggtgacccggcggctgcccatcctgcccaccctgctgaccaccctggaggtgtccctgaggatgaagcagaacctgcacttcacagaggccaccctgcacctgctgctgaccctggcccggacccagcagggcgccacagctgtggccggggccggcatcacccagagcatctgcctgcccctgctgtctgtgtaccagctgagcaccaacggcacagcccagaccccatctgccagcaggaagagcctggatgcccccagctggccaggagtgtaccgcctgtccatgagcctgatggagcagctgctgaagaccctgcgctacaacttcctgcctgaggccctggactttgtgggcgtgcaccaggagaggaccctgcagtgcctgaatgctgtgaggacagtgcagagcctggcctgcctggaggaggccgaccacacagtgggcttcatcctgcagctgagcaacttcatgaaggagtggcacttccacctgccccagctgatgagggacatccaggtgaacctgggctacctgtgccaggcctgcaccagcctgctgcacagcaggaagatgctgcagcactacctgcagaacaagaatggagatggcctgcccagcgctgtggcccagagggtgcagaggcctcccagcgctgccagcgctgcccccagcagcagcaagcagcctgctgctgacacagaggccagcgagcagcaggccctgcacacagtgcagtatggcctgctgaagatcctgagcaagaccctggccgccctgcggcacttcaccccagatgtgtgccagatcctgctggaccagagcctggacctggccgagtacaacttcctgtttgccctgtccttcaccacccccacctttgacagcgaggtggcccccagctttggcaccctgctggccaccgtgaatgtggccctgaacatgctgggggagctggacaagaagaaggagcccctgacccaggccgtgggcctgagcacccaggccgagggcaccaggaccctgaagagcctgctgatgttcaccatggagaactgcttctacctgctgatcagccaggccatgagatacctgcgggaccctgctgtgcacccccgggacaagcagaggatgaagcaggagctgagcagcgagctgagcaccctgctgagcagcctgagccgctacttccggcggggggcccccagcagccctgccactggagtgctgcccagcccccagggcaagagcaccagcctgagcaaggccagccctgagagccaggagcccctcatccagctggtgcaggcctttgtgcgccacatgcagaggtag

SEQ ID NO: 16331 - DNA, 5250 bp, Artificial Sequence
  Description of Artificial Sequence: Synthetic coding sequence
atggctgctgctgctgggggcccctgtgtgcgcagcagccgggagctgtggaccatcctgctgggccgcagcgccctgcgggagctgagccagatcgaggccgagctgaacaagcactggaggcggctgctggagggcctgagctactacaagccacccagccccagcagcgctgagaaggtgaaggccaacaaggatgtggccagccccctgaaggagctgggcctgcgcatcagcaagttcctgggcctggatgaggagcagagcgtgcagctgctgcagtgctacctgcaggaggactaccggggcacccgggacagcgtgaagacagtgctgcaggatgagcggcagagccaggccctgatcctgaagattgctgactactactatgaggagaggacctgcatcctgcgctgtgtgctgcacctgctgacctacttccaggatgagcggcacccctacagagtggagtatgctgactgtgtggacaagctggagaaggagctggtgtccaagtaccggcagcagtttgaggagctgtacaagacagaggcccccacctgggagacccacggcaacctgatgacagagcggcaggtgagccgctggtttgtgcagtgcctgcgggagcagagcatgctgctggagatcatcttcctgtactatgcctactttgagatggcccccagcgacctgctggtgctgaccaagatgttcaaggagcagggcttcggcagccggcagaccaacagacacctggtggatgagaccatggacccctttgtggacagaattggctacttcagcgccctgatcctggtggagggcatggacatcgagagcctgcacaagtgtgccctggatgaccggcgggagctgcaccagtttgcccaggacggcctcatctgccaggacatggactgcctgatgctgacctttggagacatcccccaccacgcccctgtgctgctggcctgggccctgctgcggcacaccctgaaccctgaggagaccagctctgtggtgaggaagattggaggaacagccatccagctgaatgtgttccagtacctgacccggctgctgcagagcctggccagcggcggcaatgactgcaccaccagcacagcctgcatgtgtgtgtatggcctgctgagctttgtgctgaccagcctggagctgcacaccctgggcaaccagcaggacatcatcgacacagcctgtgaggtgctggccgaccccagcctgcctgagctgttctggggcacagagcccaccagcggcctgggcatcatcctggacagcgtgtgtggcatgttcccccacctgctgagccccctgctgcagctgctgcgggccctggtgtctgggaagagcacagccaagaaggtgtacagcttcctggacaagatgtccttctacaatgagctgtacaagcacaagccccatgatgtgatcagccatgaagatggcaccctgtggaggcggcagacccccaagctgctgtaccccctgggcggccagaccaacctgcgcatcccccagggcaccgtgggccaggtgatgctggatgaccgggcctacctggtgcgctgggagtacagctacagctcctggaccctcttcacctgtgaaattgagatgctgctgcacgtggtgtccacagcagatgtgatccagcactgccagagggtgaagcccatcatcgacctggtgcacaaggtgatcagcacagacctgagcattgctgactgcctgctgcccatcaccagccgcatctacatgctgctgcagaggctgaccaccgtcatcagcccccctgtggatgtgattgccagctgtgtgaactgcctgactgtgctggccgccaggaacccagccaaggtgtggacagacctgcggcacacaggcttcctgccctttgtggcccaccctgtgagcagcctgagccagatgatctctgctgagggcatgaatgctgggggctacggcaacctgctgatgaacagcgagcagccccagggcgagtatggagtgaccatcgccttcctgcggctcatcaccaccctggtgaagggccagctgggcagcacccagagccagggcctggtgccctgtgtgatgtttgtgctgaaggagatgctgcccagctaccacaagtggagatacaacagccacggcgtgcgggagcagatcggctgcctgatcctggagctgattcatgccatcctgaacctgtgccacgagacagacctgcacagcagccacacccccagcctgcagttcctgtgcatctgcagcctggcctacacagaagctggccagaccgtcatcaacatcatgggcattggagtggacaccatcgacatggtgatggccgcccagcccaggagtgatggagctgagggccagggccagggccagctgctgatcaagacagtgaagctggccttctctgtgaccaacaacgtcatccggctgaagccacccagcaatgtggtgagccccctggagcaggccctgagccagcacggggcccacggcaacaacctgattgctgtgctggccaagtacatctaccacaagcatgaccctgccctgccccggctggccatccagctgctgaagaggctggccaccgtggcccccatgtctgtgtatgcctgcctgggcaatgatgctgctgccatcagagatgccttcctgacccggctgcagagcaagattgaggacatgaggatcaaggtgatgatcctggagttcctgactgtggccgtggagacccagcccggcctgattgagctgttcctgaacctggaggtgaaggatggcagtgatggcagcaaggagttcagcctgggcatgtggagctgcctgcatgctgtgctggagctgattgacagccagcagcaggaccgctactggtgcccccccctgctgcacagagctgccatcgccttcctgcacgccctgtggcaggacagaagagacagcgccatgctggtgctgcggaccaagcccaagttctgggagaacctgaccagccccctgtttggcaccctgagccccccatctgagaccagcgagcccagcatcctggagacctgtgccctgatcatgaagatcatctgcctggagatctactacgtggtgaagggcagcctggaccagagcctgaaggacaccctgaagaagttcagcattgagaagagatttgcctactggagcggctacgtgaagagcctggccgtgcacgtggccgagacagagggcagcagctgcaccagcctgctggagtaccagatgctggtgtctgcctggaggatgctgctgatcatcgccaccacccacgccgacatcatgcacctgacagacagcgtggtgcggcggcagctgttcctggatgtgctggatggcaccaaggccctgctgctggtgcctgcctctgtgaactgcctgcggctgggctccatgaagtgcaccctgctgctgatcctgctgcggcagtggaagcgggagctgggctctgtggatgagatcctgggccccctgacagagatcctggagggcgtgctgcaggccgaccagcagctgatggagaagaccaaggccaaggtgttcagcgccttcatcaccgtgctgcagatgaaggagatgaaggtgtctgacatcccccagtacagccagctggtgctgaatgtgtgtgagaccctgcaggaggaggtgattgccctgtttgaccagaccaggcacagcctggccctgggcagcgccacagaggacaaggacagcatggagacagatgactgcagccgcagccgccaccgggaccagagagatggagtgtgtgtgctgggcctgcacctggccaaggagctgtgtgaggtggatgaagatggagacagctggctgcaggtgacccggcggctgcccatcctgcccaccctgctgaccaccctggaggtgtccctgaggatgaagcagaacctgcacttcacagaggccaccctgcacctgctgctgaccctggcccggacccagcagggcgccacagctgtggccggggccggcatcacccagagcatctgcctgcccctgctgtctgtgtaccagctgagcaccaatggaacagcccagacccccagcgccagcaggaagagcctggatgcccccagctggccaggagtgtaccgcctgtccatgagcctgatggagcagctgctgaagaccctgcgctacaacttcctgcctgaggccctggactttgtgggcgtgcaccaggagaggaccctgcagtgcctgaatgctgtgaggacagtgcagagcctggcctgcctggaggaggccgaccacacagtgggcttcatcctgcagctgagcaacttcatgaaggagtggcacttccacctgccccagctgatgagggacatccaggtgaacctgggctacctgtgccaggcctgcaccagcctgctgcacagcaggaagatgctgcagcactacctgcagaacaagaatggagatggcctgcccagcgctgtggcccagagggtgcagaggcctccttctgctgccagcgctgcccccagcagcagcaagcagcctgctgctgacacagaggccagcgagcagcaggccctgcacacagtgcagtatggcctgctgaagatcctgagcaagaccctggccgccctgcggcacttcaccccagatgtgtgccagatcctgctggaccagagcctggacctggccgagtacaacttcctgtttgccctgtccttcaccacccccacctttgattctgaggtggcccccagctttggcaccctgctggccaccgtgaatgtggccctgaacatgctgggggagctggacaagaagaaggagcccctgacccaggccgtgggcctgagcacccaggccgagggcaccaggaccctgaagagcctgctgatgttcaccatggagaactgcttctacctgctgatcagccaggccatgagatacctgcgggaccctgctgtgcacccccgggacaagcagaggatgaagcaggagctgagcagcgagctgagcaccctgctgagcagcctgagccgctacttcagaagaggagcccccagcagccctgccaccggggtgctgcccagcccccagggcaagagcaccagcctgagcaaggccagccctgagagccaggagcccctcatccagctggtgcaggcctttgtgcgccacatgcagaggtag

SEQ ID NO: 16332 - DNA, 219 bp, Artificial Sequence
  Description of Artificial Sequence: Synthetic coding sequence
atgcagttcaccagcatcagcaacagcctgaccagcacagctgccatcggcctgtccttcaccaccagcaccaccaccacagccaccttcaccaccaacaccaccaccaccatcaccagcggcttcaccgtgaaccagaaccagctgctgagccggggctttgagaacctggtgccctacaccagcacagtgcgctttgtgttctacatggagaagtag

SEQ ID NO: 16333 - DNA, 801 bp, Artificial Sequence
  Description of Artificial Sequence: Synthetic coding sequence
atgcagttcaccagcatcagcaacagcctgaccagcacagctgccatcggcctgtccttcaccaccagcaccaccaccacagccaccttcaccaccaacaccaccaccaccatcaccagcggcttcaccgtgaaccagaaccagctgctgagccggggctttgagaacctggtgccctacaccagcacagtgtctgtggtggccacccctgtgatgacctacggccacctggagggcctcatcaatgagtggaacctggagctggaggaccaggagaagtacttcctgctgcaggccacccaggtgaatgcctgggaccacaccctgattgaaaatggagagatgatccgcatcctgcacggggaggtgaacaaggtgaagctggaccagaagaggctggagcaggagctggacttcatcctgagccagcagcaggagctggagttcctgctgacctacctggaggagagcacccgggaccagagcggcctgcactacctgcaggatgctgatgaggagcacgtggagatctaccgcctggccgagagcattgatgcccagctgaagcagatggcccaggacctgaaggatgtggtgaaccacctgaacacctttgagagcagcagtgacaccacagaccccctgcaccagatctgccgcatcctgaatgcccacatggacagcctgcagtggattgacaggaacagcggcatgctgcggaggaaggtggaggtggtgaccagggtgtttgaggactacagacatgaggagcacgcccacaacgtgaacacagccttctag

SEQ ID NO: 16334 - DNA, 555 bp, Artificial Sequence
  Description of Artificial Sequence: Synthetic coding sequence
atgcagttcaccagcatcagcaacagcctgaccagcacagctgccatcggcctgtccttcaccaccagcaccaccaccacagccaccttcaccaccaacaccaccaccaccatcaccagcggcttcaccgtgaaccagaaccagctgctgagccggggctttgagaacctggtgccctacaccagcacagtgtctgtggtggccacccctgtgatgacctacggccacctggagggcctcatcaatgagtggaacctggagctggaggaccaggagaagtacttcctgctgcaggccacccaggtgaatgcctgggaccacaccctgattgaaaatggagagatgatccgcatcctgcacggggaggtgaacaaggtgaagctggaccagaagaggctggagcaggagctggacttcatcctgagccagcagcaggagctggagttcctgctgacctacctggaggagagcacccgggaccagagcggcctgcactacctgcaggatgctgatgaggagcacgtggagatcagcaccaggtctgctgagttctag

SEQ ID NO: 16335 - DNA, 411 bp, Artificial Sequence
  Description of Artificial Sequence: Synthetic coding sequence
atgcagttcaccagcatcagcaacagcctgaccagcacagctgccatcggcctgtccttcaccaccagcaccaccaccacagccaccttcaccaccaacaccaccaccaccatcaccagcggcttcaccgtgaaccagaaccagctgctgagccggggctttgagaacctggtgccctacaccagcacagtgtctgtggtggccacccctgtgatgacctacggccacctggagggcctcatcaatgagtggaacctggagctggaggaccaggagaagtacttcctgctgcaggccacccaggtgaatgcctgggaccacaccctgattgaaaatggagagatgatccgcatcctgcacggggaggtgaacaaggtgaagctggaccagaagaggctggagcaggagtag

SEQ ID NO: 16336 - DNA, 597 bp, Artificial Sequence
  Description of Artificial Sequence: Synthetic coding sequence
tgacctgtgatgacctacggccacctggagggcctcatcaatgagtggaacctggagctggaggaccaggagaagtacttcctgctgcaggccacccaggtgaatgcctgggaccacaccctgattgaaaatggagagatgatccgcatcctgcacggggaggtgaacaaggtgaagctggaccagaagaggctggagcaggagctggacttcatcctgagccagcagcaggagctggagttcctgctgacctacctggaggagagcacccgggaccagagcggcctgcactacctgcaggatgctgatgaggagcacgtggagatctaccgcctggccgagagcattgatgcccagctgaagcagatggcccaggacctgaaggatgtggtgaaccacctgaacacctttgagagcagcagtgacaccacagaccccctgcaccagatctgccgcatcctgaatgcccacatggacagcctgcagtggattgacaggaacagcggcatgctgcggaggaaggtggaggtggtgaccagggtgtttgaggactacagacatgaggagcacgcccacaacgtgaacacagccttctag

SEQ ID NO: 16337 - DNA, 1383 bp, Artificial Sequence
  Description of Artificial Sequence: Synthetic coding sequence
atggccgagagtgaaaataggaaggagctgtctgagagcagccaggaggaggccggcaaccagatcatggtggagggcctgggggagcacctggagagaggagaagatgctgctgctggcctgggagatgatggaaaatgtggggaggaggccgctgctggcctgggggaggagggggagaatggagaggacacagctgctggcagcggagaagatggcaagaagggcggggacacagatgaagattctgaggccgaccggcccaagggcctcatcggctacgtgctggacacagactttgtggagagcctgcctgtgaaggtgaagtacagagtgctggccctgaagaagctgcagacccgggccgccaacctggagagcaagttcctgcgggagttccatgacatcgagaggaagtttgctgagatgtaccagcccctgctggagaagaggcggcagatcatcaatgccatctatgagcccacagaggaggagtgtgagtacaagagtgacagcgaggactgtgatgatgaggagatgtgccacgaggagatgtatggaaatgaggagggcatggtgcatgaatatgtggatgaagatgatggctatgaggactactactatgactatgctgtggaggaggaggaggaggaggaggaggaggatgacatcgaggccactggagaggagaacaaggaggaggaggaccccaagggcatcccagacttctggctgactgtgctgaagaatgtggacaccctgacccccctcatcaagaagtatgatgagcccatcctgaagctgctgacagacatcaaggtgaagctgagtgaccctggagagcccctgtccttcaccctggagttccacttcaagcccaatgagtacttcaagaatgagctgctgaccaagacctacgtgctgaagagcaagctggcctactatgacccccacccctaccggggcacagccatcgagtacagcacaggctgtgaaattgactggaatgaaggcaagaatgtgaccctgaagaccatcaagaagaagcagaagcaccgcatctggggcaccatcagaacagtgacagaggacttccccaaggacagcttcttcaacttcttcagcccccacggcatcaccagcaatggaagagatggaaatgatgacttcctgctgggccacaacctgcggacctacatcatccccaggtctgtgctcttcttctctggagatgccctggagagccagcaggagggcgtggtgcgggaggtgaatgatgccatctatgacaagatcatctatgacaactggatggccgccatcgaggaggtgaaggcctgctgcaagaacctggaggccctggtggaggacatcgacagatag

SEQ ID NO: 16338 - DNA, 957 bp, Artificial Sequence
  Description of Artificial Sequence: Synthetic coding sequence
atgtaccagcccctgctggagaagaggcggcagatcatcaatgccatctatgagcccacagaggaggagtgtgagtacaagagtgacagcgaggactgtgatgatgaggagatgtgccacgaggagatgtatggaaatgaggagggcatggtgcatgaatatgtggatgaagatgatggctatgaggactactactatgactatgctgtggaggaggaggaggaggaggaggaggaggatgacatcgaggccactggagaggagaacaaggaggaggaggaccccaagggcatcccagacttctggctgactgtgctgaagaatgtggacaccctgacccccctcatcaagaagtatgatgagcccatcctgaagctgctgacagacatcaaggtgaagctgagtgaccctggagagcccctgtccttcaccctggagttccacttcaagcccaatgagtacttcaagaatgagctgctgaccaagacctacgtgctgaagagcaagctggcctactatgacccccacccctaccggggcacagccatcgagtacagcacaggctgtgaaattgactggaatgaaggcaagaatgtgaccctgaagaccatcaagaagaagcagaagcaccgcatctggggcaccatcagaacagtgacagaggacttccccaaggacagcttcttcaacttcttcagcccccacggcatcaccagcaatggaagagatggaaatgatgacttcctgctgggccacaacctgcggacctacatcatccccaggtctgtgctcttcttctctggagatgccctggagagccagcaggagggcgtggtgcgggaggtgaatgatgccatctatgacaagatcatctatgacaactggatggccgccatcgaggaggtgaaggcctgctgcaagaacctggaggccctggtggaggacatcgacagatag

SEQ ID NO: 16339 - DNA, 489 bp, Artificial Sequence
  Description of Artificial Sequence: Synthetic coding sequence
atgctgtttggccgcatccccctgcgctatgccatcctgatgcagatgagatttgatggccgcctgggcttccctgggggctttgtggacacccaggacaggagcctggaggatggcctgaaccgggagctgcgggaggagctgggggaggccgctgctgccttccgggtggagaggacagactaccgcagcagccacgtgggcagcggcccccgggtggtggcccacttctacgccaagaggctgaccctggaggagctgctggccgtggaggccggggccacccgggccaaggaccacggcctggaggtgctgggcctggtgcgggtgcccctgtacaccctgagagatggagtgggcggcctgcccaccttcctggagaacagcttcatcggcagcgcccgggagcagctgctggaggccctgcaggacctgggcctgctgcagagcggcagcatcagcggcctgaagatcccagcccaccactag

SEQ ID NO: 16340 - DNA, 588 bp, Artificial Sequence
  Description of Artificial Sequence: Synthetic coding sequence
atggccggggcccggcggctggagctgggggaggccctggccctgggcagcggctggaggcatgcctgccacgccctgctgtatgccccagaccccggcatgctgtttggccgcatccccctgcgctatgccatcctgatgcagatgagatttgatggccgcctgggcttccctgggggctttgtggacacccaggacaggagcctggaggatggcctgaaccgggagctgcgggaggagctgggggaggccgccgccgccttccgggtggagaggacagactaccgcagcagccacgtgggcagcggcccccgggtggtggcccacttctacgccaagaggctgaccctggaggagctgctggccgtggaggccggggccacccgggccaaggaccacggcctggaggtgctgggcctggtgcgggtgcccctgtacaccctgagagatggagtgggcggcctgcccaccttcctggagaacagcttcatcggcagcgcccgggagcagctgctggaggccctgcaggacctgggcctgctgcagagcggcagcatcagcggcctgaagatcccagcccaccactag

SEQ ID NO: 16341 - DNA, 480 bp, Artificial Sequence
  Description of Artificial Sequence: Synthetic coding sequence
atgcagatgagatttgatggccgcctgggcttccctgggggctttgtggacacccaggacaggagcctggaggatggcctgaaccgggagctgcgggaggagctgggggaggccgccgccgccttccgggtggagaggacagactaccgcagcagccacgtgggcagcggcccccgggtggtggcccacttctacgccaagaggctgaccctggaggagctgctggccgtggaggccggggccacccgggccaaggaccacggcctggaggtgctgggcctggtgcgggtgcccctgtacaccctgagagatggagtgggcggcctgcccaccttcctggagaacagcttcatcggcagcgcccgggagcagctgctggaggccgccctgcacggccccatgaagacagagatgaggaccctggtgctgggccgggagggccgcacctgggagtgcttcctgattggcagcgagaggtag

SEQ ID NO: 16342 - DNA, 684 bp, Artificial Sequence
  Description of Artificial Sequence: Synthetic coding sequence
atggccggggcccggcggctggagctgggggaggccctggccctgggcagcggctggaggcatgcctgccacgccctgctgtatgccccagaccccggcatgctgtttggccgcatccccctgcgctatgccatcctgatgcagatgagatttgatggccgcctgggcttccctgggggctttgtggacacccaggacaggagcctggaggatggcctgaaccgggagctgcgggaggagctgggggaggccgccgccgccttccgggtggagaggacagactaccgcagcagccacgtgggcagcggcccccgggtggtggcccacttctacgccaagaggctgaccctggaggagctgctggccgtggaggccggggccacccgggccaaggaccacggcctggaggtgggccctgcctgggacagcgtgcccttccccatcagcagcagccccaaggccttcagcccccccaggaagcacccctggaggaaggtgtttgcccccctgaccctgcccagcccccagctgtcctggtggagctgggaccgggaccacctgtacagcgagctggtgctgcccacctgggccttctgcaagggcctgagccaccccctgcctggagagatcctgagcaggacccacagctccatgagcctgtgctgcagcctgctgactgtgtag

SEQ ID NO: 16343 - DNA, 768 bp, Artificial Sequence
  Description of Artificial Sequence: Synthetic coding sequence
atgctgcggccccagaggcctggggacctgcagctgggcgccagcctgtatgagctggtgggctaccggcagccccccagcagcagcagcagcagcaccagcagcaccagcagcaccagcagcagcagcaccacagcccccctgctgcccaaggccgcccgggagaagccagaggccccagctgagcccccaggccctggccctggcagcggggcccaccctgggggcagcgcccggccagatgccaaggaggagcagcagcagcagctgcggaggaagatcaacagccgggagaggaagaggatgcaggacctgaacctggccatggatgccctgcgggaggtgatcctgccctacagcgctgcccactgccagggcgcccctggcaggaagctgagcaagatcgccaccctgctgctggccaggaactacatcctgctgctgggcagcagcctgcaggagctgcggcgggccctgggggagggcgccggccctgctgccccccggctgctgctggccggcctgcccctgctggccgccgcccctggctctgtgctgctggcccctggagctgtgggccccccagatgccctgcggcctgccaagtacctgagcctggccctggatgagcccccctgtggccagtttgccctgcccggcggcggggccggcggccctggcctgtgcacctgtgctgtgtgcaagttcccccacctggtgcctgccagcctgggcctggccgctgtgcaggcccagttcagcaagtag

SEQ ID NO: 16344 - DNA, 816 bp, Artificial Sequence
  Description of Artificial Sequence: Synthetic coding sequence
atgtactatgctgtgtcccaggcccgggtgaatgctgtgcccggcaccatgctgcggccccagaggcctggggacctgcagctgggcgccagcctgtatgagctggtgggctaccggcagccccccagcagcagcagcagcagcaccagcagcaccagcagcaccagcagcagcagcaccacagcccccctgctgcccaaggccgcccgggagaagccagaggccccagctgagcccccaggccctggccctggcagcggggcccaccctgggggcagcgcccggccagatgccaaggaggagcagcagcagcagctgcggaggaagatcaacagccgggagaggaagaggatgcaggacctgaacctggccatggatgccctgcgggaggtgatcctgccctacagcgctgcccactgccagggcgcccctggcaggaagctgagcaagatcgccaccctgctgctggccaggaactacatcctgctgctgggcagcagcctgcaggagctgcggcgggccctgggggagggcgccggccctgctgccccccggctgctgctggccggcctgcccctgctggccgccgcccctggctctgtgctgctggcccctggagctgtgggccccccagatgccctgcggcctgccaagtacctgagcctggccctggatgagcccccctgtggccagtttgccctgcccggcggcggggccggcggccctggcctgtgcacctgtgctgtgtgcaagttcccccacctggtgcctgccagcctgggcctggccgctgtgcaggcccagttcagcaagtag

SEQ ID NO: 16345 - DNA, 99 bp, Artificial Sequence
  Description of Artificial Sequence: Synthetic coding sequence
tgaggacctggcctgtgcacctgtgctgtgtgcaagttcccccacctggtgcctgccagcctgggcctggccgctgtgcaggcccagttcagcaagtag

SEQ ID NO: 16346 - DNA, 1485 bp, Artificial Sequence
  Description of Artificial Sequence: Synthetic coding sequence
atggagctgagcctggagagcctgggcggcctgcacagcgtggcccacgcccaggccggggagctgctgagccctggccacgcccggtctgctgctgcccagcaccggggcctggtggcccctggccggcccggcctggtggccggcatggccagcctgctggatggcggcggcggcggcggcggcggcggggccggcggggccggcggggccggcagcgctgggggcggcgctgacttccggggggagctggccggccccctgcacccagccatgggcatggcctgtgaggcccctggcctgggcggcacctacaccaccctgacccccctgcagcacctgccccccctggccgctgtggccgacaagttccaccagcacgccgctgctgctgctgtggccggggcccatggaggccacccccacgcccacccccaccctgctgctgcccctcctcctcctcctccaccccagaggctggccgcctctgtgtctggcagcttcaccctgatgagagatgagcgggccgccctggcctctgtgggccacctgtatggcccctacggcaaggagctgcctgccatgggcagccccctgagccccctgcccaatgccctgcccccagccctgcatggagccccccagcccccacctcctcctcctcctccacccctggccgcctacggccccccaggccacctggccggggacaagctgctgcccccagctgcctttgagccccatgctgccctgctgggccgggcagaagatgccctggcccggggcctgcccggcggcggcggcggcaccggcagcggcggggccggcagcggcagcgctgctggcctgctggcccccctgggcggcctggccgctgctggggcccacggcccccatggaggcggcggcggccctgggggcagcggcggcggccccagcgctggagctgctgctgaggagatcaacaccaaggaggtggcccagaggatcacagctgagctgaagcgctacagcatcccccaggccatctttgcccagaggatcctgtgccgcagccagggcaccctgagtgacctgctgaggaaccccaagccctggagcaagctgaagagcggccgggagaccttccggaggatgtggaagtggctgcaggagcctgagttccagaggatgtctgccctgcggctggccgcctgcaagaggaaggagcaggagcagcagaaggagcgggccctgcagcccaagaagcagaggctggtgttcacagacctgcagaggaggaccctcatcgccatcttcaaggagaacaagaggcccagcaaggagatgcaggtgaccatcagccagcagctgggcctggagctgaacacagtgagcaacttcttcatgaatgcccggcggcgctgcatgaaccgctgggccgaggagcccagcacagcccctgggggccctgctggggccacagccaccttcagcaaggcctag

SEQ ID NO: 16347 - DNA, 2922 bp, Artificial Sequence
  Description of Artificial Sequence: Synthetic coding sequence
atggccagcatcctggatgaatatgagaacagcctgagccgctctgctgtgctgcagcccggctgccccagcgtgggcatcccccacagcggctacgtgaatgcccagctggagaaggaggtgcccatcttcaccaagcagagaattgacttcacccccagcgagcgcatcaccagcctggtggtgagcagcaaccagctgtgcatgagcctgggcaaggacaccctgctgagaattgacctgggcaaggccaatgagcccaaccacgtggagctgggcaggaaggatgatgccaaggtgcacaagatgttcctggaccacacaggcagccacctgctgattgccctgagcagcacagaggtgctgtatgtgaacagaaatggccagaaggtgcggcccctggcccgctggaagggccagctggtggagagcgtgggctggaacaaggccctgggcacagagagcagcacaggccccatcctggtgggcacagcccagggccacatctttgaggccgagctgagcgccagcgagggcggcctgtttggacctgccccagacctgtacttccggcccctgtatgtgctgaatgaggagggcggccctgcccctgtgtgcagcctggaggccgagcggggcccagatggccgcagctttgtgattgccaccacccggcagaggctcttccagttcatcggccgggctgctgagggcgctgaggcccagggcttcagcggcctgtttgctgcctacacagaccaccccccacccttccgggagttccccagcaacctgggctacagcgagctggccttctacacccccaagctgcggagcgccccccgggcctttgcctggatgatgggagatggagtgctgtatggagccctggactgtggccgcccagacagcctgctgtctgaggagcgggtgtgggagtacccagagggcgtgggccctggggccagcccccccctggccatcgtgctgacccagttccacttcctgctgctgctggccgacagagtggaggccgtgtgcaccctgaccggccaggtggtgctgcgggaccacttcctggagaagtttggccccctgaagcacatggtgaaggacagcagcacaggccagctgtgggcctacacagaaagagctgtgttccgctaccacgtgcagcgggaggccagagatgtgtggaggacctacctggacatgaacagatttgacctggccaaggagtactgccgggagaggccagactgcctggacacagtgctggcccgggaggccgacttctgcttccggcagaggcgctacctggagagcgcccgctgctacgccctgacccagagctactttgaggagatcgccctgaagttcctggaggcccggcaggaggaggccctggccgagttcctgcagaggaagctggccagcctgaagccagctgagaggacccaggccaccctgctgaccacctggctgacagagctgtacctgagccggctgggcgccctgcagggcgaccctgaggccctgaccctgtaccgggagaccaaggagtgcttccgcaccttcctgagcagccccaggcacaaggagtggctgtttgccagccgggccagcatccacgagctgctggccagccacggggacacagagcacatggtgtactttgctgtgatcatgcaggactatgaaagagtggtggcctaccactgccagcacgaggcctatgaggaggccctggccgtgctggcccggcaccgggacccccagctgttctacaagttcagccccatcctgatccgccacatcccccggcagctggtggatgcctggattgagatgggcagccggctggatgcccggcagctgatcccagccctggtgaactacagccagggcggggaggtgcagcaggtgtcccaggccatccgctacatggagttctgtgtgaatgtgctgggggagacagagcaggccatccacaactacctgctgagcctgtatgcccggggccgcccagacagcctgctggcctacctggagcaggccggggccagcccccaccgggtgcactatgacctgaagtatgccctgcggctgtgtgccgagcacggccaccaccgggcctgtgtgcacgtgtacaaggtgctggagctgtatgaggaggccgtggacctggccctgcaggtggatgtggacctggccaagcagtgtgccgacctgcctgaagaagatgaggagctgaggaagaagctgtggctgaagatcgcccggcacgtggtgcaggaggaggaggatgtgcagacagccatggcctgcctggccagctgccccctgctgaagattgaagatgtgctgcccttcttcccagactttgtgaccatcgaccacttcaaggaggccatctgcagcagcctgaaggcctacaaccaccacatccaggagctgcagcgggagatggaggaggccacagccagcgcccagaggatccggcgggacctgcaggagctgcggggccgctatggcaccgtggagccccaggacaagtgtgccacctgtgacttccccctgctgaaccggcccttctacctgttcctgtgtggccacatgtttcatgctgactgcctgctgcaggccgtgcggcccggcctgcctgcctacaagcaggcccggctggaggagctgcagaggaagctgggcgccgcccctcctccagccaagggcagcgcccgggccaaggaggccgagggcggggccgccacagctggccccagccgggagcagctgaaggctgacctggatgagctggtggccgcagaatgtgtgtactgtggggagctgatgatccgcagcattgaccggcccttcatcgacccccagagatatgaggaggagcagctgtcctggctgtag

SEQ ID NO: 16348 - DNA, 828 bp, Artificial Sequence
  Description of Artificial Sequence: Synthetic coding sequence
atgcccaaggtgttcctggtgaagagaagaagcctgggcgtgtctgtgcgctcctgggatgagctgcctgatgagaagagagctgacacctacatccctgtgggcctgggccgcctgctgcatgaccccccagaggactgccgcagtgatggcggcagcagcagcggcagcggcagcagcagcgctggggagcctggaggagctgagagcagcagcagcccccacgcccctgagagcgagaccccagagcctggagatgctgagggcccagatggccacctggccaccaagcagaggcctgtggcccggagcaagatcaagttcaccaccggcacctgcagcgacagcgtggtgcacagctgtgacctgtgtgggaagggcttccggctgcagaggatgctgaacagacacctgaagtgccacaaccaggtgaagaggcacctgtgcaccttctgtgggaagggcttcaatgacacctttgacctgaagagacatgtgaggacccacacaggcatccggccctacaagtgcaatgtgtgcaacaaggccttcacccagcgctgcagcctggagagccacctgaagaagatccacggcgtgcagcagcagtatgcctacaagcagaggcgggacaagctgtatgtgtgtgaggactgtggctacacaggccccacccaggaggacctgtacctgcacgtgaacagcgcccaccctggcagcagcttcctgaagaagaccagcaagaagctggccgccctgctgcagggcaagctgaccagcgcccaccaggagaacaccagcctgtctgaggaggaggagaggaagtag

SEQ ID NO: 16349 - DNA, 1269 bp, Artificial Sequence
  Description of Artificial Sequence: Synthetic coding sequence
atgcagaacagccacagcggcgtgaaccagctgggcggcgtgtttgtgaatggccggcccctgcctgacagcacccggcagaagatcgtggagctggcccacagcggggcccggccctgtgacatcagccgcatcctgcaggtgtccaatggctgtgtgtccaagatcctgggccgctactatgaaacaggcagcatccggccccgggccatcggcggcagcaagccccgggtggccaccccagaggtggtgtccaagatcgcccagtacaagagagaatgtcccagcatctttgcctgggagatccgggaccggctgctgtctgagggcgtgtgcaccaatgacaacatccccagcgtgagcagcatcaacagagtgctgaggaacctggccagcgagaagcagcagatgggcgcagatggcatgtatgacaagctgaggatgctgaatggccagacaggctcctggggcacccggcccggctggtacccaggcacctctgtgcccggccagcccacccaggacggctgccagcagcaggagggcggcggggagaacaccaacagcatcagcagcaatggagaagattctgatgaggcccagatgaggctgcagctgaagaggaagctgcagaggaacagaaccagcttcacccaggagcagatcgaggccctggagaaggagtttgagaggacccactacccagatgtgtttgcccgggagcggctggccgccaagattgacctgcctgaggcccgcatccaggtgtggttcagcaacagaagagccaagtggaggcgggaggagaagctgaggaaccagaggcggcaggccagcaacacccccagccacatccccatcagcagcagcttcagcacctctgtgtaccagcccatcccccagcccaccacccctgtgagcagcttcaccagcggctccatgctgggccgcacagacacagccctgaccaacacctacagcgccctgccccccatgcccagcttcaccatggccaacaacctgcccatgcagccccctgtgcccagccagaccagcagctacagctgcatgctgcccaccagccccagcgtgaatggccgctcctatgacacctacaccccaccccacatgcagacccacatgaacagccagcccatgggcaccagcggcaccaccagcacaggcctcatcagccctggggtgtctgtgcctgtgcaggtgcccggcagcgagccagacatgagccagtactggccccggctgcagtag

SEQ ID NO: 16350 - DNA, 1311 bp, Artificial Sequence
  Description of Artificial Sequence: Synthetic coding sequence
atgcagaacagccacagcggcgtgaaccagctgggcggcgtgtttgtgaatggccggcccctgcctgacagcacccggcagaagatcgtggagctggcccacagcggggcccggccctgtgacatcagccgcatcctgcagacccatgctgatgccaaggtgcaggtgctggacaaccagaatgtgtccaatggctgtgtgtccaagatcctgggccgctactatgaaacaggcagcatccggccccgggccatcggcggcagcaagccccgggtggccaccccagaggtggtgtccaagatcgcccagtacaagagagaatgtcccagcatctttgcctgggagatccgggaccggctgctgtctgagggcgtgtgcaccaatgacaacatccccagcgtgagcagcatcaacagagtgctgaggaacctggccagcgagaagcagcagatgggcgcagatggcatgtatgacaagctgaggatgctgaatggccagacaggctcctggggcacccggcccggctggtacccaggcacctctgtgcccggccagcccacccaggacggctgccagcagcaggagggcggcggggagaacaccaacagcatcagcagcaatggagaagattctgatgaggcccagatgaggctgcagctgaagaggaagctgcagaggaacagaaccagcttcacccaggagcagatcgaggccctggagaaggagtttgagaggacccactacccagatgtgtttgcccgggagcggctggccgccaagattgacctgcctgaggcccgcatccaggtgtggttcagcaacagaagagccaagtggaggcgggaggagaagctgaggaaccagaggcggcaggccagcaacacccccagccacatccccatcagcagcagcttcagcacctctgtgtaccagcccatcccccagcccaccacccctgtgagcagcttcaccagcggctccatgctgggccgcacagacacagccctgaccaacacctacagcgccctgccccccatgcccagcttcaccatggccaacaacctgcccatgcagccccctgtgcccagccagaccagcagctacagctgcatgctgcccaccagccccagcgtgaatggccgctcctatgacacctacaccccaccccacatgcagacccacatgaacagccagcccatgggcaccagcggcaccaccagcacaggcctcatcagccctggggtgtctgtgcctgtgcaggtgcccggcagcgagccagacatgagccagtactggccccggctgcagtag

SEQ ID NO: 16351 - DNA, 1269 bp, Artificial Sequence; identical to SEQ ID NO: 16349
  Description of Artificial Sequence: Synthetic coding sequence

SEQ ID NO: 16352 - DNA, 1269 bp, Artificial Sequence; identical to SEQ ID NO: 16349
  Description of Artificial Sequence: Synthetic coding sequence

SEQ ID NO: 16353 - DNA, 1311 bp, Artificial Sequence; identical to SEQ ID NO: 16350
  Description of Artificial Sequence: Synthetic coding sequence

SEQ ID NO: 16354 - DNA, 1269 bp, Artificial Sequence; identical to SEQ ID NO: 16349
  Description of Artificial Sequence: Synthetic coding sequence

SEQ ID NO: 16355 - DNA, 1311 bp, Artificial Sequence; identical to SEQ ID NO: 16350
  Description of Artificial Sequence: Synthetic coding sequence

SEQ ID NO: 16356 - DNA, 1269 bp, Artificial Sequence; identical to SEQ ID NO: 16349
  Description of Artificial Sequence: Synthetic coding sequence

SEQ ID NO: 16357 - DNA, 1311 bp, Artificial Sequence; identical to SEQ ID NO: 16350
  Description of Artificial Sequence: Synthetic coding sequence

SEQ ID NO: 16358 - DNA, 201 bp, Artificial Sequence
  Description of Artificial Sequence: Synthetic coding sequence
atgcagaacagccacagcggcgtgaaccagctgggcggcgtgtttgtgaatggccggcccctgcctgacagcacccggcagaagatcgtggagctggcccacagcggggcccggccctgtgacatcagccgcatcctgcagacccatgctgatgccaaggtgcaggtgctggacaaccagaatgtgtccaatggctgctag

SEQ ID NO: 16359 - DNA, 120 bp, Artificial Sequence
  Description of Artificial Sequence: Synthetic coding sequence
atgcagaacagccacagcggcgtgaaccagctgggcggcgtgtttgtgaatggccggcccctgcctgacagcacccggcagaagatcgtggagctggcccacagcggggcccggccctag

SEQ ID NO: 16360 - DNA, 375 bp, Artificial Sequence
  Description of Artificial Sequence: Synthetic coding sequence
atgcagaacagccacagcggcgtgaaccagctgggcggcgtgtttgtgaatggccggcccctgcctgacagcacccggcagaagatcgtggagctggcccacagcggggcccggccctgtgacatcagccgcatcctgcagacccatgctgatgccaaggtgcaggtgctggacaaccagaatgtgtccaatggctgtgtgagcagcatcaacagagtgctgaggaacctggccagcgagaagcagcagatgggcgcagatggcatgtatgacaagctgaggatgctgaatggccagacaggctcctggggcaccaggcctggctggtacccaggcacctctgtgcccggccagcccacccaggacggctgctag

SEQ ID NO: 16361 - DNA, 177 bp, Artificial Sequence
  Description of Artificial Sequence: Synthetic coding sequence
atgcagaacagccacagcggcgtgaaccagctgggcggcgtgtttgtgaatggccggcccctgcctgacagcacccggcagaagatcgtggagctggcccacagcggggcccggccctgtgacatcagccgcatcctgcaggtgtccaatggctgtgtgtccaagatcctgggctag

SEQ ID NO: 16362 - DNA, 9 bp, Artificial Sequence
  Description of Artificial Sequence: Synthetic coding sequence
atgcagtag

SEQ ID NO: 16363 - DNA, 1134 bp, Artificial Sequence
  Description of Artificial Sequence: Synthetic coding sequence
atgcaggtgtccaatggctgtgtgtccaagatcctgggccgctactatgagaccggcagcatccggccccgggccatcggcggcagcaagccccgggtggccaccccagaggtggtgtccaagatcgcccagtacaagcgggagtgccccagcatctttgcctgggagatccgggaccggctgctgtctgaaggagtgtgcaccaatgacaacatccccagcgtgagcagcatcaacagagtgctgaggaacctggccagcgagaagcagcagatgggcgcagatggcatgtatgacaagctgaggatgctgaatggccagacaggctcctggggcaccaggcctggctggtacccaggcacctctgtgcccggccagcccacccaggacggctgccagcagcaggagggcggcggggagaacaccaacagcatcagcagcaatggagaggacagtgatgaggcccagatgaggctgcagctgaagaggaagctgcagaggaacagaaccagcttcacccaggagcagatcgaggccctggagaaggagtttgagaggacccactacccagatgtgtttgcccgggagcggctggccgccaagattgacctgcctgaggcccgcatccaggtgtggttcagcaacagaagagccaagtggaggcgggaggagaagctgaggaaccagaggcggcaggccagcaacacccccagccacatccccatcagcagcagcttcagcacctctgtgtaccagcccatcccccagcccaccacccctgtgtcctccttcaccagcggctccatgctgggccgcacagacacagccctgaccaacacctacagcgccctgccccccatgcccagcttcaccatggccaacaacctgcccatgcagccccctgtgcccagccagaccagcagctacagctgcatgctgcccaccagccccagcgtgaatggccgctcctatgacacctacaccccaccccacatgcagacccacatgaacagccagcccatgggcaccagcggcaccaccagcacaggcctcatcagccctggggtgtctgtgcctgtgcaggtgcccggcagcgagccagacatgagccagtactggccccggctgcagtag

SEQ ID NO: 16364 - DNA, 1389 bp, Artificial Sequence
  Description of Artificial Sequence: Synthetic coding sequence
atgagctctgtgaagaggagcctgaagcaggagatcgtgacccagttccactgcagcgctgctgagggggacatcgccaagctgaccggcatcctgagccacagccccagcctgctgaatgagaccagtgaaaatggctggacagccctgatgtatgctgccagaaatggccaccctgagatcgtgcagttcctgctggagaagggctgtgacaggagcatcgtgaacaagagccggcagacagccctggacattgctgtgttctggggctacaagcacatcgccaacctgctggccacagccaagggcggcaagaagccctggttcctgaccaatgaggtggaggagtgtgagaactacttcagcaagaccctgctggacaggaagtctgagaagaggaacaacagcgactggctgctggccaaggagagccacccagccaccgtcttcatcctcttcagtgacctgaaccccctggtgaccctgggcggcaacaaggagagcttccagcagcctgaggtgcggctgtgccagctgaactacacagacatcaaggactacctggcccagcctgagaagatcaccctcatcttcctgggcgtggagctggagatcaaggacaagctgctgaactatgctggggaggtgccccgggaggaggaggatggcctggtggcctggtttgccctgggcatcgaccccatcgctgctgaggagttcaagcagagacatgagaactgctacttcctgcacccccccatgcctgccctgctgcagctgaaggagaaggaggccggcgtggtggcccaggcccggtctgtgctggcctggcacagccgctacaagttctgccccacctgtggaaatgccaccaagattgaggagggcggctacaagaggctgtgcctgaaggaggactgccccagcctgaatggagtgcacaacaccagctacccccgggtggaccctgtggtgatcatgcaggtgatccacccagatggcaccaagtgcctgctgggccggcagaagcgcttccccccaggcatgttcacctgcctggccggcttcatcgagcctggagagaccattgaagatgctgtgcggcgggaggtggaggaggagagcggcgtgaaggtgggccacgtgcagtatgtggcctgccagccctggcccatgcccagcagcctgatgattggctgcctggccctggccgtgtccacagagatcaaggtggacaagaatgaaattgaagatgcccgctggttcacccgggagcaggtgctggatgtgctgaccaagggcaagcagcaggccttctttgtgccccccagccgggccatcgcccaccagctgatcaagcactggatccgcatcaaccccaacctgtag

SEQ ID NO: 16365 - DNA, 84 bp, Artificial Sequence
  Description of Artificial Sequence: Synthetic coding sequence
atgagcccctgcccagaggaggccgccatgagaagagaggtggtgaagagaattgagaccgtggtgaaggacctgtggccctag

SEQ ID NO: 16366 - DNA, 1095 bp, Artificial Sequence
  Description of Artificial Sequence: Synthetic coding sequence
atggccctggccctgctggaggactggtgccgcatcatgtctgtggatgagcagaagagcctgatggtgacaggcatcccagctgactttgaggaggccgagatccaggaggtgctgcaggagaccctgaagagcctgggccgctaccgcctgctgggcaagatcttcaggaagcaggagaatgccaatgctgtgctgctggagctgctggaggacacagatgtgtctgccatccccagcgaggtgcagggcaaaggaggagtgtggaaggtgatcttcaagacccccaaccaggacacagagttcctggagcggctgaacctcttcctggagaaggagggccagacagtgtctggcatgttccgggccctgggccaggagggcgtgtccccagccaccgtgccctgcatcagccctgagctgctggcccacctgctgggccaggccatggcccacgccccccagcccctgctgcccatgagatacaggaagctgcgggtcttcagcggcagcgctgtgcctgcccctgaggaggagagctttgaggtgtggctggagcaggccacagaaattgtgaaggagtggcctgtgacagaggccgagaagaagcgctggctggccgagagcctgcggggccctgccctggacctgatgcacatcgtgcaggccgacaaccccagcatctctgtggaggagtgcctggaggccttcaagcaggtgtttggcagcctggagagcagaagaacagcccaggtgcgctacctgaagacctaccaggaggagggggagaaggtgtctgcctacgtgctgcggctggagaccctgctgcggcgggctgtggagaagagggccatccccaggagaattgctgaccaggtgcggctggagcaggtgatggccggggccaccctgaaccagatgctgtggtgccgcctgcgggagctgaaggaccagggccccccacccagcttcctggagctgatgaaggtgatccgggaggaggaggaggaggaggccagctttgaaaatgaaagcattgaggagcctgaggagagagatggctacggccgctggaaccacgagggagatgactag

SEQ ID NO: 16367 - DNA, 1392 bp, Artificial Sequence
  Description of Artificial Sequence: Synthetic coding sequence
atgcccctgaccctgctgcaggactggtgccgcggggagcacctgaacacccggcgctgcatgctgatcctgggcatccctgaggactgtggggaggatgaatttgaggagaccctgcaggaggcctgccgccacctgggccgctacagagtcatcggccgcatgttcagaagagaggagaatgcccaggccatcctgctggagctggcccaggacattgattatgccctgctgccccgggagatccctggaaaaggaggcccctgggaggtgattgtgaagcccaggaacagtgatggagagttcctgaaccggctgaaccgcttcctggaggaggagaggagaacagtgtctgacatgaacagagtgctgggcagtgacaccaactgcagcgccccccgggtgaccatcagccctgagttctggacctgggcccagaccctgggcgctgctgtgcagcccctgctggagcagatgctgtaccgggagctgcgggtcttcagcggcaacaccatcagcatccctggggccctggcctttgatgcctggctggagcacaccacagagatgctgcagatgtggcaggtgcctgagggggagaagagaagaaggctgatggagtgcctgcggggccctgccctgcaggtggtgtctggcctgcgggccagcaatgccagcatcaccgtggaggagtgcctggccgccctgcagcaggtgtttggacctgtggagagccacaagatcgcccaggtgaagctgtgcaaggcctaccaggaggccggggagaaggtgagcagctttgtgctgcggctggagcccctgctgcagagagctgtggagaacaacgtggtgtccagaagaaatgtgaaccagacccggctgaagagggtgctgagcggggccaccctgcctgacaagctgcgggacaagctgaagctgatgaagcagaggaggaagcccccaggcttcctggccctggtgaagctgctgcgggaggaggaggagtgggaggccaccctgggccctgaccgggagagcctggagggcctggaggtggccccccggcccccagcccgcatcactggagtgggcgctgtgcccctgcctgccagcggcaacagctttgatgtgcggcccagccagggctacagaagaagaagaggccggggccagcacagaagaggaggagtggcccgggccggcagccggggcagcaggaagaggaagaggcacaccttctgctacagctgtggagaagatggccacatccgggtgcagtgcatcaaccccagcaacctgctgctggtgaagcagaagaagcaggccgctgtggagagcggaaatggaaactgggcctgggacaagagccaccccaagagcaaggccaagtag

SEQ ID NO: 16368 - DNA, 1392 bp, Artificial Sequence; identical to SEQ ID NO: 16367
  Description of Artificial Sequence: Synthetic coding sequence

SEQ ID NO: 16369 - DNA, 1392 bp, Artificial Sequence; identical to SEQ ID NO: 16367
  Description of Artificial Sequence: Synthetic coding sequence

SEQ ID NO: 16370 - DNA, 759 bp, Artificial Sequence
  Description of Artificial Sequence: Synthetic coding sequence
atggagagcgagatggagacccagagcgcccgggcagaggagggcttcacccaggtgaccaggaagggcggcagaagagccaagaagaggcaggccgagcagctgtctgctgctggggagggcggagatgctggccgcatggacacagaggaggcccggcctgccaagaggcctgtgtttcctcccctgtgtggagatggcctgctgagcggcaaggaggagaccaggaagatccctgtgcctgccaaccgctacacccccctgaaggagaactggatgaagatcttcacccccatcgtggagcacctgggcctgcagatccgcttcaacctgaagagcagaaatgtggagatccgcacctgcaaggagaccaaggatgtgtctgccctgaccaaggctgctgactttgtgaaggccttcatcctgggcttccaggtggaggatgccctggccctgatccggctggatgacctcttcctggagagctttgagatcacagatgtgaagcccctgaagggggaccacctgagccgggccatcggcagaattgctgggaagggcggcaagaccaagttcaccattgaaaatgtgaccaggacccgcatcgtgctggctgatgtgaaggtgcacatcctgggcagcttccagaacatcaagatggccaggacagccatctgcaacctgatcctgggcaacccccccagcaaggtgtatggcaacatccgggctgtggccagccgctctgctgaccgcttctag

SEQ ID NO: 16371 - DNA, 2322 bp, Artificial Sequence
  Description of Artificial Sequence: Synthetic coding sequence
atgaagatgagaggagagaagaggcgggacaaggtgaaccccaagagcagccagaggaagctgaactggatccccagcttccccacctatgactacttcaaccaggtgaccctgcagctgctggatggcttcatgatcaccctgagcacagatggagtcatcatctgtgtggccgagaacatcagcagcctgctgggccacctgcctgctgagatcgtgggcaagaagctgctgagcctgctgcctgatgaggagaaggatgaggtgtaccagaagatcatcctgaagttccccctgctgaacagcgagacccacatcgagttctgctgccacctgaagagaggaaatgtggagcacggggacagcagcgcctatgaaaatgtgaagttcatcgtgaatgtgcgggacatctgcaatgagttccctgtggtgttcagcggcctcttcagcagccacctgtgtgccgactttgctgcctgtgtgccccaggaggaccggctgtacctggtgggcaatgtgtgcatcctgcggacccagctgctgcagcagctgtacaccagcaaggctgtgtctgatgaggccgtgctgacccaggacagtgatgaggagccctttgtgggggagctgagcagcagccagggccagaggggccacacctccatgaaggctgtgtatgtggagcctgctgctgctgctgctgctgctgccatcagtgatgaccagattgatattgctgaggtggagcagtatggcccccaggagaatgtgcacatgtttgtggacagcgacagcacctactgcagcagcaccgtcttcctggacaccatgcctgagagccctgccctgagcctgcaggacttccggggggagcctgaggtgaaccccctgtacagagctgaccctgtggacctggagttctctgtggaccaggtggacagcgtggaccaggagggccccatggaccagcaggaccctgagaaccctgtggcccccctggaccaggccggcctgatggaccctgtggaccctgaggacagcgtggacctgggcgccgccggggccagcgcccagcccctgcagcccagcagccctgtggcctatgacatcatcagccaggagctggagctgatgaagaagctgaaggagcagctggaggagaggacctggctgctgcatgatgccatccagaaccagcagaatgccctggagctgatgatggaccacctgcagaagcagcccaacaccctgcggcacgtggtgatcccagacctgcagagcagcgaggccgtgcccaagaagcagcagaagcagcacgccggccaggtgaagaggcccctgccccaccccaaggatgtgaagtgcttctgtggcctgagcctgagcaacagcctgaagaacacaggagagctgcaggagccctgtgtggccttcaaccagcagcagctggtgcagcaggagcagcacctgaaggagcagcagaggcagctgcgggagcagctgcagcagctgcgggagcagaggaaggtgcagaagcagaagaagatgcaggagaagaagaagctgcaggagcagaagatgcaggagaagaagaagctgcaggagcagaggcggcagaagaagaagaagctgcaggagaggaagaagtggcagggccagatgctgcagaaggagcctgaggaggagcagcagaagcagcagctgcaggagcagcccctgaagcacaacgtgattgtgggcaatgaaagagtgcagatctgcctgcagaaccccagagatgtgtctgtgcccctgtgcaaccaccctgtgcgcttcctgcaggcccagcccatcgtgcctgtgcagagagctgctgagcagcagcccagcggcttctaccaggatgagaactgtggccagcaggaggatgagagccagagcttctacccagaggcctaccagggcccccctgtgaaccagctgcccctgattgacaccagcaacagcgaggccatcagcagcagcagcatcccccagttccccatcaccagtgacagcaccatcagcaccctggagaccccccaggactacatccggctgtggcaggagctgagtgacagcctgggccctgtggtgcaggtgaacacctggagctgtgatgagcagggcaccctgcacggccagcccacctaccaccaggtgcaggtgtctgaggtgggcgtggagggccccccagacccccaggccttccagggccctgctgcctaccagcctgaccagatgaggtctgctgagcagacccggctgatgcctgctgagcagagggacagcaacaagccctgctag

SEQ ID NO: 16372 - DNA, 3069 bp, Artificial Sequence
  Description of Artificial Sequence: Synthetic coding sequence
atgttccgggaggtgaagtactatgctgtgggggacatcgacccccaggtgatccagctgctgaaggccggcaaggccaaggaggtgtcctacaatgccctggccagccacatcatcagtgaagatggagacaaccctgaggtgggggaggcccgggaggtgtttgacctgcctgtggtgaaggtgtccagtgaagatagaagtgccctgtgggccctggtgaccttctatggaggagactgccagctgaccctgaacaagaagtgcacccacctgattgtgcctgagcccaagggggagaagtatgaatgtgccctgaagagggccagcatcaagatcgtgaccccagactgggtgctggactgtgtgtctgagaagaccaagaaggatgaggccttctaccaccccaggctcatcatctatgaggaggaggaggaggaggaggaggaggaggaggaggtggagaatgaggagcaggacagccagaatgaaggcagcacagatgagaagagcagccctgccagcagccaggagggcagccccagcggggaccagcagttcagccccaagagcaacacagagaagagcaaaggagagctgatgtttgatgacagcagtgacagcagccctgagaagcaggagaggaacctgaactggaccccagctgaggtgccccagctggccgccgccaagaggcggctgccccagggcaaggagcccggcctcatcaacctgtgtgccaacgtgccccctgtgcccggcaacatcctgcccccagaggtgcggggcaacctgatggccgccggccagaacctgcagagcagcgagaggtctgagatgattgccacctggagccctgctgtgaggaccctgaggaacatcaccaacaatgctgacatccagcagatgaaccggcccagcaatgtggcccacatcctgcagaccctgagcgcccccaccaagaacctggagcagcaggtgaaccacagccagcagggccacaccaatgccaatgctgtgctcttcagccaggtgaaggtgaccccagagacccacatgctgcagcagcagcagcaggcccagcagcagcagcagcagcaccctgtgctgcacctgcagccccagcagatcatgcagctgcagcagcagcagcagcagcagatcagccagcagccctacccccagcagcccccccaccccttcagccagcagcagcagcagcagcagcaggcccacccccaccagttcagccagcagcagctgcagttcccccagcagcagctgcaccccccccagcagctgcaccggccccagcagcagctgcagcccttccagcagcagcacgccctgcagcagcagttccaccagctgcagcagcaccagctgcagcagcagcagctggcccagctgcagcagcagcacagcctgctgcagcagcagcagcagcagcagatccagcagcagcagctgcagaggatgcaccagcagcagcagcagcagcagatgcagagccagacagccccccacctgagccagaccagccaggccctgcagcaccaggtgcccccccagcagcccccccagcagcagcagcagcagcagcccccacccagcccccagcagcaccagctgtttggacatgaccctgctgtggagatccctgaggagggcttcctgctgggctgtgtgtttgccatcgctgactacccagagcagatgtctgacaagcagctgctggccacctggaagaggatcatccaggcccatggaggcaccgtggaccccaccttcaccagccgctgcacccacctgctgtgtgagagccaggtgagcagcgcctatgcccaggccatccgggagaggaagagatgtgtgacagcccactggctgaacacagtgctgaagaagaagaagatggtgcccccccaccgggccctgcacttccctgtggccttccccccaggcggcaagccctgcagccagcacatcatctctgtgactggatttgtggacagcgacagagatgacctgaagctgatggcctacctggccggggccaagtacacaggctacctgtgccgcagcaacacagtgctgatctgcaaggagcccaccggcctgaagtatgagaaggccaaggagtggaggatcccctgtgtgaatgcccagtggctgggggacatcctgctgggcaactttgaggccctgcggcagatccagtacagccgctacacagccttcagcctgcaggacccctttgcccccacccagcacctggtgctgaacctgctggatgcctggagggtgcccctgaaggtgtctgctgagctgctgatgagcatccggctgccccccaagctgaagcagaatgaggtggccaacgtgcagcccagcagcaagagggccagaattgaagatgtgcccccacccaccaagaagctgaccccagagctgaccccatttgtgctcttcaccggctttgagcctgtgcaggtgcagcagtacatcaagaagctgtacatcctgggcggggaggtggccgagagcgcccagaagtgcacccacctgattgccagcaaggtgaccaggacagtgaagttcctgacagccatctctgtggtgaagcacatcgtgaccccagagtggctggaggagtgcttccgctgccagaagttcattgatgagcagaactacatcctgagagatgctgaggccgaggtgctcttctccttcagcctggaggagagcctgaagagggcccacgtgagccccctcttcaaggccaagtacttctacatcaccccaggcatctgccccagcctgagcaccatgaaggccatcgtggagtgtgccggcggcaaggtgctgagcaagcagcccagcttcaggaagctgatggagcacaagcagaacagcagcctgtctgagatcatcctgatcagctgtgaaaatgacctgcacctgtgccgggagtactttgcccggggcattgatgtgcacaatgctgagtttgtgctgactggagtgctgacccagaccctggactatgagagctacaagttcaactag

SEQ ID NO: 16373 - DNA, 2682 bp, Artificial Sequence
  Description of Artificial Sequence: Synthetic coding sequence
gtgcgggtgctgatccaggccggggccctgtgctggagcctgcctgagctgagccagggcgaggtgggcaagggggcctgcccagctgaggtgggcaagcaccgggaccacctgcccagcagtgaccctgtgctgatgcaggccgaggcctctgtggtgatgtgctgggtgtcctctgaggacagaagtgccctgtgggccctggtgaccttctacggcggggactgccagctgaccctgaacaagaagtgcacccacctgattgtgcctgagcccaagggggagaagtatgaatgtgccctgaagagggccagcatcaagatcgtgaccccagactgggtgctggactgtgtgtctgagaagaccaagaaggatgaggccttctaccaccccaggctcatcatctatgaggaggaggaggaggaggaggaggaggaggaggaggtggagaatgaggagcaggacagccagaatgaaggcagcacagatgagaagagcagccctgccagcagccaggagggcagccccagcggggaccagcagttcagccccaagagcaacacagagaagagcaagggggagctgatgtttgatgacagcagtgacagcagccctgagaagcaggagaggaacctgaactggaccccagctgaggtgccccagctggccgccgccaagaggcggctgccccagggcaaggagcccggcctcatcaacctgtgtgccaacgtgccccctgtgcccggcaacatcctgcccccagaggtgcggggcaacctgatggctgctggccagaacctgcagagcagcgagaggtctgagatgattgccacctggagccctgctgtgaggaccctgaggaacatcaccaacaatgctgacatccagcagatgaaccggcccagcaatgtggcccacatcctgcagaccctgagcgcccccaccaagaacctggagcagcaggtgaaccacagccagcagggccacaccaatgccaatgctgtgctcttcagccaggtgaaggtgaccccagagacccacatgctgcagcagcagcagcaggcccagcagcagcagcagcagcaccctgtgctgcacctgcagccccagcagatcatgcagctgcagcagcagcagcagcagcagatcagccagcagccctacccccagcagcccccccaccccttcagccagcagcagcagcagcagcagcagcccccacccagcccccagcagcaccagctgtttggacatgaccctgctgtggagatccctgaggagggcttcctgctgggctgtgtgtttgccatcgctgactacccagagcagatgtctgacaagcagctgctggccacctggaagaggatcatccaggcccacggcggcaccgtggaccccaccttcaccagccgctgcacccacctgctgtgtgagagccaggtgtcctctgcctatgcccaggccatccgggagaggaagagatgtgtgacagcccactggctgaacacagtgctgaagaagaagaagatggtgcccccccaccgggccctgcacttccctgtggccttccccccaggcggcaagccctgcagccagcacatcatctctgtgacaggctttgtggacagcgacagagatgacctgaagctgatggcctacctggccggggccaagtacacaggctacctgtgccgcagcaacacagtgctgatctgcaaggagcccaccggcctgaagtatgagaaggccaaggagtggaggatcccctgtgtgaatgcccagtggctgggggacatcctgctgggcaactttgaggccctgcggcagatccagtacagccgctacacagccttcagcctgcaggacccctttgcccccacccagcacctggtgctgaacctgctggatgcctggagggtgcccctgaaggtgtctgctgagctgctgatgagcatccggctgccccccaagctgaagcagaatgaggtggccaacgtgcagcccagcagcaagagggccagaattgaagatgtgcccccacccaccaagaagctgaccccagagctgaccccatttgtgctcttcaccggctttgagcctgtgcaggtgcagcagtacatcaagaagctgtacatcctgggcggggaggtggccgagagcgcccagaagtgcacccacctgattgccagcaaggtgaccaggacagtgaagttcctgacagccatctctgtggtgaagcacatcgtgaccccagagtggctggaggagtgcttccgctgccagaagttcattgatgagcagaactacatcctgagagatgctgaggccgaggtgctcttctccttcagcctggaggagagcctgaagagggcccacgtgagccccctcttcaaggccaagtacttctacatcaccccaggcatctgccccagcctgagcaccatgaaggccatcgtggagtgtgccggcggcaaggtgctgagcaagcagcccagcttcaggaagctgatggagcacaagcagaacagcagcctgtctgagatcatcctgatcagctgtgaaaatgacctgcacctgtgccgggagtactttgcccggggcattgatgtgcacaatgctgagtttgtgctgactggagtgctgacccagaccctggactatgagagctacaagttcaactag

SEQ ID NO: 16374 - DNA, 3210 bp, Artificial Sequence
  Description of Artificial Sequence: Synthetic coding sequence
atgtctgaccaggcccccaaggtgcctgaggagatgttccgggaggtgaagtactatgctgtgggggacatcgacccccaggtgatccagctgctgaaggccggcaaggccaaggaggtgtcctacaatgccctggccagccacatcatcagtgaagatggagacaaccctgaggtgggggaggcccgggaggtgtttgacctgcctgtggtgaagcccagctgggtgatcctgtctgtgcagtgtggcaccctgctgcctgtgaatggcttcagccctgagagctgccagatcttcttcggcatcacagcctgcctgagccaggtgtcctctgaggacagaagtgccctgtgggccctggtgaccttctacggcggggactgccagctgaccctgaacaagaagtgcacccacctgattgtgcctgagcccaagggggagaagtatgaatgtgccctgaagagggccagcatcaagatcgtgaccccagactgggtgctggactgtgtgtctgagaagaccaagaaggatgaggccttctaccaccccaggctcatcatctatgaggaggaggaggaggaggaggaggaggaggaggaggtggagaatgaggagcaggacagccagaatgaaggcagcacagatgagaagagcagccctgccagcagccaggagggcagccccagcggggaccagcagttcagccccaagagcaacacagagaagagcaagggggagctgatgtttgatgacagcagtgacagcagccctgagaagcaggagaggaacctgaactggaccccagctgaggtgccccagctggccgccgccaagaggcggctgccccagggcaaggagcccggcctcatcaacctgtgtgccaacgtgccccctgtgcccggcaacatcctgcccccagaggtgcggggcaacctgatggctgctggccagaacctgcagagcagcgagaggtctgagatgattgccacctggagccctgctgtgaggaccctgaggaacatcaccaacaatgctgacatccagcagatgaaccggcccagcaatgtggcccacatcctgcagaccctgagcgcccccaccaagaacctggagcagcaggtgaaccacagccagcagggccacaccaatgccaatgctgtgctcttcagccaggtgaaggtgaccccagagacccacatgctgcagcagcagcagcaggcccagcagcagcagcagcagcaccctgtgctgcacctgcagccccagcagatcatgcagctgcagcagcagcagcagcagcagatcagccagcagccctacccccagcagcccccccaccccttcagccagcagcagcagcagcagcagcaggcccacccccaccagttcagccagcagcagctgcagttcccccagcagcagctgcaccccccccagcagctgcaccggccccagcagcagctgcagcccttccagcagcagcacgccctgcagcagcagttccaccagctgcagcagcaccagctgcagcagcagcagctggcccagctgcagcagcagcacagcctgctgcagcagcagcagcagcagcagatccagcagcagcagctgcagaggatgcaccagcagcagcagcagcagcagatgcagagccagacagccccccacctgagccagaccagccaggccctgcagcaccaggtgcccccccagcagcccccccagcagcagcagcagcagcagcccccacccagcccccagcagcaccagctgtttggacatgaccctgctgtggagatccctgaggagggcttcctgctgggctgtgtgtttgccatcgctgactacccagagcagatgtctgacaagcagctgctggccacctggaagaggatcatccaggcccacggcggcaccgtggaccccaccttcaccagccgctgcacccacctgctgtgtgagagccaggtgtcctctgcctatgcccaggccatccgggagaggaagagatgtgtgacagcccactggctgaacacagtgctgaagaagaagaagatggtgcccccccaccgggccctgcacttccctgtggccttccccccaggcggcaagccctgcagccagcacatcatctctgtgacaggctttgtggacagcgacagagatgacctgaagctgatggcctacctggccggggccaagtacacaggctacctgtgccgcagcaacacagtgctgatctgcaaggagcccaccggcctgaagtatgagaaggccaaggagtggaggatcccctgtgtgaatgcccagtggctgggggacatcctgctgggcaactttgaggccctgcggcagatccagtacagccgctacacagccttcagcctgcaggacccctttgcccccacccagcacctggtgctgaacctgctggatgcctggagggtgcccctgaaggtgtctgctgagctgctgatgagcatccggctgccccccaagctgaagcagaatgaggtggccaacgtgcagcccagcagcaagagggccagaattgaagatgtgcccccacccaccaagaagctgaccccagagctgaccccatttgtgctcttcaccggctttgagcctgtgcaggtgcagcagtacatcaagaagctgtacatcctgggcggggaggtggccgagagcgcccagaagtgcacccacctgattgccagcaaggtgaccaggacagtgaagttcctgacagccatctctgtggtgaagcacatcgtgaccccagagtggctggaggagtgcttccgctgccagaagttcattgatgagcagaactacatcctgagagatgctgaggccgaggtgctcttctccttcagcctggaggagagcctgaagagggcccacgtgagccccctcttcaaggccaagtacttctacatcaccccaggcatctgccccagcctgagcaccatgaaggccatcgtggagtgtgccggcggcaaggtgctgagcaagcagcccagcttcaggaagctgatggagcacaagcagaacagcagcctgtctgagatcatcctgatcagctgtgaaaatgacctgcacctgtgccgggagtactttgcccggggcattgatgtgcacaatgctgagtttgtgctgactggagtgctgacccagaccctggactatgagagctacaagttcaactag

SEQ ID NO: 16375 - DNA, 3210 bp, Artificial Sequence; identical to SEQ ID NO: 16374
  Description of Artificial Sequence: Synthetic coding sequence

SEQ ID NO: 16376 - DNA, 4668 bp, Artificial Sequence
  Description of Artificial Sequence: Synthetic coding sequence
atgtctgagcagaccccagctgaggccggggccgccggggcccgggaggatgcctgccgggactaccagagcagcctggaggacctgaccttcaacagcaagccccacatcaacatgctgaccatcctggccgaggagaacctgccctttgccaaggagatcgtgtccctcatcgaggcccagacagccaaggcccccagcagcgagaagctgcctgtgatgtacctgatggacagcatcgtgaagaatgtgggccgggagtacctgacagccttcaccaagaacctggtggccaccttcatctgtgtgtttgagaaggtggatgagaacaccaggaagagcctcttcaagctgcggagcacctgggatgagatcttccccctgaagaagctgtatgccctggatgtgcgggtgaacagcctggaccctgcctggcccatcaagcccctgcccccaaatgtgaacaccagcagcatccacgtgaaccccaagttcctgaacaagagccctgaggagcccagcaccccaggcaccgtggtgagcagccccagcatcagcaccccacccatcgtgcctgacatccagaagaacctgacccaggagcagctgatccggcagcagctgctggccaagcagaagcagctgctggagctgcagcagaagaagctggagctggagctggagcaggccaaggcccagctggccgtgtccctgtctgtgcagcaggagaccagcaacctgggccctggcagcgcccccagcaagctgcacgtgtcccagatcccccccatggctgtgaaggccccccaccaggtgcctgtgcagagcgagaagagcaggcctggccccagcctgcagatccaggacctgaagggcaccaacagagacccccggctgaaccgcatcagccagcacagccacggcaaggaccagagccacaggaaggagttcctgatgaacaccctgaaccagagcgacaccaagaccagcaagaccatccccagcgagaagctgaacagcagcaagcaggagaagagcaagagcggggagaagatcaccaagaaggagctggaccagctggacagcaagagcaagagcaagagcaagagccccagccccctgaagaacaagctgagccacaccaaggacctgaagaaccaggagagcgagagcatgaggctgagtgacatgaacaagagggacccccggctgaagaagcacctgcaggacaagacagatggcaaggatgatgatgtgaaggagaagaggaagacagctgagaagaaggacaaggatgagcacatgaagagcagcgagcaccggctggccggcagcaggaacaagatcatcaatggaattgtgcagaagcaggacaccatcacagaggagagcgagaagcagggcaccaagccaggccgcagcagcaccaggaagaggagccgcagccgcagccccaagagccgcagccccatcatccacagccccaagagaagagaccggcgcagccccaagaggcggcagaggtccatgagccccaccagcacccccaaggccggcaagatccggcagagcggggccaagcagagccacatggaggagttcaccccacccagccgggaggacagaaatgccaagaggagcaccaagcaggacatccgggaccccaggaggatgaagaagacagaggaggagcggccccaggagaccaccaaccagcacagcaccaagtctggaacagagcccaaggaaaatgtggagaactggcagagcagcaagagcgccaagcgctggaagagcggctgggaggagaacaagagcctgcagcaggtggatgagcacagcaagccaccccacctgcggcaccgggagagctggagcagcaccaagggcatcctgagcccccgggcccccaagcagcagcagcaccggctgtctgtggatgccaacctgcagatccccaaggagctgaccctggccagcaagcgggagctgctgcagaagaccagcgagcggctggccagcggggagatcacccaggatgacttcctggtggtggtgcaccagatccggcagctgttccagtaccaggagggcgtgcgggaggagcagaggagccccttcaatgaccgcttccccctgaagaggcccaggtatgaagattctgacaagccctttgtggacagccctgccagcagatttgctggcctggacaccaaccagaggctgacagccctggctgaagatcggcccctgtttgatggccccagccggcccagcgtggccagagatggccccaccaagatgatctttgagggccccaacaagctgagccccagaattgatggcccccccaccccagccagcctgcgctttgatggcagccctggccagatgggcggcggcggccccctgcgctttgagggcccccagggccagctgggcggcggctgccccctgcgctttgagggccccccaggccctgtgggcacccccctgcgctttgagggccccatcggccaggccggcggcggcggcttccgctttgagggcagccctggcctgcgctttgagggcagccctgggggcctgcgctttgagggccctgggggccagcctgtgggcggcctgcgctttgagggccaccggggccagcctgtgggcggcctgcgctttgagggcccccacggccagcctgtgggcggcctgcgctttgacaacccccggggccagcctgtgggcggcctgcgctttgaaggaggccacggccccagcggggccgccatccgctttgatggcccccacggccagcccggcggcggcatccgctttgagggccccctgctgcagcagggcgtgggcatgagatttgagggcccccacggccagagcgtggccggcctgcgctttgagggccagcacaaccagctgggcggcaacctgcgctttgagggcccccacggccagcccggggtgggcatccgctttgagggccccctggtgcagcagggcggcggcatgagatttgagggccccagcgtgcctgggggcggcctgcgcatcgagggccccctgggccagggcggccccaggtttgagggctgccacgccctgcgctttgatggccagcccggccagcccagcctgctgcccaggtttgatggcctgcacggccagcccggccccaggtttgagaggaccccaggccagcccggcccccagagatttgatggccccccaggccagcaggtgcagcccaggtttgatggagtgccccagagatttgatggcccccagcaccagcaggccagcagatttgacatccccctgggcctgcagggcaccaggtttgacaaccaccccagccagaggctggagagcgtgtccttcaaccagacaggcccctacaatgaccccccaggaaatgccttcaatgcccccagccagggcctgcagttccagagacatgagcagatctttgacagcccccagggccccaacttcaacggcccccacggccctggcaaccagagcttcagcaaccccctgaacagagccagcggccactactttgatgagaagaacctgcagagcagccagtttggaaactttggaaacatcccagcccccatgacagtgggcaacatccaggccagccagcaggtgctgtctggagtggcccagcctgtggccttcggccagggccagcagttcctgcctgtgcacccccagaaccctggctttgtgcagaaccccagcggggccctgcccaaggcctacccagacaaccacctgagccaggtggatgtgaatgagctgttcagcaagctgctgaagacaggcatcctgaagctgagccagacagattctgccaccacccaggtgtctgaggtgacagcccagcccccacctgaggaggaggaggaccagaatgaagaccaggatgtgcctgacctgaccaacttcaccgtggaggagctgaagcagagatatgacagcgtcatcaacagactctacacaggcatccagtgctacagctgtggcatgaggttcaccaccagccagacagatgtgtatgctgaccacctggactggcactaccggcagaacagaacagagaaggatgtgtccaggaaggtgacccaccggcgctggtactacagcctgacagactggattgaatttgaggagattgctgacctggaggagcgggccaagagccagttctttgagaaggtgcatgaggaggtggtgctgaagacccaggaggccgccaaggagaaggagttccagagcgtgcctgctggccctgctggagctgtggagagctgtgagatctgccaggagcagtttgagcagtactgggatgaggaggaggaggagtggcacctgaagaatgccatccgggtggatggcaagatctaccaccccagctgctatgaggactaccagaacaccagcagctttgactgcacccccagccccagcaagacccctgtggagaaccccctgaacatcatgctgaacatcgtgaagaatgagctgcaggagccctgtgacagccccaaggtgaaggaggagagaattgacaccccaccagcctgcacagaggagagcatcgccaccccatctgagatcaagacagaaaatgacacagtggagagcgtgtag

SEQ ID NO: 16377 - DNA, 2355 bp, Artificial Sequence
  Description of Artificial Sequence: Synthetic coding sequence
atgtctgagcagaccccagctgaggccggggccgccggggcccgggaggatgcctgccgggactaccagagcagcctggaggacctgaccttcaacagcaagccccacatcaacatgctgaccatcctggccgaggagaacctgccctttgccaaggagatcgtgtccctcatcgaggcccagacagccaaggcccccagcagcgagaagctgcctgtgatgtacctgatggacagcatcgtgaagaatgtgggccgggagtacctgacagccttcaccaagaacctggtggccaccttcatctgtgtgtttgagaaggtggatgagaacaccaggaagagcctcttcaagctgcggagcacctgggatgagatcttccccctgaagaagctgtatgccctggatgtgcgggtgaacagcctggaccctgcctggcccatcaagcccctgcccccaaatgtgaacaccagcagcatccacgtgaaccccaagttcctgaacaagagccctgaggagcccagcaccccaggcaccgtggtgagcagccccagcatcagcaccccacccatcgtgcctgacatccagaagaacctgacccaggagcagctgatccggcagcagctgctggccaagcagaagcagctgctggagctgcagcagaagaagctggagctggagctggagcaggccaaggcccagctggccgtgtccctgtctgtgcagcaggagaccagcaacctgggccctggcagcgcccccagcaagctgcacgtgtcccagatcccccccatggctgtgaaggccccccaccaggtgcctgtgcagagcgagaagagcaggcctggccccagcctgcagatccaggacctgaagggcaccaacagagacccccggctgaaccgcatcagccagcacagccacggcaaggaccagagccacaggaaggagttcctgatgaacaccctgaaccagagcgacaccaagaccagcaagaccatccccagcgagaagctgaacagcagcaagcaggagaagagcaagagcggggagaagatcaccaagaaggagctggaccagctggacagcaagagcaagagcaagagcaagagccccagccccctgaagaacaagctgagccacaccaaggacctgaagaaccaggagagcgagagcatgaggctgagtgacatgaacaagagggacccccggctgaagaagcacctgcaggacaagacagatggcaaggatgatgatgtgaaggagaagaggaagacagctgagaagaaggacaaggatgagcacatgaagagcagcgagcaccggctggccggcagcaggaacaagatcatcaatggaattgtgcagaagcaggacaccatcacagaggagagcgagaagcagggcaccaagccaggccgcagcagcaccaggaagaggagccgcagccgcagccccaagagccgcagccccatcatccacagccccaagagaagagaccggcgcagccccaagaggcggcagaggtccatgagccccaccagcacccccaaggccggcaagatccggcagagcggggccaagcagagccacatggaggagttcaccccacccagccgggaggacagaaatgccaagaggagcaccaagcaggacatccgggaccccaggaggatgaagaagacagaggaggagcggccccaggagaccaccaaccagcacagcaccaagtctggaacagagcccaaggaaaatgtggagaactggcagagcagcaagagcgccaagcgctggaagagcggctgggaggagaacaagagcctgcagcaggtggatgagcacagcaagccaccccacctgcggcaccgggagagctggagcagcaccaagggcatcctgagcccccgggcccccaagcagcagcagcaccggctgtctgtggatgccaacctgcagatccccaaggagctgaccctggccagcaagcgggagctgctgcagaagaccagcgagcggctggccagcggggagatcacccaggatgacttcctggtggtggtgcaccagatccggcagctgttccagtaccaggagggcgtgcgggaggagcagaggagccccttcaatgaccgcttccccctgaagaggcccaggtatgaagattctgacaagccctttgtggacagccctgccagcagatttgctggcctggacaccaaccagaggctgacagccctggctgaagatcggcccctgtttgatggccccagccggcccagcgtggccagagatggccccaccaagatgatctttgagggccccaacaagctgagccccagaattgatggccccccatag

SEQ ID NO: 16378 - DNA, 4344 bp, Artificial Sequence
  Description of Artificial Sequence: Synthetic coding sequence
atggcccacagcaagaccaggaccaatgatggcaagatcacctacccacctggggtgaaggagatcagtgacaagatcagcaaggaggagatggtgcggcggctgaagatggtggtgaagaccttcatggacatggaccaggacagcgaggaggagaaggagctgtacctgaacctggccctgcacctggccagtgacttcttcctgaagcacccagacaaggatgtgcggctgctggtggcctgctgcctggccgacatcttccgcatctatgcccctgaggccccctacaccagcccagacaagctgaaggacatcttcatgttcatcacccggcagctgaagggcctggaggacaccaagagcccccagttcaaccgctacttctacctgctggagaacatcgcctgggtgaagagctacaacatctgctttgagctggaggacagcaatgagatcttcacccagctgtaccgcaccctcttcagcgtcatcaacaacggccacaaccagaaggtgcacatgcacatggtggacctgatgagcagcatcatctgtgagggggacacagtgtcccaggagctgctggacacagtgctggtgaacctggtgcctgcccacaagaacctgaacaagcaggcctatgacctggccaaggccctgctgaagaggacagcccaggccatcgagccctacatcaccaacttcttcaaccaggtgctgatgctgggcaagaccagcatcagtgacctgtctgagcacgtgtttgacctgatcctggagctgtacaacatcgacagccacctgctgctgtctgtgctgccccagctggagttcaagctgaagagcaatgacaatgaggagcggctgcaggtggtgaagctgctggccaagatgtttggagccaaggacagcgagctggccagccagaacaagcccctgtggcagtgctacctgggccgcttcaatgacatccacgtgcccatccggctggagtgtgtgaagtttgccagccactgcctgatgaaccacccagacctggccaaggacctgacagagtacctgaaggtgcgcagccatgaccctgaggaggccatcagacatgatgtgattgtgtccatcgtgacagctgccaagaaggacatcctgctggtgaatgaccacctgctgaactttgtgcgggagaggaccctggacaagcgctggagggtgaggaaggaggccatgatgggcctggcccagatctacaagaagtatgccctgcagagcgctgctgggaaggatgctgccaagcagatcgcctggatcaaggacaagctgctgcacatctactaccagaacagcattgatgaccggctgctggtggagcgcatctttgcccagtacatggtgccccacaacctggagaccacagagaggatgaagtgcctgtactacctgtatgccaccctggacctgaatgctgtgaaggccctgaatgagatgtggaagtgccagaacctgctgcggcaccaggtgaaggacctgctggacctgatcaagcagcccaagacagatgcctctgtgaaggccatcttcagcaaggtgatggtgatcaccaggaacctgcctgaccccgggaaggcccaggacttcatgaagaagttcacccaggtgctggaggatgatgagaagatcaggaagcagctggaggtgctggtgagccccacctgcagctgcaagcaggccgagggctgtgtgcgggagatcaccaagaagctgggcaaccccaagcagcccaccaaccccttcctggagatgatcaagttcctgctggagcgcatcgcccctgtgcacatcgacacagagagcatcagcgccctgatcaagcaggtgaacaagagcattgatggaacagcagatgatgaagatgaaggagtgcccacagaccaggccatccgggccggcctggagctgctgaaggtgctgtccttcacccaccccatctccttccacagcgctgagacctttgagagcctgctggcctgcctgaagatggatgatgagaaggtggccgaggccgccctgcagatcttcaagaacacaggcagcaagattgaggaggacttcccccacatccgcagcgccctgctgcctgtgctgcaccacaagagcaagaagggccccccccggcaggccaagtatgccatccactgcatccacgccatcttcagcagcaaggagacccagtttgcccagatctttgagcccctgcacaagagcctggaccccagcaacctggagcacctgatcacccccctggtgaccatcggccacatcgccctgctggccccagaccagtttgctgcccccctgaagagcctggtggccaccttcatcgtgaaggacctgctgatgaatgaccggctgcccgggaagaagaccaccaagctgtgggtgcctgatgaggaggtgtccccagagaccatggtgaagatccaggccatcaagatgatggtgcgctggctgctgggcatgaagaacaaccacagcaagagcggcaccagcaccctgcggctgctgaccaccatcctgcacagtgatggagacctgacagagcagggcaagatcagcaagccagacatgagccggctgcggctggccgccggcagcgccatcgtgaagctggcccaggagccctgctaccacgagatcatcaccctggagcagtaccagctgtgtgccctggccatcaatgatgagtgctaccaggtgcggcaggtgtttgcccagaagctgcacaagggcctgagccggctgcggctgcccctggagtacatggccatctgtgccctgtgtgccaaggaccctgtgaaggagcggcgggcccacgcccggcagtgcctggtgaagaacatcaacgtgagaagagagtacctgaagcagcacgccgctgtgtctgagaagctgctgagcctgctgcctgaatatgtggtgccctacaccatccacctgctggcccatgaccctgactatgtgaaggtgcaggacatcgagcagctgaaggatgtgaaggaatgtctgtggtttgtgctggagatcctgatggccaagaatgaaaacaacagccacgccttcatcaggaagatggtggagaacatcaagcagaccaaggatgcccagggcccagatgatgccaagatgaatgagaagctgtacacagtgtgtgatgtggccatgaacatcatcatgagcaagagcaccacctacagcctggagagccccaaggaccctgtgctgcctgcccgcttcttcacccagcctgacaagaacttcagcaacaccaagaactacctgcccccagagatgaagagcttcttcacccctgggaagcccaagaccaccaacgtgctgggcgctgtgaacaagcccctgagcagcgctgggaagcagagccagaccaagagcagcaggatggagaccgtgtccaatgccagcagcagcagcaaccccagcagccctggccgcatcaagggccgcctggacagcagcgagatggaccacagtgaaaatgaagactacaccatgagcagccccctgcccgggaagaagagtgacaagagagatgacagcgacctggtgcgctctgagctggagaagccccggggcaggaagaagacccctgtgacagagcaggaggagaagctgggcatggatgacctgaccaagctggtgcaggagcagaagcccaagggcagccagaggagcaggaagaggggccacacagccagcgagagtgatgagcagcagtggccagaggagaagaggctgaaggaggacatcctggagaatgaagatgagcagaacagcccccccaagaagggcaagaggggccggccccccaagcccctgggcggcggcacccccaaggaggagcccaccatgaagaccagcaagaagggcagcaagaagaagagcggccccccagcccctgaggaggaggaggaggaggagcggcagagcggcaacacagagcagaagagcaagagcaagcagcaccgggtgtcccggcgggcccagcagagagctgagagccctgagagcagcgccatcgagagcacccagagcaccccccagaagggccggggccggcccagcaagacccccagccccagccagcccaagaagaatgtgcgggtgggccgcagcaagcaggccgccaccaaggaaaatgacagcagcgaggaggtggatgtgttccagggcagcagccctgtggatgacatcccccaggaggagacagaggaggaggaggtgtccacagtgaatgtgagaagaagaagtgccaagcgggagaggaggtag

SEQ ID NO: 16379 - DNA, 3909 bp, Artificial Sequence
  Description of Artificial Sequence: Synthetic coding sequence
atggcccacagcaagaccaggaccaatgatggcaagatcacctacccacctggggtgaaggagatcagtgacaagatcagcaaggaggagatggtgcggcggctgaagatggtggtgaagaccttcatggacatggaccaggacagcgaggaggagaaggagctgtacctgaacctggccctgcacctggccagtgacttcttcctgaagcacccagacaaggatgtgcggctgctggtggcctgctgcctggccgacatcttccgcatctatgcccctgaggccccctacaccagcccagacaagctgaaggacatcttcatgttcatcacccggcagctgaagggcctggaggacaccaagagcccccagttcaaccgctacttctacctgctggagaacatcgcctgggtgaagagctacaacatctgctttgagctggaggacagcaatgagatcttcacccagctgtaccgcaccctcttcagcgtcatcaacaacggccacaaccagaaggtgcacatgcacatggtggacctgatgagcagcatcatctgtgagggggacacagtgtcccaggagctgctggacacagtgctggtgaacctggtgcctgcccacaagaacctgaacaagcaggcctatgacctggccaaggccctgctgaagaggacagcccaggccatcgagccctacatcaccaacttcttcaaccaggtgctgatgctgggcaagaccagcatcagtgacctgtctgagcacgtgtttgacctgatcctggagctgtacaacatcgacagccacctgctgctgtctgtgctgccccagctggagttcaagctgaagagcaatgacaatgaggagcggctgcaggtggtgaagctgctggccaagatgtttggagccaaggacagcgagctggccagccagaacaagcccctgtggcagtgctacctgggccgcttcaatgacatccacgtgcccatccggctggagtgtgtgaagtttgccagccactgcctgatgaaccacccagacctggccaaggacctgacagagtacctgaaggtgcgcagccatgaccctgaggaggccatcagacatgatgtgattgtgtccatcgtgacagctgccaagaaggacatcctgctggtgaatgaccacctgctgaactttgtgcgggagaggaccctggacaagcgctggagggtgaggaaggaggccatgatgggcctggcccagatctacaagaagtatgccctgcagagcgctgctgggaaggatgctgccaagcagatcgcctggatcaaggacaagctgctgcacatctactaccagaacagcattgatgaccggctgctggtggagcgcatctttgcccagtacatggtgccccacaacctggagaccacagagaggatgaagtgcctgtactacctgtatgccaccctggacctgaatgctgtgaaggccctgaatgagatgtggaagtgccagaacctgctgcggcaccaggtgaaggacctgctggacctgatcaagcagcccaagacagatgcctctgtgaaggccatcttcagcaaggtgatggtgatcaccaggaacctgcctgaccccgggaaggcccaggacttcatgaagaagttcacccaggtgctggaggatgatgagaagatcaggaagcagctggaggtgctggtgagccccacctgcagctgcaagcaggccgagggctgtgtgcgggagatcaccaagaagctgggcaaccccaagcagcccaccaaccccttcctggagatgatcaagttcctgctggagcgcatcgcccctgtgcacatcgacacagagagcatcagcgccctgatcaagcaggtgaacaagagcattgatggaacagcagatgatgaagatgaaggagtgcccacagaccaggccatccgggccggcctggagctgctgaaggtgctgtccttcacccaccccatctccttccacagcgctgagacctttgagagcctgctggcctgcctgaagatggatgatgagaaggtggccgaggccgccctgcagatcttcaagaacacaggcagcaagattgaggaggacttcccccacatccgcagcgccctgctgcctgtgctgcaccacaagagcaagaagggccccccccggcaggccaagtatgccatccactgcatccacgccatcttcagcagcaaggagacccagtttgcccagatctttgagcccctgcacaagagcctggaccccagcaacctggagcacctgatcacccccctggtgaccatcggccacatcgccctgctggccccagaccagtttgctgcccccctgaagagcctggtggccaccttcatcgtgaaggacctgctgatgaatgaccggctgcccgggaagaagaccaccaagctgtgggtgcctgatgaggaggtgtccccagagaccatggtgaagatccaggccatcaagatgatggtgcgctggctgctgggcatgaagaacaaccacagcaagagcggcaccagcaccctgcggctgctgaccaccatcctgcacagtgatggagacctgacagagcagggcaagatcagcaagccagacatgagccggctgcggctggccgccggcagcgccatcgtgaagctggcccaggagccctgctaccacgagatcatcaccctggagcagtaccagctgtgtgccctggccatcaatgatgagtgctaccaggtgcggcaggtgtttgcccagaagctgcacaagggcctgagccggctgcggctgcccctggagtacatggccatctgtgccctgtgtgccaaggaccctgtgaaggagcggcgggcccacgcccggcagtgcctggtgaagaacatcaacgtgagaagagagtacctgaagcagcacgccgctgtgtctgagaagctgctgagcctgctgcctgaatatgtggtgccctacaccatccacctgctggcccatgaccctgactatgtgaaggtgcaggacatcgagcagctgaaggatgtgaaggaatgtctgtggtttgtgctggagatcctgatggccaagaatgaaaacaacagccacgccttcatcaggaagatggtggagaacatcaagcagaccaaggatgcccagggcccagatgatgccaagatgaatgagaagctgtacacagtgtgtgatgtggccatgaacatcatcatgagcaagagcaccacctacagcctggagagccccaaggaccctgtgctgcctgcccgcttcttcacccagcctgacaagaacttcagcaacaccaagaactacctgcccccagagatgaagagcttcttcacccctgggaagcccaagaccaccaacgtgctgggcgctgtgaacaagcccctgagcagcgctgggaagcagagccagaccaagagcagcaggatggagaccgtgtccaatgccagcagcagcagcaaccccagcagccctggccgcatcaagggccgcctggacagcagcgagatggaccacagtgaaaatgaagactacaccatgagcagccccctgcccgggaagaagagtgacaagagagatgacagcgacctggtgcgctctgagctggagaagccccggggcaggaagaagacccctgtgacagagcaggaggagaagctgggcatggatgacctgaccaagctggtgcaggagcagaagcccaagggcagccagaggagcaggaagaggggccacacagccagcgagagtgatgagcagcagtggccagaggagaagaggctgaaggaggacatcctggagaatgaagatgagcagaacagcctgcccctgcaccagaaggatgccagtgacaggaggaccaccatgcagatcgtgaagtag

SEQ ID NO: 16380 - DNA, 2115 bp, Artificial Sequence
  Description of Artificial Sequence: Synthetic coding sequence
atggccaatgaaaaccacggcagcccccgggaggaggccagcctgctgagccacagccctggcaccagcaaccagagccagccctgcagccccaagcccatccggctggtgcaggacctgcctgaggagctggtgcatgctggctgggagaagtgctggagcagaagagaaaatcggccctactacttcaaccgcttcaccaaccagagcctgtgggagatgcctgtgctgggccagcatgatgtgatcagtgaccccctgggcctgaatgccacccccctgccccaggacagcagcctggtggagaccccacctgctgagaacaagcccaggaagaggcagctgtctgaggagcagcccagcggaaatggagtgaagaagcccaagattgagatccctgtgacccccaccggccagagcgtgcccagcagccccagcatccctggcacccccaccctgaagatgtggggcaccagccctgaggacaagcagcaggccgccctgctgcggcccacagaggtgtactgggacctggacatccagaccaatgctgtgatcaagcaccggggccccagcgaggtgctgcccccccaccctgaggtggagctgctgcggagccagctgatcctgaagctgcggcagcactaccgggagctgtgccagcagcgggagggcatcgagcccccccgggagagcttcaaccgctggatgctggagaggaaggtggtggacaagggcagtgaccccctgctgcccagcaactgtgagcctgtggtgagccccagcatgttccgggagatcatgaatgacatccccatccggctgagccgcatcaagttccgggaggaggccaagaggctgctcttcaagtatgcagaggccgcccggcggctgattgagagccgcagcgccagcccagacagcaggaaggtggtgaagtggaatgtggaggacaccttctcctggctgaggaaggaccacagcgccagcaaggaggactacatggaccggctggagcacctgcggcggcagtgtggcccccacgtgtctgctgctgccaaggacagcgtggagggcatctgcagcaagatctaccacatcagcctggagtatgtgaagaggatccgggagaagcacctggccatcctgaaggagaacaacatcagcgaggaggtggaggcccctgaggtggagccccggctggtgtactgctaccctgtgcggctggccgtgtctgccccacccatgcccagcgtggagatgcacatggagaacaacgtggtgtgcatccgctacaagggggagatggtgaaggtgtccaggaactacttcagcaagctgtggctgctgtaccgctacagctgcattgatgattctgcctttgagcgcttcctgccccgggtgtggtgcctgctgcggcgctaccagatgatgtttggagtgggcctgtatgagggcaccggcctgcagggcagcctgcctgtgcacgtgtttgaggccctgcaccggctgtttggagtgtcctttgagtgctttgccagccccctgaactgctacttccggcagtactgcagcgccttcccagacacagatggctacttcggcagccggggcccctgcctggactttgcccccctgagcggcagctttgaggccaacccccccttctgtgaggagctgatggatgccatggtgagccactttgagcggctgctggagagcagccctgagcccctgtccttcatcgtgttcatccctgagtggagggagccccccaccccagccctgaccaggatggagcagagccgcttcaagaggcaccagctgatcctgcctgcctttgagcacgagtaccgcagcggcagccagcacatctgcaagaaggaggagatgcactacaaggctgtgcacaacacagctgtgctcttcctgcagaatgaccccggctttgccaagtgggcccccaccccagagcggctgcaggagctgtctgctgcctaccggcagagcggccgcagccacagcagcggcagcagcagcagcagcagcagcgaggccaaggaccgggacagcggccgggagcagggccccagccgggagccccaccccacctag

SEQ ID NO: 16381 - DNA, 2133 bp, Artificial Sequence
  Description of Artificial Sequence: Synthetic coding sequence
atggccaatgaaaaccacggcagcccccgggaggaggccagcctgctgagccacagccctggcaccagcaaccagagccagccctgcagccccaagcccatccggctggtgcaggacctgcctgaggagctggtgcatgctggctgggagaagtgctggagcagaagagaaaatcggccctactacttcaaccgcttcaccaaccagagcctgtgggagatgcctgtgctgggccagcatgatgtgatcagtgaccccctgggcctgaatgccacccccctgccccaggacagcagcctggtggagaccccacctgctgagaacaagcccaggaagaggcagctgtctgaggagcagcccagcggaaatggagtgaagaagcccaagattgagatccctgtgacccccaccggccagagcgtgcccagcagccccagcatccctggcacccccaccctgaagatgtggggcaccagccctgaggacaagcagcaggccgccctgctgcggcccacagaggtgtactgggacctggacatccagaccaatgctgtgatcaagcaccggggccccagcgaggtgctgcccccccaccctgaggtggagctgctgcggagccagctgatcctgaagctgcggcagcactaccgggagctgtgccagcagcgggagggcatcgagcccccccgggagagcttcaaccgctggatgctggagaggaaggtggtggacaagggcagtgaccccctgctgcccagcaactgtgagcctgtggtgagccccagcatgttccgggagatcatgaatgacatccccatccggctgagccgcatcaagttccgggaggaggccaagaggctgctcttcaagtatgcagaggccgcccggcggctgattgagagccgcagcgccagcccagacagcaggaaggtggtgaagtggaatgtggaggacaccttctcctggctgaggaaggaccacagcgccagcaaggaggactacatggaccggctggagcacctgcggcggcagtgtggcccccacgtgtctgctgctgccaaggacagcgtggagggcatctgcagcaagatctaccacatcagcctggagtatgtgaagaggatccgggagaagcacctggccatcctgaaggagaacaacatcagcgaggaggtggaggcccctgaggtggagccccggctggtgtactgctaccctgtgcggctggccgtgtctgccccacccatgcccagcgtggagatgcacatggagaacaacgtggtgtgcatccgctacaagggggagatggtgaaggtgtccaggaactacttcagcaagctgtggctgctgtaccgctacagctgcattgatgattctgcctttgagcgcttcctgccccgggtgtggtgcctgctgcggcgctaccagatgatgtttggagtgggcctgtatgagggcaccggcctgcagggcagcctgcctgtgcacgtgtttgaggccctgcaccggctgtttggagtgtcctttgagtgctttgccagccccctgaactgctacttccggcagtactgcagcgccttcccagacacagatggctacttcggcagccggggcccctgcctggactttgcccccctgagcggcagctttgaggccaacccccccttctgtgaggagctgatggatgccatggtgagccactttgagcggctgctggagagcagccctgagcccctgtccttcatcgtgttcatccctgagtggagggagccccccaccccagccctgaccaggatggagcagagccgcttcaagaggcaccagctgatcctgcctgcctttgagcacgagtaccgcagcggcagccagcacatctgcaagaaggaggagatgcactacaaggctgtgcacaacacagctgtgctcttcctgcagaatgaccccggctttgccaagtgggcccccaccccagagcggctgcaggagctgtctgctgcctaccggcagagcggccgcagccacagcagcggcagcagcagcagcagcagcagcgaggccaaggaccgggacagcggccgggagcagggccccagccgggagccccaccctgtggccaccctcttccacctgtag

SEQ ID NO: 16382 - DNA, 498 bp, Artificial Sequence
  Description of Artificial Sequence: Synthetic coding sequence
atgtctgtgaccctgcacacagatgtgggggacatcaagattgaggtgttctgtgagaggacccccaagacctgtgagatggagagccgctgtgtgccccaggccggcgtgcagtggagggacctgggcagcctgcagcccccacctcctggcttcaagcaggtgttctgcctgagcctgcccaggacaggccggggcggcaacagcatctggggcaagaagtttgaagatgagtacagcgagtacctgaagcacaacgtgcggggcgtggtgtccatggccaacaacggccccaacaccaacggcagccagttcttcatcacctacggcaagcagccccacctggacatgaagtacacagtgtttgggaaggtgattgatggcctggagaccctggatgagctggagaagctgcctgtgaatgagaagacctaccggcccctgaatgatgtgcacatcaaggacatcaccatccacgccaacccctttgcccagtag

SEQ ID NO: 16383 - DNA, 486 bp, Artificial Sequence
  Description of Artificial Sequence: Synthetic coding sequence
atgtctgtgaccctgcacacagatgtgggggacatcaagattgaggtgttctgtgagaggacccccaagacctgtgagaacttcctggccctgtgtgccagcaactactacaacggctgcatcttccacaggaacatcaagggcttcatggtgcagacaggagaccccactggaacaggccggggcggcaacagcatctggggcaagaagtttgaagatgagtacagcgagtacctgaagcacaacgtgcggggcgtggtgtccatggccaacaacggccccaacaccaacggcagccagttcttcatcacctacggcaagcagccccacctggacatgaagtacacagtgtttgggaaggtgattgatggcctggagaccctggatgagctggagaagctgcctgtgaatgagaagacctaccggcccctgaatgatgtgcacatcaaggacatcaccatccacgccaacccctttgcccagtag

SEQ ID NO: 16384 - DNA, 498 bp, Artificial Sequence; identical to SEQ ID NO: 16382
  Description of Artificial Sequence: Synthetic coding sequence

SEQ ID NO: 16385 - DNA, 243 bp, Artificial Sequence
  Description of Artificial Sequence: Synthetic coding sequence
atgtctgtgaccctgcacacagatgtgggggacatcaagattgaggtgttctgtgagaggacccccaagacctgtgagaacttcctggccctgtgtgccagcaactactacaacggctgcatcttccacaggaacatcaagggcttcatggtgcagacaggagaccccactggaacaggccggggcggcaacagcatctggggcaagaagtttgaagatgagtacagcgagtacctgaagtag

SEQ ID NO: 16386 - DNA, 1941 bp, Artificial Sequence
  Description of Artificial Sequence: Synthetic coding sequence
atggctgctgagagcggcagtgacttccagcagaggagaagaagaagaagagatcctgaggagcctgagaagacagagctgtctgagcgggagctggccgtggccgtggccgtgtcccaggagaatgatgaagaaaatgaggagcgctgggtgggccccctgcctgtggaggccaccctggccaagaagaggaaggtgctggagtttgagcgggtgtacctggacaacctgcccagcgcctccatgtatgaaagaagctacatgcacagagatgtgatcacccacgtggtgtgcaccaagacagacttcatcatcacagccagccatgatggccacgtgaagttctggaagaagattgaggagggcattgaatttgtgaagcacttccgcagccacctgggcgtcatcgagagcattgctgtgtcctctgagggcgccctcttctgcagcgtgggagatgacaaggccatgaaggtgtttgatgtggtgaactttgacatgatcaacatgctgaagctgggctacttccctggccagtgtgagtggatctactgccctggagatgccatcagctctgtggccgccagcgagaagagcacaggcaagatcttcatctatgatggccgcggggacaaccagcccctgcacatctttgacaagctgcacaccagccccctgacccagatccggctgaaccctgtgtacaaggctgtggtgtccagtgacaagagcggcatgattgagtactggacaggcccccctcatgagtacaagttccccaagaatgtgaactgggagtacaagacagacacagacctgtatgaatttgccaagtgcaaggcctaccccacctctgtgtgcttctccccagatggcaagaagatcgccaccatcggcagtgacaggaaggtgcgcatcttccgctttgtgacaggcaagctgatgagggtgtttgatgagagcctgtccatgttcacagagctgcagcagatgaggcagcagctgcctgacatggagtttggccgcaggatggctgtggagcgggagctggagaaggtggatgctgtgcggctcatcaacatcgtgtttgatgagaccggccactttgtgctgtatggcaccatgctgggcatcaaggtgatcaacgtggagaccaacagatgtgtgcgcatcctgggcaagcaggagaacatccgggtgatgcagctggccctcttccagggcatcgccaagaagcacagagctgccaccaccatcgagatgaaggcctctgaaaatcctgtgctgcagaacatccaggccgaccccaccatcgtgtgcaccagcttcaagaagaaccgcttctacatgttcaccaagcgggagcctgaggacaccaagtctgctgacagcgacagagatgtgttcaatgagaagcccagcaaggaggaggtgatggccgccacccaggccgagggccccaagagggtgtctgattctgccatcatccacacctccatgggagacatccacaccaagctgtttcctgtggagtgccccaagacagtggagaacttctgtgtgcacagcagaaatggctactacaacggccacaccttccaccgcatcatcaagggcttcatgatccagacaggagaccccaccggcaccggcatgggcggggagagcatctggggcggggagtttgaagatgagttccacagcaccctgcggcatgaccggccctacaccctgtccatggccaatgccggcagcaacaccaacggcagccagttcttcatcaccgtggtgcccaccccctggctggacaacaagcacacagtgtttggccgggtgaccaagggcatggaggtggtgcagaggatcagcaatgtgaaggtgaaccccaagacagacaagccctatgaagatgtgtccatcatcaacatcaccgtgaagtag

SEQ ID NO: 16387 - DNA, 1851 bp, Artificial Sequence
  Description of Artificial Sequence: Synthetic coding sequence
atgaggaggaccaagtctgctggcctggacctgtacctgtggaggcagcactggccccggcggggcaagcagccccatgaggtgggcatcagcaacagctacctggtgctggagtttgagcgggtgtacctggacaacctgcccagcgcctccatgtatgaaagaagctacatgcacagagatgtgatcacccacgtggtgtgcaccaagacagacttcatcatcacagccagccatgatggccacgtgaagttctggaagaagattgaggagggcattgaatttgtgaagcacttccgcagccacctgggcgtcatcgagagcattgctgtgtcctctgagggcgccctcttctgcagcgtgggagatgacaaggccatgaaggtgtttgatgtggtgaactttgacatgatcaacatgctgaagctgggctacttccctggccagtgtgagtggatctactgccctggagatgccatcagctctgtggccgccagcgagaagagcacaggcaagatcttcatctatgatggccgcggggacaaccagcccctgcacatctttgacaagctgcacaccagccccctgacccagatccggctgaaccctgtgtacaaggctgtggtgtccagtgacaagagcggcatgattgagtactggacaggcccccctcatgagtacaagttccccaagaatgtgaactgggagtacaagacagacacagacctgtatgaatttgccaagtgcaaggcctaccccacctctgtgtgcttctccccagatggcaagaagatcgccaccatcggcagtgacaggaaggtgcgcatcttccgctttgtgacaggcaagctgatgagggtgtttgatgagagcctgtccatgttcacagagctgcagcagatgaggcagcagctgcctgacatggagtttggccgcaggatggctgtggagcgggagctggagaaggtggatgctgtgcggctcatcaacatcgtgtttgatgagaccggccactttgtgctgtatggcaccatgctgggcatcaaggtgatcaacgtggagaccaacagatgtgtgcgcatcctgggcaagcaggagaacatccgggtgatgcagctggccctcttccagggcatcgccaagaagcacagagctgccaccaccatcgagatgaaggcctctgaaaatcctgtgctgcagaacatccaggccgaccccaccatcgtgtgcaccagcttcaagaagaaccgcttctacatgttcaccaagcgggagcctgaggacaccaagtctgctgacagcgacagagatgtgttcaatgagaagcccagcaaggaggaggtgatggccgccacccaggccgagggccccaagagggtgtctgattctgccatcatccacacctccatgggagacatccacaccaagctgtttcctgtggagtgccccaagacagtggagaacttctgtgtgcacagcagaaatggctactacaacggccacaccttccaccgcatcatcaagggcttcatgatccagacaggagaccccaccggcaccggcatgggcggggagagcatctggggcggggagtttgaagatgagttccacagcaccctgcggcatgaccggccctacaccctgtccatggccaatgccggcagcaacaccaacggcagccagttcttcatcaccgtggtgcccaccccctggctggacaacaagcacacagtgtttggccgggtgaccaagggcatggaggtggtgcagaggatcagcaatgtgaaggtgaaccccaagacagacaagccctatgaagatgtgtccatcatcaacatcaccgtgaagtag

SEQ ID NO: 16388 - DNA, 1473 bp, Artificial Sequence
  Description of Artificial Sequence: Synthetic coding sequence
atgaaggtgtttgatgtggtgaactttgacatgatcaacatgctgaagctgggctacttccctggccagtgtgagtggatctactgccctggagatgccatcagctctgtggccgccagcgagaagagcacaggcaagatcttcatctatgatggccgcggggacaaccagcccctgcacatctttgacaagctgcacaccagccccctgacccagatccggctgaaccctgtgtacaaggctgtggtgtccagtgacaagagcggcatgattgagtactggacaggcccccctcatgagtacaagttccccaagaatgtgaactgggagtacaagacagacacagacctgtatgaatttgccaagtgcaaggcctaccccacctctgtgtgcttctccccagatggcaagaagatcgccaccatcggcagtgacaggaaggtgcgcatcttccgctttgtgacaggcaagctgatgagggtgtttgatgagagcctgtccatgttcacagagctgcagcagatgaggcagcagctgcctgacatggagtttggccgcaggatggctgtggagcgggagctggagaaggtggatgctgtgcggctcatcaacatcgtgtttgatgagaccggccactttgtgctgtatggcaccatgctgggcatcaaggtgatcaacgtggagaccaacagatgtgtgcgcatcctgggcaagcaggagaacatccgggtgatgcagctggccctcttccagggcatcgccaagaagcacagagctgccaccaccatcgagatgaaggcctctgaaaatcctgtgctgcagaacatccaggccgaccccaccatcgtgtgcaccagcttcaagaagaaccgcttctacatgttcaccaagcgggagcctgaggacaccaagtctgctgacagcgacagagatgtgttcaatgagaagcccagcaaggaggaggtgatggccgccacccaggccgagggccccaagagggtgtctgattctgccatcatccacacctccatgggagacatccacaccaagctgtttcctgtggagtgccccaagacagtggagaacttctgtgtgcacagcagaaatggctactacaacggccacaccttccaccgcatcatcaagggcttcatgatccagacaggagaccccaccggcaccggcatgggcggggagagcatctggggcggggagtttgaagatgagttccacagcaccctgcggcatgaccggccctacaccctgtccatggccaatgccggcagcaacaccaacggcagccagttcttcatcaccgtggtgcccaccccctggctggacaacaagcacacagtgtttggccgggtgaccaagggcatggaggtggtgcagaggatcagcaatgtgaaggtgaaccccaagacagacaagccctatgaagatgtgtccatcatcaacatcaccgtgaagtag

SEQ ID NO: 16389 - DNA, 906 bp, Artificial Sequence
  Description of Artificial Sequence: Synthetic coding sequence
atggccaccaccaagagggtgctgtatgtgggcggcctggccgaggaggtggatgacaaggtgctgcacgccgccttcatcccctttggagacatcacagacatccagatccccctggactatgaaacagagaagcaccggggctttgcctttgtggagtttgagctggccgaggatgctgctgctgccatcgacaacatgaatgaaagtgagctgtttggaagaaccatccgggtgaacctggccaagcccatgaggatcaaggagggcagcagcaggcctgtgtggagcgatgatgactggctgaagaagttcagcggcaagaccctggaggagaacaaggaggaggagggcagcgagccccccaaggccgagacccaggagggggagcccatcgccaagaaggcccggagcaacccccaggtgtacatggacatcaagattggcaacaagccagctggccgcatccagatgctgctgcggagtgatgtggtgcccatgacagctgagaacttccgctgcctgtgcacccatgagaagggcttcggcttcaagggcagcagcttccaccgcatcatcccccagttcatgtgccagggcggggacttcaccaaccacaatggaactggaggcaagagcatctacggcaagaagtttgatgatgagaacttcatcctgaagcacactggacctggcctgctgtccatggccaacagcggccccaacaccaacggcagccagttcttcctgacctgtgacaagacagactggctggatggcaagcacgtggtgtttggagaggtgacagagggcctggatgtgctgcggcagatcgaggcccagggcagcaaggatggcaagcccaagcagaaggtgatcatcgctgactgtggggagtatgtgtag

SEQ ID NO: 16390 - DNA, 891 bp, Artificial Sequence
  Description of Artificial Sequence: Synthetic coding sequence
atggccaccaccaagagggtgctgtatgtgggcggcctggccgaggaggtggatgacaaggtgctgcacgccgccttcatcccctttggagacatcacagacatccagatccccctggactatgaaacagagaagcaccggggctttgcctttgtggagtttgagctggccgaggatgctgctgctgccatcgacaacatgaatgaaagtgagctgtttggaagaaccatccgggtgaacctggccaagcccatgaggatcaaggagggcagcagcaggcctgtgtggagcgatgatgactggctgaagaagttcagcggcaagaccctggaggagaacaaggaggaggagggcagcgagccccccaaggccgagacccaggagggggagcccatcgccaagaaggcccggagcaacccccaggtgtacatggacatcaagattggcaacaagccagctggccgcatccagatgctgctgcggagtgatgtggtgcccatgacagctgagaacttccgctgcctgtgcacccatgagaagggcttcggcttcaagggcagcagcttccaccgcatcatcccccagttcatgtgccagggcggggacttcaccaaccacaatggaactggaggcaagagcatctacggcaagaagtttgatgatgagaacttcatcctgaagcacactggacctggcctgctgtccatggccaacagcggccccaacaccaacggcagccagttcttcctgacctgtgacaagacagactggctggatggcaagcacgtggtgtttggagaggtgacagagggcctggatgtgctgcggcagatcgagaagcaggaggagagcgccatcaccagccagcccaggtcctggaagctgacctag

SEQ ID NO: 16391 - DNA, 945 bp, Artificial Sequence
  Description of Artificial Sequence: Synthetic coding sequence
atggccaccaccaagagggtgctgtatgtgggcggcctggccgaggaggtggatgacaaggtgctgcacgccgccttcatcccctttggagacatcacagacatccagatccccctggactatgaaacagagaagcaccggggctttgcctttgtggagtttgagctggccgaggatgctgctgctgccatcgacaacatgaatgaaagtgagctgtttggaagaaccatccgggtgaacctggccaagcccatgaggatcaaggagggcagcagcaggcctgtgtggagcgatgatgactggctgaagaagttcagcggcaagaccctggaggagaacaaggaggaggagggcagcgagccccccaaggccgagacccaggagggggagcccatcgccaagaaggcccggagcaacccccaggtgtacatggacatcaagattggcaacaagccagctggccgcatccagatgctgctgcggagtgatgtggtgcccatgacagctgagaacttccgctgcctgtgcacccatgagaagggcttcggcttcaagggcagcagcttccaccgcatcatcccccagttcatgtgccagggcggggacttcaccaaccacaatggaactggaggcaagagcatctacggcaagaagtttgatgatgagaacttcatcctgaagcacactggacctggcctgctgtccatggccaacagcggccccaacaccaacggcagccagttcttcctgacctgtgacaagacagactggctggatggcaagcacgtggtgtttggagaggtgacagagggcctggatgtgctgcggcagatcgaggtggccccagacaccaaggccagcaaggcccggggcagcaggaagaacaaggatggccaggagaggaactggggcaagagccagaaggtggagagccacaccatctag

SEQ ID NO: 16392 - DNA, 6243 bp, Artificial Sequence
  Description of Artificial Sequence: Synthetic coding sequence
atgagcagcagccccagccgctctgctgctgacatctacatccgggagtacttccacagccacgtgtctgggggccaccctgaggccacccccctgcgggtgatgtacacagaccggcccctgagccagacagatcctgtgaccctgcagtactgctgcctgacagatgaccggcaggccttccggccccccaccagggctgagctggcccggcaccgggtggtggtgaccaccaccagccaggcccgggagctgcgggtgcctgtgggcttcttcagccacatcctgattgatgaggccgcccagatgctggagtgtgaggccctgacccccctggcctatgccagccacggcacccggctggtgctggccggggaccacatgcaggtgacccccaggctcttctctgtggcccgggcccgggctgctgagcacaccctgctgcacaggctcttcctgtgctaccagcaggagacccatgaggtggcccggcagagccggctggtgttccacgagaactaccgctgcacagatgccatcgtgtccttcatcagccgccacttctacgtggccaagggcaaccccatccacgcccggggcaaggtgcccccccaccccaggcactaccccctgatgttctgccacgtggccggcagcccagaccgggacatgtccatggcctcctggctgaacctggccgagatcgcccaggtggtggagaaggtgcaggaggcctacaacacctggcccagctgctggggcggccgggagcagcgctgcatctgtgtggtgagccacggggcccaggtgtctgccctgcggcaggagctgcggcggcgggacctgggccaggtgtctgtgggcagctttgagatcctgcccggccggcagttccgggtggtggtgctgagcacagtgcacacctgccagagcctgctgagccctggggccctggcccctgagttcttcacagatgcccgggtgctgaacacagtgctgacccgggcccagagccagctggtggtggtgggagatgctgtggccctgtgcagctttggagcctgtgggaagctgtgggagagcttcatcagagaatgtgtggagcggcacagcgtgtgcccagagggcctgtccatggagcaggtggagcagggcgtggcccagaggcggcgctggccaccccggggcacccaggccggggccgccggcaactgggaggccgcccctgagcctgtgggggacctggccgaggagcaggccgctgtggtgacagccatggtgaaggccgagcctggagatgaggccctgagccctgccagccgggacatcacagccaccacagcccagacagaggccgccgccgccccagctggagatgctgtgaaggaggatgtggtgcctggggcctgtgccgccggggctgctgctgctgctggggtggagagcacagaagcagaagatgctgaggccgacttctggccctgggatggagagctgaatgctgatgatgccatcctgcgggagctgctggatgagagccagaaggtgatggtgacagtgggggaggatggcctgctggacacagtggcccggcctgagagcctgcagcaggcccggctgtatgagaacctgcccccagctgccctgaggaagctgctgcatgctgagcctgagcgctaccgccactgcagctttgtgcctgagacctttgagcgggccagcgccatccccctggatgatgccagcagcggccccatccaggtgcggggccgcctggactgtggcatggcctttgctggagatgaggtgctggtgcagctgctgagcggggacaaggcccctgagggccgcctgcggggccgggtgctgggcgtgctgaagaggaagagacatgagctggcctttgtgtgcaggatggacacctgggacccccgcatcatggtgcccatcaatggatctgtgaccaagatctttgtggccgagctgaaggaccccagccaggtgcccatctacagcctgaggaagggccgcctgcagagggtgggcctggagcggctgacagctgaggcccggcacagccgcctcttctgggtgcagatcgtgctgtggaggcagggcttctactaccccctgggcatcgtgcgggaggtgctgcctgaggccagcacctgggagcagggcctgcgcatcctgggcctggagtacagcctgcgggtgccccccagcgaccaggccaccatcaccaaggtgctgcagaagtaccacacagagctgggccgggtggccggccggcgggaggactgccgggccttcctgaccttcaccgtggacccccagggcgcctgcaacctggatgatgccctgtctgtgcgggacctgggcccccgctgtgaggtggccgtgcacatcacagatgtggccagctttgtgcccagagatggagtgctggatgtggaggcccggcggcagggcgccgccttctacgcccctggccgggagcctgtgcccatgctgcctgccagcctgtgccaggatgtgctgagcctgctgcccggccgggaccggctggccatcagcctcttcctgaccatggagaaggccagcggccagctgaagagcctgcgctttgcccccagcgtggtgcagagcgaccggcagctgtcctatgaggaggccgaggaggtgatccggcagcaccctggggccggccgggagctgcctgcccggctggacagcgtggatgcctgtgtggtggccgcctgctacttcagccggctgctgcggcggcaccggctgcggagtgactgcttctatgagcagccagatgaagatggcaccctgggcttccgggccgcccacatcatggtgaaggagtacatgatccagttcaaccggctggtggccgagttcctggtgggctctgaatgtaccaggacagtgacccccctgcgctggcagcctgcccccaggagccagcagctgaaggccctgtgtgagaagcatggagacagagtgcccctgagcctgcacctgggccaccacctgcacggcggcggcggcagccccccagacacccggctgcacctgctggccagcctgtggaagcaggtgcagtttgctgcccggacccaggactatgagcagatggtggacctggtgaccacagatgacatgcaccccttcctggccccagctggccgggacctgaggaaggccctggagaggtctgccttcggccgctgtgcccggggccaccagcagcagggcggccactacagcctgcaggtggactggtacacctgggccaccagccccatccgccgctacctggatgtggtgctgcagaggcagatcctgctggccctgggccacggcggcagcgcctacagcgcccgggacattgatggcctgtgccaggccttcagcctgcagcacgccctggcccagagctaccagaggcgggcccggagcctgcacctggccgtgcagctgaaggcccagcccctggacaagctgggctttgtggtggatgtggaggccggcagccgctgcttccggctgctcttccccagcaaccgggagaccctgcctgacccctgccctgtgccctacggcagcctgcagctggccgagcacccccacgccctggccggccggcccggcctgcggctgctgtggaggcggcgggtgtacagcgcccagggcagcagcccccccctgcccctgcccggcaccgtgcctgacccccacaccctggccgtggagacagccctgtggaagcagctgctggagctggtggagctgcagcgctggccagaggccgccgccctgatccaggagaagggggaggccagccagaggcgggagctggtgcaggtgcagaggagccactgcggccacttcctggaggtggcccgggagctgggcagcggggacaccctgcaggtgcagctgggcaccagcctgcagcacggcttcctggtgcccagcccccagctgtggacagtggcccctggcttcagcctgtgcctggagcacgtggagaggcctggggactgcttcagcggccgggtgtaccgggccccccgggaccgctacagagatgtggatgaatatgcctgtgtgtgggagcccttctgtgccctggagagcgccaccggggctgtggctgaaaatgacagcgtgaccctgcagcacctgtctgtgtcctgggaggccagcaggaccccccagggccagctgcagggcgccttccggctggaggccgccttcctggaggagaactgtgccgacatcaacttcagctgctgctacctgtgcatccggctggagggcctgcctgcccccacagccagccccaggcctggccccagcagcctgggccctggcctgaatgtggaccccggcacctacacctgggtggcccacggccagacccaggactgggaccaggagcggcgggctgaccggcaggaggcccccaggagagtgcacctgtttgtgcaccacatgggcatggagaaggtgcctgaggaggtgctgcggcccggcaccctcttcaccgtggagctgctgcccaagcagctgcctgacctgaggaaggaggaggccgtgcggggcctggaggaggccagccccctggtgaccagcatcgccctgggccggcctgtgccccagcccctgtgcagggtcatccccagccgcttcctggagcggcagacctacaacatccctgggggccgccacaagctgaaccccagccagaatgtggccgtgcgggaggccctggagaagcccttcaccgtcatccagggccccccaggcaccgggaagaccatcgtgggcctgcacatcgtgttctggttccacaagagcaaccaggagcaggtgcagcccggcggccccccaagaggagagaagaggctgggcggcccctgcatcctgtactgcggccccagcaacaagtctgtggatgtgctggccggcctgctgctgcggaggatggagctgaagcccctgcgggtgtacagcgagcaggccgaggccagcgagttccctgtgccccgggtgggcagcaggaagctgctgaggaagagcccccgggagggccggcccaaccagagcctgcggagcatcaccctgcaccaccgcatccggcaggcccccaacccctacagcagcgagatcaaggcctttgacacccggctgcagagaggagagctgttcagccgggaggacctggtgtggtacaagaaggtgctgtgggaggccaggaagtttgagctggacagacatgaagtcatcctgtgcacctgcagctgtgccgccagcgccagcctgaagatcctggatgtgcggcagatcctggtggatgaagctggcatggccacagagcctgagaccctcatccccctggtgcagttcccccaggccgagaaggtggtgctgctgggggaccacaagcagctgcggcctgtggtgaagaatgaaaggctgcagaacctgggcctggacaggagcctgtttgagcgctaccatgaagatgcccacatgctggacacccagtacaggatgcatgagggcatctgtgccttccccagcgtggccttctacaagagcaagctgaagacctggcagggcctgcggcggccccccagcgtgctgggccatgctgggaaggagagctgccctgtgatcttcggccacgtgcagggccacgagaggagcctgctggtgtccacagatgagggcaatgaaaacagcaaggccaacctggaggaggtggccgaggtggtgcgcatcaccaagcagctgaccctgggccgcacagtggagccccaggacattgctgtgctgaccccctacaatgcccaggccagcgagatcagcaaggccctgcggcgggagggcattgctggggtggccgtgagcagcatcaccaagagccagggcagcgagtggaggtatgtgctggtgtccacagtgaggacctgtgccaagagtgacctggaccagaggcccaccaagtcctggctgaagaagttcctgggctttgtggtggaccccaaccaggtgaatgtggccgtgacccgggcccaggagggcctgtgcctgattggagaccacctgctgctgcgctgctgccccctgtggaggagcctgctggacttctgtgaggcccagcagaccctggtgcctgctggccaggtgcgggtgtgccggcggcccaccatgcccagctag

SEQ ID NO: 16393 - DNA, 7950 bp, Artificial Sequence
  Description of Artificial Sequence: Synthetic coding sequence
atggctgtgtgggaggccgagcagctgggcggcctgcagagaggagacctgctgaccccaccagccccagatggagatggccgcacagcccccctgggccagcccccaggggcccagctgtactgcccagcctgcctggtgacctgccacagccaggaggcctttgagaaccactgtgccagcagcgagcacgcccagatggtggcctttgaccaggccctgccctgggagcacaggagccccccacctggcctgagcaagtttgagctgtgccccaagccagacctgtgtgaatatggagatgcctgcaccaaggcccacagcgcccaggagctgcaggagtgggtgcggaggacccaggccgtggagctgcggggccaggccgcctggcaggacggcctggtgccctaccaggagcggctgctggccgagtaccagaggagcagcagcgaggtgctggtgctggccgagaccctggatggagtgcgggtgacctgcaaccagcccctgatgtaccaggcccaggagaggaagacccagtacagctggacctttgctgtgcacagcgaggagcccctgctgcacgtggccctgctgaagcaggagcctggagctgacttcagcctggtggcccctggcctgcccccaggccgcctgtatgcccggggggagcgcttccgggtgcccagcagcacagctgacttccaggtgggcgtgcgggtgcaggccgccagctttggcacctttgagcagtgggtggtgtttgattttggaagaagacctgtgctgctgcagaagctgggcctgcagctgggccagggcagaagacctggcccctgcaggaacctggccctgggccaccctgaggagatggagcgctggcacacaggcaacagacatgtggtgcctggggtggagaggacagctgagcagacagccctgatggccaagtacaagggccctgccctggccctggagttcaacagaagctctgtggccagcggccccatcagccccaccaactaccggcagaggatgcaccagttcctgtatgaggaggaggccgcccagcagcagctggtggccaagctgaccctgcggggccaggtgttcctgaagacagccctgcagaccccagccctgaacatgctgtttgcccctcctggggccctgtatgcagaggtgcctgtgcccagcagcctgatgccagacacagaccagggcttcctgctgggccgggctgtgtccacagccctggtggcccctgtgcctgccccagacaacacagtgtttgaggtgcggctggagcggcgggccagcagcgagcaggccctgtggctgctgctgcctgcccgctgctgcctggccctgggcctgcagcctgaggcccggctggtgctggaggtgcagttccagattgaccccatgaccttccggctgtggcaccaggccgtggacaccctgcctgaggagcagctggtggtgcctgacctgcccacctgtgccctgccccggccctggagcgtgccccccctgcggcggggcaacaggaagcaggagctggccgtggccctgattgctggctggggccctggagatggaagaagagtgccccccctgctgatctacggccccttcggcaccgggaagacctacaccctggccatggccagcctggaggtgatcagaagacctgagaccaaggtgctgatctgcacccacaccaacagcgctgctgacatctacatccgggagtacttccacagccacgtgtctgggggccaccctgaggccacccccctgcgggtgatgtacacagaccggcccctgagccagacagatcctgtgaccctgcagtactgctgcctgacagatgaccggcaggccttccggccccccaccagggctgagctggcccggcaccgggtggtggtgaccaccaccagccaggcccgggagctgcgggtgcctgtgggcttcttcagccacatcctgattgatgaagctgcccagatgctggagtgtgaggccctgacccccctggcctatgccagccacggcacccggctggtgctggccggggaccacatgcaggtgacccccaggctcttctctgtggcccgggcccgggctgctgagcacaccctgctgcacaggctcttcctgtgctaccagcaggagacccatgaggtggcccggcagagccggctggtgttccacgagaactaccgctgcacagatgccatcgtgtccttcatcagccgccacttctacgtggccaagggcaaccccatccacgcccggggcaaggtgcccccccaccccaggcactaccccctgatgttctgccacgtggccggcagcccagaccgggacatgtccatggcctcctggctgaacctggccgagatcgcccaggtggtggagaaggtgcaggaggcctacaacacctggcccagctgctggggcggccgggagcagcgctgcatctgtgtggtgtcccatggagcccaggtgtctgccctgcggcaggagctgcggcggcgggacctgggccaggtgtctgtgggcagctttgagatcctgcccggccggcagttccgggtggtggtgctgagcacagtgcacacctgccagagcctgctgagccctggggccctggcccctgagttcttcacagatgcccgggtgctgaacacagtgctgacccgggcccagagccagctggtggtggtgggagatgctgtggccctgtgcagctttggagcctgtgggaagctgtgggagagcttcatccgggagtgtgtggagcggcacagcgtgtgcccagagggcctgtccatggagcaggtggagcagggcgtggcccagaggcggcgctggccaccccggggcacccaggccggggctgctggcaactgggaggccgcccctgagcctgtgggggacctggccgaggagcaggccgctgtggtgacagccatggtgaaggccgagcctggagatgaggccctgagccctgccagccgggacatcacagccaccacagcccagacagaagctgctgctgccccagctggagatgctgtgaaggaggatgtggtgcctggggcctgtgccgccggggctgctgctgctgctggggtggagagcacagaagcagaagatgctgaggccgacttctggccctgggatggagagctgaatgctgatgatgccatcctgcgggagctgctggatgagagccagaaggtgatggtgacagtgggagaagatggcctgctggacacagtggcccggcctgagagcctgcagcaggcccggctgtatgagaacctgcccccagctgccctgaggaagctgctgcacgccgagcctgagcgctaccgccactgcagctttgtgcctgagacctttgagcgggccagcgccatccccctggatgatgccagcagcggccccatccaggtgcggggccgcctggactgtggcatggcctttgctggagatgaggtgctggtgcagctgctgagcggggacaaggcccctgagggccgcctgcggggccgggtgctgggcgtgctgaagaggaagagacatgagctggcctttgtgtgcaggatggacacctgggacccccgcatcatggtgcccatcaatggatctgtgaccaagatctttgtggccgagctgaaggaccccagccaggtgcccatctacagcctgaggaagggccgcctgcagagggtgggcctggagcggctgacagctgaggcccggcacagccgcctcttctgggtgcagatcgtgctgtggaggcagggcttctactaccccctgggcatcgtgcgggaggtgctgcctgaggccagcacctgggagcagggcctgcgcatcctgggcctggagtacagcctgcgggtgcccccaagtgaccaggccaccatcaccaaggtgctgcagaagtaccacacagagctgggccgggtggccggcagaagagaggactgccgggccttcctgaccttcaccgtggacccccagggcgcctgcaacctggatgatgccctgtctgtgcgggacctgggcccccgctgtgaggtggccgtgcacatcacagatgtggccagctttgtgcccagagatggagtgctggatgtggaggcccggcggcagggcgccgccttctacgcccctggccgggagcctgtgcccatgctgcctgccagcctgtgccaggatgtgctgagcctgctgcccggccgggaccggctggccatcagcctcttcctgaccatggagaaggccagcggccagctgaagagcctgcgctttgcccccagcgtggtgcagagcgaccggcagctgtcctatgaggaggccgaggaggtgatccggcagcaccctggagctggccgggagctgcctgcccggctggacagcgtggatgcctgtgtggtggccgcctgctacttcagccggctgctgcggcggcaccggctgcggagtgactgcttctatgagcagccagatgaagatggcaccctgggcttccgggccgcccacatcatggtgaaggagtacatgatccagttcaaccggctggtggccgagttcctggtgggcagcgagtgcaccaggacagtgacccccctgcgctggcagcctgcccccaggagccagcagctgaaggccctgtgtgagaagcacggggacagagtgcccctgagcctgcacctgggccaccacctgcatggaggcggcggcagccccccagacacccggctgcacctgctggccagcctgtggaagcaggtgcagtttgctgcccggacccaggactatgagcagatggtggacctggtgaccacagatgacatgcaccccttcctggccccagctggccgggacctgaggaaggccctggagaggtctgccttcggccgctgtgcccggggccaccagcagcagggcggccactacagcctgcaggtggactggtacacctgggccaccagccccatccgccgctacctggatgtggtgctgcagaggcagatcctgctggccctgggccatggaggcagcgcctacagcgcccgggacattgatggcctgtgccaggccttcagcctgcagcacgccctggcccagagctaccagaggcgggcccggagcctgcacctggccgtgcagctgaaggcccagcccctggacaagctgggctttgtggtggatgtggaggccggcagccgctgcttccggctgctcttccccagcaaccgggagaccctgcctgacccctgccctgtgccctacggcagcctgcagctggccgagcacccccacgccctggccggccggcccggcctgcggctgctgtggaggagaagagtgtacagcgcccagggcagcagcccccccctgcccctgcccggcaccgtgcctgacccccacaccctggccgtggagacagccctgtggaagcagctgctggagctggtggagctgcagcgctggccagaggccgccgccctgatccaggagaagggggaggccagccagaggcgggagctggtgcaggtgcagaggagccactgcggccacttcctggaggtggcccgggagctgggcagcggggacaccctgcaggtgcagctgggcaccagcctgcagcacggcttcctggtgcccagcccccagctgtggacagtggcccctggcttcagcctgtgcctggagcacgtggagaggcctggggactgcttcagcggccgggtgtaccgggccccccgggaccgctacagagatgtggatgaatatgcctgtgtgtgggagcccttctgtgccctggagagcgccactggagctgtggccgagaatgattctgtgaccctgcagcacctgtctgtgtcctgggaggccagcaggaccccccagggccagctgcagggcgccttccggctggaggccgccttcctggaggagaactgtgccgacatcaacttcagctgctgctacctgtgcatccggctggagggcctgcctgcccccacagccagcccccggcccggccccagcagcctgggccctggcctgaatgtggaccccggcacctacacctgggtggcccacggccagacccaggactgggaccaggagaggagagctgaccggcaggaggccccccggcgggtgcacctgtttgtgcaccacatgggcatggagaaggtgcctgaggaggtgctgcggcccggcaccctcttcaccgtggagctgctgcccaagcagctgcctgacctgaggaaggaggaggccgtgcggggcctggaggaggccagccccctggtgaccagcatcgccctgggccggcctgtgccccagcccctgtgcagggtcatccccagccgcttcctggagcggcagacctacaacatccctgggggccgccacaagctgaaccccagccagaatgtggccgtgcgggaggccctggagaagcccttcaccgtcatccagggccccccaggcaccgggaagaccatcgtgggcctgcacatcgtgttctggttccacaagagcaaccaggagcaggtgcagcccggcggccccccaagaggagagaagaggctgggcggcccctgcatcctgtactgcggccccagcaacaagtctgtggatgtgctggccggcctgctgctgcggaggatggagctgaagcccctgcgggtgtacagcgagcaggccgaggccagcgagttccctgtgccccgggtgggcagcaggaagctgctgaggaagagcccccgggagggccggcccaaccagagcctgcggagcatcaccctgcaccaccgcatccggcaggcccccaacccctacagcagcgagatcaaggcctttgacacccggctgcagagaggagagctgttcagccgggaggacctggtgtggtacaagaaggtgctgtgggaggccaggaagtttgagctggacagacatgaggtgatcctgtgcacctgcagctgtgccgccagcgccagcctgaagatcctggatgtgcggcagatcctggtggatgaggccggcatggccacagagcctgagaccctcatccccctggtgcagttcccccaggccgagaaggtggtgctgctgggggaccacaagcagctgcggcctgtggtgaagaatgaaaggctgcagaacctgggcctggacaggagcctgtttgagcgctaccatgaagatgcccacatgctggacacccagtacaggatgcatgagggcatctgtgccttccccagcgtggccttctacaagagcaagctgaagacctggcagggcctgcggcggcccccatctgtgctgggccacgccggcaaggagagctgccctgtgatctttggacatgtgcagggccacgagaggagcctgctggtgtccacagatgagggcaatgaaaacagcaaggccaacctggaggaggtggccgaggtggtgcgcatcaccaagcagctgaccctgggccgcacagtggagccccaggacattgctgtgctgaccccctacaatgcccaggccagcgagatcagcaaggccctgcggcgggagggcattgctggggtggccgtgagcagcatcaccaagagccagggcagcgagtggaggtatgtgctggtgtccacagtgaggacctgtgccaagagtgacctggaccagaggcccaccaagtcctggctgaagaagttcctgggctttgtggtggaccccaaccaggtgaatgtggccgtgacccgggcccaggagggcctgtgcctgattggagaccacctgctgctgcgctgctgccccctgtggaggagcctgctggacttctgtgaggcccagcagaccctggtgcctgctggccaggtgcgggtgtgcagaagacccaccatgcccagctag

SEQ ID NO: 16394 - DNA, 4995 bp, Artificial Sequence
  Description of Artificial Sequence: Synthetic coding sequence
atggccgcccggcggggcagaagagatggagtggcccccccacccagcggcggccctggccctgaccccggcggcggggcccggggcagcggctggggcagccgcagccaggccccctacggcaccctgggcgctgtgtctggaggagagcaggtgctgctgcacgaggaggccggggacagcggctttgtgtccctgagccggctgggccccagcctgcgggacaaggacctggagatggaggagctgatgctgcaggatgagaccctgctgggcaccatgcagagctacatggatgccagcctcatcagcctgattgaagattttggcagcctgggggagagccggctgagcctggaggaccagaatgaggtgtccctgctgacagccctgacagagatcctggacaatgctgacagcgagaacctgagcccctttgacagcatcccagacagcgagctgctggtgagcccccgggagggcagcagcctgcacaagctgctgaccctgagcaggaccccacctgagcgggacctgatcacccctgtggaccccctgggccccagcacaggcagcagccggggcagcggcgtggagatgagcctgcctgaccccagctgggacttcagccccccatccttcctggagaccagcagccccaagctgcccagctggaggcctcccaggagccggccccgctggggccagagccccccaccccagcagaggagtgatggagaggaggaggaggaggtggccagcttcagcggccagatcctggccggggagctggacaactgtgtgagcagcatcccagacttccccatgcacctggcctgcccagaggaggaggacaaggccacagctgctgagatggctgtgcctgctgctggagatgagagcatcagcagcctgtctgagctggtgcgggccatgcacccctactgcctgcccaacctgacccacctggccagcctggaggatgagctgcaggagcagccagatgacctgaccctgcctgagggctgtgtggtgctggagatcgtgggccaggccgccacagctggagatgacctggagatccctgtggtggtgcggcaggtgtccccaggccccaggcctgtgctgctggatgacagcctggagaccagcagcgccctgcagctgctgatgcccaccctggagagcgagacagaggccgctgtgcccaaggtgaccctgtgcagcgagaaggagggcctgagcctgaacagcgaggagaagctggacagcgcctgcctgctgaagccccgggaggtggtggagcctgtggtgcccaaggagccccagaaccccccagccaatgctgcccctggcagccagagggccaggaagggcaggaagaagaagagcaaggagcagcctgctgcctgtgtggagggctacgcccggcggctgcggagcagcagccggggccagagcacagtgggcacagaggtgaccagccaggtggacaacctgcagaagcagccccaggaggagctgcagaaggagagcggccccctgcagggcaagggcaagccccgggcctgggcccgggcctgggccgccgccctggagaacagcagccccaagaacctggagaggtctgctggccagagcagccctgccaaggagggccccctggacctgtaccccaagctggccgacaccatccagaccaaccccatccccacccacctgagcctggtggacagcgcccaggccagccccatgcctgtggacagcgtggaggccgaccccacagctgtgggccctgtgctggccggccctgtgcctgtggaccccggcctggtggacctggccagcaccagcagcgagctggtggagcccctgcctgctgagcctgtgctgatcaaccctgtgctggccgacagcgctgctgtggaccctgctgtggtgcccatcagtgacaacctgccccctgtggatgctgtgcccagcggccctgcccctgtggacctggccctggtggaccctgtgcccaatgacctgacccctgtggaccctgtgctggtgaagagccggcccacagaccccaggagaggagctgtgagcagcgccctgggcggcagcgccccccagctgctggtggagagcgagagcctggacccccccaagaccatcatccctgaggtgaaggaggtggtggacagcctgaagattgaaagtggcaccagcgccaccacccatgaggcccggccccggcccctgagcctgtctgagtacagaagaagacggcagcagaggcaggccgagacagaggagaggagcccccagccccccaccgggaagtggcccagcctgcctgagacccccaccggcctggccgacatcccctgcctggtgatccccccagccccagccaagaagacagccctgcagaggagccctgagacccccctggagatctgcctggtgcctgtgggccccagccctgccagccccagccctgagccccctgtgtccaagcctgtggccagcagccccacagagcaggtgcccagccaggagatgcccctgctggcccggcccagcccccctgtgcagagcgtgtccccagctgtgcccaccccacccagcatgtctgctgccctgcccttccctgctgggggcctgggcatgccacccagcctgcccccaccacccctgcagccccccagcctgcccctgtccatgggccctgtgctgcctgaccccttcacccactacgcccccctgcccagctggccctgctacccccacgtgagccccagcggctacccctgcctgcccccaccacccaccgtgcccctggtgtctggcacccctggggcctatgctgtgccccccacctgcagcgtgccctgggcccctcctccagcccctgtgagcccctacagcagcacctgcacctacggccccctgggctggggccctggcccccagcacgcccccttctggagcacagtgcccccaccacccctgcccccagccagcatcggccgggctgtgccccagcccaagatggagagccggggcaccccagctggccccccagaaaatgtgctgcccctgtccatggccccacccctgagcctgggcctgcccggccatggagccccccagacagagcccaccaaggtggaggtgaagcctgtgcctgccagcccccaccccaagcacaaggtgtctgccctggtgcagagcccccagatgaaggccctggcctgtgtgtctgctgagggcgtgacagtggaggagcccgccagcgagcggctgaagccagagacccaggagacccggccccgggagaagccacccctgcctgccaccaaggctgtgcccaccccccggcagagcacagtgcccaagctgcctgctgtgcacccagcccggctgaggaagctgtccttcctgcccacccccaggacccagggctctgaagatgtggtgcaggccttcatcagcgagattggaattgaggccagtgacctgagcagcctgctggagcagtttgagaagtctgaggccaagaaggaatgtcctcctccagccccagctgacagcctggccgtgggcaacagcggcggcgtggacatcccccaggagaagaggcccctggaccggctgcaggcccctgagctggccaacgtggccggcctgaccccaccagccaccccaccccaccagctgtggaagcccctggccgctgtgtccctgctggccaaggccaagagccccaagagcacagcccaggagggcaccctgaagccagagggcgtgacagaggccaagcaccctgctgctgtgcggctgcaggagggcgtgcacggccccagccgggtgcacgtgggcagcggggaccatgactactgtgtgcgcagcaggaccccacccaagaagatgcctgccctggtgattcctgaggtgggcagccgctggaatgtgaagaggcaccaggacatcaccatcaagcctgtgctgagcctgggccctgctgcccctcctccaccctgcatcgccgccagccgggagcccctggaccacaggaccagcagcgagcaggccgaccccagcgccccctgcctggcccccagcagcctgctgagccctgaggccagcccctgcagaaatgacatgaacaccaggaccccacctgagcccagcgccaagcagaggtccatgcgctgctacaggaaggcctgccgcagcgccagccccagcagccagggctggcagggccggcggggcaggaacagccgctctgtgagcagcggcagcaacagaaccagcgaggccagcagcagcagcagcagcagcagcagcagcagccgcagccgcagccgcagcctgagccccccccacaagcgctggaggaggagcagctgcagcagcagcggccgcagccgccgctgcagcagcagcagcagcagcagcagcagcagcagcagcagcagcagcagcagcagcagcagccgcagccgcagccgcagccccagcccccggcggcggagtgacagaagaagacgctacagcagctaccgcagccatgaccactaccagaggcagagggtgctgcagaaggagcgggccatcgaggagcggcgggtggtgttcatcggcaagatccctggccgcatgaccaggtctgagctgaagcagcgcttctctgtgtttggagaaattgaagaatgtaccatccacttccgggtgcagggcgacaactacggctttgtgacctaccgctatgcagaggaggcctttgctgccatcgagagcggccacaagctgcggcaggctgatgagcagccctttgacctgtgcttcggcggccggcggcagttctgcaagaggagctacagcgacctggacagcaacagagaagattttgatcctgcccctgtgaagagcaagtttgacagcctggactttgacaccctgctgaagcaggcccagaagaacctgcggaggtag

SEQ ID NO: 16395 - DNA, 4203 bp, Artificial Sequence
  Description of Artificial Sequence: Synthetic coding sequence
atggccgcccggcggggcagaagagatggagtggcccccccacccagcggcggccctggccctgaccccggcggcggggcccggggcagcggctggggcagccgcagccaggccccctacggcaccctgggcgctgtgtctggaggagagcaggtgctgctgcacgaggaggccggggacagcggctttgtgtccctgagccggctgggccccagcctgcgggacaaggacctggagatggaggagctgatgctgcaggatgagaccctgctgggcaccatgcagagctacatggatgccagcctcatcagcctgattgaagattttggcagcctgggggagagccggctgagcctggaggaccagaatgaggtgtccctgctgacagccctgacagagatcctggacaatgctgacagcgagaacctgagcccctttgacagcatcccagacagcgagctgctggtgagcccccgggagggcagcagcctgcacaagctgctgaccctgagcaggaccccacctgagcgggacctgatcacccctgtggaccccctgggccccagcacaggcagcagccggggcagcggcgtggagatgagcctgcctgaccccagctgggacttcagccccccatccttcctggagaccagcagccccaagctgcccagctggaggcctcccaggagccggccccgctggggccagagccccccaccccagcagaggagtgatggagaggaggaggaggaggtggccagcttcagcggccagatcctggccggggagctggacaactgtgtgagcagcatcccagacttccccatgcacctggcctgcccagaggaggaggacaaggccacagctgctgagatggctgtgcctgctgctggagatgagagcatcagcagcctgtctgagctggtgcgggccatgcacccctactgcctgcccaacctgacccacctggccagcctggaggatgagctgcaggagcagccagatgacctgaccctgcctgagggctgtgtggtgctggagatcgtgggccaggccgccacagctggagatgacctggagatccctgtggtggtgcggcaggtgtccccaggccccaggcctgtgctgctggatgacagcctggagaccagcagcgccctgcagctgctgatgcccaccctggagagcgagacagaggccgctgtgcccaaggtgaccctgtgcagcgagaaggagggcctgagcctgaacagcgaggagaagctggacagcgcctgcctgctgaagccccgggaggtggtggagcctgtggtgcccaaggagccccagaaccccccagccaatgctgcccctggcagccagagggccaggaagggcaggaagaagaagagcaaggagcagcctgctgcctgtgtggagggctacgcccggcggctgcggagcagcagccggggccagagcacagtgggcacagaggtgaccagccaggtggacaacctgcagaagcagccccaggaggagctgcagaaggagagcggccccctgcagggcaagggcaagccccgggcctgggcccgggcctgggccgccgccctggagaacagcagccccaagaacctggagaggtctgctggccagagcagccctgccaaggagggccccctggacctgtaccccaagctggccgacaccatccagaccaaccccatccccacccacctgagcctggtggacagcgcccaggccagccccatgcctgtggacagcgtggaggccgaccccacagctgtgggccctgtgctggccggccctgtgcctgtggaccccggcctggtggacctggccagcaccagcagcgagctggtggagcccctgcctgctgagcctgtgctgatcaaccctgtgctggccgacagcgctgctgtggaccctgctgtggtgcccatcagtgacaacctgccccctgtggatgctgtgcccagcggccctgcccctgtggacctggccctggtggaccctgtgcccaatgacctgacccctgtggaccctgtgctggtgaagagccggcccacagaccccaggagaggagctgtgagcagcgccctgggcggcagcgccccccagctgctggtggagagcgagagcctggacccccccaagaccatcatccctgaggtgaaggaggtggtggacagcctgaagattgaaagtggcaccagcgccaccacccatgaggcccggccccggcccctgagcctgtctgagtacagaagaagacggcagcagaggcaggccgagacagaggagaggagcccccagccccccaccgggaagtggcccagcctgcctgagacccccaccggcctggccgacatcccctgcctggtgatccccccagccccagccaagaagacagccctgcagaggagccctgagacccccctggagatctgcctggtgcctgtgggccccagccctgccagccccagccctgagccccctgtgtccaagcctgtggccagcagccccacagagcaggtgcccagccaggagatgcccctgctggcccggcccagcccccctgtgcagagcgtgtccccagctgtgcccaccccacccagcatgtctgctgccctgcccttccctgctgggggcctgggcatgccacccagcctgcccccaccacccctgcagccccccagcctgcccctgtccatgggccctgtgctgcctgaccccttcacccactacgcccccctgcccagctggccctgctacccccacgtgagccccagcggctacccctgcctgcccccaccacccaccgtgcccctggtgtctggcacccctggggcctatgctgtgccccccacctgcagcgtgccctgggcccctcctccagcccctgtgagcccctacagcagcacctgcacctacggccccctgggctggggccctggcccccagcacgcccccttctggagcacagtgcccccaccacccctgcccccagccagcatcggccgggctgtgccccagcccaagatggagagccggggcaccccagctggccccccagaaaatgtgctgcccctgtccatggccccacccctgagcctgggcctgcccggccatggagccccccagacagagcccaccaaggtggaggtgaagcctgtgcctgccagcccccaccccaagcacaaggtgtctgccctggtgcagagcccccagatgaaggccctggcctgtgtgtctgctgagggcgtgacagtggaggagcccgccagcgagcggctgaagccagagacccaggagacccggccccgggagaagccacccctgcctgccaccaaggctgtgcccaccccccggcagagcacagtgcccaagctgcctgctgtgcacccagcccggctgaggaagctgtccttcctgcccacccccaggacccagggctctgaagatgtggtgcaggccttcatcagcgagattggaattgaggccagtgacctgagcagcctgctggagcagtttgagaagtctgaggccaagaaggaatgtcctcctccagccccagctgacagcctggccgtgggcaacagcggcagcagctgcagcagcagcggccgcagccgccgctgcagcagcagcagcagcagcagcagcagcagcagcagcagcagcagcagcagcagcagcagccgcagccgcagccgcagccccagcccccggcggcggagtgacagaagaagacgctacagcagctaccgcagccatgaccactaccagaggcagagggtgctgcagaaggagcgggccatcgaggagcggcgggtggtgttcatcggcaagatccctggccgcatgaccaggtctgagctgaagcagcgcttctctgtgtttggagaaattgaagaatgtaccatccacttccgggtgcagggcgacaactacggctttgtgacctaccgctatgcagaggaggcctttgctgccatcgagagcggccacaagctgcggcaggctgatgagcagccctttgacctgtgcttcggcggccggcggcagttctgcaagaggagctacagcgacctggacagcaacagagaagattttgatcctgcccctgtgaagagcaagtttgacagcctggactttgacaccctgctgaagcaggcccagaagaacctgcggaggtag

SEQ ID NO: 16396 - DNA, 537 bp, Artificial Sequence
  Description of Artificial Sequence: Synthetic coding sequence
atggctgatggcaaggctggagatgagaagccagagaagagccagagagctggagctgctgggggccctgaggaggaggccgagaagcctgtgaagaccaagacagtgagcagcagcaatggaggagagagcagcagccgctctgctgagaagaggtctgctgaggaggaggccgctgacctgcccaccaagcccaccaagatcagcaagtttggatttgccatcggcagccagaccaccaagaaggccagcgccatcagcatcaagctgggcagcagcaagcccaaggagaccgtgcccaccctggcccccaagaccctgtctgtggccgccgccttcaatgaagatgaagattctgagcctgaggagatgcctcctgaggccaagatgaggatgaagaacatcggccgggacacccccaccagcgctggccccaacagcttcaacaagggcaagcacggcttcagtgacaaccagaagctgtgggagaggaacatcaagagccacctgggcaatgtgcatgaccaggacaactag

SEQ ID NO: 16397 - DNA, 4950 bp, Artificial Sequence
  Description of Artificial Sequence: Synthetic coding sequence
atggatgatgacagcctggatgagctggtggcccggagccctggcccagatggccacccccaggtgggccctgctgaccctgctggggactttgaggagagctctgtgggcagcagcggggacagcggagatgacagcgacagcgagcacggagatggaacagatggagaagatgagggcgccagcgaggaggaggacctggaggacagaagtggcagcgaggacagtgaagatgatggagagaccctgctggaggtggccggcacccagggcaagctggaggccgccggcagcttcaacagtgatgatgatgctgagagctgccccatctgcctgaatgccttccgggaccaggccgtgggcaccccagagaactgtgcccactacttctgcctggactgcatcgtggagtggagcaagaatgccaacagctgccctgtggacaggaccctcttcaagtgcatctgcatccgggcccagtttggaggcaagatcctgaggaagatccctgtggagaacaccaaggccagcgaggaggaggaggaccccaccttctgtgaggtgtgtggccgcagtgacagagaagatcggctgctgctgtgtgatggctgtgatgctggctaccacatggagtgcctggacccccccctgcaggaggtgcctgtggatgagtggttctgcccagaatgtgccgcccctggggtggtgctggccgcagatgctggccctgtgtctgaggaggaggtgtccctgctgctggctgatgtggtgcccaccaccagccggctgcggcccagggctggccgcacccgggccatcgcccggacccggcagagcgagcgggtgcgggccaccgtgaacagaaaccgcatcagcacagccaggagagtgcagcacaccccaggccgcctgggcagcagcctgctggatgaggccattgaagctgtggccaccggcctgagcacagctgtgtaccagaggcccctgacccccaggaccccagcccggaggaagaggaagaccaggaggaggaagaaggtgcccggcaggaagaagaccccatctggccccagcgccaagagcaagagcagcgccaccaggagcaagaagaggcagcaccgggtgaagaagaggcggggcaagaaggtgaagtctgaggccaccaccaggagcagaattgcccggaccctgggcctgcggcggcctgtgcacagcagctgcatccccagcgtgctgaagcctgtggagcccagcctgggcctgctgcgggctgacatcggggccgccagcctgagcctgtttggagacccctatgagctggacccctttgacagcagcgaggagctgagcgccaaccccctgagccccctgagcgccaagagaagagccctgagccgcagcgccctgcagagccaccagcctgtggcccggcctgtgtctgtgggcctgagcagaagaaggctgcctgctgctgtgcctgagccagacctggaggaggagcctgtgcctgacctgctgggcagcatcctgagcggccagagcctgctgatgctgggcagcagtgatgtgatcatccacagagatggcagcctgagcgccaagagagctgcccctgtgtccttccagagaaattctggcagcctgagcagaggagaggagggcttcaagggctgcctgcagccccgggccctgcccagcggcagccctgcccagggccccagcggcaaccggccccagagcacaggcctgagctgccagggccgcagcaggaccccagccaggacagctggggcccctgtgcggctggacctgcctgctgcccctggagctgtgcaggccaggaacctgagcaatggatctgtgcccggcttccggcagagccacagcccctggttcaacggcaccaacaagcacaccctgcccctggccagcgctgccagcaagatcagcagccgggacagcaagccaccctgccgctctgtggtgcccggcccccccctgaagccagcccccaggagaacagacatcagcgagctgccccgcatccccaagatcagaagagatgatggcggcggcagaagagatgctgccccagcccacggccagagcattgagatccccagcgcctgcatcagccggctgaccggccgggagggcaccggccagcccggccggggcaccagggctgagagcgaggccagcagccgggtgccccgggagcccggggtgcacacaggcagcagccggcccccagcccccagcagccacggcagcctggcccccctgggccccagccggggcaagggcgtgggcagcacctttgagagcttccgcatcaacatccctggcaacatggcccacagcagccagctgagcagccctggcttctgcaacaccttccggcctgtggatgacaaggagcagaggaaagaaaaccccagccccctcttcagcatcaagaagaccaagcagctgcggtctgaggtgtatgaccccagcgaccccaccggcagtgacagcagcgcccctggcagcagccctgagaggagcggccctggcctgctgcccagcgagatcaccaggaccatcagcatcaacagccccaaggcccagacagtgcaggccgtgcgctgtgtgaccagctacacagtggagagcatcttcggcacagagcctgagccccccctgggccccagcagcgccatgagcaagctgcggggagctgtggccgctgagggcgccagtgacacagagcgggaggagcccacagagagccagggcctggccgcccggctgcggcggcccagccccccagagccctgggatgaggaggatggagccagctgcagcaccttctttggaagtgaggagaggacagtgacctgtgtgacagtggtggagcctgaggccccacccagcccagatgtgctgcaggccgccacccaccgggtggtggagctgcggccccccagccgcagccgcagcaccagcagcagccgcagcaggaagaaggccaagaggaagagggtgtcccgggagcacggccgcaccaggagcggcaccaggtctgagagccgggacaggagcagccgcagcgccagccccagcgtgggggaggagcggccccggcggcagaggagcaaggccaagagccgccgcagcagcagtgacaggagcagcagccgggagcgggccaagaggaagaaggccaaggacaagagccgggagcaccggcggggcccctggggccacagcaggaggaccagccgcagccgcagcggcagccctggcagcagcagctatgagcactatgagagcaggaagaagaagaagagaagaagtgccagccggccccggggccgggagtgcagccccaccagcagcctggagcggctgtgccgccacaagcaccagcgggagaggagccatgagaggccagacaggaaggagagcgtggcctggccccgggacaggaggaagagaagaagccgcagccccagcagcgagcaccgggcccgggagcaccggcggcccaggagccgggagaagtggccccagaccaggagccacagccctgagaggaaaggagctgtgcgggaggccagccctgcccccctggcccagggcgagcccggccgggaggacctgcccacccggctgcctgccctgggggaggcccacgtgtccccagaggtggccacagctgacaaggcccccctgcaggcccctcctgtgctggaggtggccgcagaatgtgagccagatgacctggacctggactatggagacagcgtggaggccggccacgtgtttgatgacttcagcagtgatgctgtgttcatccagctggatgacatgagcagcccccccagccctgagagcacagacagcagccctgagcgggacttccccctgaagccagccctgcccccagccagcctggccgtggccgccatccagcgggaggtgtccctgatgcatgatgaggaccccagccagcccccacccctgcctgagggcacccaggagccccacctgctgcggccagatgctgctgagaaggccgaggcccccagcagcccagatgtggccccagctgggaaggaggacagccccagcgccagcggccgggtgcaggaggccgcccggcctgaggaggtggtgtcccagacccccctgctgcggagccgggccctggtgaagagggtgacctggaacctgcaggagagcgagagcagcgccccagcagaagatcgggccccccgggcccccctgcaccggccccagaagccccgggagggcgcctgggacatggaggatgtggcccccaccggggtgcggcaggtgttttctgagctgcccttccccagccacgtgctgcctgagcccggcttcccagacacagaccccagccaggtgtacagccctggcctgcccccagccccagcccagcccagcagcatccccccctgtgccctggtgtcccagcccaccgtgcagttcatcctgcagggcagcctgcccctggtgggctgtggggccgcccagaccctggcccctgtgcctgctgccctgaccccagccagcgagcccgccagccaggccacagctgccagcaacagcgaggagaagaccccagccccccggctggccgctgagaagaccaagaaggaggagtacatgaagaagctgcacatgcaggagagagctgtggaggaggtgaagctggccatcaagcccttctaccagaagcgggaggtgaccaaggaggagtacaaggacatcctgaggaaggctgtgcagaagatctgccacagcaagagcggggagatcaaccctgtgaaggtggccaacctggtgaaggcctacgtggacaagtaccgccacatgagaagacacaagaagccagaggccggggaggagccccccacccagggcgctgagggctag

SEQ ID NO: 16398 - DNA, 4947 bp, Artificial Sequence
  Description of Artificial Sequence: Synthetic coding sequence
atggatgatgacagcctggatgagctggtggcccggagccctggcccagatggccacccccaggtgggccctgctgaccctgctggggactttgaggagagctctgtgggcagcagcggggacagcggagatgacagcgacagcgagcacggagatggaacagatggagaagatgagggcgccagcgaggaggaggacctggaggacagaagtggcagcgaggacagtgaagatgatggagagaccctgctggaggtggccggcacccagggcaagctggaggccgccggcagcttcaacagtgatgatgatgctgagagctgccccatctgcctgaatgccttccgggaccaggccgtgggcaccccagagaactgtgcccactacttctgcctggactgcatcgtggagtggagcaagaatgccaacagctgccctgtggacaggaccctcttcaagtgcatctgcatccgggcccagtttggaggcaagatcctgaggaagatccctgtggagaacaccaaggccagcgaggaggaggaggaccccaccttctgtgaggtgtgtggccgcagtgacagagaagatcggctgctgctgtgtgatggctgtgatgctggctaccacatggagtgcctggacccccccctgcaggaggtgcctgtggatgagtggttctgcccagaatgtgccgcccctggggtggtgctggccgcagatgctggccctgtgtctgaggaggaggtgtccctgctgctggctgatgtggtgcccaccaccagccggctgcggcccagggctggccgcacccgggccatcgcccggacccggcagagcgagcgggtgcgggccaccgtgaacagaaaccgcatcagcacagccaggagagtgcagcacaccccaggccgcctgggcagcagcctgctggatgaggccattgaagctgtggccaccggcctgagcacagctgtgtaccagaggcccctgacccccaggaccccagcccggaggaagaggaagaccaggaggaggaagaaggtgcccggcaggaagaagaccccatctggccccagcgccaagagcaagagcagcgccaccaggagcaagaagaggcagcaccgggtgaagaagaggcggggcaagaaggtgaagtctgaggccaccaccaggagcagaattgcccggaccctgggcctgcggcggcctgtgcacagcagctgcatccccagcgtgctgaagcctgtggagcccagcctgggcctgctgcgggctgacatcggggccgccagcctgagcctgtttggagacccctatgagctggacccctttgattctgaggagctgagcgccaaccccctgagccccctgagcgccaagaggcgggccctgagccgcagcgccctgcagagccaccagcctgtggcccggcctgtgtctgtgggcctgagcagaagaaggctgcctgctgctgtgcctgagccagacctggaggaggagcctgtgcctgacctgctgggcagcatcctgagcggccagagcctgctgatgctgggcagcagtgatgtgatcatccacagagatggcagcctgagcgccaagagagctgcccctgtgtccttccagaggaacagcggcagcctgagcagaggagaggagggcttcaagggctgcctgcagccccgggccctgcccagcggcagccctgcccagggccccagcggcaaccggccccagagcacaggcctgagctgccagggccgcagcaggaccccagccaggacagctggggcccctgtgcggctggacctgcctgctgcccctggagctgtgcaggccaggaacctgagcaatggatctgtgcccggcttccggcagagccacagcccctggttcaacggcaccaacaagcacaccctgcccctggccagcgctgccagcaagatcagcagccgggacagcaagccaccctgccgctctgtggtgcccggcccccccctgaagccagcccccaggagaacagacatcagcgagctgccccgcatccccaagatcagaagagatgatggcggcggcagaagagatgctgccccagcccacggccagagcattgagatccccagcgcctgcatcagccggctgaccggccgggagggcaccggccagcccggccggggcaccagggctgagagcgaggccagcagccgggtgccccgggagcccggggtgcacacaggcagcagccggcccccagcccccagcagccacggcagcctggcccccctgggccccagccggggcaaaggagtgggcagcacctttgagagcttccgcatcaacatccctggcaacatggcccacagcagccagctgagcagccctggcttctgcaacaccttccggcctgtggatgacaaggagcagaggaaggagaaccccagccccctcttcagcatcaagaagaccaagcagctgcggtctgaggtgtatgaccccagcgaccccactggaagtgacagcagcgcccctggcagcagccctgagaggagcggccctggcctgctgcccagcgagatcaccaggaccatcagcatcaacagccccaaggcccagacagtgcaggccgtgcgctgtgtgaccagctacacagtggagagcatctttggaacagagcctgagccccccctgggccccagcagcgccatgagcaagctgcggggagctgtggccgctgagggcgccagtgacacagagcgggaggagcccacagagagccagggcctggccgcccggctgcggcggcccagccccccagagccctgggatgaagaagatggagccagctgcagcaccttcttcggcagcgaggagaggacagtgacctgtgtgacagtggtggagcctgaggccccacccagcccagatgtgctgcaggccgccacccaccgggtggtggagctgcggccccccagccgcagccgcagcaccagcagcagccgcagcaggaagaaggccaagaggaagagggtgtcccgggagcacggccgcaccaggagcggcaccaggtctgagagccgggacaggagcagccgcagcgccagccccagcgtgggggaggagcggccccggcggcagaggagcaaggccaagagcagaagaagcagcagtgacaggagcagcagccgggagcgggccaagaggaagaaggccaaggacaagagccgggagcacagaagaggcccctggggccacagcaggaggaccagccgcagccgcagcggcagccctggcagcagcagctatgagcactatgagagcaggaagaagaagaagagaagaagtgccagccggccccggggcagagaatgtagccccaccagcagcctggagcggctgtgccgccacaagcaccagcgggagaggagccatgagaggccagacaggaaggagagcgtggcctggccccgggacaggaggaagaggaggagccgcagccccagcagcgagcaccgggcccgggagcacagaagacccaggagccgggagaagtggccccagaccaggagccacagccctgagaggaaaggagctgtgcgggaggccagccctgcccccctggcccagggcgagcccggccgggaggacctgcccacccggctgcctgccctgggggaggcccacgtgtccccagaggtggccacagctgacaaggcccccctgcaggcccctcctgtgctggaggtggccgcagaatgtgagccagatgacctggacctggactatggagacagcgtggaggccggccacgtgtttgatgacttcagcagtgatgctgtgttcatccagctggatgacatgagcagcccccccagccctgagagcacagacagcagccctgagcgggacttccccctgaagccagccctgcccccagccagcctggccgtggccgccatccagcgggaggtgtccctgatgcatgatgaggaccccagccagcccccacccctgcctgagggcacccaggagccccacctgctgcggccagatgctgctgagaaggccgaggcccccagcagcccagatgtggccccagctgggaaggaggacagccccagcgccagcggccgggtgcaggaggccgcccggcctgaggaggtggtgtcccagacccccctgctgcggagccgggccctggtgaagagggtgacctggaacctgcaggagagcgagagcagcgccccagctgaggaccgggccccccgggcccccctgcaccggccccagaagccccgggagggcgcctgggacatggaggatgtggcccccactggagtgcggcaggtgttcagcgagctgcccttccccagccacgtgctgcctgagcccggcttcccagacacagaccccagccaggtgtacagccctggcctgcccccagccccagcccagcccagcagcatccccccctgtgccctggtgtcccagcccaccgtgcagttcatcctgcagggcagcctgcccctggtgggctgtggggccgcccagaccctggcccctgtgcctgctgccctgaccccagccagcgagcccgccagccaggccacagctgccagcaacagcgaggagaagaccccagccccccggctggccgctgagaagaccaagaaggaggagtacatgaagaagctgcacatgcaggagagagctgtggaggaggtgaagctggccatcaagcccttctaccagaagcgggaggtgaccaaggaggagtacaaggacatcctgaggaaggctgtgcagaagatctgccacagcaagtctggagagatcaaccctgtgaaggtggccaacctggtgaaggcctacgtggacaagtaccgccacatgaggaggcacaagaagccagaggccggggaggagccccccacccagggcgctgagggctag

SEQ ID NO: 16399 - DNA, 2115 bp, Artificial Sequence
  Description of Artificial Sequence: Synthetic coding sequence
atgtgggagaagatggagaccaagaccatcgtgtatgacctggacaccagcggcggcctgatggagcagatccaggccctgctggccccacccaagacagatgaggccgagaagaggagcaggaagccagagaaggagccccggcgcagcggccgggccaccaaccacgacagctgtgacagctgcaaggagggcggggacctgctgtgctgtgaccactgcccagctgccttccacctgcagtgctgcaacccccccctgtctgaggagatgctgcccccaggagagtggatgtgccaccgctgcaccgtgcggaggaagaagcgggagcagaagaaggagctgggccacgtgaatggcctggtggacaagagcggcaagaggaccaccagccccagcagtgacacagacctgctggacagaagtgccagcaagacagagctgaaggccatcgcccacgcccgcatcctggagcggcgggccagccggcccggcacccccaccagcagcgccagcacagagacccccaccagcgagcagaatgatgtggatgaggacatcattgatgtggatgaggagcctgtggccgctgagccagactatgtgcagccccagctgcggcggccctttgagctgctgattgctgctgccatggagaggaaccccacccagttccagctgcccaatgagctgacctgcaccacagccctgcccggcagcagcaagagaagaaggaaggaggagaccaccgggaagaatgtgaagaagacccagcacgagctggaccacaacggcctggtgcccctgcctgtgaaggtgtgcttcacctgcaacagaagctgccgggtggcccccctcatccagtgtgactactgccccctgctcttccacatggactgcctggagccccccctgacagccatgcccctgggccgctggatgtgccccaaccacattgaacatgtggtgctgaaccagaagaacatgaccctgagcaaccgctgccaggtgtttgaccgcttccaggacacagtgtcccagcacgtggtgaaggtggacttcctgaaccgcatccacaagaagcacccccccaacagaagagtgctgcagagcgtgaagaggaggagcctgaaggtgcctgatgccatcaagagccagtaccagttccccccacccctcatcgccccagctgccatcagagatggagagctgatctgcaatggcatccctgaggagagccagatgcacctgctgaacagcgagcacctggccacccaggccgagcagcaggagtggctgtgcagcgtggtggccctgcagtgcagcatcctgaagcacctgagcgccaagcagatgcccagccactgggacagcgagcagacagagaaggctgacatcaagcctgtgattgtgacagacagctctgtgaccaccagcctgcagacagctgacaagacccccacccccagccactaccccctgagctgccccagcggcatcagcacccagaacagcctgagctgcagccccccccaccagagccctgccctggaggacatcggctgcagcagctgtgccgagaagagcaagaagaccccctgtggcacagccaacggccctgtgaacacagaggtgaaggccaacggcccccacctgtacagcagccccacagacagcacagacccccggcggctgcccggggccaacacccccctgcccggcctgagccaccggcagggctggccccggcccctgaccccacctgctgctgggggcctgcagaaccacacagtgggcatcatcgtgaagacagaaaatgccaccggccccagcagctgcccccagaggagcctggtgcctgtgcccagcctgcccccatccatccccagcagctgtgccagcattgagaacaccagcaccctgcagaggaagacagtgcagagccagatcggcccccccctgacagacagccggcccctgggcagccccccaaatgccaccagggtgctgaccccaccccaggccgctggagatggcatcctggccaccacagccaaccagcgcttcagcagccctgcccccagcagcggggagtgctgcagcgccctgggctag

SEQ ID NO: 16400 - DNA, 3015 bp, Artificial Sequence
  Description of Artificial Sequence: Synthetic coding sequence
atgtgggagaagatggagaccaagaccatcgtgtatgacctggacaccagcggcggcctgatggagcagatccaggccctgctggccccacccaagacagatgaggccgagaagaggagcaggaagccagagaaggagccccggcgcagcggccgggccaccaaccacgacagctgtgacagctgcaaggagggcggggacctgctgtgctgtgaccactgcccagctgccttccacctgcagtgctgcaacccccccctgtctgaggagatgctgcccccaggagagtggatgtgccaccgctgcaccgtgcggaggaagaagcgggagcagaagaaggagctgggccacgtgaatggcctggtggacaagagcggcaagaggaccaccagccccagcagtgacacagacctgctggacagaagtgccagcaagacagagctgaaggccatcgcccacgcccgcatcctggagcggcgggccagccggcccggcacccccaccagcagcgccagcacagagacccccaccagcgagcagaatgatgtggatgaggacatcattgatgtggatgaggagcctgtggccgctgagccagactatgtgcagccccagctgcggcggccctttgagctgctgattgctgctgccatggagaggaaccccacccagttccagctgcccaatgagctgacctgcaccacagccctgcccggcagcagcaagagaagaaggaaggaggagaccaccgggaagaatgtgaagaagacccagcacgagctggaccacaacggcctggtgcccctgcctgtgaaggtgtgcttcacctgcaacagaagctgccgggtggcccccctcatccagtgtgactactgccccctgctcttccacatggactgcctggagccccccctgacagccatgcccctgggccgctggatgtgccccaaccacattgaacatgtggtgctgaaccagaagaacatgaccctgagcaaccgctgccaggtgtttgaccgcttccaggacacagtgtcccagcacgtggtgaaggtggacttcctgaaccgcatccacaagaagcacccccccaacagaagagtgctgcagagcgtgaagaggaggagcctgaaggtgcctgatgccatcaagagccagtaccagttccccccacccctcatcgccccagctgccatcagagatggagagctgatctgcaatggcatccctgaggagagccagatgcacctgctgaacagcgagcacctggccacccaggccgagcagcaggagtggctgtgcagcgtggtggccctgcagtgcagcatcctgaagcacctgagcgccaagcagatgcccagccactgggacagcgagcagacagagaaggctgacatcaagcctgtgattgtgacagacagctctgtgaccaccagcctgcagacagctgacaagacccccacccccagccactaccccctgagctgccccagcggcatcagcacccagaacagcctgagctgcagccccccccaccagagccctgccctggaggacatcggctgcagcagctgtgccgagaagagcaagaagaccccctgtggcacagccaacggccctgtgaacacagaggtgaaggccaacggcccccacctgtacagcagccccacagacagcacagacccccggcggctgcccggggccaacacccccctgcccggcctgagccaccggcagggctggccccggcccctgaccccacctgctgctgggggcctgcagaaccacacagtgggcatcatcgtgaagacagaaaatgccaccggccccagcagctgcccccagaggagcctggtgcctgtgcccagcctgcccccatccatccccagcagctgtgccagcattgagaacaccagcaccctgcagaggaagacagtgcagagccagatcggcccccccctgacagacagccggcccctgggcagccccccaaatgccaccagggtgctgaccccaccccaggccgctggagatggcatcctggccaccacagccaaccagcgcttcagcagccctgcccccagcagtgatggcaaggtgtccccaggcaccctgagcatcggcagcgccctgactgtgcccagcttccctgccaacagcacagccatggtggacctgaccaacagcctgcgggccttcatggatgtgaatggagaaattgagatcaacatgctggatgagaagctgatcaagttcctggccctgcagaggatccaccagctgttccccagccgggtgcagcccagccctggctctgtgggcacccaccagctggccagcggcggccaccacatcgaggtgcagaggaaggaggtgcaggcccgggctgtgttctaccccctgctgggcctgggcggcgctgtgaacatgtgctaccgcaccctgtacatcggcactggagctgacatggatgtgtgcctgaccaactacggccactgcaactacgtgtctgggaagcacgcctgcatcttctatgatgagaacaccaagcactatgagctgctgaactacagcgagcacggcaccaccgtggacaacgtgctgtacagctgtgacttcagcgagaagaccccacccaccccacccagcagcatcgtggccaaggtgcagagcgtcatcagaagaagaagacaccagaagcaggatgaggagcccagcgaggaggccgccatgatgagcagccaggcccagggcccccagaggcggccctgcaactgcaaggccagcagcagcagcctcatcggcggcagcggggccggctgggagggcacagccctgctgcaccacggcagctacatcaagctgggctgcctgcagtttgtgttcagcatcacagaatttgccaccaagcagcccaagggagatgccagcctgctgcaggatggagtgctggccgagaagctgagcctgaagccccaccagggccctgtgctgcggagcaacagcgtgccctag

SEQ ID NO: 16401 - DNA, 2550 bp, Artificial Sequence
  Description of Artificial Sequence: Synthetic coding sequence
atgtgggagaagatggagaccaagaccatcgtgtatgacctggacaccagcggcggcctgatggagcagatccaggccctgctggccccacccaagacagatgaggccgagaagaggagcaggaagccagagaaggagccccggcgcagcggccgggccaccaaccacgacagctgtgacagctgcaaggagggcggggacctgctgtgctgtgaccactgcccagctgccttccacctgctggtgtaccaggactttgtggcccccatcagcctcttccacggcaccttccatgatggccccacctgcagctttgcccagaagcgggagcagaagaaggagctgggccacgtgaatggcctggtggacaagagcggcaagaggaccaccagccccagcagtgacacagacctgctggacagaagtgccagcaagacagagctgaaggccatcgcccacgcccgcatcctggagcggcgggccagccggcccggcacccccaccagcagcgccagcacagagacccccaccagcgagcagaatgatgtggatgaggacatcattgatgtggatgaggagcctgtggccgctgagccagactatgtgcagccccagctgcggcggccctttgagctgctgattgctgctgccatggagaggaaccccacccagttccagctgcccaatgagctgacctgcaccacagccctgcccggcagcagcaagagaagaaggaaggaggagaccaccgggaagaatgtgaagaagacccagcacgagctggaccacaacggcctggtgcccctgcctgtgaaggtgtgcttcacctgcaacagaagctgccgggtggcccccctcatccagtgtgactactgccccctgctcttccacatggactgcctggagccccccctgacagccatgcccctgggccgctggatgtgccccaaccacattgaacatgtggtgctgaaccagaagaacatgaccctgagcaaccgctgccaggtgtttgaccgcttccaggacacagtgtcccagcacgtggtgaaggtggacttcctgaaccgcatccacaagaagcacccccccaacagaagagtgctgcagagcgtgaagaggaggagcctgaaggtgcctgatgccatcaagagccagtaccagttccccccacccctcatcgccccagctgccatcagagatggagagctgatctgcaatggcatccctgaggagagccagatgcacctgctgaacagcgagcacctggccacccaggccgagcagcaggagtggctgtgcagcgtggtggccctgcagtgcagcatcctgaagcacctgagcgccaagcagatgcccagccactgggacagcgagcagacagagaaggctgacatcaagcctgtgattgtgacagacagctctgtgaccaccagcctgcagacagctgacaagacccccacccccagccactaccccctgagctgccccagcggcatcagcacccagaacagcctgagctgcagccccccccaccagagccctgccctggaggacatcggctgcagcagctgtgccgagaagagcaagaagaccccctgtggcacagccaacggccctgtgaacacagaggtgaaggccaacggcccccacctgtacagcagccccacagacagcacagacccccggcggctgcccggggccaacacccccctgcccggcctgagccaccggcagggctggccccggcccctgaccccacctgctgctgggggcctgcagaaccacacagtgggcatcatcgtgaagacagaaaatgccaccggccccagcagctgcccccagaggagcctggtgcctgtgcccagcctgcccccatccatccccagcagctgtgccagcattgagaacaccagcaccctgcagaggaagacagtgcagagccagatcggcccccccctgacagacagccggcccctgggcagccccccaaatgccaccagggtgctgaccccaccccaggccgctggagatggcatcctggccaccacagccaaccagcgcttcagcagccctgcccccagcagtgatggcaaggtgtccccaggcaccctgagcatcggcagcgccctgactgtgcccagcttccctgccaacagcacagccatggtggacctgaccaacagcctgcgggccttcatggatgtgaatggagaaattgagatcaacatgctggatgagaagctgatcaagttcctggccctgcagaggatccaccagctgttccccagccgggtgcagcccagccctggctctgtgggcacccaccagctggccagcggcggccaccacattgaaggagcccacgtgcacacctgccaccacatcatccgcagccccctgtatgtgtgtgagtggagcccctgcctgcatggagagagcgagctgcctgtgtcccagaccagcctgtgtgccttccacggcctgaacaaggccccctggttcttcagcgaggagagcaggaacaagatggccaccacagccttctag

SEQ ID NO: 16402 - DNA, 903 bp, Artificial Sequence
  Description of Artificial Sequence: Synthetic coding sequence
atggacagcgacagctgtgccgccgccttccaccctgaggagtacagccccagctgcaagagaagaagaacagtggaggacttcaacaagttctgcacctttgtgctggcctatgccggctacatcccctaccccaaggaggagctgcccctgcggagcagccccagccctgccaacagcacagctggcaccatcgacagtgatggctgggatgctggcttcagtgacatcgccagctctgtgcccctgcctgtgtctgaccgctgcttcagccacctgcagcccaccctgctgcagagggccaagcccagcaacttcctgctggacaggaagaagacagacaagctgaagaagaagaagaagaggaagaggcgggacagtgatgcccctgggaaggagggctacagaggaggcctgctgaagctggaggccgctgacccctacgtggagacccccaccagccccaccctgcaggacatcccccaggcccccagcgacccctgcagcggctgggacagcgacacccccagcagcggcagctgtgccaccgtgtccccagaccaggtgaaggagatcaagacagagggcaagaggaccatcgtgcggcagggcaagcaggtggtgttcagagatgaggacagcactggaaatgatgaggacatcatggtggacagtgatgatgacagctgggacctggtgacctgcttctgcatgaagccctttgctggccggcccatgattgagtgcaatgaatgccacacctggatccacctgagctgtgccaagatcaggaagagcaatgtgcctgaggtgtttgtgtgccagaagtgccgggacagcaagtttgacatcagaagaagcaacagaagcaggacaggcagcaggaagctgttcctggactag

SEQ ID NO: 16403 - DNA, 2373 bp, Artificial Sequence
  Description of Artificial Sequence: Synthetic coding sequence
atggaggagaagaggaggaagtacagcatcagcagtgacaacagcgacaccacagacagccacgccaccagcaccagcgccagccgctgcagcaagctgcccagcagcaccaagagcggctggccccggcagaatgagaagaagcccagcgaggtgttcagaacagacctgatcacagccatgaagatcccagacagctaccagctgagcccagatgactactacatcctggccgacccctggaggcaggagtgggagaagggcgtgcaggtgcctgctggagctgaggccatccctgagcctgtggtgcgcatcctgccccccctggagggccccccagcccaggccagccccagcagcaccatgctgggggagggcagccagcctgactggccaggcggcagccgctatgacctggatgaaattgatgcctactggctggagctgatcaacagcgagctgaaggagatggagaggcctgagctggatgagctgaccctggagcgggtgctggaggagctggagaccctgtgccaccagaacatggcccgggccatcgagacccaggagggcctgggcatcgagtatgatgaagatgtggtgtgtgatgtgtgccgcagcccagaaggagaagatggaaatgagatggtgttctgtgacaagtgcaatgtgtgtgtgcaccaggcctgctacggcatcctgaaggtgcccaccggctcctggctgtgcaggacctgtgccctgggcgtgcagcccaagtgcctgctgtgccccaagagaggaggagccctgaagcccaccaggagcggcaccaagtgggtgcacgtgtcctgtgccctgtggatccctgaggtgtccatcggctgcccagagaagatggagcccatcaccaagatcagccacatcccagccagccgctgggccctgagctgcagcctgtgcaaggagtgcaccggcacctgcatccagtgcagcatgcccagctgtgtgacagccttccacgtgacctgtgcctttgaccacggcctggagatgaggaccatcctggccgacaatgatgaggtgaagttcaagagcttctgccaggagcacagtgatggcggccccagaaatgagcccaccagcgagcccacagagcccagccaggccggggaggacctggagaaggtgaccctgaggaagcagaggctgcagcagctggaggaggacttctatgagctggtggagcctgctgaggtggccgagcggctggacctggccgaggccctggtggacttcatctaccagtactggaagctgaagaggaaggccaatgccaaccagcccctgctgacccccaagacagatgaggtggacaacctggcccagcaggagcaggatgtgctgtaccgccgcctgaagctgttcacccacctgcggcaggacctggagcgggtgaggaacctgtgctacatggtgacccggcgggagaggaccaagcacgccatctgcaagctgcaggagcagatcttccacctgcagatgaagctgattgagcaggacctgtgccggggcctgagcaccagcttccccattgatggcaccttcttcaacagctggctggcccagagcgtgcagatcacagctgagaacatggccatgtctgagtggcccctgaacaacggccaccgggaggaccctgcccctggcctgctgtctgaggagctgctgcaggatgaggagaccctgctgtccttcatgagggaccccagcctgcggcctggggaccctgccaggaaggcccggggccgcacccggctgcctgccaagaagaagcccccacctcctccaccccaggacggccctggcagcaggaccaccccagacaaggcccccaagaagacctggggccaggatgctggcagcgggaaaggaggccagggcccccccaccaggaagccacccaggaggaccagcagccacctgcccagcagccctgctgctggggactgccccatcctggccaccccagagagccccccacccctggcccctgagaccccagatgaggccgcctctgtggccgctgacagtgatgtgcaggtgcccggccctgctgccagccccaagcccctgggccgcctgcggcccccccgggagagcaaggtgacccggcggctgcccggggcccggccagatgctggcatgggccccccatctgctgtggccgagcggcccaaggtgtccctgcactttgacacagaaacagatggctacttcagtgatggagagatgtctgacagtgatgtggaggccgaggatggaggagtgcagaggggcccccgggaggccggggctgaggaggtggtgaggatgggcgtgctggccagctag

SEQ ID NO: 16404 - DNA, 2382 bp, Artificial Sequence
  Description of Artificial Sequence: Synthetic coding sequence
atggaggagaagaggaggaagtacagcatcagcagtgacaacagcgacaccacagacagccacgccaccagcaccagcgccagccgctgcagcaagctgcccagcagcaccaagagcggctggccccggcagaatgagaagaagcccagcgaggtgttcagaacagacctgatcacagccatgaagatcccagacagctaccagctgagcccagatgactactacatcctggccgacccctggaggcaggagtgggagaagggcgtgcaggtgcctgctggagctgaggccatccctgagcctgtggtgcgcatcctgccccccctggagggccccccagcccaggccagccccagcagcaccatgctgggggagggcagccagcctgactggccaggcggcagccgctatgacctggatgaaattgatgcctactggctggagctgatcaacagcgagctgaaggagatggagaggcctgagctggatgagctgaccctggagcgggtgctggaggagctggagaccctgtgccaccagaacatggcccgggccatcgagacccaggagggcctgggcatcgagtatgatgaagatgtggtgtgtgatgtgtgccgcagcccagaaggagaagatggaaatgagatggtgttctgtgacaagtgcaatgtgtgtgtgcaccaggcctgctacggcatcctgaaggtgcccaccggctcctggctgtgcaggacctgtgccctgggcgtgcagcccaagtgcctgctgtgccccaagagaggaggagccctgaagcccaccaggagcggcaccaagtgggtgcacgtgtcctgtgccctgtggatccctgaggtgtccatcggctgcccagagaagatggagcccatcaccaagatcagccacatcccagccagccgctgggccctgagctgcagcctgtgcaaggagtgcaccggcacctgcatccagtgcagcatgcccagctgtgtgacagccttccacgtgacctgtgcctttgaccacggcctggagatgaggaccatcctggccgacaatgatgaggtgaagttcaagagcttctgccaggagcacagtgatggcggccccagaaatgagcccaccagcgagcccacagagcccagccaggccggggaggacctggagaaggtgaccctgaggaagcagaggctgcagcagctggaggaggacttctatgagctggtggagcctgctgaggtggccgagcggctggacctggccgaggccctggtggacttcatctaccagtactggaagctgaagaggaaggccaatgccaaccagcccctgctgacccccaagacagatgaggtggacaacctggcccagcaggagcaggatgtgctgtaccgccgcctgaagctgttcacccacctgcggcaggacctggagcgggtgaggaacctgtgctacatggtgacccggcgggagaggaccaagcacgccatctgcaagctgcaggagcagatcttccacctgcagatgaagctgattgagcaggacctgtgccgggagaggagcggccggcgggccaagggcaagaagagtgacagcaagaggaagggctgtgagggcagcaagggcagcacagagaagaaggagaaggtgaaggccggcccagattctgtgctgggccagctggccggcctgagcaccagcttccccattgatggcaccttcttcaacagctggctggcccagagcgtgcagatcacagctgagaacatggccatgtctgagtggcccctgaacaacggccaccgggaggaccctgcccctggcctgctgtctgaggagctgctgcaggatgaggagaccctgctgtccttcatgagggaccccagcctgcggcctggggaccctgccaggaaggcccggggccgcacccggctgcctgccaagaagaagccacccaggaggaccagcagccacctgcccagcagccctgctgctggggactgccccatcctggccaccccagagagccccccacccctggcccctgagaccccagatgaagctgcctctgtggccgctgacagtgatgtgcaggtgcccggccctgctgccagccccaagcccctgggccgcctgcggcccccccgggagagcaaggtgacccggcggctgcccggggcccggccagatgctggcatgggcccccccagcgctgtggccgagcggcccaaggtgtccctgcactttgacacagaaacagatggctacttcagtgatggagagatgtctgacagtgatgtggaggctgaagatggcggcgtgcagaggggcccccgggaggccggggctgaggaggtggtgaggatgggcgtgctggccagctag

SEQ ID NO: 16405 - DNA, 768 bp, Artificial Sequence
  Description of Artificial Sequence: Synthetic coding sequence
atggaggagaagaggaggaagtacagcatcagcagtgacaacagcgacaccacagacagccacgccaccagcaccagcgccagccgctgcagcaagctgcccagcagcaccaagagcggctggccccggcagaatgagaagaagcccagcgaggtgttcagaacagacctgatcacagccatgaagatcccagacagctaccagctgagcccagatgactactacatcctggccgacccctggaggcaggagtgggagaagggcgtgcaggtgcctgctggagctgaggccatccctgagcctgtggtgcgcatcctgccccccctggagggccccccagcccaggccagccccagcagcaccatgctgggggagggcagccagcctgactggccaggcggcagccgctatgacctggatgaaattgatgcctactggctggagctgatcaacagcgagctgaaggagatggagaggcctgagctggatgagctgaccctggagcgggtgctggaggagctggagaccctgtgccaccagaacatggcccgggccatcgagacccaggagggcctgggcatcgagtatgatgaagatgtggtgtgtgatgtgtgccgcagcccagaaggagaagatggaaatgagatggtgttctgtgacaagtgcaatgtgtgtgtgcaccaggcctgctacggcatcctgaaggtgcccaccggctcctggctgtgcaggacctgtgccctgggcgtgcagcccaagtgcctgtag

SEQ ID NO: 16406 - DNA, 2376 bp, Artificial Sequence
  Description of Artificial Sequence: Synthetic coding sequence
atggaggagaagaggaggaagtacagcatcagcagtgacaacagcgacaccacagacagccacgccaccagcaccagcgccagccgctgcagcaagctgcccagcagcaccaagagcggctggccccggcagaatgagaagaagcccagcgaggtgttcagaacagacctgatcacagccatgaagatcccagacagctaccagctgagcccagatgactactacatcctggccgacccctggaggcaggagtgggagaagggcgtgcaggtgcctgctggagctgaggccatccctgagcctgtggtgcgcatcctgccccccctggagggccccccagcccaggccagccccagcagcaccatgctgggggagggcagccagcctgactggccaggcggcagccgctatgacctggatgaaattgatgcctactggctggagctgatcaacagcgagctgaaggagatggagaggcctgagctggatgagctgaccctggagcgggtgctggaggagctggagaccctgtgccaccagaacatggcccgggccatcgagacccaggagggcctgggcatcgagtatgatgaagatgtggtgtgtgatgtgtgccgcagcccagaaggagaagatggaaatgagatggtgttctgtgacaagtgcaatgtgtgtgtgcaccaggcctgctacggcatcctgaaggtgcccaccggctcctggctgtgcaggacctgtgccctgggcgtgcagcccaagtgcctgctgtgccccaagagaggaggagccctgaagcccaccaggagcggcaccaagtgggtgcacgtgtcctgtgccctgtggatccctgaggtgtccatcggctgcccagagaagatggagcccatcaccaagatcagccacatcccagccagccgctgggccctgagctgcagcctgtgcaaggagtgcaccggcacctgcatccagtgcagcatgcccagctgtgtgacagccttccacgtgacctgtgcctttgaccacggcctggagatgaggaccatcctggccgacaatgatgaggtgaagttcaagagcttctgccaggagcacagtgatggcggccccagaaatgagcccaccagcgagcccacagagcccagccaggccggggaggacctggagaaggtgaccctgaggaagcagaggctgcagcagctggaggaggacttctatgagctggtggagcctgctgaggtggccgagcggctggacctggccgaggccctggtggacttcatctaccagtactggaagctgaagaggaaggccaatgccaaccagcccctgctgacccccaagacagatgaggtggacaacctggcccagcaggagcaggatgtgctgtaccgccgcctgaagctgttcacccacctgcggcaggacctggagcgggtgaggaacctgtgctacatggtgacccggcgggagaggaccaagcacgccatctgcaagctgcaggagcagatcttccacctgcagatgaagctgattgagcaggacctgtgccgggccggcctgagcaccagcttccccattgatggcaccttcttcaacagctggctggcccagagcgtgcagatcacagctgagaacatggccatgtctgagtggcccctgaacaacggccacagagaagatcctgcccctggcctgctgtctgaggagctgctgcaggatgaggagaccctgctgtccttcatgagggaccccagcctgcggcctggggaccctgccaggaaggcccggggccgcacccggctgcctgccaagaagaagcccccacctcctccaccccaggacggccctggcagcaggaccaccccagacaaggcccccaagaagacctggggccaggatgctggcagcggcaagggcggccagggcccccccaccaggaagccacccaggaggaccagcagccacctgcccagcagccctgctgctggggactgccccatcctggccaccccagagagccccccacccctggcccctgagaccccagatgaagctgcctctgtggccgctgacagtgatgtgcaggtgcccggccctgctgccagccccaagcccctgggccgcctgcggcccccccgggagagcaaggtgacccggcggctgcccggggcccggccagatgctggcatgggcccccccagcgctgtggccgagcggcccaaggtgtccctgcactttgacacagaaacagatggctacttcagtgatggagagatgtctgacagtgatgtggaggctgaagatggcggcgtgcagaggggcccccgggaggccggggctgaggaggtggtgaggatgggcgtgctggccagctag

SEQ ID NO: 16407 - DNA, 2553 bp, Artificial Sequence
  Description of Artificial Sequence: Synthetic coding sequence
atggtgcccacagctgccatcgctgtgggcggctacttcctgggcggcatggaggagaagaggaggaagtacagcatcagcagtgacaacagcgacaccacagacagccacgccaccagcaccagcgccagccgctgcagcaagctgcccagcagcaccaagagcggctggccccggcagaatgagaagaagcccagcgaggtgttcagaacagacctgatcacagccatgaagatcccagacagctaccagctgagcccagatgactactacatcctggccgacccctggaggcaggagtgggagaagggcgtgcaggtgcctgctggagctgaggccatccctgagcctgtggtgcgcatcctgccccccctggagggccccccagcccaggccagccccagcagcaccatgctgggggagggcagccagcctgactggccaggcggcagccgctatgacctggatgaaattgatgcctactggctggagctgatcaacagcgagctgaaggagatggagaggcctgagctggatgagctgaccctggagcgggtgctggaggagctggagaccctgtgccaccagaacatggcccgggccatcgagacccaggagggcctgggcatcgagtatgatgaagatgtggtgtgtgatgtgtgccgcagcccagaaggagaagatggaaatgagatggtgttctgtgacaagtgcaatgtgtgtgtgcaccaggcctgctacggcatcctgaaggtgcccaccggctcctggctgtgcaggacctgtgccctgggcgtgcagcccaagtgcctgctgtgccccaagagaggaggagccctgaagcccaccaggagcggcaccaagtgggtgcacgtgtcctgtgccctgtggatccctgaggtgtccatcggctgcccagagaagatggagcccatcaccaagatcagccacatcccagccagccgctgggccctgagctgcagcctgtgcaaggagtgcaccggcacctgcatccagtgcagcatgcccagctgtgtgacagccttccacgtgacctgtgcctttgaccacggcctggagatgaggaccatcctggccgacaatgatgaggtgaagttcaagagcttctgccaggagcacagtgatggcggccccagaaatgagcccaccagcgagcccacagagcccagccaggccggggaggacctggagaaggtgaccctgaggaagcagaggctgcagcagctggaggaggacttctatgagctggtggagcctgctgaggtggccgagcggctggacctggccgaggccctggtggacttcatctaccagtactggaagctgaagaggaaggccaatgccaaccagcccctgctgacccccaagacagatgaggtggacaacctggcccagcaggagcaggatgtgctgtaccgccgcctgaagctgttcacccacctgcggcaggacctggagcgggtgaggaacctgtgctacatggtgacccggcgggagaggaccaagcacgccatctgcaagctgcaggagcagatcttccacctgcagatgaagctgattgagcaggacctgtgccgggagaggagcggccggcgggccaagggcaagaagagtgacagcaagaggaagggctgtgagggcagcaagggcagcacagagaagaaggagaaggtgaaggccggcccagattctgtgctgggccagctggccggcctgagcaccagcttccccattgatggcaccttcttcaacagctggctggcccagagcgtgcagatcacagctgagaacatggccatgtctgagtggcccctgaacaacggccaccgggaggaccctgcccctggcctgctgtctgaggagctgctgcaggatgaggagaccctgctgtccttcatgagggaccccagcctgcggcctggggaccctgccaggaaggcccggggccgcacccggctgcctgccaagaagaagcccccacctcctccaccccaggacggccctggcagcaggaccaccccagacaaggcccccaagaagacctggggccaggatgctggcagcgggaaaggaggccagggcccccccaccaggaagccacccaggaggaccagcagccacctgcccagcagccctgctgctggggactgccccatcctggccaccccagagagccccccacccctggcccctgagaccccagatgaggccgcctctgtggccgctgacagtgatgtgcaggtgcccggccctgctgccagccccaagcccctgggccgcctgcggcccccccgggagagcaaggtgacccggcggctgcccggggcccggccagatgctggcatgggccccccatctgctgtggccgagcggcccaaggtgtccctgcactttgacacagaaacagatggctacttcagtgatggagagatgtctgacagtgatgtggaggccgaggatggaggagtgcagaggggcccccgggaggccggggctgaggaggtggtgaggatgggcgtgctggccagctag

SEQ ID NO: 16408 - DNA, 450 bp, Artificial Sequence
  Description of Artificial Sequence: Synthetic coding sequence
atggaggagaagaggaggaagtacagcatcagcagtgacaacagcgacaccacagacagccacgccaccagcaccagcgccagccgctgcagcaagctgcccagcagcaccaagagcggctggccccggcagaatgagaagaagcccagcgaggtgttcagaacagacctgatcacagccatgaagatcccagacagctaccagctgagcccagatgactactacatcctggccgacccctggaggcaggagtgggagaagggcgtgcaggtgcctgctggagctgaggccatccctgagcctgtggtgcgcatcctgccccccctggagggccccccagcccaggccagccccagcagcaccatgctgggggagggcagccagcctgactggccaggcggcagccgctatgacctggatgaaattgatgcctactggctggagctgtag

SEQ ID NO: 16409 - DNA, 1053 bp, Artificial Sequence
  Description of Artificial Sequence: Synthetic coding sequence
atgggctgcttcttcagcaagaggaggaaggctgacaaggagagcaggccagaaaatgaggaggagcggcccaagcagtacagctgggaccagcgggagaaggtggaccccaaggactacatgttttctggcctgaaggatgaaacagtgggccgcctgcccggcaccgtggccggccagcagttcctgatccaggactgtgagaactgcaacatctacatctttgaccacagcgccaccgtgaccattgatgactgcaccaactgcatcatcttcctgggccctgtgaagggctctgtgttcttcaggaactgccgggactgcaagtgcaccctggcctgccagcagttccgggtgcgggactgcaggaagctggaggtgttcctgtgctgtgccacccagcccatcatcgagagcagcagcaacatcaagtttggctgcttccagtggtactacccagagctggccttccagttcaaggatgctggcctgagcatcttcaacaacacctggagcaacatccatgacttcacccctgtgtctggagagctgaactggagcctgctgcctgaagatgctgtggtgcaggactatgtgcccatccccaccacagaggagctgaaggctgtgcgggtgtccacagaggccaacagaagcatcgtgcccatcagccggggccagaggcagaagagcagtgatgagagctgcctggtggtgctgtttgctggggactacaccatcgccaatgccaggaagctgattgatgagatggtgggcaagggcttcttcctggtgcagaccaaggaggtgtccatgaaggcagaagatgcccagagggtcttccgggagaaggccccagacttcctgcccctgctgaacaagggccctgtgattgccctggagttcaatggagatggagctgtggaggtgtgccagctgattgtgaatgagatcttcaacggcaccaagatgtttgtgtctgagagcaaggagacagccagcggagatgtggacagcttctacaactttgctgacatccagatgggcatctag

SEQ ID NO: 16410 - DNA, 2472 bp, Artificial Sequence
  Description of Artificial Sequence: Synthetic coding sequence
atgaagaggcacaggcctgtgagcagcagtgacagcagtgatgagagccccagcaccagcttcaccagcggctccatgtaccgcatcaagagcaagatccccaatgagcacaagaagccagctgaggtgttcaggaaggacctgatcagcgccatgaagctgcctgacagccaccacatcaacccagacagctactacctgtttgctgacacctggaaggaggagtgggagaagggcgtgcaggtgcctgccagcccagacacagtgccccagcccagcctgcgcatcatcgccgagaaggtgaaggatgtgctcttcatccggcccaggaagtacatccactgcagcagcccagacaccacagagcccggctacatcaacatcatggagctggccgcctctgtgtgccgctatgacctggatgacatggacatcttctggctgcaggagctgaatgaagacctggccgagatgggctgcggccctgtggatgagaacctgatggagaagacagtggaggtgctggagcggcactgccacgagaacatgaaccacgccattgaaacagaggagggcctgggcattgaatatgatgaagatgtgatctgtgatgtgtgccgcagcccagattctgaggagggcaatgacatggtgttctgtgacaagtgcaatgtgtgtgtgcaccaggcctgctacggcatcctgaaggtgcctgagggctcctggctgtgccgcagctgtgtgctgggcatctacccccagtgtgtgctgtgccccaagaagggcggggccctgaagaccaccaagacaggcaccaagtgggcccacgtgtcctgtgccctgtggatccctgaggtgtccatcgcctgcccagagaggatggagcccatcaccaagatcagccacatcccccccagccgctgggccctggtgtgcaacctgtgcaagctgaagacaggagcctgcatccagtgcagcatcaagagctgcatcacagccttccacgtgacctgtgcctttgagcacggcctggagatgaagaccatcctggatgaaggagatgaggtgaagttcaagagctactgcctgaagcacagccagaaccggcagaagctgggggaggccgagtacccccaccaccgggccaaggagcagagccaggccaagtctgagaagaccagcctgcgggcccagaagctgcgggagctggaggaggagttctacagcctggtgcgggtggaggatgtggccgctgagctgggcatgcccaccctggccgtggacttcatctacaactactggaagctgaagaggaagagcaacttcaacaagcccctcttcccccccaaggaggatgaggagaatggcctggtgcagcccaaggaggagagcatccacaccaggatgaggatgttcatgcacctgcggcaggacctggagcgggtgaggaacctgtgctacatgatcagcagaagagagaagctgaagctgagccacaacaagatccaggagcagatcttcggcctgcaggtgcagctgctgaaccaggagattgatgctggcctgcccctgaccaatgccctggagaacagcctcttctaccccccaccccgcatcaccctgaagctgaagatgcccaagagcaccccagaggaccacaggaacagcagcacagaaacagaccagcagccccacagcccagacagcagcagctctgtgcacagcatccggaacatgcaggtgccccaggagagcctggagatgaggaccaagagctacccccgctaccccctggagagcaagaacaaccggctgctggccagcctgagccacagccgctctgaggccaaggagagcagccctgcctggaggacccccagcagcgagtgctaccacggccagagcctgggcaagcccctggtgctgcaggccgccctgcacggccagagcagcattggaaatggcaagagccagcccaacagcaagtttgccaagagcaatggcctggagggctcctggagcggaaatgtgacccagaaggacagcagcagcgagatgttctgtgaccaggagcccgtcttcagcccccacctggtgtcccagggcagcttcaggaagagcacagtggagcacttcagccgctccttcaaggagaccaccaaccgctgggtgaagaacacagaggacctgcagtgctacgtgaagcccaccaagaacatgagccccaaggagcagttctggggccggcaggtgctgcggcgctctgctggccgggccccctaccaggagaatgatggctactgcccagacctggagctgagtgacagcgaggccgagagtgatggcaacaaggagaaggtgcgggtgaggaaggacagcagtgacagagaaaatcctcctcatgacagccggcgggactgccacggcaagagcaagacccaccccctgagccacagctccatgcagaggtag

SEQ ID NO: 16411 - DNA, 561 bp, Artificial Sequence
  Description of Artificial Sequence: Synthetic coding sequence
atgaagaggcacaggcctgtgagcagcagtgacagcagtgatgagagccccagcaccagcttcaccagcggctccatgtaccgcatcaagagcaagatccccaatgagcacaagaagccagctgaggtgttcaggaaggacctgatcagcgccatgaagctgcctgacagccaccacatcaacccagacagctactacctgtttgctgacacctggaaggaggagtgggagaagggcgtgcaggtgcctgccagcccagacacagtgccccagcccagcctgcgcatcatcgccgagaaggtgaaggatgtgctcttcatccggcccaggaagtacatccactgcagcagcccagacaccacagagcccggctacatcaacatcatggagctggccgcctctgtgtgccgctatgacctggatgacatggacatcttctggctgcaggagctgaatgaagacctggccgagatgggctgcggccctgtggatgagaacctgatggagaagacagtggaggtgctggagcggcactgccacgagaacatgaaccacgcctag

SEQ ID NO: 16412 - DNA, 345 bp, Artificial Sequence
  Description of Artificial Sequence: Synthetic coding sequence
atgaagaggcacaggcctgtgagcagcagtgacagcagtgatgagagccccagcaccagcttcaccagcggctccatgtaccgcatcaagagcaagatccccaatgagcacaagaagccagctgaggtgttcaggaaggacctgatcagcgccatgaagctgcctgacagccaccacatcaacccagacagctactacctgtttgctgacacctggaaggaggagtgggagaagggcgtgcaggtgcctgccagcccagacacagtgccccagcccagcctgcgcatcatcgccgagaaggtgaaggatgtgctcttcatccggcccaggaagtacatccactag

SEQ ID NO: 16413 - DNA, 1632 bp, Artificial Sequence
  Description of Artificial Sequence: Synthetic coding sequence
atgaccaagcacccccccaacagaagaggcatcagctttgaggtgggcgcccagctggaggcccgggaccggctgaagaactggtacccagcccacatcgaggacatcgactatgaggagggcaaggtgctgatccacttcaagcgctggaaccacagatatgatgagtggttctgctgggacagcccctacctgcggcccctggagaagatccagctgaggaaggagggcctgcatgaagaagatggcagcagcgagttccagatcaatgagcaggtgctggcctgctggagcgactgccgcttctacccagccaaggtgacagctgtgaacaaggatggcacctacacagtgaagttctatgatggagtggtgcagacagtgaagcacatccacgtgaaggccttcagcaaggaccagaacatcgtgggcaatgcccggcccaaggagacagaccacaagagcctgagcagcagcccagacaagcgggagaagttcaaggagcagaggaaggccaccgtgaatgtgaagaaggacaaggaggacaagcccctgaagacagagaagaggcccaagcagcctgacaaggagggcaagctgatctgcagcgagaagggcaaggtgtctgagaagagcctgcccaagaatgagaaggaggacaaggagaacatcagtgaaaatgaccgggagtacagcggagatgcccaggtggacaagaagccagaaaatgacatcgtgaagagcccccaggagaacctgcgggagcccaagaggaagaggggccggcccccatccatcgcccccacagctgtggacagcaacagccagaccctgcagcccatcaccctggagctgcggcggaggaagatcagcaagggctgtgaggtgcccctgaagaggccccggctggacaagaacagcagccaggagaagagcaagaactacagtgaaaatacagacaaggacctgagcagaagaagaagcagccggctgagcaccaacggcacccatgagatcctggaccctgacctggtggtgtctgacctggtggacacagaccccctgcaggacaccctgagcagcaccaaggagagcgaggagggccagctgaagagcgccctggaggccggccaggtgtcctctgccctgacctgccacagctttggagatggcagcggggctgctggcctggagctgaactgccccagcatgggagagaacaccatgaagacagagcccaccagccccctggtggagctgcaggagatcagcacagtggaggtgaccaacaccttcaagaagacagatgactttggcagcagcaatgccccagctgtggacctggaccacaagttccgctgcaaggtggtggactgcctgaagttcttcaggaaggccaagctgctgcactaccacatgaagtacttccacggcatggagaagagcctggagcctgaggagagccctgggaagagacatgtgcagacccggggccccagcgccagtgacaagcccagccaggagaccctgaccaggaagagggtgtctgccagcagccccaccaccaaggacaaggagaagaacaaggagaagaagttcaaggagtttgtgcgggtgaagcccaagaagtag

SEQ ID NO: 16414 - DNA, 1650 bp, Artificial Sequence
  Description of Artificial Sequence: Synthetic coding sequence
atgaccaagcacccccccaacagaagaggcatcagctttgaggtgggcgcccagctggaggcccgggaccggctgaagaactggtacccagcccacatcgaggacatcgactatgaggagggcaaggtgctgatccacttcaagcgctggaaccacagatatgatgagtggttctgctgggacagcccctacctgcggcccctggagaagatccagctgaggaaggagggcctgcatgaagaagatggcagcagcgagttccagatcaatgagcaggtgctggcctgctggagcgactgccgcttctacccagccaaggtgacagctgtgaacaaggatggcacctacacagtgaagttctatgatggagtggtgcagacagtgaagcacatccacgtgaaggccttcagcaaggaccagaacatcgtgggcaatgcccggcccaaggagacagaccacaagagcctgagcagcagcccagacaagcgggagaagttcaaggagcagaggaaggccaccgtgaatgtgaagaaggacaaggaggacaagcccctgaagacagagaagaggcccaagcagcctgacaaggagggcaagctgatctgcagcgagaagggcaaggtgtctgagaagagcctgcccaagaatgagaaggaggacaaggagaacatcagtgaaaatgaccgggagtacagcggagatgcccaggtggacaagaagccagaaaatgacatcgtgaagagcccccaggagaacctgcgggagcccaagaggaagaggggccggcccccatccatcgcccccacagctgtggacagcaacagccagaccctgcagcccatcaccctggagctgcggcggaggaagatcagcaagggctgtgaggtgcccctgaagaggccccggctggacaagaacagcagccaggagaagagcaagaactacagtgaaaatacagacaaggacctgagcagaagaagaagcagccggctgagcaccaacggcacccatgagatcctggaccctgacctggtggtgtctgacctggtggacacagaccccctgcaggacaccctgagcagcaccaaggagagcgaggagggccagctgaagagcgccctggaggccggccaggtgtcctctgccctgacctgccacagctttggagatggcagcggggctgctggcctggagctgaactgccccagcatgggagagaacaccatgaagacagagcccaccagccccctggtggagctgcaggagatcagcacagtggaggtgaccaacaccttcaagaagacagatgactttggcagcagcaatgccccagctgtggacctggaccacaagttccgctgcaaggtggtggactgcctgaagttcttcaggaaggccaagctgctgcactaccacatgaagtacttccacggcatggagaagagcctggagcctgaggagagccctgggaagagacatgtgcagacccggggccccagcgccagtgacaagcccagccaggagaccctgaccaggaagagggtgtctgccagcagccccaccaccaaggacaaggagaagaacaaggagaagaagttcaaggagtttgtgcgggtgaagcccaagaagaagaagaagaagaagaagtag

SEQ ID NO: 16415 - DNA, 3039 bp, Artificial Sequence
  Description of Artificial Sequence: Synthetic coding sequence
atgaccaagcacccccccaacagaagaggcatcagctttgaggtgggcgcccagctggaggcccgggaccggctgaagaactggtacccagcccacatcgaggacatcgactatgaggagggcaaggtgctgatccacttcaagcgctggaaccacagatatgatgagtggttctgctgggacagcccctacctgcggcccctggagaagatccagctgaggaaggagggcctgcatgaagaagatggcagcagcgagttccagatcaatgagcaggtgctggcctgctggagcgactgccgcttctacccagccaaggtgacagctgtgaacaaggatggcacctacacagtgaagttctatgatggagtggtgcagacagtgaagcacatccacgtgaaggccttcagcaaggaccagaacatcgtgggcaatgcccggcccaaggagacagaccacaagagcctgagcagcagcccagacaagcgggagaagttcaaggagcagaggaaggccaccgtgaatgtgaagaaggacaaggaggacaagcccctgaagacagagaagaggcccaagcagcctgacaaggagggcaagctgatctgcagcgagaagggcaaggtgtctgagaagagcctgcccaagaatgagaaggaggacaaggagaacatcagtgaaaatgaccgggagtacagcggagatgcccaggtggacaagaagccagaaaatgacatcgtgaagagcccccaggagaacctgcgggagcccaagaggaagaggggccggcccccatccatcgcccccacagctgtggacagcaacagccagaccctgcagcccatcaccctggagctgcggcggaggaagatcagcaagggctgtgaggtgcccctgaagaggccccggctggacaagaacagcagccaggagaagagcaagaactacagtgaaaatacagacaaggacctgagcagaagaagaagcagccggctgagcaccaacggcacccatgagatcctggaccctgacctggtggtgtctgacctggtggacacagaccccctgcaggacaccctgagcagcaccaaggagagcgaggagggccagctgaagagcgccctggaggccggccaggtgtcctctgccctgacctgccacagctttggagatggcagcggggctgctggcctggagctgaactgccccagcatgggagagaacaccatgaagacagagcccaccagccccctggtggagctgcaggagatcagcacagtggaggtgaccaacaccttcaagaagacagatgactttggcagcagcaatgccccagctgtggacctggaccacaagttccgctgcaaggtggtggactgcctgaagttcttcaggaaggccaagctgctgcactaccacatgaagtacttccacggcatggagaagagcctggagcctgaggagagccctgggaagagacatgtgcagacccggggccccagcgccagtgacaagcccagccaggagaccctgaccaggaagagggtgtctgccagcagccccaccaccaaggacaaggagaagaacaaggagaagaagttcaaggagtttgtgcgggtgaagcccaagaagaagaagaagaagaagaagaagaccaagccagagtgcccctgcagcgaggagatcagtgacaccagccaggagcccagcccccccaaggcctttgctgtgacccgctgtggcagcagccacaagccaggagtgcacatgagcccccagctgcacggccctgagagcggccaccacaagggcaaggtgaaggccctggaggaggacaacctgtctgagagcagcagcgagagcttcctgtggagcgatgatgaatatggccaggatgtggatgtgaccaccaacccagatgaggagctggatggagatgacagatatgactttgaggtggtgcgctgcatctgtgaggtgcaggaggagaatgacttcatgatccagtgtgaggagtgccagtgctggcagcacggcgtgtgcatgggcctgctggaggagaatgtgcctgagaagtacacctgctacgtgtgccaggaccccccaggccagaggcctggcttcaagtactggtatgacaaggagtggctgagccggggccacatgcacggcctggccttcctggaggagaactacagccaccagaatgccaagaagatcgtggccacccaccagctgctgggagatgtgcagagggtgattgaggtgctgcacggcctgcagctgaagatgagcatcctgcagagccgggagcacccagacctgcccctgtggtgccagccctggaagcagcacagcggggagggccgcagccacttcaggaacatccctgtgacagacaccaggagcaaggaggaggcccccagctaccgcaccctgaatggagctgtggagaagccccggcccctggccctgcccctgcccaggtctgtggaggagagctacatcaccagcgagcactgctaccagaagccccgggcctactacccagctgtggagcagaagctggtggtggagacccggggcagcgccctggatgatgctgtgaaccccctgcatgaaaatggagatgacagcctgagcccccggctgggctggcccctggaccaggacaggagcaaaggagacagcgaccccaagccaggcagccccaaggtgaaggagtatgtgtccaagaaggccctgcctgaggaggccccagccaggaagctgctggacagaggaggagagggcctgctgagcagccagcaccagtggcagttcaacctgctgacccacgtggagagcctgcaggatgaggtgacccacaggatggacagcattgagaaggagctggatgtgctggagagctggctggactacaccggggagctggagcccccagagcccctggcccggctgccccagctgaagcactgcatcaagcagctgctgatggacctgggcaaggtgcagcagatcgccctgtgctgcagcacctag

SEQ ID NO: 16416 - DNA, 819 bp, Artificial Sequence
  Description of Artificial Sequence: Synthetic coding sequence
atgaccaagcacccccccaacagaagaggcatcagctttgaggtgggcgcccagctggaggcccgggaccggctgaagaactggtacccagcccacatcgaggacatcgactatgaggagggcaaggtgctgatccacttcaagcgctggaaccacagatatgatgagtggttctgctgggacagcccctacctgcggcccctggagaagatccagctgaggaaggagggcctgcatgaagaagatggcagcagcgagttccagatcaatgagcaggtgctggcctgctggagcgactgccgcttctacccagccaaggtgacagctgtgaacaaggatggcacctacacagtgaagttctatgatggagtggtgcagacagtgaagcacatccacgtgaaggccttcagcaaggaccagaacatcgtgggcaatgcccggcccaaggagacagaccacaagagcctgagcagcagcccagacaagcgggagaagttcaaggagcagaggaaggccaccgtgaatgtgaagaaggacaaggaggacaagcccctgaagacagagaagaggcccaagcagcctgacaaggagggcaagctgatctgcagcgagaagggcaaggtgtctgagaagagcctgcccaagaatgagaaggaggacaaggagaacatcagtgaaaatgaccgggagtacagcggagatgcccagaagacccggcagacccccttccacagcagctactgctgcggcttcaagctgagcaactttgccaccaacaacattggaacagagaagaaggagaacatcaagaggatgtag

SEQ ID NO: 16417 - DNA, 2289 bp, Artificial Sequence
  Description of Artificial Sequence: Synthetic coding sequence
atggagggccccaggagcagcacccacgtgcccctggtgctgcccctgctggtgctgctgctgctggccccagcccggcaggccgccgcccagcgctgcccccaggcctgcatctgtgacaacagcagaagacatgtggcctgccgctaccagaacctgacagaggtgcctgatgccatccctgagctgacccagaggctggacctgcagggcaacctgctgaaggtgatcccagctgctgccttccagggcgtgccccacctgacccacctggacctgcggcactgtgaggtggagctggtggccgagggcgccttccggggcctgggccgcctgctgctgctgaacctggccagcaaccacctgcgggagctgccccaggaggccctggatggcctgggcagcctgcggcggctggagctggagggcaatgccctggaggagctgcggcccggcaccttcggggccctgggcgccctggccaccctgaacctggcccacaatgccctggtgtacctgcctgccatggccttccagggcctgctgcgggtgcgctggctgcggctgagccacaatgccctgtctgtgctggcccctgaggccctggccggcctgcctgccctgcggcggctgagcctgcaccacaatgagctgcaggccctgcccggccctgtgctgagccaggcccggggcctggcccggctggagctgggccacaaccccctgacctacgccggggaggaggatggcctggccctgcccggcctgcgggagctgctgctggatggaggagccctgcaggccctgggcccccgggcctttgcccactgcccccggctgcacaccctggacctgcggggcaaccagctggacaccctgccccccctgcagggccctggccagctgcggcggctgcggctgcagggcaaccccctgtggtgtggctgccaggcccggcccctgctggagtggctggcccgggcccgggtgcggagtgatggagcctgccagggcccccggcggctgcggggggaggccctggatgccctgcggccctgggacctgcgctgccctggagatgctgcccaggaggaggaggagctggaggagagagctgtggccggcccccgggccccaccccggggccccccccggggccctggagaggagagagctgtggccccctgcccccgggcctgtgtgtgtgtgcctgagagccgccacagcagctgtgagggctgcggcctgcaggccgtgccccggggcttccccagcgacacccagctgctggacctgcggaggaaccacttccccagcgtgcccagggctgccttccctggcctgggccacctggtgtccctgcacctgcagcactgcggcattgctgagctggaggccggggccctggccggcctgggccgcctcatctacctgtacctgagtgacaaccagctggccggcctgtctgctgctgccctggagggcgccccccggctgggctacctgtacctggagaggaaccgcttcctgcaggtgcctggagctgccctgcgggccctgcccagcctcttcagcctgcacctgcaggacaatgctgtggaccggctggcccctggggacctgggccgcacccgggccctgcgctgggtgtacctgagcggcaaccgcatcacagaggtgtccctgggcgccctgggccctgcccgggagctggagaagctgcacctggacaggaaccagctgcgggaggtgcccaccggggccctggagggcctgcctgccctgctggagctgcagctgagcggcaaccccctgcgggccctgagagatggagccttccagcctgtgggccgcagcctgcagcacctgttcctgaacagcagcggcctggagcagatctgccctggggccttcagcggcctgggccctggcctgcagagcctgcacctgcagaagaaccagctgcgggccctgcctgccctgcccagcctgagccagctggagctgattgacctgagcagcaaccccttccactgtgactgccagctgctgcccctgcaccgctggctgaccggcctgaacctgcgggtgggcgccacctgtgccaccccaccaaatgcccggggccagagggtgaaggctgctgctgctgtgtttgaggactgccccggctgggccgccaggaaggccaagaggaccccagccagccggcccagcgcccggaggacccccatcaagggccggcagtgtggggctgacaaggtgggcaaggagaagggccgcctgtag

SEQ ID NO: 16418 - DNA, 1146 bp, Artificial Sequence
  Description of Artificial Sequence: Synthetic coding sequence
atgaagacagtgaaggagaagaaggagtgccagaggctgaggaagagcgccaagacccggcgggtgacccagaggaagcccagcagcggccctgtgtgctggctgtgcctgcgggagcccggggaccctgagaagctgggggagttcctgcagaaggacaacatctctgtgcactacttctgcctgatcctgagcagcaagctgccccagaggggccagagcaacagaggcttccacggcttcctgcctgaggacatcaagaaggaggccgcccgggccagcaggaagatctgctttgtgtgcaagaagaagggggccgccatcaactgccagaaggaccagtgcctgaggaacttccacctgccctgtggccaggagcggggctgcctgagccagttcttcggggagtacaagagcttctgtgacaagcaccggcccacccagaacatccagcacggccacgtgggggaggagagctgcatcctgtgctgtgaggacctgagccagcagagcgtggagaacatccagagcccctgctgcagccaggccatctaccacaggaagtgcatccagaagtatgcccacaccagcgccaagcacttcttcaagtgcccccagtgcaacaacaggaaggagttcccccaggagatgctgaggatgggcatccacatcccagacagagatgctgcctgggagctggagcccggggccttcagtgacctgtaccagcgctaccagcactgtgatgcccccatctgcctgtatgagcagggccgggacagctttgaagatgagggccgctggtgcctgatcctgtgtgccacctgtggcagccacggcacccaccgggactgcagcagcctgcggagcaacagcaagaagtgggagtgtgaagaatgttctccagctgctgccacagactacatcccagaaaattctggggacatcccctgctgcagcagcaccttccaccctgaggagcacttctgccgggacaacaccctggaggagaaccctggcctgtcctggacagactggccagagcccagcctgctggagaagccagagagcagccggggcagaagaagctacagctggaggagcaaaggagtgcgcatcaccaacagctgcaagaagagcaagtag

SEQ ID NO: 16419 - DNA, 1029 bp, Artificial Sequence
  Description of Artificial Sequence: Synthetic coding sequence
atgaagacagtgaaggagaagaaggagtgccagaggctgaggaagagcgccaagacccggcgggtgacccagaggaagcccagcagcggccctgtgtgctggctgtgcctgcgggagcccggggaccctgagaagctgggggagttcctgcagaaggacaacatctctgtgcactacttctgcctgatcctgagcagcaagctgccccagaggggccagagcaacagaggcttccacggcttcctgcctgaggacatcaagaaggaggccgcccgggccagcaggaagatctgctttgtgtgcaagaagaagggggccgccatcaactgccagaaggaccagtgcctgaggaacttccacctgccctgtggccaggagcggggctgcctgagccagttcttcggggagtacaagagcttctgtgacaagcaccggcccacccagaacatccagcacggccacgtgggggaggagagctgcatcctgtgctgtgaggacctgagccagcagagcgtggagaacatccagagcccctgctgcagccaggccatctaccacaggaagtgcatccagaagtatgcccacaccagcgccaagcacttcttcaagtgcccccagtgcaacaacaggaaggagttcccccaggagatgctgaggatgggcatccacatcccagaccggcgctggtgcctgatcctgtgtgccacctgtggcagccacggcacccaccgggactgcagcagcctgcggagcaacagcaagaagtgggagtgtgaggagtgcagccctgctgctgccacagactacatccctgagaacagcggggacatcccctgctgcagcagcaccttccaccctgaggagcacttctgccgggacaacaccctggaggagaaccctggcctgtcctggacagactggccagagcccagcctgctggagaagccagagagcagccggggccgccgcagctacagctggaggagcaagggcgtgcgcatcaccaacagctgcaagaagagcaagtag

SEQ ID NO: 16420 - DNA, 873 bp, Artificial Sequence
  Description of Artificial Sequence: Synthetic coding sequence
ttcaacaggaagatctgctttgtgtgcaagaagaagggggccgccatcaactgccagaaggaccagtgcctgaggaacttccacctgccctgtggccaggagcggggctgcctgagccagttcttcggggagtacaagagcttctgtgacaagcaccggcccacccagaacatccagcacggccacgtgggggaggagagctgcatcctgtgctgtgaggacctgagccagcagagcgtggagaacatccagagcccctgctgcagccaggccatctaccacaggaagtgcatccagaagtatgcccacaccagcgccaagcacttcttcaagtgcccccagtgcaacaacaggaaggagttcccccaggagatgctgaggatgggcatccacatcccagacagcagagatgctgcctgggagctggagcccggggccttcagtgacctgtaccagcgctaccagcactgtgatgcccccatctgcctgtatgagcagggccgggacagctttgaagatgagggccgctggtgcctgatcctgtgtgccacctgtggcagccacggcacccaccgggactgcagcagcctgcggagcaacagcaagaagtgggagtgtgaggagtgcagccctgctgctgccacagactacatccctgagaacagcggggacatcccctgctgcagcagcaccttccaccctgaggagcacttctgccgggacaacaccctggaggagaaccctggcctgtcctggacagactggccagagcccagcctgctggagaagccagagagcagccggggccgccgcagctacagctggaggagcaagggcgtgcgcatcaccaacagctgcaagaagagcaagtag

SEQ ID NO: 16421 - DNA, 642 bp, Artificial Sequence
  Description of Artificial Sequence: Synthetic coding sequence
atgctgcgggagcccggggaccctgagaagctgggggagttcctgcagaaggacaacatctctgtgcactacttctgcctgatcctgagcagcaagctgccccagaggggccagagcaacagaggctccatggacttctgcctgaagaccagcaagaggcggcagcccggcctgctgggccgcagcgccctgtgtgccaggaagcgggagctgctgagcacagcccggcgcatcagcgccagcgagaccagcatctgcctggtggccaagaagggcgtggccttccacaacttcctggagagcaccaaccactttgtgaccaacatcgcccagcacaggaccagcaacatgggcatgtggggcaggaaggccgccagctatgtggtgaagacctaccccaacagagtgctgcggaccagccgggcccgggtggtggtgaagcccagcaccacagccagcgcctacagaaacatgcccacccaccagcagagcatcagcagcaatgtgcacagcgtgaccatcgagcgggtgagcagcagaaatgcagaaaatggaaacagctacagccggcaggaggtggtgccccacagcgtgtgctacatgaggatccccaggaacccccagggcctgctgctgtcctag

SEQ ID NO: 16422 - DNA, 72 bp, Artificial Sequence
  Description of Artificial Sequence: Synthetic coding sequence
atgaagacagtgaaggagaagaaggagtgccagaggctgaggaagagcgccaagacccggcgggtgacctag

SEQ ID NO: 16423 - DNA, 1146 bp, Artificial Sequence; identical to SEQ ID NO: 16418
  Description of Artificial Sequence: Synthetic coding sequence

SEQ ID NO: 16424 - DNA, 1557 bp, Artificial Sequence
  Description of Artificial Sequence: Synthetic coding sequence
atggaccagaccccaccagcccggcctgagtacctggtgtctggcatccgcaccccacctgtgagaagaaacagcaagctggccaccctgggccgcatcttcaagccctggaagtggaggaagaagaagaatgagaagctgaagcagaccaccagcgccctggagaagaagatggccggccggcagggccgggaggagctgatcaagaagggcctgctggagatgatggagcaggatgctgagagcaagacctgcaacccagatggcggccccaggtctgtgcagagcgagccccccacccccaagtctgagaccctgaccagtgaagatgcccagcccggcagccccctggccactggaacagaccaggtgtccctggacaagcccctgagcagcgctgcccacctggatgatgctgccaagatgcccagcgccagcagtggagaggaggctgatgctggcagcctgctgcccaccaccaatgagctgagccaggccctggccggggctgacagcctggacagccccccccggcccctggagaggtctgtgggccagctgcccagcccccccctgctgcccaccccaccacccaaggccagcagcaagaccaccaagaatgtgacaggccaggccaccctcttccaggccagctccatgaagtctgctgaccccagcctgcggggccagctgagcacccccaccggcagcccccacctgaccaccgtgcaccggcccctgccccccagccgggtgattgaggagctgcaccgggccctggccaccaagcaccggcaggacagcttccagggccgggagagcaagggcagccccaagaagaggctggatgtgcggctgagcaggaccagctctgtggagcggggcaaggagcgggaggaggcctggagctttgatggagccctggagaacaagaggacagctgccaaggagagcgaggagaacaaggaaaatctcatcatcaacagcgagctgaaggatgacctgctgctgtaccaggatgaggaggccctgaatgacagcatcatcagcggcaccctgcccaggaagtgcaagaaggagctgctggccgtgaagctgaggaaccggcccagcaagcaggagctggaggacaggaacatcttccccaggagaacagatgaggagcggcaggagatccggcagcagatcgagatgaagctgagcaagaggctgagccagaggcctgctgtggaggagctggagaggaggaacatcctgaagcagagaaatgaccagacagagcaggaggagcggcgggagatcaagcagaggctgaccaggaagctgaaccagaggcccaccgtggatgagctgcgggacaggaagatcctgatccgcttcagtgactatgtggaggtggccaaggcccaggactatgaccggcgggctgacaagccctggacccggctgtctgctgctgacaaggccgccatcaggaaggagctgaatgagtacaagagcaatgagatggaggtgcacgccagcagcaagcacctgacccgcttccaccggccctag

SEQ ID NO: 16425 - DNA, 1347 bp, Artificial Sequence
  Description of Artificial Sequence: Synthetic coding sequence
atggaccagaccccaccagcccggcctgagtacctggtgtctggcatccgcaccccacctgtgagaagaaacagcaagctggccaccctgggccgcatcttcaagccctggaagtggaggaagaagaagaatgagaagctgaagcagaccaccagcgccctggagaagaagatggccggccggcagggccgggaggagctgatcaagaagggcctgctggagatgatggagcaggatgctgagagcaagacctgcaacccagatggcggccccaggtctgtgcagagcgagccccccacccccaagtctgagaccctgaccagtgaagatgcccagcccggcagccccctggccactggaacagaccaggtgtccctggacaagcccctgagcagcgctgcccacctggatgatgctggccaggccaccctcttccaggccagctccatgaagtctgctgaccccagcctgcggggccagctgagcacccccaccggcagcccccacctgaccaccgtgcaccggcccctgccccccagccgggtgattgaggagctgcaccgggccctggccaccaagcaccggcaggacagcttccagggccgggagagcaagggcagccccaagaagaggctggatgtgcggctgagcaggaccagctctgtggagcggggcaaggagcgggaggaggcctggagctttgatggagccctggagaacaagaggacagctgccaaggagagcgaggagaacaaggaaaatctcatcatcaacagcgagctgaaggatgacctgctgctgtaccaggatgaggaggccctgaatgacagcatcatcagcggcaccctgcccaggaagtgcaagaaggagctgctggccgtgaagctgaggaaccggcccagcaagcaggagctggaggacaggaacatcttccccaggagaacagatgaggagcggcaggagatccggcagcagatcgagatgaagctgagcaagaggctgagccagaggcctgctgtggaggagctggagaggaggaacatcctgaagcagagaaatgaccagacagagcaggaggagcggcgggagatcaagcagaggctgaccaggaagctgaaccagaggcccaccgtggatgagctgcgggacaggaagatcctgatccgcttcagtgactatgtggaggtggccaaggcccaggactatgaccggcgggctgacaagccctggacccggctgtctgctgctgacaaggccgccatcaggaaggagctgaatgagtacaagagcaatgagatggaggtgcacgccagcagcaagcacctgacccgcttccaccggccctag

SEQ ID NO: 16426 - DNA, 1680 bp, Artificial Sequence
  Description of Artificial Sequence: Synthetic coding sequence
atggccgcctctgaagatggcagcggctgcctggtgtcccggggccgcagccagagcgaccccagcgtgctgacagacagcagcgccaccagcagcgcagatgctggagaaaatccagatgagatggaccagaccccaccagcccggcctgagtacctggtgtctggcatccgcaccccacctgtgagaagaaacagcaagctggccaccctgggccgcatcttcaagccctggaagtggaggaagaagaagaatgagaagctgaagcagaccaccagcgccctggagaagaagatggccggccggcagggccgggaggagctgatcaagaagggcctgctggagatgatggagcaggatgctgagagcaagacctgcaacccagatggcggccccaggtctgtgcagagcgagccccccacccccaagtctgagaccctgaccagtgaagatgcccagcccggcagccccctggccaccggcacagaccaggtgtccctggacaagcccctgagcagcgctgcccacctggatgatgctgccaagatgcccagcgccagcagcggggaggaggctgatgctggcagcctgctgcccaccaccaatgagctgagccaggccctggccggggctgacagcctggacagccccccccggcccctggagaggtctgtgggccagctgcccagcccccccctgctgcccaccccaccacccaaggccagcagcaagaccaccaagaatgtgacaggccaggccaccctcttccaggccagctccatgaagtctgctgaccccagcctgcggggccagctgagcacccccaccggcagcccccacctgaccaccgtgcaccggcccctgccccccagcagggtcatcgaggagctgcaccgggccctggccaccaagcaccggcaggacagcttccagggccgggagagcaagggcagccccaagaagaggctggatgtgcggctgagcaggaccagctctgtggagcggggcaaggagcgggaggaggcctggagctttgatggagccctggagaacaagaggacagctgccaaggagagcgaggagaacaaggagaacctgatcatcaacagcgagctgaaggatgacctgctgctgtaccaggatgaggaggccctgaatgacagcatcatcagcggcaccctgcccaggaagtgcaagaaggagctgctggccgtgaagctgaggaaccggcccagcaagcaggagctggaggacaggaacatcttccccaggagaacagatgaggagcggcaggagatccggcagcagatcgagatgaagctgagcaagaggctgagccagaggcctgctgtggaggagctggagaggaggaacatcctgaagcagagaaatgaccagacagagcaggaggagcggcgggagatcaagcagaggctgaccaggaagctgaaccagaggcccaccgtggatgagctgcgggacaggaagatcctgatccgcttcagtgactatgtggaggtggccaaggcccaggactatgacagaagagctgacaagccctggacccggctgtctgctgctgacaaggccgccatcaggaaggagctgaatgagtacaagagcaatgagatggaggtgcacgccagcagcaagcacctgacccgcttccaccggccctag

SEQ ID NO: 16427 - DNA, 1557 bp, Artificial Sequence; identical to SEQ ID NO: 16424
  Description of Artificial Sequence: Synthetic coding sequence

SEQ ID NO: 16428 - DNA, 1347 bp, Artificial Sequence; identical to SEQ ID NO: 16425
  Description of Artificial Sequence: Synthetic coding sequence

SEQ ID NO: 16429 - DNA, 126 bp, Artificial Sequence
  Description of Artificial Sequence: Synthetic coding sequence
atggccgcctctgaagatggcagcggctgcctggtgtcccggggccgcagccagagcgaccccagcgtgctgacagacagcagcgccaccagcagcgcagatgctggagaaaatccagatgaatag

SEQ ID NO: 16430 - DNA, 1557 bp, Artificial Sequence; identical to SEQ ID NO: 16424
  Description of Artificial Sequence: Synthetic coding sequence

SEQ ID NO: 16431 - DNA, 2430 bp, Artificial Sequence
  Description of Artificial Sequence: Synthetic coding sequence
atgtatgaggccctgcccggccctgccccagaaaatgaagatggcctggtgaaggtgaaggaggaggaccccacctgggagcaggtgtgcaacagccaggagggcagcagccacacccaggagatctgccgcctgcgcttccgccacttctgctaccaggaggcccacggcccccaggaggccctggcccagctgcgggagctgtgccaccagtggctgcggcctgagatgcacaccaaggagcagatcatggagctgctggtgctggagcagttcctgaccatcctgcccaaggagctgcagccctgtgtgaagacctaccccctggagagcggggaggaggccgtgacagtgctggagaacctggagaccggcagcggggacaccggccagcaggcctctgtgtacatccagggccaggacatgcaccccatggtggccgagtaccagggcgtgtccctggagtgccagagcctgcagctgctgcccggcatcaccaccctgaagtgtgagcccccccagaggccccagggcaacccccaggaggtgtctggccctgtgccccacggcagcgcccacctgcaggagaagaacccccgggacaaggctgtggtgcctgtgttcaaccctgtgcgcagccagaccctggtgaagacagaggaggagacagcccaggccgtggccgctgagaagtggagccacctgagcctgaccaggaggaacctgtgtggcaacagcgcccaggagaccgtgatgagcctgagccccatgacagaggagatcgtgaccaaggacaggctcttcaaggccaagcaggagaccagcgaggagatggagcagagcggggaggccagcggcaagcccaacagagaatgtgccccccagatcccctgcagcacccccatcgccacagagaggacagtggcccacctgaacaccctgaaggacagacaccctggggacctgtgggccaggatgcacatcagcagcctggagtatgctgctggggacatcaccaggaaaggaaggaagaaggacaaggcccgggtgtctgagctgctgcagggcctgtccttcagcggggacagtgatgtggagaaggacaatgaacctgagatccagcctgcccagaagaagctgaaggtgtcctgcttccctgagaagtcctggaccaagagggacatcaagcccaacttccccagctggagcgccctggacagcggcctgctgaacctgaagtctgagaagctgaaccctgtggagctgtttgagctgttctttgatgatgagaccttcaacctgattgtgaatgagaccaacaactatgccagccagaagaatgtgtccctggaggtgacagtgcaggagatgagatgtgtgtttggagtgctgctgctgagcggcttcatgaggcacccccggcgggagatgtactgggaggtgtctgacacagaccagaacctggtgagagatgccatccggcgggacagatttgagctgatcttcagcaacctgcactttgctgacaatggccacctggaccagaaggacaagttcaccaagctgcggcccctcatcaagcagatgaacaagaacttcctgctgtatgcccccctggaggagtactactgctttgacaagtccatgtgtgaatgttttgacagcgaccagttcctgaatggcaagcccatccgcatcggctacaagatctggtgtggcaccaccacccagggctacctggtgtggtttgagccctaccaggaggagagcaccatgaaggtggatgaggaccctgacctgggcctgggcggcaacctggtgatgaactttgctgatgtgctgctggagcggggccagtacccctaccacctgtgctttgacagcttcttcacctctgtgaagctgctgagcgccctgaagaagaagggcgtgcgggccaccggcaccatccgggagaacagaacagagaagtgccccctgatgaatgtggagcacatgaagaagatgaagaggggctactttgacttccgcatcgaggagaacaatgagatcatcctgtgccgctggtatggagatggcatcatcagcctgtgcagcaatgctgtgggcatcgagcctgtgaatgaggtgtcctgctgtgatgctgacaatgaggagatcccccagatcagccagcccagcatcgtgaaggtgtatgatgagtgcaaggagggcgtggccaagatggaccagatcatcagcaagtacagagtgcgcatccgcagcaagaagtggtacagcatcctggtgtcctacatgattgatgtggccatgaacaatgcctggcagctgcaccgggcctgcaaccctggggccagcctggaccccctggacttcagaagatttgtggcccacttctacctggagcacaatgcccacctgagtgactag

SEQ ID NO: 16432 - DNA, 2430 bp, Artificial Sequence; identical to SEQ ID NO: 16431
  Description of Artificial Sequence: Synthetic coding sequence

SEQ ID NO: 16433 - DNA, 2418 bp, Artificial Sequence
  Description of Artificial Sequence: Synthetic coding sequence
atgtgggaccagggcggccagccctggcagcagtggcccctgaaccagcagcagtggatgcagagcttccagcaccagcaggaccccagccagattgactgggccgccctggcccaggcctggatcgcccagcgggaggccagcggccagcagagcatggtggagcagcccccaggcatgatgcccaacggccaggacatgagcaccatggagagcggccccaacaaccacggcaacttccagggcgacagcaacttcaacaggatgtggcagcctgagtggggcatgcaccagcagcccccccaccccccaccagaccagccctggatgccacccaccccaggccccatggacatcgtgcccccatctgaggacagcaacagccaggacagcggggagtttgccccagacaacagacacatcttcaaccagaacaaccacaactttggaggccccccagacaactttgctgtgggccctgtgaaccagtttgactaccagcacggggccgccttcggccccccccagggcggcttccaccccccctactggcagcccggccccccaggccccccagccccaccccagaacagaagagagcggcccagcagcttccgggaccggcagaggagccccatcgccctgcctgtgaagcaggagcccccccagattgatgctgtgaagaggaggaccctgcctgcctggatccgggagggcctggagaagatggagcgggagaagcagaagaagctggagaaggagaggatggagcagcagaggagccagctgagcaagaaggagaagaaggccacagaagatgctgagggcggagatggcccccggctgccccagaggagcaagtttgacagtgatgaggaggaggaggacacagaaaatgtggaggccgccagcagcggcaaggtgaccaggagccccagccctgtgccccaggaggagcacagcgaccctgagatgacagaggaggagaaggagtaccagatgatgctgctgaccaagatgctgctgacagagatcctgctggatgtgacagatgaggagatctactacgtggccaaggatgcccacaggaaggccaccaaggccccagccaagcagctggcccagagcagcgccctggccagcctgaccggcctgggcggcctgggcggctacggcagcggggacagtgaagatgagaggagtgaccggggcagcgagagcagtgacacagatgatgaggagctgcggcaccgcatccggcagaagcaggaggccttctggaggaaggagaaggagcagcagctgctgcatgacaagcagatggaggaggagaagcagcagacagagcgggtgaccaaggagatgaatgagttcatccacaaggagcagaacagcctgagcctgctggaggcccgggaggctgatggagatgtggtgaatgagaagaagaggaccccaaatgagaccacctctgtgctggagcccaagaaggagcacaaggagaaggagaagcagggccgcagccgcagcggcagcagcagcagcggcagcagcagcagcaacagcaggaccagcagcaccagcagcacagtgagcagcagcagctacagcagcagcagcggcagcagcaggaccagcagccgcagcagcagccccaagaggaagaagaggcacagccgcagccgcagccccaccatcaaggcccggcgcagccgcagccgcagctacagccgccgcatcaagattgagagcaacagagcccgggtgaagatccgggacagaagaagaagcaacagaaattccattgaaagagagaggagaagaaacagaagccccagccgggagaggagaagaagccgcagccgcagccgggacaggaggaccaacagagccagccgcagccgcagccgggacaggaggaagattgatgaccagaggggcaacctgagcggcaacagccacaagcacaagggggaggccaaggagcaggagaggaagaaggagaggagccgcagcattgacaaggacaggaagaagaaggacaaggagcgggagcgggagcaggacaagaggaaggagaagcagaagcgggaggagaaggacttcaagttcagcagccaggatgaccggctgaagaggaagcgggagagcgagaggaccttcagccgcagcggcagcatctctgtgaagatcatcagacatgacagccggcaggacagcaagaagagcaccaccaaggacagcaagaagcacagcggcagtgacagcagcggccgcagcagcagcgagagccctggcagcagcaaggagaagaaggccaagaagcccaagcacagccgcagccgctctgtggagaagagccagaggtctgggaagaaggccagcaggaagcacaagagcaagagccgcagcaggtag

SEQ ID NO: 16434 - DNA, 2418 bp, Artificial Sequence; identical to SEQ ID NO: 16433
  Description of Artificial Sequence: Synthetic coding sequence

SEQ ID NO: 16435 - DNA, 1830 bp, Artificial Sequence
  Description of Artificial Sequence: Synthetic coding sequence
atggagagcacagcctaccccctgaacctgagcctgaaggaggaggaggaggaggaggagatccagagccgggagctggaggatggccctgctgacatgcagaaggtgcgcatctgcagcgagggcggctgggtgcctgccctgtttgatgaggtggccatctacttcagtgatgaggagtgggaggtgctgacagagcagcagaaggccctgtaccgggaggtgatgaggatgaactatgagaccgtgctgagcctggagttccccttccccaagccagacatgatcacccggctggagggggaggaggagagccagaacagtgatgagtggcagctgcagggcggcaccagcgcagaaaatgaggagagtgatgtgaagcccccagactggcccaaccccatgaatgccaccagccagttcccccagccccagcactttgacagctttggcctgcggctgccccgggacatcacagagctgcctgagtggagcgagggctaccccttctacatggccatgggcttccctggctatgacctgtctgcagatgacattgctgggaagttccagttcagccggggcatgagaagaagctatgatgctggcttcaagctgatggtggtggagtatgcagagagcaccaacaactgccaggccgccaagcagtttggagtgctggagaagaatgtgcgggactggaggaaggtgaagccccagctgcagaatgcccacgccatgaggcgggccttccggggccccaagaatggccgctttgccctggtggaccagagggtggccgagtatgtgcgctacatgcaggccaagggggaccccatcacccgggaggccatgcagctgaaggccctggagatcgcccaggagatgaacatccctgagaagggcttcaaggccagcctgggctggtgcaggaggatgatgagaagatatgacctgagcctgcggcacaaggtgcctgtgccccagcacctgcctgaggacctgacagagaagctggtgacctaccagaggtctgtgctggccctgcggcgggcccatgactatgaggtggcccagatgggaaatgctgatgagacccccatctgcctggaggtgcccagccgggtgacagtggacaaccagggcgagaagcctgtgctggtgaagaccccaggccgggagaagctgaagatcacagccatgctgggcgtgctggctgatggcaggaagctgcccccctacatcatcctgcggggcacctacatccccccaggcaagttccccagcggcatggagatccgctgccacagatatggctggatgacagaggacctgatgcaggactggctggaggtggtgtggaggagaagaactggagctgtgcccaagcagaggggcatgctgatcctgaatggcttccggggccacgccacagacagcgtgaagaacagcatggagagcatgaacacagacatggtgatcatccctgggggcctgaccagccagctgcaggtgctggatgtggtggtgtacaagcccctgaatgattctgtgcgggcccagtacagcaactggctgctggccggcaacctggccctgagccccactggaaatgccaagaagccacccctgggcctcttcctggagtgggtgatggtggcctggaacagcatcagcagcgagagcatcgtgcagggcttcaagaagtgccacatcagcagcaacctggaggaggaggatgatgtgctgtgggagattgagagcgagctgcccggcggcggggagccccccaaggactgtgacacagagagcatggccgagagcaactag

SEQ ID NO: 16436 - DNA, 1830 bp, Artificial Sequence; identical to SEQ ID NO: 16435
  Description of Artificial Sequence: Synthetic coding sequence

SEQ ID NO: 16437 - DNA, 630 bp, Artificial Sequence
  Description of Artificial Sequence: Synthetic coding sequence
atggagagcacagcctaccccctgaacctgagcctgaaggaggaggaggaggaggaggagatccagagccgggagctggaggatggccctgctgacatgcagaaggtgcgcatctgcagcgagggcggctgggtgcctgccctgtttgatgaggtggccatctacttcagtgatgaggagtgggaggtgctgacagagcagcagaaggccctgtaccgggaggtgatgaggatgaactatgagaccgtgctgagcctggagttccccttccccaagccagacatgatcacccggctggagggggaggaggagagccagaacagtgatgagtggcagctgcagggcggcaccagcgcagaaaatgaggagagtgatgtgaagcccccagactggcccaaccccatgaatgccaccagccagttcccccagccccagcactttgacagctttggcctgcggctgccccgggacatcacagagctgcctgagtggagcgagggctaccccttctacatggccatgggcttccctggctatgacctgtctgcagatgacattgctgggaagttccagttcagccggggcatgagaagaagctatgatgctggcttcaagctgatggtggtgtag

SEQ ID NO: 16438 - DNA, 1575 bp, Artificial Sequence
  Description of Artificial Sequence: Synthetic coding sequence
atggagttccccttccccaagccagacatgatcacccggctggagggggaggaggagagccagaacagtgatgagtggcagctgcagggcggcaccagcgcagaaaatgaggagagtgatgtgaagcccccagactggcccaaccccatgaatgccaccagccagttcccccagccccagcactttgacagctttggcctgcggctgccccgggacatcacagagctgcctgagtggagcgagggctaccccttctacatggccatgggcttccctggctatgacctgtctgcagatgacattgctgggaagttccagttcagccggggcatgaggaggagctatgatgctggcttcaagctgatggtggtggagtatgcagagagcaccaacaactgccaggccgccaagcagtttggagtgctggagaagaatgtgcgggactggaggaaggtgaagccccagctgcagaatgcccacgccatgagaagagccttccggggccccaagaatggccgctttgccctggtggaccagagggtggccgagtatgtgcgctacatgcaggccaagggggaccccatcacccgggaggccatgcagctgaaggccctggagatcgcccaggagatgaacatccctgagaagggcttcaaggccagcctgggctggtgcaggaggatgatgagaagatatgacctgagcctgcggcacaaggtgcctgtgccccagcacctgcctgaggacctgacagagaagctggtgacctaccagaggtctgtgctggccctgcggcgggcccatgactatgaggtggcccagatgggaaatgctgatgagacccccatctgcctggaggtgcccagccgggtgacagtggacaaccagggcgagaagcctgtgctggtgaagaccccaggccgggagaagctgaagatcacagccatgctgggcgtgctggctgatggcaggaagctgcccccctacatcatcctgcggggcacctacatccccccaggcaagttccccagcggcatggagatccgctgccacagatatggctggatgacagaggacctgatgcaggactggctggaggtggtgtggaggagaagaactggagctgtgcccaagcagaggggcatgctgatcctgaatggcttccggggccacgccacagattctgtgaagaacagcatggagagcatgaacacagacatggtgatcatccctgggggcctgaccagccagctgcaggtgctggatgtggtggtgtacaagcccctgaatgacagcgtgcgggcccagtacagcaactggctgctggccggcaacctggccctgagccccactggaaatgccaagaagccacccctgggcctcttcctggagtgggtgatggtggcctggaacagcatcagcagcgagagcatcgtgcagggcttcaagaagtgccacatcagcagcaacctggaggaggaggatgatgtgctgtgggagattgaaagtgagctgcccggcggcggggagccccccaaggactgtgacacagagagcatggccgagagcaactag

SEQ ID NO: 16439 - DNA, 2211 bp, Artificial Sequence
  Description of Artificial Sequence: Synthetic coding sequence
atgaaggagatgtctgccaacacagtgctggacagccagaggcagcagaagcactacggcatcaccagccccatcagcctggccagccccaaggagattgaccacatctacacccagaagctgattgatgccatgaagcccttcggcgtgtttgaagatgaggaggagctgaaccaccggctggtggtgctgggcaagctgaacaacctggtgaaggagtggatcagtgatgtgtctgagagcaagaacctgcccccatctgtggtggccaccgtgggcggcaagatcttcaccttcggcagctaccgcctgggcgtgcacaccaagggagctgacattgatgccctgtgtgtggcccccaggcatgtggagaggagtgacttcttccagagcttctttgagaagctgaagcaccaggacggcatccggaacctgcgggctgtggaggatgcctttgtgcctgtgatcaagtttgaatttgatggcattgaaattgacctggtgtttgcccggctggccatccagaccatcagtgacaacctggacctgagagatgacagccggctgcggagcctggacatccgctgcatccgcagcctgaatggctgccgggtgacagatgagatcctgcacctggtgcccaacaaggagaccttccggctgaccctgcgggctgtgaagctgtgggccaagaggcggggcatctacagcaacatgctgggcttcctgggcggcgtgtcctgggccatgctggtggcccggacctgccagctgtacccaaatgctgctgccagcaccctggtgcacaagttcttcctggtgttcagcaagtgggagtggcccaaccctgtgctgctgaagcagcctgaggagagcaacctgaacctgcctgtgtgggacccccgggtgaaccccagcgaccgctaccacctgatgcccatcatcaccccagcctacccccagcagaacagcacctacaacgtgtccaccagcaccaggacagtgatggtggaggagttcaagcagggcctggccgtgacagatgagatcctgcagggcaagagtgactggagcaagctgctggagccccccaacttcttccagaagtaccgccactacatcgtgctgacagccagcgccagcacagaggagaaccacctggagtgggtgggcctggtggagagcaagatccgggtgctggtgggcaacctggagagaaatgagttcatcaccctggcccacgtgaacccccagagcttccctggcaacaaggagcaccacaaggacaacaactacgtgtccatgtggttcctgggcatcatcttcagaagagtggagaatgctgagagcgtgaacatcgacctgacctatgacatccagagcttcacagacacagtgtaccggcaggccaacaacatcaacatgctgaaggagggcatgaagattgaggccacccacgtgaagaagaagcagctgcaccactacctgcctgctgagatcctgcagaagaagaagaagcagagcctgagtgatgtgaacagaagcagcggcggcctgcagagcaagaggctgagcctggacagcagctgcctggacagcagccgggacacagacaatggcacccccttcaacagccctgccagcaagagtgacagccccagcgtgggggagacagagaggaacagcgctgagcctgctgctgtgattgtggagaagcccctgtctgtgcccccagcccagggcctgagcatccctgtgattggagccaaggtggacagcacagtgaagacagtgagcccccccaccgtgtgcaccatccccaccgtggtgggcagaaatgtcatcccccgcatcaccaccccccacaacccagcccagggccagccccacctgaatggcatgagcaacatcaccaagacagtgacccccaagaggagccacagccccagcattgatggcacccccaagaggctgaaggatgtggagaagttcatccggctggagagcaccttcaaggaccccaggacagctgaggagaggaagaggaagtctgtggatgccatcggcggggagagcatgcccatccccaccatcgacaccagcaggaagaagaggctgcccagcaaggagctgcctgacagcagcagccctgtgcctgccaacaacatccgggtcatcaagaacagcatccggctgaccctgaacagatag

SEQ ID NO: 16440 - DNA, 1212 bp, Artificial Sequence
  Description of Artificial Sequence: Synthetic coding sequence
atgcccatcatcaccccagcctacccccagcagaacagcacctacaacgtgtccaccagcaccaggacagtgatggtggaggagttcaagcagggcctggccgtgacagatgagatcctgcagggcaagagtgactggagcaagctgctggagccccccaacttcttccagaagtaccgccactacatcgtgctgacagccagcgccagcacagaggagaaccacctggagtgggtgggcctggtggagagcaagatccgggtgctggtgggcaacctggagagaaatgagttcatcaccctggcccacgtgaacccccagagcttccctggcaacaaggagcaccacaaggacaacaactacgtgtccatgtggttcctgggcatcatcttccggcgggtggagaatgctgagagcgtgaacatcgacctgacctatgacatccagagcttcacagacacagtgtaccggcaggccaacaacatcaacatgctgaaggagggcatgaagattgaggccacccacgtgaagaagaagcagctgcaccactacctgcctgctgagatcctgcagaagaagaagaagcagagcctgagtgatgtgaacagaagcagcggcggcctgcagagcaagaggctgagcctggacagcagctgcctggacagcagccgggacacagacaatggcacccccttcaacagccctgccagcaagagtgacagccccagcgtgggggagacagaaagaaattctgctgagcctgctgctgtgattgtggagaagcccctgtctgtgcccccagcccagggcctgagcatccctgtgattggagccaaggtggacagcacagtgaagacagtgtccccacccaccgtgtgcaccatccccaccgtggtgggcagaaatgtcatcccccgcatcaccaccccccacaacccagcccagggccagccccacctgaatggcatgagcaacatcaccaagacagtgacccccaagaggagccacagccccagcattgatggcacccccaagaggctgaaggatgtggagaaggatgccatcggcggggagagcatgcccatccccaccatcgacaccagcaggaagaagaggctgcccagcaaggagctgcctgacagcagcagccctgtgcctgccaacaacatccgggtcatcaagaacagcatccggctgaccctgaacagatag

SEQ ID NO: 16441 - DNA, 1149 bp, Artificial Sequence
  Description of Artificial Sequence: Synthetic coding sequence
aggacagtgatggtggaggagttcaagcagggcctggccgtgacagatgagatcctgcagggcaagagtgactggagcaagctgctggagccccccaacttcttccagaagtaccgccactacatcgtgctgacagccagcgccagcacagaggagaaccacctggagtgggtgggcctggtggagagcaagatccgggtgctggtgggcaacctggagagaaatgagttcatcaccctggcccacgtgaacccccagagcttccctggcaacaaggagcaccacaaggacaacaactacgtgtccatgtggttcctgggcatcatcttcagaagagtggagaatgctgagagcgtgaacatcgacctgacctatgacatccagagcttcacagacacagtgtaccggcaggccaacaacatcaacatgctgaaggagggcatgaagattgaggccacccacgtgaagaagaagcagctgcaccactacctgcctgctgagatcctgcagaagaagaagaagcagagcctgagtgatgtgaacagaagcagcggcggcctgcagagcaagaggctgagcctggacagcagctgcctggacagcagccgggacacagacaatggcacccccttcaacagccctgccagcaagagtgacagccccagcgtgggggagacagagaggaacagcgctgagcctgctgctgtgattgtggagaagcccctgtctgtgcccccagcccagggcctgagcatccctgtgattggagccaaggtggacagcacagtgaagacagtgagcccccccaccgtgtgcaccatccccaccgtggtgggcagaaatgtcatcccccgcatcaccaccccccacaacccagcccagggccagccccacctgaatggcatgagcaacatcaccaagacagtgacccccaagaggagccacagccccagcattgatggcacccccaagaggctgaaggatgtggagaaggatgccatcggcggggagagcatgcccatccccaccatcgacaccagcaggaagaagaggctgcccagcaaggagctgcctgacagcagcagccctgtgcctgccaacaacatccgggtcatcaagaacagcatccggctgaccctgaacagatag

SEQ ID NO: 16442 - DNA, 642 bp, Artificial Sequence
  Description of Artificial Sequence: Synthetic coding sequence
atggctgtgctgagcgcccctggcctgcggggcttccgcatcctgggcctgcggagctctgtgggccctgctgtgcaggcccggggcgtgcaccagagcgtggccacagatggccccagcagcacccagcctgccctgcccaaggcccgggctgtggcccccaagcccagcagcagaggagaatatgtggtggccaagctggatgacctggtgaactgggcccggcgcagcagcctgtggcccatgaccttcggcctggcctgctgtgctgtggagatgatgcacatggccgcccccaggtatgacatggaccgcttcggcgtggtgttccgggccagcccccggcagagtgatgtgatgattgtggccggcaccctgaccaacaagatggccccagccctgaggaaggtgtatgaccagatgcctgagccccgctacgtggtgtccatgggcagctgtgccaatggaggcggctactaccactacagctacagcgtggtgcggggctgtgacagaattgtgcctgtggacatctacatccctggctgccccccaacagctgaggccctgctgtatggcatcctgcagctgcagaggaagatcaagcgggagcggcggctgcagatctggtacagaagatag

SEQ ID NO: 16443 - DNA, 1035 bp, Artificial Sequence
  Description of Artificial Sequence: Synthetic coding sequence
atgcacaggaccacccgcatcaagatcacagagctgaacccccacctgatgtgtgccctgtgtggcggctacttcattgatgccaccaccatcgtggagtgcctgcacagcttctgcaagacctgcatcgtgcgctacctggagaccaacaagtactgccccatgtgtgatgtgcaggtgcacaagacccggcccctgctgagcatccgcagtgacaagaccctgcaggacatcgtgtacaagctggtgcccggcctcttcaaggatgagatgaagagaagaagagacttctatgctgcctaccccctgacagaggtgcccaacggcagcaatgaagatagaggagaggtgctggagcaggagaagggggccctgagtgatgatgagatcgtgtccctgagcattgagttctatgagggcgcccgggacagagatgagaagaagggccccctggagaatggagatggagacaaggagaagacaggagtgcgcttcctgcgctgcccagctgccatgacagtgatgcacctggccaagttcctgaggaacaagatggatgtgcccagcaagtacaaggtggaggtgctgtatgaagatgagcccctgaaggagtactacaccctgatggacatcgcctacatctacccctggaggagaaatggccccctgcccctgaagtacagagtgcagcctgcctgcaagaggctgaccctggccaccgtgcccaccccatctgagggcaccaacaccagcggggcctctgaatgtgagagcgtgtctgacaaggcccccagccctgccaccctgcctgccaccagcagcagcctgcccagccctgccacccccagccacggcagccccagcagccacggccccccagccacccaccccaccagccccaccccacccagcacagccagcggggccaccacagctgccaacggcggcagcctgaactgcctgcagacccccagcagcaccagccggggcaggaagatgacagtgaatggagcccctgtgccccccctgacctag

SEQ ID NO: 16444 - DNA, 729 bp, Artificial Sequence
  Description of Artificial Sequence: Synthetic coding sequence
atgctgaccaggaagatcaagctgtgggacatcaatgcccacatcacctgccgcctgtgcagcggctacctgattgatgccaccaccgtgacagagtgcctgcacaccttctgccgcagctgcctggtgaagtacctggaggagaacaacacctgccccacctgcagaattgtcatccaccagagccaccccctgcagtacatcggccatgacaggaccatgcaggacatcgtgtacaagctggtgcccggcctgcaggaggccgagatgaggaagcagcgggagttctaccacaagctgggcatggaggtgcctggggacatcaagggggagacctgcagcgccaagcagcacctggacagccacagaaatggagagaccaaggcagatgacagcagcaacaaggaggccgctgaggagaagccagaggaggacaatgactaccacagaagtgatgagcaggtgtccatctgcctggagtgcaacagcagcaagctgcggggcctgaagaggaagtggatccgctgcagcgcccaggccaccgtgctgcacctgaagaagttcatcgccaagaagctgaacctgagcagcttcaatgagctggacatcctgtgcaatgaggagatcctgggcaaggaccacaccctgaagtttgtggtggtgacccgctggaggttcaagaaggcccccctgctgctgcactaccggcccaagatggacctgctgtag

SEQ ID NO: 16445 - DNA, 123 bp, Artificial Sequence
  Description of Artificial Sequence: Synthetic coding sequence
atgctgaccaggaagatcaagctgtgggacatcaatgcccacatcacctgccgcctgtgcagcggctacctgattgatgccaccaccgtgacagagtgcctgcacaccttctgccgctcctag

SEQ ID NO: 16446 - DNA, 189 bp, Artificial Sequence
  Description of Artificial Sequence: Synthetic coding sequence
atgctgaccaggaagatcaagctgtgggacatcaatgcccacatcacctgccgcctgtgcagcggctacctgattgatgccaccaccgtgacagagtgcctgcacaccttctgccgcagctgcctggtgaagtacctggaggagaacaacacctgccccacctgcagaattgtcatccaccagagctag

SEQ ID NO: 16447 - DNA, 330 bp, Artificial Sequence
  Description of Artificial Sequence: Synthetic coding sequence
atgctgaccaggaagatcaagctgtgggacatcaatgcccacatcacctgccgcctgtgcagcggctacctgattgatgccaccaccgtgacagagtgcctgcacaccttctgccgcagctgcctggtgaagtacctggaggagaacaacacctgccccacctgcagaattgtcatccaccagagccaccccctgcagtacatcggccatgacaggaccatgcaggacatcgtgtacaagctggtgcccggcctgcaggaggccgagatgaggaagcagcgggagttctaccacaagctgggcatggaggtgcctggggacatcaagtag

SEQ ID NO: 16448 - DNA, 729 bp, Artificial Sequence; identical to SEQ ID NO: 16444
  Description of Artificial Sequence: Synthetic coding sequence

SEQ ID NO: 16449 - DNA, 729 bp, Artificial Sequence; identical to SEQ ID NO: 16444
  Description of Artificial Sequence: Synthetic coding sequence

SEQ ID NO: 16450 - DNA, 627 bp, Artificial Sequence
  Description of Artificial Sequence: Synthetic coding sequence
atgacagtgtgccgcagctgcctggtgaagtacctggaggagaacaacacctgccccacctgcagaattgtcatccaccagagccaccccctgcagtacatcggccatgacaggaccatgcaggacatcgtgtacaagctggtgcccggcctgcaggaggccgagatgaggaagcagcgggagttctaccacaagctgggcatggaggtgcctggggacatcaagggggagacctgcagcgccaagcagcacctggacagccacagaaatggagagaccaaggcagatgacagcagcaacaaggaggccgctgaggagaagccagaggaggacaatgactaccacagaagtgatgagcaggtgtccatctgcctggagtgcaacagcagcaagctgcggggcctgaagaggaagtggatccgctgcagcgcccaggccaccgtgctgcacctgaagaagttcatcgccaagaagctgaacctgagcagcttcaatgagctggacatcctgtgcaatgaggagatcctgggcaaggaccacaccctgaagtttgtggtggtgacccgctggaggttcaagaaggcccccctgctgctgcactaccggcccaagatggacctgctgtag

SEQ ID NO: 16451 - DNA, 3015 bp, Artificial Sequence
  Description of Artificial Sequence: Synthetic coding sequence
atggagacagaaagtgagcagaacagcaacagcaccaacggcagcagcagcagcggcggcagcagccggccccagatcgcccagatgagcctgtatgaaaggcaggccgtgcaggccctgcaggccctgcagaggcagcccaatgctgcccagtacttccaccagttcatgctgcagcagcagctgagcaatgcccagctgcacagcctggccgctgtgcagcaggccaccatcgccgccagccggcaggccagcagccccaacaccagcaccacccagcagcagaccaccaccacccaggccagcatcaacctggccaccaccagcgctgcccagctgatcagccgcagccagagcgtgagcagccccagcgccaccaccctgacccagagcgtgctgctgggcaacaccaccagcccccccctgaaccagagccaggcccagatgtacctgcggccccagctgggcaacctgctgcaggtgaacagaaccctgggcagaaatgtgcccctggccagccagctgatcctgatgcccaacggggctgtggccgctgtgcagcaggaggtgcccagcgcccagagccctggggtgcatgctgatgctgaccaggtgcagaacctggccgtgaggaaccagcaggccagcgcccagggcccccagatgcagggcagcacccagaaggccatccccccaggggccagccctgtgagcagcctgagccaggccagcagccaggccctggccgtggcccaggccagcagcggggccaccaaccagagcctgaacctgagccaggccggcggcggcagcggcaacagcatccctggctccatgggccctgggggcggcggccaggcccacggcggcctgggccagctgcccagcagcggcatgggcggcggcagctgccccaggaaaggaactggagtggtgcagcccctgcctgctgcccagacagtgacagtgtcccagggcagccagacagaagctgagagcgctgctgccaagaaggccgaggctgatggcagcggccagcagaatgtgggcatgaacctgaccaggacagccaccccagcccccagccagaccctcatcagcagcgccacctacacccagatccagccccacagcctcatccagcagcagcagcagatccacctgcagcagaagcaggtggtgatccagcagcagatcgccatccaccaccagcagcagttccagcaccggcagagccagctgctgcacacagccacccacctgcagctggcccagcagcagcagcagcagcagcagcagcagcagcagcagcagcagccccaggccaccaccctgacagccccccagcccccccaggtgccccccacccagcaggtgccccccagccagagccagcagcaggcccagaccctggtggtgcagcccatgctgcagagcagccccctgagcctgcccccagatgctgcccccaagccacccatccccatccagagcaagccccctgtggcccccatcaagccaccccagctgggcgccgccaagatgtctgctgcccagcagcccccaccccacatccctgtgcaggtggtgggcacccggcagcctggaacagcccaggcccaggccctgggcctggcccagctggccgctgctgtgcccaccagccggggcatgcctggcaccgtgcagagcggccaggcccacctggccagcagcccccccagcagccaggcccctggggccctgcaggagtgcccccccaccctggcccctggcatgaccctggcccctgtgcagggcacagcccacgtggtgaagggcggggccaccaccagcagccctgtggtggcccaggtgcctgctgccttctacatgcagagcgtgcacctgcccgggaagccccagaccctggccgtgaagaggaaggctgacagcgaggaggagagagatgatgtgtccaccctgggctccatgctgcctgccaaggccagccctgtggccgagagccccaaggtgatggatgagaagagcagcctgggggagaaggccgagagcgtggccaacgtgaatgccaacacccccagcagcgagctggtggccctgaccccagcccccagcgtgcccccacccaccctggccatggtgtcccggcagatgggagacagcaagccaccccaggccatcgtgaagccccagatcctgacccacatcatcgagggctttgtgatccaggagggcgctgagcccttccctgtgggctgcagccagctgctgaaggagagcgagaagcccctgcagacaggcctgcccaccggcctgacagagaaccagagcggcggccccctgggcgtggacagccccagcgctgagctggacaagaaggccaacctgctgaagtgtgagtactgcggcaagtatgccccagctgagcagttccggggcagcaagcgcttctgcagcatgacctgtgccaagcgctacaacgtgtcctgcagccaccagttccggctgaagaggaagaagatgaaggagttccaggaggccaactatgcccgggtgagaagaagaggccccaggaggagcagcagtgacatcgcccgggccaagatccagggcaagtgccaccggggccaggaggacagcagccggggcagtgacaacagcagctatgatgaggccctgagccccaccagccctggccccctgtctgtgcgggccggccacggggagcgggacctgggcaaccccaacacagccccacccaccccagagctgcacggcatcaaccctgtgttcctgagcagcaaccccagccgctggagcgtggaggaggtgtatgagttcatcgccagcctgcagggctgccaggagattgctgaggagttccgcagccaggagattgatggccaggccctgctgctgctgaaggaggagcacctgatgtctgccatgaacatcaagctgggccctgccctgaagatctgtgccaagatcaacgtgctgaaggagacctag

SEQ ID NO: 16452 - DNA, 1833 bp, Artificial Sequence
  Description of Artificial Sequence: Synthetic coding sequence
atgcagggcagcacccagaaggccatccccccaggggccagccctgtgagcagcctgagccaggccagcagccaggccctggccgtggcccaggccagcagcggggccaccaaccagagcctgaacctgagccaggccggcggcggcagcggcaacagcatccctggctccatgggccctgggggcggcggccaggcccatggaggcctgggccagctgcccagcagcggcatgggcggcggcagctgccccaggaagggcaccggggtggtgcagcccctgcctgctgcccagacagtgacagtgtcccagggcagccagacagaggccgagagcgctgctgccaagaaggccgaggctgatggcagcggccagcagaatgtgggcatgaacctgaccaggacagccaccccagcccccagccagaccctcatcagcagcgccacctacacccagatccagccccacagcctcatccagcagcagcagcagatccacctgcagcagaagcaggtggtgatccagcagcagatcgccatccaccaccagcagcagttccagcaccggcagagccagctgctgcacacagccacccacctgcagctggcccagcagcagcagcagcagcagcagcagcagcagcagcagcagcagccccaggccaccaccctgacagccccccagcccccccaggtgccccccacccagcagggcaagccccagaccctggccgtgaagaggaaggctgacagcgaggaggagagagatgatgtgtccaccctgggctccatgctgcctgccaaggccagccctgtggccgagagccccaaggtgatggatgagaagagcagcctgggggagaaggccgagagcgtggccaacgtgaatgccaacacccccagcagcgagctggtggccctgaccccagcccccagcgtgcccccacccaccctggccatggtgtcccggcagatgggagacagcaagccaccccaggccatcgtgaagccccagatcctgacccacatcatcgagggctttgtgatccaggagggcgctgagcccttccctgtgggctgcagccagctgctgaaggagagcgagaagcccctgcagacaggcctgcccaccggcctgacagagaaccagagcggcggccccctgggcgtggacagccccagcgctgagctggacaagaaggccaacctgctgaagtgtgagtactgcggcaagtatgccccagctgagcagttccggggcagcaagcgcttctgcagcatgacctgtgccaagcgctacaacgtgtcctgcagccaccagttccggctgaagaggaagaagatgaaggagttccaggaggccaactatgcccgggtgagaagaagaggccccaggaggagcagcagtgacatcgcccgggccaagatccagggcaagtgccaccggggccaggaggacagcagccggggcagtgacaacagcagctatgatgaggccctgagccccaccagccctggccccctgtctgtgcgggccggccacggggagcgggacctgggcaaccccaacacagccccacccaccccagagctgcacggcatcaaccctgtgttcctgagcagcaaccccagccgctggagcgtggaggaggtgtatgagttcatcgccagcctgcagggctgccaggagattgctgaggagttccgcagccaggagattgatggccaggccctgctgctgctgaaggaggagcacctgatgtctgccatgaacatcaagctgggccctgccctgaagatctgtgccaagatcaacgtgctgaaggagacctag

SEQ ID NO: 16453 - DNA, 519 bp, Artificial Sequence
  Description of Artificial Sequence: Synthetic coding sequence
atggagacagaaagtgagcagaacagcaacagcaccaacggcagcagcagcagcggcggcagcagccggccccagatcgcccagatgagcctgtatgaaaggcaggccgtgcaggccctgcaggccctgcagaggcagcccaatgctgcccagtacttccaccagttcatgctgcagcagcagctgagcaatgcccagctgcacagcctggccgctgtgcagcaggccaccatcgccgccagccggcaggccagcagccccaacaccagcaccacccagcagcagaccaccaccacccaggccagcatcaacctggccaccaccagcgctgcccagctgatcagccgcagccagagcgtgagcagccccagcgccaccaccctgacccagagcgtgctgctgggcaacaccaccagcccccccctgaaccagagccaggcccagatgtacctgcggccccagctgggcaacctgctgcaggtgaacagaaccctgggcagaaatgtgcccctggcctag

SEQ ID NO: 16454 - DNA, 3015 bp, Artificial Sequence; identical to SEQ ID NO: 16451
  Description of Artificial Sequence: Synthetic coding sequence

SEQ ID NO: 16455 - DNA, 3015 bp, Artificial Sequence; identical to SEQ ID NO: 16451
  Description of Artificial Sequence: Synthetic coding sequence

SEQ ID NO: 16456 - DNA, 2577 bp, Artificial Sequence
  Description of Artificial Sequence: Synthetic coding sequence
atggagaatgagctgcctgtgccccacaccagcagcagcgcctgtgccaccagcagcaccagcggggccagcagcagcagcggctgcaacaacagcagcagcggcggcagcggccggcccaccggcccccagatctctgtgtacagcggcatcccagaccggcagacagtgcaggtgatccagcaggccctgcaccggcagcccagcacagctgcccagtacctgcagcagatgtatgctgcccagcagcagcacctgatgctgcagacagctgccctgcagcagcagcacctgagcagcgcccagctgcagagcctggccgctgtgcagcaggccagcctggtgagcaaccggcagggcagcaccagcggcagcaatgtgtctgcccaggccccagcccagagcagcagcatcaacctggccgccagccctgctgctgcccagctgctgaacagagcccagagcgtgaacagcgctgctgccagcggcatcgcccagcaggccgtgctgctgggcaacaccagcagccctgccctgacagccagccaggcccagatgtacctgcgggcccagatgctgatcttcacccccacagccaccgtggccaccgtgcagcctgagctgggcaccggcagccctgcccggccccccaccccagcccaggtgcagaacctgaccctgcggacccagcagaccccagctgctgctgccagcggccccacccccacccagcctgtgctgcccagcctggccctgaagcccacccctgggggcagccagcccctgcccaccccagcccagagcaggaacacagcccaggccagccctgctggggccaagccaggcattgctgacagcgtgatggagccccacaagaagggagatggcaacagctctgtgcccggctccatggagggccgggccggcctgagcaggacagtgcctgctgtggccgcccaccccctgattgccccagcctatgcccagctgcagccccaccagctgctgccccagcccagcagcaagcacctgcagccccagtttgtgatccagcagcagccccagccccagcagcagcagcccccaccccagcagagcaggcctgtgctgcaggccgagccccacccccagctggcctctgtgagccccagcgtggccctgcagcccagcagcgaggcccacgccatgcccctgggccctgtgaccccagccctgcccctgcagtgccccacagccaacctgcacaagccaggcggcagccagcagtgccacccccccaccccagacaccggcccccagaatggccaccctgagggcgtgccccacaccccccagaggcgcttccagcacaccagcgctgtgatcctgcagctgcagcctgccagccccccccagcagtgtgtgcctgatgactggaaggaggtggcccctggagagaagtctgtgcctgagaccaggagcggccccagcccccaccagcaggccatcgtgacagccatgcctgggggcctgcctgtgcccaccagccccaacatccagcccagccctgcccacgagaccggccagggcatcgtgcacgccctgacagacctgagcagccctggcatgaccagcggaaatggaaattctgccagcagcattgctggaacagccccccagaatggagagaacaagccaccccaggccatcgtgaagccccagatcctgacccacgtgattgagggcttcgtcatccaggagggcgctgagcccttccctgtgggccgcagcagcctgctggtgggcaacctgaagaagaagtatgcccagggcttcctgcctgagaagctgccccagcaggaccacaccaccaccacagattctgagatggaggagccctacctgcaggagagcaaggaggagggcgcccccctgaagctgaagtgtgagctgtgtggccgggtggactttgcctacaagttcaagaggagcaagcgcttctgcagcatggcctgtgccaagcgctacaacgtgggctgcaccaagagggtgggcctcttccacagcgacaggagcaagctgcagaaggccggggccgccacccacaacagaagaagagccagcaaggccagcctgccccccctgaccaaggacaccaagaagcagcccactggaacagtgcccctgtctgtgacagctgccctgcagctgacccacagccaggaggacagcagccgctgcagcgacaacagcagctatgaggagcccctgagccccatcagcgccagcagcagcaccagcagaagacggcagggccagagggacctggagctgcctgacatgcacatgagggacctggtgggcatgggccaccacttcctgcccagcgagcccaccaagtggaatgtggaggatgtgtatgagttcatccgcagcctgcccggctgccaggagattgctgaggagttccgggcccaggagattgatggccaggccctgctgctgctgaaggaggaccacctgatgtctgccatgaacatcaagctgggccctgccctgaagatctatgcccgcatctccatgctgaaggacagctag

SEQ ID NO: 16457 - DNA, 1305 bp, Artificial Sequence
  Description of Artificial Sequence: Synthetic coding sequence
tgcctgcggggcggctgcagcccccgggccccagctgcccgggcccggcagccccggcccccaccagccctgcccccccggccccgggcccctgtgcctgccagcaggcctggccggcccctgctgaccccagcccggccctgtggccgcatgaggcggggcagccctggcccccggctgggcggcagcagaggagagaggaggcctgcccgggcccgggaccctgcccgggtgggccctggagagggcctgcggcggcctgcccggcccggccctgctggcccctggacagaaacaggccagggcatcgtgcacgccctgacagacctgagcagccctggcatgaccagcggaaatggaaacagcgccagcagcattgctggaacagccccccagaatggagagaacaagccaccccaggccatcgtgaagccccagatcctgacccacgtgattgagggctttgtgatccaggagggcgctgagctgagccgctgggatgcccggctgctggtgggcaacctgaagaagaagtatgcccagggcttcctgcctgagaagctgccccagcaggaccacaccaccaccacagattctgagatggaggagccctacctgcaggagagcaaggaggagggcgcccccctgaagctgaagtgtgagctgtgtggccgggtggactttgcctacaagttcaagaggagcaagcgcttctgcagcatggcctgtgccaagcgctacaacgtgggctgcaccaagagggtgggcctcttccacagcgacaggagcaagctgcagaaggccggggccgccacccacaacagaagaagacctgccaagcctgtgtgccaccacctgccccgcatccccaggagcagccagcaggccctgtgccccttccggctgctgctgctgtgcctgacccacagccaggaggacagcagccgctgcagcgacaacagcagctatgaggagcccctgagccccatcagcgccagcagcagcaccagcgctggggacaaggccagcggcacctggagcagccccacctgcatctgtggcacctggtgggcctgggacaccaccagctgccaggtgagccaccaggtgaatgtggaggatgtgtatgagttcatccgcagcctgcccggctgccaggagattgctgaggagttccgggcccaggagattgatggccaggccctgctgctgctgaaggaggaccacctgatgtctgccatgaacatcaagctgggccctgccctgaagatctatgcccgcatctccatgctgaaggacagctag

SEQ ID NO: 16458 - DNA, 954 bp, Artificial Sequence
  Description of Artificial Sequence: Synthetic coding sequence
atgaccagcggaaatggaaacagcgccagcagcattgctggaacagccccccagaatggagagaacaagccaccccaggccatcgtgaagccccagatcctgacccacgtgattgagggctttgtgatccaggagggcgctgagcccttccctgtgggccgcagcagcctgctggtgggcaacctgaagaagaagtatgcccagggcttcctgcctgagaagctgccccagcaggaccacaccaccaccacagacagcgagatggaggagccctacctgcaggagagcaaggaggagggcgcccccctgaagctgaagtgtgagctgtgtggccgggtggactttgcctacaagttcaagaggagcaagcgcttctgcagcatggcctgtgccaagcgctacaacgtgggctgcaccaagagggtgggcctcttccacagcgacaggagcaagctgcagaaggccggggccgccacccacaacagaagaagagccagcaaggccagcctgccccccctgaccaaggacaccaagaagcagcccaccggcaccgtgcccctgtctgtgacagctgccctgcagctgacccacagccaggaggacagcagccgctgcagcgacaacagcagctatgaggagcccctgagccccatcagcgccagcagcagcaccagcagaagacggcagggccagagggacctggagctgcctgacatgcacatgagggacctggtgggcatgggccaccacttcctgcccagcgagcccaccaagtggaatgtggaggatgtgtatgagttcatccgcagcctgcccggcctgcccagcagcttccccaagggccacgagaccagcatctacagcctgagcaagcacctgcggcacagccgcttcccccagagccccagcggcagctgcctgtggcctgtgctgcggccccggccccacctgtag

SEQ ID NO: 16459 - DNA, 972 bp, Artificial Sequence
  Description of Artificial Sequence: Synthetic coding sequence
atgaccagcggaaatggaaacagcgccagcagcattgctggaacagccccccagaatggagagaacaagccaccccaggccatcgtgaagccccagatcctgacccacgtgattgagggctttgtgatccaggagggcgctgagcccttccctgtgggccgcagcagcctgctggtgggcaacctgaagaagaagtatgcccagggcttcctgcctgagaagctgccccagcaggaccacaccaccaccacagacagcgagatggaggagccctacctgcaggagagcaaggaggagggcgcccccctgaagctgaagtgtgagctgtgtggccgggtggactttgcctacaagttcaagaggagcaagcgcttctgcagcatggcctgtgccaagcgctacaacgtgggctgcaccaagagggtgggcctcttccacagcgacaggagcaagctgcagaaggccggggccgccacccacaacagaagaagagccagcaaggccagcctgccccccctgaccaaggacaccaagaagcagcccaccggcaccgtgcccctgtctgtgacagctgccctgcagctgacccacagccaggaggacagcagccgctgcagcgacaacagcagctatgaggagcccctgagccccatcagcgccagcagcagcaccagcagaagacggcagggccagagggacctggagctgcctgacatgcacatgagggacctggtgggcatgggccaccacttcctgcccagcgagcccaccaagtggaatgtggaggatgtgtatgagttcatccgcagcctgcccggctgccaggagattgctgaggagttccgggcccaggagattgatggccaggccctgctgctgctgaaggaggaccacctgatgtctgccatgaacatcaagctgggccctgccctgaagatctatgcccgcatctccatgctgaaggacagctag

SEQ ID NO: 16460 - DNA, 1395 bp, Artificial Sequence
  Description of Artificial Sequence: Synthetic coding sequence
atgcccctgggccctgtgaccccagccctgcccctgcagtgccccacagccaacctgcacaagccaggcggcagccagcagtgccacccccccaccccagacaccggcccccagaatggccaccctgagggcgtgccccacaccccccagaggcgcttccagcacaccagcgctgtgatcctgcagctgcagcctgccagccctgtgccccagcagtgtgtgcctgatgactggaaggaggtggcccctggagagaagtctgtgcctgagaccaggagcggccccagcccccaccagcaggccatcgtgacagccatgcctgggggcctgcctgtgcccaccagccccaacatccagcccagccctgcccacgagaccggccagggcatcgtgcacgccctgacagacctgagcagccctggcatgaccagcggaaatggaaattctgccagcagcattgctggaacagccccccagaatggagagaacaagccaccccaggccatcgtgaagccccagatcctgacccacgtgattgagggcttcgtcatccaggagggcgctgagcccttccctgtgggccgcagcagcctgctggtgggcaacctgaagaagaagtatgcccagggcttcctgcctgagaagctgccccagcaggaccacaccaccaccacagattctgagatggaggagccctacctgcaggagagcaaggaggagggcgcccccctgaagctgaagtgtgagctgtgtggccgggtggactttgcctacaagttcaagaggagcaagcgcttctgcagcatggcctgtgccaagcgctacaacgtgggctgcaccaagagggtgggcctcttccacagcgacaggagcaagctgcagaaggccggggccgccacccacaacagaagaagagccagcaaggccagcctgccccccctgaccaaggacaccaagaagcagcccactggaacagtgcccctgtctgtgacagctgccctgcagctgacccacagccaggaggacagcagccgctgcagcgacaacagcagctatgaggagcccctgagccccatcagcgccagcagcagcaccagcagaagacggcagggccagagggacctggagctgcctgacatgcacatgagggacctggtgggcatgggccaccacttcctgcccagcgagcccaccaagtggaatgtggaggatgtgtatgagttcatccgcagcctgcccggctgccaggagattgctgaggagttccgggcccaggagattgatggccaggccctgctgctgctgaaggaggaccacctgatgtctgccatgaacatcaagctgggccctgccctgaagatctatgcccgcatctccatgctgaaggacagctag

SEQ ID NO: 16461 - DNA, 2580 bp, Artificial Sequence
  Description of Artificial Sequence: Synthetic coding sequence
atggagaatgagctgcctgtgccccacaccagcagcagcgcctgtgccaccagcagcaccagcggggccagcagcagcagcggctgcaacaacagcagcagcggcggcagcggccggcccaccggcccccagatctctgtgtacagcggcatcccagaccggcagacagtgcaggtgatccagcaggccctgcaccggcagcccagcacagctgcccagtacctgcagcagatgtatgctgcccagcagcagcacctgatgctgcagacagctgccctgcagcagcagcacctgagcagcgcccagctgcagagcctggccgctgtgcagcaggccagcctggtgagcaaccggcagggcagcaccagcggcagcaatgtgtctgcccaggccccagcccagagcagcagcatcaacctggccgccagccctgctgctgcccagctgctgaacagagcccagagcgtgaacagcgctgctgccagcggcatcgcccagcaggccgtgctgctgggcaacaccagcagccctgccctgacagccagccaggcccagatgtacctgcgggcccagatgctgatcttcacccccacagccaccgtggccaccgtgcagcctgagctgggcaccggcagccctgcccggccccccaccccagcccaggtgcagaacctgaccctgcggacccagcagaccccagctgctgctgccagcggccccacccccacccagcctgtgctgcccagcctggccctgaagcccacccctgggggcagccagcccctgcccaccccagcccagagcaggaacacagcccaggccagccctgctggggccaagccaggcattgctgacagcgtgatggagccccacaagaagggagatggcaacagctctgtgcccggctccatggagggccgggccggcctgagcaggacagtgcctgctgtggccgcccaccccctgattgccccagcctatgcccagctgcagccccaccagctgctgccccagcccagcagcaagcacctgcagccccagtttgtgatccagcagcagccccagccccagcagcagcagcccccaccccagcagagcaggcctgtgctgcaggccgagccccacccccagctggcctctgtgagccccagcgtggccctgcagcccagcagcgaggcccacgccatgcccctgggccctgtgaccccagccctgcccctgcagtgccccacagccaacctgcacaagccaggcggcagccagcagtgccacccccccaccccagacaccggcccccagaatggccaccctgagggcgtgccccacaccccccagaggcgcttccagcacaccagcgctgtgatcctgcagctgcagcctgccagccctgtgccccagcagtgtgtgcctgatgactggaaggaggtggcccctggagagaagtctgtgcctgagaccaggagcggccccagcccccaccagcaggccatcgtgacagccatgcctgggggcctgcctgtgcccaccagccccaacatccagcccagccctgcccatgaaacaggccagggcatcgtgcacgccctgacagacctgagcagccctggcatgaccagcggaaatggaaacagcgccagcagcattgctggaacagccccccagaatggagagaacaagccaccccaggccatcgtgaagccccagatcctgacccacgtgattgagggctttgtgatccaggagggcgctgagcccttccctgtgggccgcagcagcctgctggtgggcaacctgaagaagaagtatgcccagggcttcctgcctgagaagctgccccagcaggaccacaccaccaccacagacagcgagatggaggagccctacctgcaggagagcaaggaggagggcgcccccctgaagctgaagtgtgagctgtgtggccgggtggactttgcctacaagttcaagaggagcaagcgcttctgcagcatggcctgtgccaagcgctacaacgtgggctgcaccaagagggtgggcctcttccacagcgacaggagcaagctgcagaaggccggggccgccacccacaacagaagaagagccagcaaggccagcctgccccccctgaccaaggacaccaagaagcagcccaccggcaccgtgcccctgtctgtgacagctgccctgcagctgacccacagccaggaggacagcagccgctgcagcgacaacagcagctatgaggagcccctgagccccatcagcgccagcagcagcaccagcagaagacggcagggccagagggacctggagctgcctgacatgcacatgagggacctggtgggcatgggccaccacttcctgcccagcgagcccaccaagtggaatgtggaggatgtgtatgagttcatccgcagcctgcccggctgccaggagattgctgaggagttccgggcccaggagattgatggccaggccctgctgctgctgaaggaggaccacctgatgtctgccatgaacatcaagctgggccctgccctgaagatctatgcccgcatctccatgctgaaggacagctag

SEQ ID NO: 16462 - DNA, 2490 bp, Artificial Sequence
  Description of Artificial Sequence: Synthetic coding sequence
atggagaatgagctgcctgtgccccacaccagcagcagcgcctgtgccaccagcagcaccagcggggccagcagcagcagcggctgcaacaacagcagcagcggcggcagcggccggcccaccggcccccagatctctgtgtacagcggcatcccagaccggcagacagtgcaggtgatccagcaggccctgcaccggcagcccagcacagctgcccagtacctgcagcagatgtatgctgcccagcagcagcacctgatgctgcagacagctgccctgcagcagcagcacctgagcagcgcccagctgcagagcctggccgctgtgcagcaggccagcctggtgagcaaccggcagggcagcaccagcggcagcaatgtgtctgcccaggccccagcccagagcagcagcatcaacctggccgccagccctgctgctgcccagctgctgaacagagcccagagcgtgaacagcgctgctgccagcggcatcgcccagcaggccgtgctgctgggcaacaccagcagccctgccctgacagccagccaggcccagatgtacctgcgggcccagatggtgcagaacctgaccctgcggacccagcagaccccagctgctgctgccagcggccccacccccacccagcctgtgctgcccagcctggccctgaagcccaccccaggcggcagccagcccctgcccaccccagcccagagcaggaacacagcccaggccagccctgctggggccaagccaggcattgctgacagcgtgatggagccccacaagaagggagatggcaacagctctgtgcccggctccatggagggccgggccggcctgagcaggacagtgcctgctgtggccgcccaccccctcatcgccccagcctatgcccagctgcagccccaccagctgctgccccagcccagcagcaagcacctgcagccccagtttgtgatccagcagcagccccagccccagcagcagcagcccccaccccagcagagcaggcctgtgctgcaggccgagccccacccccagctggcctctgtgagccccagcgtggccctgcagcccagcagcgaggcccacgccatgcccctgggccctgtgaccccagccctgcccctgcagtgccccacagccaacctgcacaagccaggcggcagccagcagtgccacccccccaccccagacaccggcccccagaatggccaccctgagggcgtgccccacaccccccagaggcgcttccagcacaccagcgctgtgatcctgcagctgcagcctgccagccccccccagcagtgtgtgcctgatgactggaaggaggtggcccctggagagaagtctgtgcctgagaccaggagcggccccagcccccaccagcaggccatcgtgacagccatgcctgggggcctgcctgtgcccaccagccccaacatccagcccagccctgcccatgaaacaggccagggcatcgtgcacgccctgacagacctgagcagccctggcatgaccagcggaaatggaaacagcgccagcagcattgctggaacagccccccagaatggagagaacaagccaccccaggccatcgtgaagccccagatcctgacccacgtgattgagggctttgtgatccaggagggcgctgagcccttccctgtgggccgcagcagcctgctggtgggcaacctgaagaagaagtatgcccagggcttcctgcctgagaagctgccccagcaggaccacaccaccaccacagacagcgagatggaggagccctacctgcaggagagcaaggaggagggcgcccccctgaagctgaagtgtgagctgtgtggccgggtggactttgcctacaagttcaagaggagcaagcgcttctgcagcatggcctgtgccaagcgctacaacgtgggctgcaccaagagggtgggcctcttccacagcgacaggagcaagctgcagaaggccggggccgccacccacaacagaagaagagccagcaaggccagcctgccccccctgaccaaggacaccaagaagcagcccaccggcaccgtgcccctgtctgtgacagctgccctgcagctgacccacagccaggaggacagcagccgctgcagcgacaacagcagctatgaggagcccctgagccccatcagcgccagcagcagcaccagcagaagacggcagggccagagggacctggagctgcctgacatgcacatgagggacctggtgggcatgggccaccacttcctgcccagcgagcccaccaagtggaatgtggaggatgtgtatgagttcatccgcagcctgcccggctgccaggagattgctgaggagttccgggcccaggagattgatggccaggccctgctgctgctgaaggaggaccacctgatgtctgccatgaacatcaagctgggccctgccctgaagatctatgcccgcatctccatgctgaaggacagctag

SEQ ID NO: 16463 - DNA, 561 bp, Artificial Sequence
  Description of Artificial Sequence: Synthetic coding sequence
atggacacagagcccaaccctggcaccagctctgtgtccaccaccaccagcagcaccaccaccaccaccatcaccaccagcagcagcaggatgcagcagccccagatctctgtgtacagcggcagtgacagacatgctgtgcaggccctgcacaggcctcccagcagcgctgcccagtacctgcagcagatgtatgctgcccagcagcagcacctgatgctgcacacagctgccctgcagcagcagcacctgagcagcagccagctgcagagcctggccgctgtgcaggccagcctgagcagcggccggcccagcaccagccccactggatctgtgacccagcagagctccatgagccagaccagcatcaacctgagcaccagccccaccccagcccagctgatcagccgcagccaggccagcagcagcaccagcggcagcatcacccagcagaccatgctgctgggcagcaccagccccaccctgacagccagccaggcccagatgtacctgcgggcccagatggtgcgctatgagctgcccaacttcttctctgtgtag

SEQ ID NO: 16464 - DNA, 744 bp, Artificial Sequence
  Description of Artificial Sequence: Synthetic coding sequence
atggccgaggccgagttcaaggaccacagcacagccatggacacagagcccaaccctggcaccagctctgtgtccaccaccaccagcagcaccaccaccaccaccatcaccaccagcagcagcaggatgcagcagccccagatctctgtgtacagcggcagtgacagacatgctgtgcaggtgatccagcaggccctgcacaggcctcccagcagcgctgcccagtacctgcagcagatgtatgctgcccagcagcagcacctgatgctgcacacagctgccctgcagcagcagcacctgagcagcagccagctgcagagcctggccgctgtgcaggccagcctgagcagcggccggcccagcaccagccccactggatctgtgacccagcagagctccatgagccagaccagcatcaacctgagcaccagccccaccccagcccagctgatcagccgcagccaggccagcagcagcaccagcggcagcatcacccagcagaccatgctgctgggcagcaccagccccaccctgacagccagccaggcccagatgtacctgcgggcccagatgctgatcttcaccccagccaccaccgtggccgctgtgcagagcgacatccctgtggtgagcagcagcagcagcagcagctgccagagcgctgccacccaggtgcagaacctgaccctgcggagccagaagctgggcgtgctgagcagcagccagaatggaccacccaagtag

SEQ ID NO: 16465 - DNA, 444 bp, Artificial Sequence
  Description of Artificial Sequence: Synthetic coding sequence
atggccgaggccgagttcaaggaccacagcacagccatggacacagagcccaaccctggcaccagctctgtgtccaccaccaccagcagcaccaccaccaccaccatcaccaccagcagcagcaggatgcagcagccccagatctctgtgtacagcggcagtgacagacatgctgtgcaggccctgcacaggcctcccagcagcgctgcccagtacctgcagcagatgtatgctgcccagcagcagcacctgatgctgcacacagctgccctgcagcagcagcacctgagcagcagccagctgcagagcctggccgctgtgcaggccagcctgagcagcggccggcccagcaccagccccactggatctgtgacccagcagagctccatgagccagacctctgtgagcagcctgaacttcttcttcctggacctgaagttctag

SEQ ID NO: 16466 - DNA, 486 bp, Artificial Sequence
  Description of Artificial Sequence: Synthetic coding sequence
tgaagatggaacaggaagccagacaaccagagcctgggccaccggggcagaagacccagcggcccagatggagctgcccgggagcacatcctgcggcagctgcccatcacctaccccagcgctgaggaggacctggccagccatgaagattctgtgcccagcgccatgaccacccggctgcggcggcagagcgagcgggagcgggagcgggagctgagagatgtgcgcatcaggaagatgcctgagaacagcgacctgctgcctgtggcccagacagagcccagcatctggacagtggatgatgtgtgggccttcatccacagcctgcccggctgccaggacattgctgatgagttccgggcccaggagattgatggccaggccctgctgctgctgaaggaggaccacctgatgtctgccatgaacatcaagctgggccctgccctgaagatctgtgcccgcatcaacagcctgaaggagagctag

SEQ ID NO: 16467 - DNA, 2952 bp, Artificial Sequence
  Description of Artificial Sequence: Synthetic coding sequence
atggacacagagcccaaccctggcaccagctctgtgtccaccaccaccagcagcaccaccaccaccaccatcaccaccagcagcagcaggatgcagcagccccagatctctgtgtacagcggcagtgacagacatgctgtgcaggtgatccagcaggccctgcacaggcctcccagcagcgctgcccagtacctgcagcagatgtatgctgcccagcagcagcacctgatgctgcacacagctgccctgcagcagcagcacctgagcagcagccagctgcagagcctggccgctgtgcaggccagcctgagcagcggccggcccagcaccagccccactggatctgtgacccagcagagctccatgagccagaccagcatcaacctgagcaccagccccaccccagcccagctgatcagccgcagccaggccagcagcagcaccagcggcagcatcacccagcagaccatgctgctgggcagcaccagccccaccctgacagccagccaggcccagatgtacctgcgggcccagatgctgatcttcaccccagccaccaccgtggccgctgtgcagagcgacatccctgtggtgagcagcagcagcagcagcagctgccagagcgctgccacccaggtgcagaacctgaccctgcggagccagaagctgggcgtgctgagcagcagccagaatggaccacccaagagcaccagccagacccagagcctgaccatctgccacaacaagaccaccgtgaccagcagcaagatcagccagagggaccccagccctgagagcaacaagaagggggagagccccagcctggagagccgcagcacagctgtgaccaggaccagcagcatccaccagctgattgccccagccagctacagccccatccagccccacagcctcatcaagcaccagcagatccccctgcacagcccccccagcaaggtgagccaccaccagctgatcctgcagcagcagcagcagcagatccagcccatcaccctgcagaacagcacccaggaccccccacccagccagcactgcatccccctgcagaaccacggcctgcccccagcccccagcaatgcccagagccagcactgcagccccatccagagccaccccagccccctgactgtgagccccaaccagagccagagcgcccagcagagcgtggtggtgagccccccaccaccccacagccccagccagagccccaccatcatcatccacccccaggccctgatccagccccaccccctggtgagcagcgccctgcagcccggccccaacctgcagcagagcacagccaaccaggtgcaggccacagcccagctgaacctgcccagccacctgcccctgcctgccagccctgtggtgcacatcggccctgtgcagcagagcgccctggtgtccccaggccagcagatcgtgagccccagccaccagcagtacagcagcctgcagagcagccccatccccatcgccagccccccccagatgagcaccagccccccagcccagatcccccccctgcccctgcagagcatgcagagcctgcaggtgcagcctgagatcctgagccagggccaggtgctggtgcagaatgccctggtgtctgaggaggagctgcctgctgctgaggccctggtgcagctgcccttccagaccctgcccccaccccagacagtggccgtgaacctgcaggtgcagcccccagcccctgtggacccccctgtggtgtaccaggtggaggatgtgtgtgaggaggagatgcctgaggagagtgatgaatgtgtgaggatggacaggaccccacctccacccaccctgagccctgctgccatcaccgtgggccgcggggaggacctgaccagcgagcaccccctgctggagcaggtggagctgcctgctgtggcctctgtgtctgccagcgtcatcaagagccccagcgaccccagccacgtgtctgtgcccccaccacccctgctgctgcctgctgccaccaccaggagcaacagcacctccatgcacagcagcatccccagcattgagaacaagccaccccaggccatcgtgaagccccagatcctgacccacgtgattgagggctttgtgatccaggagggcctggagcccttccctgtgagccgcagcagcctgctgattgagcagcctgtgaagaagaggcccctgctggacaaccaggtgatcaacagcgtgtgtgtgcagcctgagctgcagaacaacaccaagcacgccgacaacagcagtgacacagagatggaggacatgattgctgaggagaccctggaggagatggacagcgagctgctgaagtgtgagttctgtgggaagatgggctacgccaatgagttcctgcggagcaagcgcttctgcaccatgagctgtgccaagcgctacaacgtgtcctgcagcaagaagtttgccctgagccgctggaacaggaagccagacaaccagagcctgggccaccggggcagaagacccagcggcccagatggagctgcccgggagcacatcctgcggcagctgcccatcacctaccccagcgctgaggaggacctggccagccatgaagattctgtgcccagcgccatgaccacccggctgcggcggcagagcgagcgggagcgggagcgggagctgagagatgtgcgcatcaggaagatgcctgagaacagcgacctgctgcctgtggcccagacagagcccagcatctggacagtggatgatgtgtgggccttcatccacagcctgcccggctgccaggacattgctgatgagttccgggcccaggagattgatggccaggccctgctgctgctgaaggaggaccacctgatgtctgccatgaacatcaagctgggccctgccctgaagatctgtgcccgcatcaacagcctgaaggagagctag

SEQ ID NO: 16468 - DNA, 2988 bp, Artificial Sequence
  Description of Artificial Sequence: Synthetic coding sequence
atggccgaggccgagttcaaggaccacagcacagccatggacacagagcccaaccctggcaccagctctgtgtccaccaccaccagcagcaccaccaccaccaccatcaccaccagcagcagcaggatgcagcagccccagatctctgtgtacagcggcagtgacagacatgctgtgcaggtgatccagcaggccctgcacaggcctcccagcagcgctgcccagtacctgcagcagatgtatgctgcccagcagcagcacctgatgctgcacacagctgccctgcagcagcagcacctgagcagcagccagctgcagagcctggccgctgtgcaggccagcctgagcagcggccggcccagcaccagccccactggatctgtgacccagcagagctccatgagccagaccagcatcaacctgagcaccagccccaccccagcccagctgatcagccgcagccaggccagcagcagcaccagcggcagcatcacccagcagaccatgctgctgggcagcaccagccccaccctgacagccagccaggcccagatgtacctgcgggcccagatgctgatcttcaccccagccaccaccgtggccgctgtgcagagcgacatccctgtggtgagcagcagcagcagcagcagctgccagagcgctgccacccaggtgcagaacctgaccctgcggagccagaagctgggcgtgctgagcagcagccagaatggaccacccaagagcaccagccagacccagagcctgaccatctgccacaacaagaccaccgtgaccagcagcaagatcagccagagggaccccagccctgagagcaacaagaagggggagagccccagcctggagagccgcagcacagctgtgaccaggaccagcagcatccaccagctgattgccccagccagctacagccccatccagccccacagcctcatcaagcaccagcagatccccctgcacagcccccccagcaaggtgagccaccaccagctgatcctgcagcagcagcagcagcagatccagcccatcaccctgcagaacagcacccaggaccccccacccagccagcactgcatccccctgcagaaccacggcctgcccccagcccccagcaatgcccagagccagcactgcagccccatccagagccaccccagccccctgactgtgagccccaaccagagccagagcgcccagcagagcgtggtggtgagccccccaccaccccacagccccagccagagccccaccatcatcatccacccccaggccctgatccagccccaccccctggtgagcagcgccctgcagcccggccccaacctgcagcagagcacagccaaccaggtgcaggccacagcccagctgaacctgcccagccacctgcccctgcctgccagccctgtggtgcacatcggccctgtgcagcagagcgccctggtgtccccaggccagcagatcgtgagccccagccaccagcagtacagcagcctgcagagcagccccatccccatcgccagccccccccagatgagcaccagccccccagcccagatcccccccctgcccctgcagagcatgcagagcctgcaggtgcagcctgagatcctgagccagggccaggtgctggtgcagaatgccctggtgtctgaggaggagctgcctgctgctgaggccctggtgcagctgcccttccagaccctgcccccaccccagacagtggccgtgaacctgcaggtgcagcccccagcccctgtggacccccctgtggtgtaccaggtggaggatgtgtgtgaggaggagatgcctgaggagagtgatgaatgtgtgaggatggacaggaccccacctccacccaccctgagccctgctgccatcaccgtgggccgcggggaggacctgaccagcgagcaccccctgctggagcaggtggagctgcctgctgtggcctctgtgtctgccagcgtcatcaagagccccagcgaccccagccacgtgtctgtgcccccaccacccctgctgctgcctgctgccaccaccaggagcaacagcacctccatgcacagcagcatccccagcattgagaacaagccaccccaggccatcgtgaagccccagatcctgacccacgtgattgagggctttgtgatccaggagggcctggagcccttccctgtgagccgcagcagcctgctgattgagcagcctgtgaagaagaggcccctgctggacaaccaggtgatcaacagcgtgtgtgtgcagcctgagctgcagaacaacaccaagcacgccgacaacagcagtgacacagagatggaggacatgattgctgaggagaccctggaggagatggacagcgagctgctgaagtgtgagttctgtgggaagatgggctacgccaatgagttcctgcggagcaagcgcttctgcaccatgagctgtgccaagcgctacaacgtgtcctgcagcaagaagtttgccctgagccgctggaacaggaagccagacaaccagagcctgggccaccggggcagaagacccagcggcccagatggagctgcccgggagcacatcctgcggcagctgcccatcacctaccccagcgctgaggaggacctggccagccatgaagattctgtgcccagcgccatgaccacccggctgcggcggcagagcgagcgggagcgggagcgggagctgagagatgtgcgcatcaggaagatgcctgagaacagcgacctgctgcctgtggcccagacagagcccagcatctggacagtggatgatgtgtgggccttcatccacagcctgcccggctgccaggacattgctgatgagttccgggcccaggagattgatggccaggccctgctgctgctgaaggaggaccacctgatgtctgccatgaacatcaagctgggccctgccctgaagatctgtgcccgcatcaacagcctgaaggagagctag

SEQ ID NO: 16469 - DNA, 456 bp, Artificial Sequence
  Description of Artificial Sequence: Synthetic coding sequence
atggccgaggccgagttcaaggaccacagcacagccatggacacagagcccaaccctggcaccagctctgtgtccaccaccaccagcagcaccaccaccaccaccatcaccaccagcagcagcaggatgcagcagccccagatctctgtgtacagcggcagtgacagacatgctgtgcaggtgatccagcaggccctgcacaggcctcccagcagcgctgcccagtacctgcagcagatgtatgctgcccagcagcagcacctgatgctgcacacagctgccctgcagcagcagcacctgagcagcagccagctgcagagcctggccgctgtgcaggccagcctgagcagcggccggcccagcaccagccccactggatctgtgacccagcagagctccatgagccagacctctgtgagcagcctgaacttcttcttcctggacctgaagttctag

SEQ ID NO: 16470 - DNA, 1797 bp, Artificial Sequence
  Description of Artificial Sequence: Synthetic coding sequence
atgtctgccagcgcccagcagctggccgaggagctgcagatcttcggcctggactgtgaggaggccctgattgagaagctggtggagctgtgtgtgcagtatggccagaatgaggagggcatggtgggggagctgattgccttctgcaccagcacccacaaggtgggcctgaccagcgagatcctgaacagctttgaacatgagttcctgagcaagaggctgagcaaggcccggcacagcacctgcaaggacagcggccacgccggggcccgggacatcgtgtccatccaggagctgattgaggtggaggaggaggaggagatcctgctgaacagctacaccacccccagcaagggcagccagaagagggccatcagcaccccagagacccccctgaccaagaggtctgtgtccaccaggagcccccaccagctgctgagccccagcagcttcagccccagcgccacccccagccagaagtacaacagccgcagcaacagaggagaggtggtgaccagctttggcctggcccagggcgtgtcctggagcggccggggcggggccggcaacatcagcctgaaggtgctgggctgcccagaggccctgaccggcagctacaagtccatgttccagaagctgcctgacatccgggaggtgctgacctgcaagattgaggagctgggcagcgagctgaaggagcactacaagattgaggccttcacccccctgctggccccagcccaggagcctgtgaccctgctgggccagatcggctgtgacagcaatggcaagctgaacaacaagagcgtcatcctggagggggaccgggagcacagcagcggggcccagatccctgtggacctgtctgagctgaaggagtacagcctcttccctggccaggtggtgatcatggagggcatcaacaccaccggcaggaagctggtggccaccaagctgtatgagggcgtgcccctgcccttctaccagcccacagaagaagatgctgactttgagcagagcatggtgctggtggcctgtggcccctacaccaccagtgacagcatcacctatgaccccctgctggacctgattgctgtgatcaaccacgacagaccagatgtgtgcatcctgtttggccccttcctggatgccaagcatgagcaggtggagaactgcctgctgaccagcccctttgaggacatcttcaagcagtgcctgcggaccatcatcgagggcaccaggagcagcggcagccacctggtgtttgtgcccagcctgagagatgtgcaccacgagcctgtgtacccccagccccccttctcctacagcgacctgagccgggaggacaagaagcaggtgcagtttgtgtctgagccctgcagcctgagcatcaatggagtcatcttcggcctgaccagcacagacctgctcttccacctgggcgctgaggagatcagcagcagcagcggcaccagtgaccgcttcagccgcatcctgaagcacatcctgacccagaggagctactaccccctgtacccaccccaggaggacatggccatcgactatgagagcttctacgtgtatgcccagctgcctgtgaccccagatgtgctgatcatccccagcgagctgcgctactttgtgaaggatgtgctgggctgtgtgtgtgtgaaccctggccgcctgaccaagggccaggtgggcggcacctttgcccggctgtacctgcggcggcctgctgctgatggagctgagcggcagagcccctgcatcgctgtgcaggtggtgcgcatctag

SEQ ID NO: 16471 - DNA, 1086 bp, Artificial Sequence
  Description of Artificial Sequence: Synthetic coding sequence
atgttccagaagctgcctgacatccgggaggtgctgacctgcaagattgaggagctgggcagcgagctgaaggagcactacaagattgaggccttcacccccctgctggccccagcccaggagcctgtgaccctgctgggccagatcggctgtgacagcaatggcaagctgaacaacaagagcgtcatcctggagggggaccgggagcacagcagcggggcccagatccctgtggacctgtctgagctgaaggagtacagcctcttccctggccaggtggtgatcatggagggcatcaacaccaccggcaggaagctggtggccaccaagctgtatgagggcgtgcccctgcccttctaccagcccacagaagaagatgctgactttgagcagagcatggtgctggtggcctgtggcccctacaccaccagtgacagcatcacctatgaccccctgctggacctgattgctgtgatcaaccacgacagaccagatgtgtgcatcctgtttggccccttcctggatgccaagcatgagcaggtggagaactgcctgctgaccagcccctttgaggacatcttcaagcagtgcctgcggaccatcatcgagggcaccaggagcagcggcagccacctggtgtttgtgcccagcctgagagatgtgcaccacgagcctgtgtacccccagccccccttctcctacagcgacctgagccgggaggacaagaagcaggtgcagtttgtgtctgagccctgcagcctgagcatcaatggagtcatcttcggcctgaccagcacagacctgctcttccacctgggcgctgaggagatcagcagcagcagcggcaccagtgaccgcttcagccgcatcctgaagcacatcctgacccagaggagctactaccccctgtacccaccccaggaggacatggccatcgactatgagagcttctacgtgtatgcccagctgcctgtgaccccagatgtgctgatcatccccagcgagctgcgctactttgtgaaggtgggcctgaacagcgccttcagccagaagcaccagaaccctgtgtttgacttccccttctag

SEQ ID NO: 16472 - DNA, 1485 bp, Artificial Sequence
  Description of Artificial Sequence: Synthetic coding sequence
atgctgcccaagagaagaagagcccgggtgggcagccccagcggagatgctgccagcagcaccccacccagcacccgcttccctggggtggccatctacctggtggagcccaggatgggccgcagcagaagagccttcctgaccggcctggcccggagcaagggcttccgggtgctggatgcctgcagcagcgaggccacccacgtggtgatggaggagaccagcgctgaggaggccgtgtcctggcaggagaggaggatggctgctgcccctcctggctgcaccccaccagccctgctggacatctcctggctgacagagagcctgggcgccggccagcctgtgcctgtggagtgccgccaccggctggaggtggccggccccaggaagggccccctgagccctgcctggatgcctgcctatgcctgccagaggcccacccccctgacccaccacaacacaggcctgtctgaggccctggagatcctggccgaggccgccggctttgagggcagcgagggccgcctgctgaccttctgccgggccgcctctgtgctgaaggccctgcccagccctgtgaccaccctgagccagctgcagggcctgccccactttggagagcacagcagccgggtggtgcaggagctgctggagcacggcgtgtgtgaggaggtggagcgggtgagaagaagtgagcgctaccagaccatgaagctgttcacccagatcttcggcgtgggcgtgaagacagctgaccgctggtaccgggagggcctgcggaccctggatgacctgcgggagcagccccagaagctgacccagcagcagaaggccggcctgcagcaccaccaggacctgagcacccctgtgctgcggagtgatgtggatgccctgcagcaggtggtggaggaggccgtgggccaggccctgcccggggccaccgtgaccctgaccggcggcttccggcggggcaagctgcagggccatgatgtggacttcctgatcacccaccccaaggagggccaggaggccggcctgctgccccgggtgatgtgccgcctgcaggaccagggcctcatcctgtaccaccagcaccagcacagctgctgtgagagccccacccggctggcccagcagagccacatggatgcctttgagaggagcttctgcatcttccggctgccccagcccccaggagctgctgtgggcggcagcacccggccctgccccagctggaaggctgtgcgggtggacctggtggtggcccctgtgtcccagttcccctttgccctgctgggctggacaggcagcaagctgttccagcgggagctgcggcgcttcagcaggaaggagaagggcctgtggctgaacagccacggcctgtttgatcctgagcagaagaccttcttccaggccgccagcgaggaggacatcttccgccacctgggcctggagtacctgcccccagagcagagaaatgcctag

SEQ ID NO: 16473 - DNA, 1374 bp, Artificial Sequence
  Description of Artificial Sequence: Synthetic coding sequence
atgctgcccaagagaagaagagcccgggtgggcagccccagcggagatgctgccagcagcaccccacccagcacccgcttccctggggtggccatctacctggtggagcccaggatgggccgcagcagaagagccttcctgaccggcctggcccggagcaagggcttccgggtgctggatgcctgcagcagcgaggccacccacgtggtgatggaggagaccagcgctgaggaggccgtgtcctggcaggagaggaggatggctgctgcccctcctggctgcaccccaccagccctgctggacatctcctggctgacagagagcctgggcgccggccagcctgtgcctgtggagtgccgccaccggctggaggtggccggccccaggaagggccccctgagccctgcctggatgcctgcctatgcctgccagaggcccacccccctgacccaccacaacacaggcctgtctgaggccctggagatcctggccgaggccgccggctttgagggcagcgagggccgcctgctgaccttctgccgggccgcctctgtgctgaaggccctgcccagccctgtgaccaccctgagccagctgcagggcctgccccactttggagagcacagcagccgggtggtgcaggagctgctggagcacggcgtgtgtgaggaggtggagcgggtgagaagaagtgagcgctaccagaccatgaagctgttcacccagatcttcggcgtgggcgtgaagacagctgaccgctggtaccgggagggcctgcggaccctggatgacctgcgggagcagccccagaagctgacccagcagcagaaggccgcccctcctggccctgagcaccccagccctgctgtgcgctgccgctgcccagctgctgggggcggcggcagctgtggggccggccctgcctggggccacagacatgctgaccggcggctgccccagggcctcatcctgtaccaccagcaccagcacagctgctgtgagagccccacccggctggcccagcagagccacatggatgcctttgagaggagcttctgcatcttccggctgccccagcccccaggagctgctgtgggcggcagcacccggccctgccccagctggaaggctgtgcgggtggacctggtggtggcccctgtgtcccagttcccctttgccctgctgggctggacaggcagcaagctgttccagcgggagctgcggcgcttcagcaggaaggagaagggcctgtggctgaacagccacggcctgtttgatcctgagcagaagaccttcttccaggccgccagcgaggaggacatcttccgccacctgggcctggagtacctgcccccagagcagagaaatgcctag

SEQ ID NO: 16474 - DNA, 1527 bp, Artificial Sequence
  Description of Artificial Sequence: Synthetic coding sequence
atgctgcccaagagaagaagagcccgggtgggcagccccagcggagatgctgccagcagcaccccacccagcacccgcttccctggggtggccatctacctggtggagcccaggatgggccgcagcagaagagccttcctgaccggcctggcccggagcaagggcttccgggtgctggatgcctgcagcagcgaggccacccacgtggtgatggaggagaccagcgctgaggaggccgtgtcctggcaggagaggaggatggctgctgcccctcctggctgcaccccaccagccctgctggacatctcctggctgacagagagcctgggcgccggccagcctgtgcctgtggagtgccgccaccggctggaggtggccggccccaggaagggccccctgagccctgcctggatgcctgcctatgcctgccagaggcccacccccctgacccaccacaacacaggcctgtctgaggccctggagatcctggccgaggccgccggctttgagggcagcgagggccgcctgctgaccttctgccgggccgcctctgtgctgaaggccctgcccagccctgtgaccaccctgagccagctgcagggcctgccccactttggagagcacagcagccgggtggtgcaggagctgctggagcacggcgtgtgtgaggaggtggagcgggtgagaagaagtgagcgggccccagcccctcctggccctgagcaccccagccctgctgtgcgctgccgctgcccagctgctgggggcggcggcagctgtggggccggccctgcctggggccacagacatgctgaccggcggctgccccagggcctcatcctgtaccaccagcaccagcacagctgctgtgagagccccacccggctggcccagcagagccacatggatgcctttgagaggagcttctgcatcttccggctgccccagcccccaggagctgctgtgggcggcagcacccggccctgccccagctggaaggctgtgcgggtggacctggtggtggcccctgtgtcccagttcccctttgccctgctgggctggacaggcagcaagctgttccagcgggagctgcggcgcttcagcaggaaggagaagggcctgtggctgaacagccacggcctgtttgatcctgagcagggcagcagcagcggcaagacccccaggagcaggaagagctgcttctgctgccgccgccacttcagcaagaggctgcagaggaagaccagcagtgacacctgggccctgagcaccttcctgcagagccgggagaccccagagcccgcctgtgtgccccacttccacagcggcaactgggccgcccccaacctggccacagaatgtctgcaggccgacatgctgcccccagacccccacctgcaccccagcccccccaggcctggcagcagcggcggccagctgtgcctgcaggaccagctgagcccctgctggtgtgccgccggctgtgatgaggtgggcgccctgagcgccagcctcatcaccgtgtag

SEQ ID NO: 16475 - DNA, 480 bp, Artificial Sequence
  Description of Artificial Sequence: Synthetic coding sequence
atgctgcccaagagaagaagagcccgggtgggcagccccagcggagatgctgccagcagcaccccacccagcacccgcttccctggggtggccatctacctggtggagcccaggatgggccgcagcagaagagccttcctgaccggcctggcccggagcaagggcttccgggtgctggatgcctgcagcagcgaggccacccacgtggtgatggaggagaccagcgctgaggaggccgtgtcctggcaggagaggaggatggctgctgcccctcctggctgcaccccaccagccctgctggacatctcctggctgacagagagcctgggcgccggccagcctgtgcctgtggagtgccgccaccggctggaggaggccctggagatcctggccgaggccgccggctttgagggcagcgagggccgcctgctgaccttctgcagagctgcctctgtgctgaaggccctgcccagcccctag

SEQ ID NO: 16476 - DNA, 729 bp, Artificial Sequence
  Description of Artificial Sequence: Synthetic coding sequence
atgctgcccaagagaagaagagcccgggtgggcagccccagcggagatgctgccagcagcaccccacccagcacccgcttccctggggtggccatctacctggtggagcccaggatgggccgcagcagaagagccttcctgaccggcctggcccggagcaagggcttccgggtgctggatgcctgcagcagcgaggccacccacgtggtgatggaggagaccagcgctgaggaggccgtgtcctggcaggagaggaggatggctgctgcccctcctggctgcaccccaccagccctgctggacatctcctggctgacagagagcctgggcgccggccagcctgtgcctgtggagtgccgccaccggctggaggtggccggccccaggaagggccccctgagccctgcctggatgcctgcctatgcctgccagaggcccacccccctgacccaccacaacacaggcctgtctgaggccctggagatcctggccgaggccgccggctttgagggcagcgagggccgcctgctgaccttctgccgggccgcctctgtgctgaaggccctgcccagccctgtgaccaccctgagccagctgcagggcctgccccactttggagagcacagcagccgggtggtgcaggagctgctggagcacggcgtgtgtgaggaggtggagcgggtgagaagaagtgagagcagcagccccaggagcagcggctctgtgtag

SEQ ID NO: 16477 - DNA, 813 bp, Artificial Sequence
  Description of Artificial Sequence: Synthetic coding sequence
atgctgcccaagagaagaagagcccgggtgggcagccccagcggagatgctgccagcagcaccccacccagcacccgcttccctggggtggccatctacctggtggagcccaggatgggccgcagcagaagagccttcctgaccggcctggcccggagcaagggcttccgggtgctggatgcctgcagcagcgaggccacccacgtggtgatggaggagaccagcgctgaggaggccgtgtcctggcaggagaggaggatggctgctgcccctcctggctgcaccccaccagccctgctggacatctcctggctgacagagagcctgggcgccggccagcctgtgcctgtggagtgccgccaccggctggaggtggccggccccaggaagggccccctgagccctgcctggatgcctgcctatgcctgccagaggcccacccccctgacccaccacaacacaggcctgtctgaggccctggagatcctggccgaggccgccggctttgagggcagcgagggccgcctgctgaccttctgccgggccgcctctgtgctgaaggccctgcccagccctgtgaccaccctgagccagctgcagggcctgccccactttggagagcacagcagccgggtggtgcaggagctgctggagcacggcgtgtgtgaggaggtggagcgggtgagaagaagtgagcgctaccagaccatgaaggtgcggcgggccggcctgggccccaccccaggcatgagctgccctggaaatgacaacacagtgcacaccatgcatggagaggccaacagaggcagctag

SEQ ID NO: 16478 - DNA, 5163 bp, Artificial Sequence
  Description of Artificial Sequence: Synthetic coding sequence
atgctgatcagcaagaacatgccctggaggcggctgcagggcatcagctttggcatgtacagcgctgaggagctgaagaagctgtctgtgaagagcatcaccaacccccgctacctggacagcctgggcaaccccagcgccaacggcctgtatgacctggccctgggccctgctgacagcaaggaggtgtgcagcacctgtgtgcaggacttcagcaactgcagcggccacctgggccacatcgagctgcccctgactgtgtacaaccccctgctgtttgacaagctgtacctgctgctgcggggcagctgcctgaactgccacatgctgacctgccccagggctgtgatccacctgctgctgtgccagctgcgggtgctggaggtgggcgccctgcaggccgtgtatgagctggagcgcatcctgaaccgcttcctggaggagaacccagaccccagcgccagcgagatccgggaggagctggagcagtacaccacagagatcgtgcagaacaacctgctgggcagccagggcgcccacgtgaagaatgtgtgtgagagcaagagcaagctgattgccctcttctggaaggcccacatgaatgccaagcgctgcccccactgcaagacaggccgctctgtggtgaggaaggagcacaacagcaagctgaccatcaccttccctgccatggtgcacaggacagctggccagaaggacagcgagcccctgggcatcgaggaggcccagatcggcaagaggggctacctgacccccaccagcgcccgggagcacctgagcgccctgtggaagaatgaaggcttcttcctgaactacctgttcagcggcatggatgatgatggcatggagagccgcttcaaccccagcgtcttcttcctggacttcctggtggtgccccccagccgctacagacctgtgtcccggctgggggaccagatgttcaccaacggccagacagtgaacctgcaggccgtgatgaaggatgtggtgctgatcaggaagctgctggccctgatggcccaggagcagaagctgcctgaggaggtggccacccccaccacagatgaggagaaggacagcctcatcgccatcgaccgctccttcctgagcaccctgcccggccagagcctgattgacaagctgtacaacatctggatccggctgcagagccacgtgaacatcgtgtttgacagcgagatggacaagctgatgatggacaagtacccaggcatccggcagatcctggagaagaaggagggcctcttcaggaagcacatgatgggcaagagggtggactatgctgcccggagcgtcatctgcccagacatgtacatcaacaccaatgagatcggcatccccatggtgtttgccaccaagctgacctacccccagcctgtgaccccctggaatgtgcaggagctgcggcaggccgtcatcaatggccccaacgtgcaccctggggcctccatggtgatcaatgaagatggcagcaggacagccctgtctgctgtggacatgacccagcgggaggccgtggccaagcagctgctgaccccagccactggagcccccaagccccagggcaccaagatcgtgtgcagacatgtgaagaatggagacatcctgctgctgaaccggcagcccaccctgcaccggcccagcatccaggcccaccgggcccgcatcctgcctgaggagaaggtgctgcggctgcactacgccaactgcaaggcctacaatgctgactttgatggagatgagatgaatgcccacttcccccagagcgagctgggccgggcagaggcctacgtgctggcctgcacagaccagcagtacctggtgcccaaggatggccagcccctggccggcctcatccaggaccacatggtgtctggggcctccatgaccacccggggctgcttcttcacccgggagcactacatggagctggtgtaccggggcctgacagacaaggtgggccgggtgaagctgctgagccccagcatcctgaagcccttccccctgtggacaggcaagcaggtggtgtccaccctgctgatcaacatcatccctgaggaccacatccccctgaacctgagcggcaaggccaagatcaccgggaaggcctgggtgaaggagacccccaggtctgtgcccggcttcaacccagacagcatgtgtgagagccaggtgatcatccgggagggggagctgctgtgtggggtgctggacaaggcccactacggcagcagcgcctacggcctggtgcactgctgctatgagatctatggaggagagaccagcggcaaggtgctgacctgcctggcccggctcttcaccgcctacctgcagctgtaccggggcttcaccctgggcgtggaggacatcctggtgaagcccaaggcagatgtgaagaggcagaggatcatcgaggagagcacccactgcggcccccaggccgtgcgggccgccctgaacctgcctgaggccgccagctatgatgaggtgcggggcaagtggcaggatgcccacctgggcaaggaccagagggacttcaacatgattgacctgaagttcaaggaggaggtgaaccactacagcaatgagatcaacaaggcctgcatgcccttcggcctgcaccggcagtttcctgagaacagcctgcagatgatggtgcagagcggggccaagggcagcacagtgaacaccatgcagatcagctgcctgctgggccagatcgagctggagggccggcggccccccctgatggccagcggcaagagcctgccctgctttgagccctatgagttcacccccagggctgggggctttgtgacaggccgcttcctgaccggcatcaagcccccagagttcttcttccactgcatggccggccgggagggcctggtggacacagctgtgaagaccagccgcagcggctacctgcagcgctgcatcatcaagcacctggagggcctggtggtgcagtatgacctgactgtgcgggacagtgatggctctgtggtgcagttcctgtatggagaagatggcctggacatccccaagacccagttcctgcagcccaagcagttccccttcctggccagcaactatgaggtgatcatgaagagccagcacctgcacgaggtgctgagcagagctgaccccaagaaggccctgcaccacttccgggccatcaagaagtggcagagcaagcaccccaacaccctgctgcggcggggggccttcctgagctacagccagaagatccaggaggccgtgaaggccctgaagctggagagcgagaacagaaatggccgcagccctggcacccaggagatgctgaggatgtggtatgagctggatgaggagagcaggaggaagtaccagaagaaggccgccgcctgcccagaccccagcctgtctgtgtggaggccagacatctactttgcctctgtgtctgagacctttgagaccaaggtggatgactacagccaggagtgggccgcccagacagagaagagctatgagaagtctgagctgagcctggaccggctgcggaccctgctgcagctgaagtggcagaggagcctgtgtgagcctggagaggccgtgggcctgctggccgcccagagcattggagagcccagcacccagatgaccctgaacaccttccactttgctggccgcggggagatgaatgtgaccctgggcatcccccggctgcgggagatcctgatggtggccagcgccaacatcaagacccccatgatgtctgtgcctgtgctgaacaccaagaaggccctgaagagggtgaagagcctgaagaagcagctgaccagggtgtgcctgggggaggtgctgcagaagattgatgtgcaggagagcttctgcatggaggagaagcagaacaagttccaggtgtaccagctgcgcttccagttcctgccccacgcctactaccagcaggagaagtgcctgcggcctgaggacatcctgcgcttcatggagacccgcttcttcaagctgctgatggagagcatcaagaagaagaacaacaaggccagcgccttcagaaatgtgaacacccggcgggccacccagagggacctggacaatgctggggagctgggccgcagcagaggagagcaggagggagatgaggaggaggagggccacatcgtggatgctgaggccgaggagggagatgctgatgccagtgatgccaagaggaaggagaagcaggaggaggaggtggactatgaaagtgaggaggaggaggagcgggagggggaggagaatgatgatgaggacatgcaggaggagaggaacccccaccgggagggcgccaggaagacccaggagcaggatgaggaggtgggcctgggcacagaggaggaccccagcctgcctgccctgctgacccagcccaggaagcccacccacagccaggagccccagggccctgaggccatggagcggcgggtgcaggccgtgcgggagatccaccccttcattgatgactaccagtatgacacagaggagagcctgtggtgccaggtgacagtgaagctgcccctgatgaagatcaactttgacatgagcagcctggtggtgtccctggcccatggagctgtgatctatgccaccaagggcatcacccgctgcctgctgaatgagaccaccaacaacaagaatgagaaggagctggtgctgaacacagagggcatcaacctgcctgagctgttcaagtatgcagaggtgctggacctgcggcggctgtacagcaatgacatccacgccatcgccaacacctacggcatcgaggccgccctgcgggtgattgagaaggagatcaaggatgtgtttgctgtgtatggaattgctgtggaccccaggcacctgagcctggtggccgactacatgtgctttgagggcgtgtacaagcccctgaaccgcttcggcatccgcagcaacagcagccccctgcagcagatgacctttgagaccagcttccagttcctgaagcaggccaccatgctgggcagccatgatgagctgcggagccccagcgcctgcctggtggtgggcaaggtggtgcggggcggcaccggcctgtttgagctgaagcagcccctgaggtag

SEQ ID NO: 16479 - DNA, 4980 bp, Artificial Sequence
  Description of Artificial Sequence: Synthetic coding sequence
atgctgatcagcaagaacatgccctggaggcggctgcagggcatcagctttggcatgtacagcgctgaggagctgaagaagctgtctgtgaagagcatcaccaacccccgctacctggacagcctgggcaaccccagcgccaacggcctgtatgacctggccctgggccctgctgacagcaaggaggtgtgcagcacctgtgtgcaggacttcagcaactgcagcggccacctgggccacatcgagctgcccctgactgtgtacaaccccctgctgtttgacaagctgtacctgctgctgcggggcagctgcctgaactgccacatgctgacctgccccagggctgtgatccacctgctgctgtgccagctgcgggtgctggaggtgggcgccctgcaggccgtgtatgagctggagcgcatcctgaaccgcttcctggaggagaacccagaccccagcgccagcgagatccgggaggagctggagcagtacaccacagagatcgtgcagaacaacctgctgggcagccagggcgcccacgtgaagaatgtgtgtgagagcaagagcaagctgattgccctcttctggaaggcccacatgaatgccaagcgctgcccccactgcaagacaggccgctctgtggtgaggaaggagcacaacagcaagctgaccatcaccttccctgccatggtgcacaggacagctggccagaaggacagcgagcccctgggcatcgaggaggcccagatcggcaagaggggctacctgacccccaccagcgcccgggagcacctgagcgccctgtggaagaatgaaggcttcttcctgaactacctgttcagcggcatggatgatgatggcatggagagccgcttcaaccccagcgtcttcttcctggacttcctggtggtgccccccagccgctacagacctgtgtcccggctgggggaccagatgttcaccaacggccagacagtgaacctgcaggccgtgatgaaggatgtggtgctgatcaggaagctgctggccctgatggcccaggagcagaagctgcctgaggaggtggccacccccaccacagatgaggagaaggacagcctcatcgccatcgaccgctccttcctgagcaccctgcccggccagagcctgattgacaagctgtacaacatctggatccggctgcagagccacgtgaacatcgtgtttgacagcgagatggacaagctgatgatggacaagtacccaggcatccggcagatcctggagaagaaggagggcctcttcaggaagcacatgatgggcaagagggtggactatgctgcccggagcgtcatctgcccagacatgtacatcaacaccaatgagatcggcatccccatggtgtttgccaccaagctgacctacccccagcctgtgaccccctggaatgtgcaggagctgcggcaggccgtcatcaatggccccaacgtgcaccctggggcctccatggtgatcaatgaagatggcagcaggacagccctgtctgctgtggacatgacccagcgggaggccgtggccaagcagctgctgaccccagccactggagcccccaagccccagggcaccaagatcgtgtgcagacatgtgaagaatggagacatcctgctgctgaaccggcagcccaccctgcaccggcccagcatccaggcccaccgggcccgcatcctgcctgaggagaaggtgctgcggctgcactacgccaactgcaaggcctacaatgctgactttgatggagatgagatgaatgcccacttcccccagagcgagctgggccgggcagaggcctacgtgctggcctgcacagaccagcagtacctggtgcccaaggatggccagcccctggccggcctcatccaggaccacatggtgtctggggcctccatgaccacccggggctgcttcttcacccgggagcactacatggagctggtgtaccggggcctgacagacaaggtgggccgggtgaagctgctgagccccagcatcctgaagcccttccccctgtggacaggcaagcaggtggtgtccaccctgctgatcaacatcatccctgaggaccacatccccctgaacctgagcggcaaggccaagatcaccgggaaggcctgggtgaaggagacccccaggtctgtgcccggcttcaacccagacagcatgtgtgagagccaggtgatcatccgggagggggagctgctgtgtggggtgctggacaaggcccactacggcagcagcgcctacggcctggtgcactgctgctatgagatctatggaggagagaccagcggcaaggtgctgacctgcctggcccggctcttcaccgcctacctgcagctgtaccggggcttcaccctgggcgtggaggacatcctggtgaagcccaaggcagatgtgaagaggcagaggatcatcgaggagagcacccactgcggcccccaggccgtgcgggccgccctgaacctgcctgaggccgccagctatgatgaggtgcggggcaagtggcaggatgcccacctgggcaaggaccagagggacttcaacatgattgacctgaagttcaaggaggaggtgaaccactacagcaatgagatcaacaaggcctgcatgcccttcggcctgcaccggcagtttcctgagaacagcctgcagatgatggtgcagagcggggccaagggcagcacagtgaacaccatgcagatcagctgcctgctgggccagatcgagctggagggccggcggccccccctgatggccagcggcaagagcctgccctgctttgagccctatgagttcacccccagggctgggggctttgtgacaggccgcttcctgaccggcatcaagcccccagagttcttcttccactgcatggccggccgggagggcctggtggacacagctgtgaagaccagccgcagcggctacctgcagcgctgcatcatcaagcacctggagggcctggtggtgcagtatgacctgactgtgcgggacagtgatggctctgtggtgcagttcctgtatggagaagatggcctggacatccccaagacccagttcctgcagcccaagcagttccccttcctggccagcaactatgaggtgatcatgaagagccagcacctgcacgaggtgctgagcagagctgaccccaagaaggccctgcaccacttccgggccatcaagaagtggcagagcaagcaccccaacaccctgctgcggcggggggccttcctgagctacagccagaagatccaggaggccgtgaaggccctgaagctggagagcgagaacagaaatggccgcagccctggcacccaggagatgctgaggatgtggtatgagctggatgaggagagcaggaggaagtaccagaagaaggccgccgcctgcccagaccccagcctgtctgtgtggaggccagacatctactttgcctctgtgtctgagacctttgagaccaaggtggatgactacagccaggagtgggccgcccagacagagaagagctatgagaagtctgagctgagcctggaccggctgcggaccctgctgcagctgaagtggcagaggagcctgtgtgagcctggagaggccgtgggcctgctggccgcccagagcattggagagcccagcacccagatgaccctgaacaccttccactttgctggccgcggggagatgaatgtgaccctgggcatcccccggctgcgggagatcctgatggtggccagcgccaacatcaagacccccatgatgtctgtgcctgtgctgaacaccaagaaggccctgaagagggtgaagagcctgaagaagcagctgaccagggtgtgcctgggggaggtgctgcagaagattgatgtgcaggagagcttctgcatggaggagaagcagaacaagttccaggtgtaccagctgcgcttccagttcctgccccacgcctactaccagcaggagaagtgcctgcggcctgaggacatcctgcgcttcatggagacccgcttcttcaagctgctgatggagagcatcaagaagaagaacaacaaggccagcgccttcagaaatgtgaacacccggcgggccacccagagggacctggacaatgctggggagctgggccgcagcagaggagagcaggagggagatgaggaggaggagggccacatcgtggatgctgaggccgaggagggagatgctgatgccagtgatgccaagaggaaggagaagcaggaggaggaggtggactatgaaagtgaggaggaggaggagcgggagggggaggagaatgatgatgaggacatgcaggaggagaggaacccccaccgggagggcgccaggaagacccaggagcaggatgaggaggtgacagtgaagctgcccctgatgaagatcaactttgacatgagcagcctggtggtgtccctggcccacggggccgtcatctatgccaccaagggcatcacccgctgcctgctgaatgagaccaccaacaacaagaatgagaaggagctggtgctgaacacagagggcatcaacctgcctgagctgttcaagtatgcagaggtgctggacctgcggcggctgtacagcaatgacatccacgccatcgccaacacctatggaattgaagctgccctgcgggtcatcgagaaggagatcaaggatgtgtttgctgtgtatggaattgctgtggaccccaggcacctgagcctggtggccgactacatgtgctttgaaggagtgtacaagcccctgaacagatttggcatccgcagcaacagcagccccctgcagcagatgacctttgagaccagcttccagttcctgaagcaggccaccatgctgggcagccatgatgagctgcggagccccagcgcctgcctggtggtgggcaaggtggtgcggggcggcaccggcctgtttgagctgaagcagcccctgaggtag

SEQ ID NO: 16480 - DNA, 3408 bp, Artificial Sequence
  Description of Artificial Sequence: Synthetic coding sequence
atggaccccggcagccgctggaggaacctgcccagcggccccagcctgaagcacctgacagaccccagctatggcatcccccgggagcagcagaaggccgccctgcaggagctgacccgggcccacgtggagagcttcaactatgctgtgcatgagggcctgggcctggccgtgcaggccatccccccatttgaatttgccttcaaggatgagcgcatctccttcaccatcctggatgctgtgatcagcccccccaccgtgcccaagggcaccatctgcaaggaggccaacgtgtacccagctgagtgccggggccgccgcagcacctaccggggcaagctgacagctgacatcaactgggccgtgaatggcatcagcaagggcatcatcaagcagttcctgggctacgtgcccatcatggtgaagagcaagctgtgcaacctgaggaacctgcccccccaggccctgattgagcaccacgaggaggccgaggagatgggcggctacttcatcatcaatggaattgagaaggtgatccgcatgctgatcatgcccaggaggaacttccccatcgccatgatccggcccaagtggaagacccggggccctggctacacccagtatggagtgtccatgcactgtgtgcgggaggagcacagcgctgtgaacatgaacctgcactacctggagaatggaacagtgatgctgaacttcatctacaggaaggagctgttcttcctgcccctgggctttgccctgaaggccctggtgtccttcagtgactaccagatcttccaggagctgatcaagggcaaggaggatgacagcttcctgagaaattctgtgtcccagatgctgcgcatcgtgatggaggagggctgcagcacccagaagcaggtgctgaactacctgggggagtgcttccgggtgaagctgaatgtgcctgactggtacccaaatgagcaggccgctgagttcctgttcaaccagtgcatctgcatccacctgaagagcaacacagagaagttctacatgctgtgcctgatgaccaggaagctgtttgccctggccaagggggagtgcatggaggacaacccagacagcctggtgaaccaggaggtgctgaccccaggccagctgttcctgatgttcctgaaggagaagctggagggctggctggtgtccatcaagatcgcctttgacaagaaggcccagaagacctctgtgtccatgaacacagacaacctgatgaggatcttcaccatgggcatcgacctgaccaagccctttgagtacctgtttgccaccggcaacctgcggagcaagacaggcctgggcctgctgcaggacagcggcctgtgtgtggtggccgacaagctgaacttcatccgctacctgagccacttccgctgtgtgcacagaggagctgactttgccaagatgaggaccaccaccgtgcggcggctgctgcctgagagctggggcttcctgtgccctgtgcacaccccagatggagagccctgtggcctgatgaaccacctgacagctgtgtgtgaggtggtgacccagtttgtgtacacagccagcatcccagccctgctgtgcaacctgggcgtgacccccattgatggagccccccacaggagctacagcgagtgctaccctgtgctgctggatggagtgatggtgggctgggtggacaaggacctggcccctggcattgctgacagcctgcggcacttcaaggtgctgcgggagaagaggatccccccctggatggaggtggtgctgatccccatgaccgggaagcccagcctgtacccaggcctcttcctgttcaccaccccctgccgcctggtgcggcctgtgcagaacctggccctgggcaaggaggagctgattggcaccatggagcagatcttcatgaatgtggccatctttgaagatgaggtgtttgctggggtgaccacccaccaggagctgttcccccacagcctgctgagcgtcatcgccaacttcatccccttcagtgaccacaaccagagccccaggaacatgtaccagtgccagatgggcaagcagaccatgggcttccccctgctgacctaccaggacagaagtgacaacaagctgtaccgcctgcagaccccccagagccccctggtgcggcccagcatgtatgactactatgacatggacaactaccccatcggcaccaatgccatcgtggccgtcatctcctacacaggctatgacatggaggatgccatgattgtgaacaaggcctcctgggagcggggctttgcccacggctctgtgtacaagtctgagttcatcgacctgtctgagaagatcaagcagggcgacagcagcctggtgtttggcatcaagccaggggacccccgggtgctgcagaagctggatgatgatggcctgcccttcatcggggccaagctgcagtatggagacccctactacagctacctgaacctgaacacaggagagagctttgtgatgtactacaagagcaaagaaaactgtgtggtggacaacatcaaggtgtgcagcaatgacaccggcagcggcaagttcaagtgtgtgtgcatcaccatgagggtgcccaggaaccccaccatcggggacaagtttgccagcagacatggccagaagggcatcctgagccggctgtggccagctgaggacatgcccttcacagaaagtggcatggtgcctgacatcctcttcaacccccacggcttccccagcaggatgaccatcggcatgctgattgagagcatggccggcaagtctgctgccctgcacggcctgtgccatgatgccacccccttcatcttctctgaagaaaattctgccctggagtactttggagagatgctgaaggctgctggctacaacttctacggcacagagcggctgtacagcggcatcagcggcctggagctggaggccgacatcttcatcggcgtggtgtactaccagaggctgcggcacatggtgtctgacaagttccaggtgaggaccactggagcccgggacagagtgaccaaccagcccatcggcggcagaaatgtgcagggcggcatccgctttggagagatggagagagatgccctgctggcccacggcaccagcttcctgctgcatgacaggctcttcaactgcagcgacagatctgtggcccacgtgtgtgtgaagtgtggcagcctgctgagccccctgctggagaagcccccacccagctggagcgccatgaggaacaggaagtacaactgcaccctgtgcagcagaagtgacaccatcgacacagtgtctgtgccctacgtgttccgctactttgtggccgagctggccgccatgaacatcaaggtgaagctggatgtggtgtag

SEQ ID NO: 16481 - DNA, 3240 bp, Artificial Sequence
  Description of Artificial Sequence: Synthetic coding sequence
atggaccccggcagccgctggaggaacctgcccagcggccccagcctgaagcacctgacagaccccagctatggcatcccccgggagcagcagaaggccgccctgcaggagctgacccgggcccacgtggagagcttcaactatgctgtgcatgagggcctgggcctggccgtgcaggccgacatcaactgggccgtgaatggcatcagcaagggcatcatcaagcagttcctgggctacgtgcccatcatggtgaagagcaagctgtgcaacctgaggaacctgcccccccaggccctgattgagcaccacgaggaggccgaggagatgggcggctacttcatcatcaatggaattgagaaggtgatccgcatgctgatcatgcccaggaggaacttccccatcgccatgatccggcccaagtggaagacccggggccctggctacacccagtatggagtgtccatgcactgtgtgcgggaggagcacagcgctgtgaacatgaacctgcactacctggagaatggaacagtgatgctgaacttcatctacaggaaggagctgttcttcctgcccctgggctttgccctgaaggccctggtgtccttcagtgactaccagatcttccaggagctgatcaagggcaaggaggatgacagcttcctgagaaattctgtgtcccagatgctgcgcatcgtgatggaggagggctgcagcacccagaagcaggtgctgaactacctgggggagtgcttccgggtgaagctgaatgtgcctgactggtacccaaatgagcaggccgctgagttcctgttcaaccagtgcatctgcatccacctgaagagcaacacagagaagttctacatgctgtgcctgatgaccaggaagctgtttgccctggccaagggggagtgcatggaggacaacccagacagcctggtgaaccaggaggtgctgaccccaggccagctgttcctgatgttcctgaaggagaagctggagggctggctggtgtccatcaagatcgcctttgacaagaaggcccagaagacctctgtgtccatgaacacagacaacctgatgaggatcttcaccatgggcatcgacctgaccaagccctttgagtacctgtttgccaccggcaacctgcggagcaagacaggcctgggcctgctgcaggacagcggcctgtgtgtggtggccgacaagctgaacttcatccgctacctgagccacttccgctgtgtgcacagaggagctgactttgccaagatgaggaccaccaccgtgcggcggctgctgcctgagagctggggcttcctgtgccctgtgcacaccccagatggagagccctgtggcctgatgaaccacctgacagctgtgtgtgaggtggtgacccagtttgtgtacacagccagcatcccagccctgctgtgcaacctgggcgtgacccccattgatggagccccccacaggagctacagcgagtgctaccctgtgctgctggatggagtgatggtgggctgggtggacaaggacctggcccctggcattgctgacagcctgcggcacttcaaggtgctgcgggagaagaggatccccccctggatggaggtggtgctgatccccatgaccgggaagcccagcctgtacccaggcctcttcctgttcaccaccccctgccgcctggtgcggcctgtgcagaacctggccctgggcaaggaggagctgattggcaccatggagcagatcttcatgaatgtggccatctttgaagatgaggtgtttgctggggtgaccacccaccaggagctgttcccccacagcctgctgagcgtcatcgccaacttcatccccttcagtgaccacaaccagagccccaggaacatgtaccagtgccagatgggcaagcagaccatgggcttccccctgctgacctaccaggacagaagtgacaacaagctgtaccgcctgcagaccccccagagccccctggtgcggcccagcatgtatgactactatgacatggacaactaccccatcggcaccaatgccatcgtggccgtcatctcctacacaggctatgacatggaggatgccatgattgtgaacaaggcctcctgggagcggggctttgcccacggctctgtgtacaagtctgagttcatcgacctgtctgagaagatcaagcagggcgacagcagcctggtgtttggcatcaagccaggggacccccgggtgctgcagaagctggatgatgatggcctgcccttcatcggggccaagctgcagtatggagacccctactacagctacctgaacctgaacacaggagagagctttgtgatgtactacaagagcaaagaaaactgtgtggtggacaacatcaaggtgtgcagcaatgacaccggcagcggcaagttcaagtgtgtgtgcatcaccatgagggtgcccaggaaccccaccatcggggacaagtttgccagcagacatggccagaagggcatcctgagccggctgtggccagctgaggacatgcccttcacagaaagtggcatggtgcctgacatcctcttcaacccccacggcttccccagcaggatgaccatcggcatgctgattgagagcatggccggcaagtctgctgccctgcacggcctgtgccatgatgccacccccttcatcttctctgaagaaaattctgccctggagtactttggagagatgctgaaggctgctggctacaacttctacggcacagagcggctgtacagcggcatcagcggcctggagctggaggccgacatcttcatcggcgtggtgtactaccagaggctgcggcacatggtgtctgacaagttccaggtgaggaccactggagcccgggacagagtgaccaaccagcccatcggcggcagaaatgtgcagggcggcatccgctttggagagatggagagagatgccctgctggcccacggcaccagcttcctgctgcatgacaggctcttcaactgcagcgacagatctgtggcccacgtgtgtgtgaagtgtggcagcctgctgagccccctgctggagaagcccccacccagctggagcgccatgaggaacaggaagtacaactgcaccctgtgcagcagaagtgacaccatcgacacagtgtctgtgccctacgtgttccgctactttgtggccgagctggccgccatgaacatcaaggtgaagctggatgtggtgtag

SEQ ID NO: 16482 - DNA, 345 bp, Artificial Sequence
  Description of Artificial Sequence: Synthetic coding sequence
atggaccccggcagccgctggaggaacctgcccagcggccccagcctgaagcacctgacagaccccagctatggcatcccccgggagcagcagaaggccgccctgcaggagctgacccgggcccacgtggagagcttcaactatgctgtgcatgagggcctgggcctggccgtgcaggccatccccccatttgaatttgccttcaaggatgagcgcatctccttcaccatcctggatgctgtgatcagcccccccaccgtgcccaagggcaccatctgcaaggaggccaacgtgtacccagctgagtgccggggccgccgcagcacctaccggggcaagctgtag

SEQ ID NO: 16483 - DNA, 387 bp, Artificial Sequence
  Description of Artificial Sequence: Synthetic coding sequence
atggaccccggcagccgctggaggaacctgcccagcggccccagcctgaagcacctgacagaccccagctatggcatcccccgggagcagcagaaggccgccctgcaggagctgacccgggcccacgtggagagcttcaactatgctgtgcatgagggcctgggcctggccgtgcaggccatccccccatttgaatttgccttcaaggatgagcgcatctccttcaccatcctggatgctgtgatcagcccccccaccgtgcccaagggcaccatctgcaaggaggccaacgtgtacccagctgagtgccggggccgccgcagcacctaccggggcaagctgacagctgacatcaactgggccgtgaatggcatcagcaaaggatag

SEQ ID NO: 16484 - DNA, 1380 bp, Artificial Sequence
  Description of Artificial Sequence: Synthetic coding sequence
atgaatgtggccatctttgaagatgaggtgtttgctggggtgaccacccaccaggagctgttcccccacagcctgctgtctgtgattgccaacttcatccccttcagtgaccacaaccagagccccaggaacatgtaccagtgccagatgggcaagcagaccatgggcttccccctgctgacctaccaggacagaagtgacaacaagctgtaccgcctgcagaccccccagagccccctggtgcggcccagcatgtatgactactatgacatggacaactaccccatcggcaccaatgccatcgtggccgtcatctcctacacaggctatgacatggaggatgccatgattgtgaacaaggcctcctgggagcggggctttgcccacggctctgtgtacaagtctgagttcatcgacctgtctgagaagatcaagcagggcgacagcagcctggtgtttggcatcaagccaggggacccccgggtgctgcagaagctggatgatgatggcctgcccttcatcggggccaagctgcagtacggggacccctactacagctacctgaacctgaacacaggagagagctttgtgatgtactacaagagcaaggagaactgtgtggtggacaacatcaaggtgtgcagcaatgacaccggcagcggcaagttcaagtgtgtgtgcatcaccatgagggtgcccaggaaccccaccatcggggacaagtttgccagccgccacggccagaagggcatcctgagccggctgtggccagctgaggacatgcccttcacagagagcggcatggtgcctgacatcctcttcaacccccacggcttccccagcaggatgaccatcggcatgctgattgaatccatggccggcaagtctgctgccctgcacggcctgtgccatgatgccacccccttcatcttcagcgaggagaacagcgccctggagtactttggagagatgctgaaggccgccggctacaacttctatggaacagagcggctgtacagcggcatcagcggcctggagctggaggccgacatcttcatcggcgtggtgtactaccagaggctgcggcacatggtgtctgacaagttccaggtgaggaccaccggggcccgggacagagtgaccaaccagcccatcggcggcagaaatgtgcagggcggcatccgctttggagagatggagagagatgccctgctggcccacggcaccagcttcctgctgcatgacaggctcttcaactgcagcgacagatctgtggcccacgtgtgtgaggtgtggcagttcaccctgagcacagtgggggaggccacccccttcctggtgtgccacgcccagcagaagatccagctgtacagcgtgtag

SEQ ID NO: 16485 - DNA, 2775 bp, Artificial Sequence
  Description of Artificial Sequence: Synthetic coding sequence
atgcactgtgtgcgggaggagcacagcgctgtgaacatgaacctgcactacctggagaatggcaccgtgatgctgaacttcatctacaggaaggagctgttcttcctgcccctgggctttgccctgaaggccctggtgtccttcagtgactaccagatcttccaggagctgatcaagggcaaggaggatgacagcttcctgaggaacagcgtgtcccagatgctgagaattgtgatggaggagggctgcagcacccagaagcaggtgctgaactacctgggggagtgcttccgggtgaagctgaatgtgcctgactggtacccaaatgagcaggccgctgagttcctgttcaaccagtgcatctgcatccacctgaagagcaacacagagaagttctacatgctgtgcctgatgaccaggaagctgtttgccctggccaagggggagtgcatggaggacaacccagacagcctggtgaaccaggaggtgctgaccccaggccagctgttcctgatgttcctgaaggagaagctggagggctggctggtgtccatcaagatcgcctttgacaagaaggcccagaagacctctgtgtccatgaacacagacaacctgatgaggatcttcaccatgggcatcgacctgaccaagccctttgagtacctgtttgccactggaaacctgcggagcaagacaggcctgggcctgctgcaggacagcggcctgtgtgtggtggccgacaagctgaacttcatccgctacctgagccacttccgctgtgtgcacagaggagctgactttgccaagatgaggaccaccaccgtgcggcggctgctgcctgagagctggggcttcctgtgccctgtgcacaccccagatggagagccctgtggcctgatgaaccacctgacagctgtgtgtgaggtggtgacccagtttgtgtacacagccagcatcccagccctgctgtgcaacctgggcgtgacccccattgatggagccccccacaggagctacagcgagtgctaccctgtgctgctggatggagtgatggtgggctgggtggacaaggacctggcccctggcattgctgacagcctgcggcacttcaaggtgctgcgggagaagagaattcctccctggatggaggtggtgctgatccccatgaccgggaagcccagcctgtacccaggcctcttcctgttcaccaccccctgccgcctggtgcggcctgtgcagaacctggccctgggcaaggaggagctgattggcaccatggagcagatcttcatgaatgtggccatctttgaagatgaggtgtttgctggggtgaccacccaccaggagctgttcccccacagcctgctgtctgtgattgccaacttcatccccttcagtgaccacaaccagagccccaggaacatgtaccagtgccagatgggcaagcagaccatgggcttccccctgctgacctaccaggacagaagtgacaacaagctgtaccgcctgcagaccccccagagccccctggtgcggcccagcatgtatgactactatgacatggacaactaccccatcggcaccaatgccatcgtggccgtcatctcctacacaggctatgacatggaggatgccatgattgtgaacaaggcctcctgggagcggggctttgcccacggctctgtgtacaagtctgagttcatcgacctgtctgagaagatcaagcagggcgacagcagcctggtgtttggcatcaagccaggggacccccgggtgctgcagaagctggatgatgatggcctgcccttcatcggggccaagctgcagtacggggacccctactacagctacctgaacctgaacacaggagagagctttgtgatgtactacaagagcaaggagaactgtgtggtggacaacatcaaggtgtgcagcaatgacaccggcagcggcaagttcaagtgtgtgtgcatcaccatgagggtgcccaggaaccccaccatcggggacaagtttgccagccgccacggccagaagggcatcctgagccggctgtggccagctgaggacatgcccttcacagagagcggcatggtgcctgacatcctcttcaacccccacggcttccccagcaggatgaccatcggcatgctgattgaatccatggccggcaagtctgctgccctgcacggcctgtgccatgatgccacccccttcatcttcagcgaggagaacagcgccctggagtactttggagagatgctgaaggccgccggctacaacttctatggaacagagcggctgtacagcggcatcagcggcctggagctggaggccgacatcttcatcggcgtggtgtactaccagaggctgcggcacatggtgtctgacaagttccaggtgaggaccaccggggcccgggacagagtgaccaaccagcccatcggcggcagaaatgtgcagggcggcatccgctttggagagatggagagagatgccctgctggcccacggcaccagcttcctgctgcatgacaggctcttcaactgcagcgacagatctgtggcccacgtgtgtgtgaagtgtggcagcctgctgagccccctgctggagaagcccccacccagctggagcgccatgaggaacaggaagtacaactgcaccctgtgcagcagaagtgacaccatcgacacagtgtctgtgccctacgtgttccgctactttgtggccgagctggccgccatgaacatcaaggtgaagctggatgtggtgtag

SEQ ID NO: 16486 - DNA, 3522 bp, Artificial Sequence
  Description of Artificial Sequence: Synthetic coding sequence
atgagggccaaggaggccgctgagaccggcctgcggcccctgctgcctgcctgcacagagcggctggccagcggcgtgtaccgggagaccggggtgcgctgtgccggcggccacatggaccccggcagccgctggaggaacctgcccagcggccccagcctgaagcacctgacagaccccagctatggcatcccccgggagcagcagaaggccgccctgcaggagctgacccgggcccacgtggagagcttcaactatgctgtgcatgagggcctgggcctggccgtgcaggccatccccccatttgaatttgccttcaaggatgagcgcatctccttcaccatcctggatgctgtgatcagcccccccaccgtgcccaagggcaccatctgcaaggaggccaacgtgtacccagctgagtgccggggccgccgcagcacctaccggggcaagctgacagctgacatcaactgggccgtgaatggcatcagcaagggcatcatcaagcagttcctgggctacgtgcccatcatggtgaagagcaagctgtgcaacctgaggaacctgcccccccaggccctgattgagcaccacgaggaggccgaggagatgggcggctacttcatcatcaatggaattgagaaggtgatccgcatgctgatcatgcccaggaggaacttccccatcgccatgatccggcccaagtggaagacccggggccctggctacacccagtatggagtgtccatgcactgtgtgcgggaggagcacagcgctgtgaacatgaacctgcactacctggagaatggaacagtgatgctgaacttcatctacaggaaggagctgttcttcctgcccctgggctttgccctgaaggccctggtgtccttcagtgactaccagatcttccaggagctgatcaagggcaaggaggatgacagcttcctgagaaattctgtgtcccagatgctgcgcatcgtgatggaggagggctgcagcacccagaagcaggtgctgaactacctgggggagtgcttccgggtgaagctgaatgtgcctgactggtacccaaatgagcaggccgctgagttcctgttcaaccagtgcatctgcatccacctgaagagcaacacagagaagttctacatgctgtgcctgatgaccaggaagctgtttgccctggccaagggggagtgcatggaggacaacccagacagcctggtgaaccaggaggtgctgaccccaggccagctgttcctgatgttcctgaaggagaagctggagggctggctggtgtccatcaagatcgcctttgacaagaaggcccagaagacctctgtgtccatgaacacagacaacctgatgaggatcttcaccatgggcatcgacctgaccaagccctttgagtacctgtttgccaccggcaacctgcggagcaagacaggcctgggcctgctgcaggacagcggcctgtgtgtggtggccgacaagctgaacttcatccgctacctgagccacttccgctgtgtgcacagaggagctgactttgccaagatgaggaccaccaccgtgcggcggctgctgcctgagagctggggcttcctgtgccctgtgcacaccccagatggagagccctgtggcctgatgaaccacctgacagctgtgtgtgaggtggtgacccagtttgtgtacacagccagcatcccagccctgctgtgcaacctgggcgtgacccccattgatggagccccccacaggagctacagcgagtgctaccctgtgctgctggatggagtgatggtgggctgggtggacaaggacctggcccctggcattgctgacagcctgcggcacttcaaggtgctgcgggagaagaggatccccccctggatggaggtggtgctgatccccatgaccgggaagcccagcctgtacccaggcctcttcctgttcaccaccccctgccgcctggtgcggcctgtgcagaacctggccctgggcaaggaggagctgattggcaccatggagcagatcttcatgaatgtggccatctttgaagatgaggtgtttgctggggtgaccacccaccaggagctgttcccccacagcctgctgagcgtcatcgccaacttcatccccttcagtgaccacaaccagagccccaggaacatgtaccagtgccagatgggcaagcagaccatgggcttccccctgctgacctaccaggacagaagtgacaacaagctgtaccgcctgcagaccccccagagccccctggtgcggcccagcatgtatgactactatgacatggacaactaccccatcggcaccaatgccatcgtggccgtcatctcctacacaggctatgacatggaggatgccatgattgtgaacaaggcctcctgggagcggggctttgcccacggctctgtgtacaagtctgagttcatcgacctgtctgagaagatcaagcagggcgacagcagcctggtgtttggcatcaagccaggggacccccgggtgctgcagaagctggatgatgatggcctgcccttcatcggggccaagctgcagtatggagacccctactacagctacctgaacctgaacacaggagagagctttgtgatgtactacaagagcaaagaaaactgtgtggtggacaacatcaaggtgtgcagcaatgacaccggcagcggcaagttcaagtgtgtgtgcatcaccatgagggtgcccaggaaccccaccatcggggacaagtttgccagcagacatggccagaagggcatcctgagccggctgtggccagctgaggacatgcccttcacagaaagtggcatggtgcctgacatcctcttcaacccccacggcttccccagcaggatgaccatcggcatgctgattgagagcatggccggcaagtctgctgccctgcacggcctgtgccatgatgccacccccttcatcttctctgaagaaaattctgccctggagtactttggagagatgctgaaggctgctggctacaacttctacggcacagagcggctgtacagcggcatcagcggcctggagctggaggccgacatcttcatcggcgtggtgtactaccagaggctgcggcacatggtgtctgacaagttccaggtgaggaccactggagcccgggacagagtgaccaaccagcccatcggcggcagaaatgtgcagggcggcatccgctttggagagatggagagagatgccctgctggcccacggcaccagcttcctgctgcatgacaggctcttcaactgcagcgacagatctgtggcccacgtgtgtgtgaagtgtggcagcctgctgagccccctgctggagaagcccccacccagctggagcgccatgaggaacaggaagtacaactgcaccctgtgcagcagaagtgacaccatcgacacagtgtctgtgccctacgtgttccgctactttgtggccgagctggccgccatgaacatcaaggtgaagctggatgtggtgtag

SEQ ID NO: 16487 - DNA, 3525 bp, Artificial Sequence
  Description of Artificial Sequence: Synthetic coding sequence
atgtatgatgctgatgaggacatgcagtatgatgaagatgatgatgagatcaccccagacctgtggcaggaggcctgctggatcgtcatcagcagctactttgatgagaagggcctggtgcggcagcagctggacagctttgatgagttcatccagatgtctgtgcagagaattgtggaggatgccccacccatcgacctgcaggccgaggcccagcacgccagcggggaggtggaggagcccccacgctacctgctgaagtttgagcagatctacctgagcaagcccacccactgggagagagatggagcccccagccccatgatgcccaatgaggcccggctgaggaacctgacctacagcgcccccctgtatgtggacatcaccaagacagtcatcaaggagggggaggagcagctgcagacccagcaccagaagaccttcatcggcaagatccccatcatgctgcggagcacctactgcctgctgaatggcctgacagaccgggacctgtgtgagctgaatgaatgtcccctggaccccggcggctacttcatcatcaatggcagcgagaaggtgctgattgcccaggagaagatggccaccaacacagtgtatgtgtttgccaagaaggacagcaaatatgcctacaccggggagtgccgcagctgcctggagaacagcagccggcccaccagcaccatctgggtgtccatgctggcccggggcggccagggcgccaagaagagcgccatcggccagagaattgtggccaccctgccctacatcaagcaggaggtgcccatcatcatcgtgttccgggccctgggctttgtgtctgaccgggacatcctggagcacatcatctatgactttgaagatcctgagatgatggagatggtgaagcccagcctggatgaggcctttgtgatccaggagcagaatgtggccctgaacttcatcggcagcagaggagccaagccaggagtgaccaaggagaagaggatcaagtatgccaaggaggtgctgcagaaggagatgctgccccacgtgggcgtgtctgacttctgtgagaccaagaaggcctacttcctgggctacatggtgcaccggctgctgctggccgccctgggcagaagagagctggatgaccgggaccactacggcaacaagaggctggacctggccggccccctgctggccttcctgttccggggcatgttcaagaacctgctgaaggaggtgcgcatctatgcccagaagttcatcgaccggggcaaggacttcaacctggagctggccatcaagacccgcatcatcagtgatggcctgaagtacagcctggccaccggcaactggggagaccagaagaaggcccaccaggcccgggccggcgtgtcccaggtgctgaaccggctgacctttgccagcaccctgagccacctgcggcggctgaacagccccatcggcagagatggcaagctggccaagccccggcagctgcacaacaccctgtggggcatggtgtgcccagctgagaccccagagggccatgctgtgggcctggtgaagaacctggccctgatggcctacatctctgtgggcagccagcccagccccatcctggagttcctggaggagtggagcatggagaacctggaggagatcagccctgctgccatcgcagatgccaccaagatctttgtgaatggctgctgggtgggcatccacaaggaccctgagcagctgatgaacaccctgaggaagctgcggcggcagatggacatcatcgtgtctgaggtgtccatgatccgggacatccgggagcgggagatccgcatctacacagatgctggccgcatctgccggcccctgctgattgtggagaagcagaagctgctgctgaagaagaggcacatcgaccagctgaaggagcgggagtacaacaactacagctggcaggacctggtggccagcggcgtggtggagtacatcgacaccctggaggaggagaccgtgatgctggccatgaccccagatgacctgcaggagaaggaggtggcctactgcagcacctacacccactgtgagatccaccccagcatgatcctgggcgtgtgtgccagcatcatccccttcccagaccacaaccagagccccaggaacacctaccagagcgccatgggcaagcaggccatgggcgtgtacatcaccaacttccacgtgaggatggacaccctggcccacgtgctgtactacccccagaagcccctggtgaccaccaggtccatggagtacctgcgcttccgggagctgcctgctggcatcaacagcatcgtggccatcgccagctacacaggctacaaccaggaggacagcgtcatcatgaacagatctgctgtggaccggggcttcttccgcagcgtcttctaccgcagctacaaggagcaggagagcaagaagggctttgaccaggaggaggtgtttgagaagcccacccgggagacctgccagggcatgagacatgccatctatgacaagctggatgatgatggcctcatcgcccctggggtgcgggtgtctggagatgatgtgatcatcggcaagacagtgaccctgcctgaaaatgaagatgagctggagagcaccaacagacgctacaccaagagggactgcagcaccttcctgcggaccagcgagactggaattgtggaccaggtgatggtgaccctgaaccaggagggctacaagttctgcaagatccgggtgcgctctgtgcgcatcccccagattggagacaagtttgccagcagacatggccagaagggcacctgtggcatccagtaccggcaggaggacatgcccttcacctgtgagggcatcaccccagacatcatcatcaacccccacgccatccccagcaggatgaccatcggccacctgattgaatgtctgcagggcaaggtgtctgccaacaagggggagattggagatgccacccccttcaatgatgctgtgaatgtgcagaagatcagcaacctgctgagtgactatggctaccacctgcggggaaatgaggtgctgtacaacggcttcaccggcaggaagatcaccagccagatcttcatcggccccacctactaccagaggctgaagcacatggtggatgacaagatccacagccgggcccggggccccatccagatcctgaaccggcagcccatggagggccgcagcagagatggcggcctgcgctttggagagatggagcgggactgccagatcgcccatggagctgcccagttcctgcgggagcggctgtttgaggccagtgacccctaccaggtgcacgtgtgcaacctgtgtggcatcatggccatcgccaacaccaggacccacacctatgagtgccggggctgcaggaacaagacccagatcagcctggtgaggatgccctatgcctgcaagctgctcttccaggagctgatgtccatgagcatcgcccccaggatgatgtctgtgtag

SEQ ID NO: 16488 - DNA, 3525 bp, Artificial Sequence; identical to SEQ ID NO: 16487
  Description of Artificial Sequence: Synthetic coding sequence

SEQ ID NO: 16489 - DNA, 429 bp, Artificial Sequence
  Description of Artificial Sequence: Synthetic coding sequence
atggctgctgggggcagtgaccccagggctggagatgtggaggaggatgccagccagctgatcttccccaaggagtttgaaacagctgagaccctgctgaacagcgaggtgcacatgctgctggagcacaggaagcagcagaatgaatctgcagaagatgagcaggagctgtctgaggtgttcatgaagaccctgaactacacagcccgcttcagccgcttcaagaaccgggagaccatcgcctctgtgcgcagcctgctgctgcagaagaagctgcacaagtttgagctggcctgcctggccaacctgtgcccagagacagctgaggagagcaaggccctgatccccagcctggagggccgctttgaagatgaggagctgcagcagatcctggatgacatccagaccaagaggagcttccagtactag

SEQ ID NO: 16490 - DNA, 348 bp, Artificial Sequence
  Description of Artificial Sequence: Synthetic coding sequence
atgaatgcccccccagcctttgagagcttcctgctgtttgaaggagagaagatcaccatcaacaaggacaccaaggtgcccaatgcctgcctcttcaccatcaacaaggaggaccacaccctgggcaacatcatcaagagccagctgctgaaggacccccaggtgctgtttgctggctacaaggtgccccaccccctggagcacaagatcatcatccgggtgcagaccaccccagactacagcccccaggaggccttcaccaatgccatcacagacctgatcagcgagctgagcctgctggaggagcgcttccgcacctgcctgctgcccctgcggctgctgccctag

SEQ ID NO: 16491 - DNA, 348 bp, Artificial Sequence; identical to SEQ ID NO: 16490
  Description of Artificial Sequence: Synthetic coding sequence

SEQ ID NO: 16492 - DNA, 1107 bp, Artificial Sequence
  Description of Artificial Sequence: Synthetic coding sequence
atgtgcagcctgccccggggctttgagccccaggcccctgaggacctggcccagaggagcctggtggagctgcgggagatgctgaagaggcaggagcggctgctgagaaatgagaagttcatctgcaagctgcctgacaagggcaagaagatctttgacagctttgccaagctgaaggccgccatcgccgagtgtgaggaggtgcggaggaagtctgagctgttcaaccctgtgtccctggactgcaagctgcggcagaaggccatcgccgaggtggatgtgggcacagacaaggcccagaacagcgaccccatcctggacaccagcagcctggtgcccggctgcagctctgtggacaacatcaagagcagccagaccagccagaaccagggcctgggccggcccaccctggagggagatgaggagaccagcgaggtggagtacacagtgaacaagggccctgccagcagcaacagagacagagtgccccccagcagcgaggccagcgagcaccaccccaggcaccgggtgagcagccaggccgaggacaccagcagcagctttgacaacctcttcatcgaccggctgcagaggatcaccatcgctgaccagggcgagcagcagagtgaagaaaatgccagcaccaagaacctgaccggcctgagcagcggcacagagaagaagccccactacatggaggtgctggagatgagggccaagaaccctgtgccccagctgaggaagttcaagaccaacgtgctgcccttccggcagaatgacagcagcagccactgccagaagagcggcagccccatcagcagcgaggagaggagaagaagagacaagcagcacctggatgacatcacagctgcccggctgctgcccctgcaccacatgcccacccagctgctgagcattgaggagagcctggccctgcagaagcagcagaagcagaactatgaggagatgcaggccaagctggccgcccagaagctggccgagcggctgaacatcaagatgaggagctacaaccctgagggggagagcagcggccgctaccgggaggtgagagatgaagatgatgactggagcagtgatgagttctag

SEQ ID NO: 16493 - DNA, 636 bp, Artificial Sequence
  Description of Artificial Sequence: Synthetic coding sequence
atgtgcagcctgccccggggctttgagccccaggcccctgaggacctggcccagaggagcctggtggagctgcgggagatgctgaagaggcaggagcggctgctgagaaatgagctgcagaggatcaccatcgctgaccagggcgagcagcagagcgaggagaatgccagcaccaagaacctgaccggcctgagcagcggcacagagaagaagccccactacatggaggtgctggagatgagggccaagaaccctgtgccccagctgaggaagttcaagaccaacgtgctgcccttccggcagaatgacagcagcagccactgccagaagagcggcagccccatcagcagcgaggagaggagaagaagagacaagcagcacctggatgacatcacagctgcccggctgctgcccctgcaccacatgcccacccagctgctgagcattgaggagagcctggccctgcagaagcagcagaagcagaactatgaggagatgcaggccaagctggccgcccagaagctggccgagcggctgaacatcaagatgaggagctacaaccctgagggggagagcagcggccgctaccgggaggtgagagatgaagatgatgactggagcagtgatgagttctag

SEQ ID NO: 16494 - DNA, 1092 bp, Artificial Sequence
  Description of Artificial Sequence: Synthetic coding sequence
atgtgcagcctgccccggggctttgagccccaggcccctgaggacctggcccagaggagcctggtggagctgcgggagatgctgaagaggcaggagcggctgctgagaaatgagaagttcatctgcaagctgcctgacaagggcaagaagatctttgacagctttgccaagctgaaggccgccatcgccgagtgtgaggaggtgcggaggaagtctgagctgttcaaccctgtgtccctggactgcaagctgcggcagaaggccatcgccgaggtggatgtgggcacagacaaggcccagaacagcgaccccatcctggacaccagcagcctggtgcccggctgcagctctgtggacaacatcaagagcagccagaccagccagaaccagggcctgggccggcccaccctggagggagatgaggagaccagcgaggtggagtacacagtgaacaagggccctgccagcagcaacagagacagagtgccccccagcagcgaggccagcgagcaccaccccaggcaccgggtgagcagccaggccgaggacaccagcagcagctttgacaacctcttcatcgaccggctgcagaggatcaccatcgctgaccagggcgagcagcagagtgaagaaaatgccagcaccaagaacctgaccggcctgagcagcggcacagagaagaagccccactacatggaggtgctggagatgagggccaagaaccctgtgccccagctgaggaagttcaagaccaacgtgctgcccttccggcagaatgacagcagcagccactgccagaagagcggcagccccatcagcagcgaggagaggagaagaagagacaagcagcacctggatgacatcacagctgcccggctgctgcccctgcaccacatgcccacccagctgctgagcattgaggagagcctggccctgcagaagcagcagaagcagaactatgaggagcggcccttctacagcccccagtaccgcagctccatgaacctgctgagcctggccgccgccgccaaggacacccggggcagcaagagcggcaagatgggcagcctggccctgctgaccaagctgtag

SEQ ID NO: 16495 - DNA, 1605 bp, Artificial Sequence
  Description of Artificial Sequence: Synthetic coding sequence
atgacccaggccgagatcaagctgtgcagcctgctgctgcaggagcactttggagagatcgtggagaagattggagtgcacctgatcagaacaggcagccagcccctgcgggtgattgcccatgacaccggcaccagcctggaccaggtgaagaaggccctgtgtgtgctggtgcagcacaacctggtgtcctaccaggtgcacaagaggggcgtggtggagtatgaggcccagtgcagccgggtgctgaggatgctgcgctacccccgctacatctacaccaccaagaccctgtacagcgacaccggggagctgattgtggaggagctgctgctgaatggcaagctgaccatgtctgctgtggtgaagaaggtggccgaccggctgacagagaccatggaggatggcaagaccatggactatgcagaggtgagcaacacctttgtgcggctggccgacacccactttgtgcagcgctgccccagcgtgcccaccacagaaaattctgaccccggccccccacctccagcccccaccctggtgatcaatgagaaggacatgtacctggtgcccaagctgagcctcatcggcaagggcaagagaagaagaagcagtgatgaagatgctgctggggagcccaaggccaagaggcccaagtacaccacagacaacaaggagcccatcccagatgatggcatctactggcaggccaacctggaccgcttccaccagcacttccgggaccaggccatcgtgtctgctgtggccaacaggatggaccagaccagcagcgagatcgtgaggaccatgctgaggatgtctgagatcaccaccagcagcagcgcccccttcacccagcccctgagcagcaatgagatcttccgcagcctgcctgtgggctacaacatcagcaagcaggtgctggaccagtacctgaccctgctggctgatgaccccctggagtttgtgggcaagagcggggacagcggcggcggcatgtatgtgatcaacctgcacaaggccctggccagcctggccacagccaccctggagagcgtggtgcaggagcgcttcggcagccgctgtgcccgcatcttccggctggtgctgcagaagaagcacatcgagcagaagcaggtggaggactttgccatgatcccagccaaggaggccaaggacatgctgtacaagatgctgtctgagaacttcatgagcctgcaggagatccccaagaccccagaccacgcccccagcaggaccttctacctgtacacagtgaacatcctgtctgctgccaggatgctgctgcaccgctgctacaagagcatcgccaacctgattgaaagacggcagtttgagaccaaggagaacaagaggctgctggagaagagccagagggtggaggccatcatcgcctccatgcaggccactggagctgaggaggcccagctgcaggagattgaggagatgatcacagcccctgagcggcagcagctggagaccctgaagagaaatgtgaacaagctggatgccagcgagatccaggtggatgagaccatcttcctgctggagagctacatcgagtgcaccatgaagaggcagtag

SEQ ID NO: 16496 - DNA, 1236 bp, Artificial Sequence
  Description of Artificial Sequence: Synthetic coding sequence
atgacccaggccgagatcaagctgtgcagcctgctgctgcaggagcactttggagagatcgtggagaagattggagtgcacctgatcagaacaggcagccagcccctgcgggtgattgcccatgacaccggcaccagcctggaccaggtgaagaaggccctgtgtgtgctggtgcagcacaacctggtgtcctaccaggtgcacaagaggggcgtggtggagtatgaggcccagtgcagccgggtgctgaggatgctgcgctacccccgctacatctacaccaccaagaccctgtacagcgacaccggggagctgattgtggaggagctgctgctgaatggcaagctgaccatgtctgctgtggtgaagaaggtggccgaccggctgacagagaccatggaggatggcaagaccatggactatgcagaggtgagcaacacctttgtgcggctggccgacacccactttgtgcagcgctgccccagcgtgcccaccacagaaaattctgaccccggccccccacctccagcccccaccctggtgatcaatgagaaggacatgtacctggtgcccaagctgagcctcatcggcaagggcaagagaagaagaagcagtgatgaagatgctgctggggagcccaaggccaagaggcccaagtacaccacagacaacaaggagcccatcccagatgatggcatctactggcaggccaacctggaccgcttccaccagcacttccgggaccaggccatcgtgtctgctgtggccaacaggatggaccagaccagcagcgagatcgtgaggaccatgctgaggatgtctgagatcaccaccagcagcagcgcccccttcacccagcccctgagcagcaatgagatcttccgcagcctgcctgtgggctacaacatcagcaagcaggtgctggaccagtacctgaccctgctggctgatgaccccctggagtttgtgggcaagagcggggacagcggcggcggcatgtatgtgatcaacctgcacaaggccctggccagcctggccacagccaccctggagagcgtggtgcaggagcgcttcggcagccgctgtgcccgcatcttccggctggtgctgcagaagaagcacatcgagcagaagcaggtggaggactttgccatgatcccagccaaggaggccaaggacatgctgtacaagatgctgtctgagaacttcatgagcctgcaggtgggctgccagtag

SEQ ID NO: 16497 - DNA, 1197 bp, Artificial Sequence
  Description of Artificial Sequence: Synthetic coding sequence
atgtctgagggcaatgctgctggggagcccagcaccccaggcggcccccggcccctgctgactggagcccggggcctgattggaagaagacctgccccacccctgaccccaggccgcctgcccagcatccgcagccgggacctgaccctgggcggcgtgaagaagaagaccttcacccccaacatcatcagcaggaagatcaaggaggagcccaaggaggaggtgacagtgaagaaggagaagcgggagcgggaccgggaccggcagcgggagggccacggccggggccggggccggcctgaggtgatccagagccacagcatctttgagcagggccctgctgagatgatgaagaagaagggcaactgggacaagacagtggatgtgtctgacatgggccccagccacatcatcaacatcaagaaggagaagcgggagacagatgaggagaccaagcagatcctgaggatgctggagaaggatgacttcctggatgatcctggcctgagaaatgacaccaggaacatgcctgtgcagctgcccctggcccacagcggctggctgttcaaggaggagaatgatgagccagatgtgaagccctggctggccggccccaaggaggaggacatggaggtggacatcccagctgtgaaggtgaaggaggagcccagagatgaggaggaggaggccaagatgaaggccccacccaaggccgccaggaagaccccaggcctgcccaaggatgtgtctgtggccgagctgctgcgggagctgagcctgaccaaggaggaggagctgctcttcctgcagctgcctgacaccctgcccggccagccccccacccaggacatcaagcccatcaagacagaggtgcagggagaagatggccaggtggtgctgatcaagcaggagaaggaccgggaggccaagctggctgaaaatgcctgcaccctggccgacctgacagagggccaggtgggcaagctgctgatcaggaagagcggccgggtgcagctgctgctgggcaaggtgaccctggatgtgaccatgggcacagcctgcagcttcctgcaggagctggtgtctgtgggcctgggggacagcaggactggagagatgacagtgctgggccacgtgaagcacaagctggtgtgcagcccagactttgagagcctgctggaccacaagcacaggtag

SEQ ID NO: 16498 - DNA, 1197 bp, Artificial Sequence; identical to SEQ ID NO: 16497
  Description of Artificial Sequence: Synthetic coding sequence

SEQ ID NO: 16499 - DNA, 2127 bp, Artificial Sequence
  Description of Artificial Sequence: Synthetic coding sequence
atggccaatgaagaagatgatcctgtggtgcaggagattgatgtgtacctggccaagagcctggccgagaagctgtacctgttccagtaccctgtgcggcctgcctccatgacctatgatgacatcccccacctgagcgccaagatcaagcccaagcagcagaaggtggagctggagatggccatcgacaccctgaaccccaactactgccgcagcaaaggagagcagatcgccctgaatgtggatggagcctgtgctgatgagaccagcacctacagcagcaagctgatggacaagcagaccttctgcagcagccagaccaccagcaacaccagccgctatgctgctgccctgtaccggcagggcgagctgcacctgacccccctgcacggcatcctgcagctgcggcccagcttctcctacctggacaaggcagatgccaagcaccgggagcgggaggccgccaatgaggccggggacagcagccaggatgaagcagaagatgatgtgaagcagatcaccgtgcgcttcagcaggcctgagagcgagcaggcccggcagaggagagtgcagagctatgagttcctgcagaagaagcatgctgaggagccctgggtgcacctgcactactacggcctgcgggacagccgctctgagcacgagcggcagtacctgctgtgccccggcagcagtggagtggagaacacagagctggtgaagagccccagcgagtacctgatgatgctgatgccacccagccaggaggaggagaaggacaagcctgtggcccccagcaatgtgctgtccatggcccagctgcggaccctgcccctggccgaccagatcaagatcctgatgaagaatgtgaaggtgatgccctttgccaacctgatgagcctgctgggccccagcattgattctgtggccgtgctgcggggcatccagaaggtggccatgctggtgcagggcaactgggtggtgaagagtgacatcctgtaccccaaggacagcagcagcccccacagcggcgtgcctgctgaggtgctgtgccggggccgggactttgtgatgtggaagttcacccagagccgctgggtggtgaggaaggaggtggccaccgtgaccaagctgtgtgccgaggatgtgaaggacttcctggagcacatggctgtggtgcgcatcaacaagggctgggagttcatcctgccctatgatggagagttcatcaagaagcacccagatgtggtgcagaggcagcacatgctgtggacaggcatccaggccaagctggagaaggtgtacaacctggtgaaggagaccatgcccaagaagccagatgcccagagcggccctgctggcctggtgtgtggggaccagaggatccaggtggccaagaccaaggcccagcagaaccacgccctgctggagcgggagctgcagaggaggaaggagcagctgcgggtgcctgctgtgcccccaggagtgcgcatcaaggaggagcctgtgtctgaggagggggaggaggatgaggagcaggaggccgaggaggagcccatggacaccagccccagcggcctgcacagcaagctggccaacggcctgcccctgggccgggccgccggcacagacagcttcaacggccaccccccccagggctgtgccagcacccctgtggcccgggagctgaaggcctttgtggaggccaccttccagaggcagtttgtgctgaccctgtctgagctgaagaggctcttcaacctgcacctggccagcctgcccccaggccacaccctcttcagcggcatcagtgacaggatgctgcaggacacagtgctggccgccggctgcaagcagatcctggtgcccttccccccccagacagctgccagcccagatgagcagaaggtgtttgccctgtgggagagcggggacatgtctgaccagcaccggcaggtgctgctggagatcttcagcaagaactacagagtgagaagaaacatgatccagagccggctgacccaggagtgtggggaggacctgagcaagcaggaggtggacaaggtgctgaaggactgctgcgtgtcctatggaggcatgtggtacctgaagggcaccgtgcagagctag

SEQ ID NO: 16500 - DNA, 2001 bp, Artificial Sequence
  Description of Artificial Sequence: Synthetic coding sequence
atggccaatgaagaagatgatcctgtggtgcaggagattgatgtgtacctggccaagagcctggccgagaagctgtacctgttccagtaccctgtgcggcctgcctccatgacctatgatgacatcccccacctgagcgccaagatcaagcccaagcagcagaaggtggagctggagatggccatcgacaccctgaaccccaactactgccgcagcaaaggagagcagatcgccctgaatgtggatggagcctgtgctgatgagaccagcacctacagcagcaagctgatggacaagcagaccttctgcagcagccagaccaccagcaacaccagccgctatgctgctgccctgtaccggcagggcgagctgcacctgacccccctgcacggcatcctgcagctgcggcccagcttctcctacctggacaaggcagatgccaagcaccgggagcgggaggccgccaatgaggccggggacagcagccaggatgaagcagaagatgatgtgaagcagatcaccgtgcgcttcagcaggcctgagagcgagcaggcccggcagaggagagtgcagagctatgagttcctgcagaagaagcatgctgaggagccctgggtgcacctgcactactacggcctgcgggacagccgctctgagcacgagcggcagtacctgctgtgccccggcagcagtggagtggagaacacagagctggtgaagagccccagcgagtacctgatgatgctgatgccacccagccaggaggaggagaaggacaagcctgtggcccccagcaatgtgctgtccatggcccagctgcggaccctgcccctggccgaccagatcaagatcctgatgaagaatgtgaaggtgatgccctttgccaacctgatgagcctgctgggccccagcattgattctgtggccgtgctgcggggcatccagaaggtggccatgctggtgcagggcaactgggtggtgaagagtgacatcctgtaccccaaggacagcagcagcccccacagcggcgtgcctgctgaggtgctgtgccggggccgggactttgtgatgtggaagttcacccagagccgctgggtggtgaggaaggaggtggccaccgtgaccaagctgtgtgccgaggatgtgaaggacttcctggagcacatggctgtggtgcgcatcaacaagggctgggagttcatcctgccctatgatggagagttcatcaagaagcacccagatgtggtgcagaggcagcacatgctgtggacaggcatccaggccaagctggagaaggtgtacaacctggtgaaggagaccatgcccaagaagccagatgcccagagcggccctgctggcctggtgtgtggggaccagaggatccaggtggccaagaccaaggcccagcagaaccacgccctgctggagcgggagctgcagaggaggaaggagcagctgcgggtgcctgctgtgcccccaggagtgcgcatcaaggaggagcctgtgtctgaggagggggaggaggatgaggagcaggaggccgaggaggagcccatggacaccagccccagcggcctgcacagcaagctggccaacggcctgcccctgggccgggccgccggcacagacagcttcaacggccaccccccccagggctgtgccagcacccctgtggcccgggagctgaaggcctttgtggaggccaccttccagaggcagtttgtgctgaccctgtctgagctgaagaggctcttcaacctgcacctggccagcctgcccccaggccacaccctcttcagcggcatcagtgacaggatgctgcaggacacagtgctggccgccggctgcaagcagatcctggtgcccttccccccccagacagctgccagcccagatgagcagaaggtgtttgccctgtgggagagcggggacatgtctgaccaggactgctgcgtgtcctatggaggcatgtggtacctgaagggcaccgtgcagagctag

SEQ ID NO: 16501 - DNA, 2019 bp, Artificial Sequence
  Description of Artificial Sequence: Synthetic coding sequence
atggccaatgaagaagatgatcctgtggtgcaggagatcaagcccaagcagcagaaggtggagctggagatggccatcgacaccctgaaccccaactactgccgcagcaaaggagagcagatcgccctgaatgtggatggagcctgtgctgatgagaccagcacctacagcagcaagctgatggacaagcagaccttctgcagcagccagaccaccagcaacaccagccgctatgctgctgccctgtaccggcagggcgagctgcacctgacccccctgcacggcatcctgcagctgcggcccagcttctcctacctggacaaggcagatgccaagcaccgggagcgggaggccgccaatgaggccggggacagcagccaggatgaagcagaagatgatgtgaagcagatcaccgtgcgcttcagcaggcctgagagcgagcaggcccggcagaggagagtgcagagctatgagttcctgcagaagaagcatgctgaggagccctgggtgcacctgcactactacggcctgcgggacagccgctctgagcacgagcggcagtacctgctgtgccccggcagcagtggagtggagaacacagagctggtgaagagccccagcgagtacctgatgatgctgatgccacccagccaggaggaggagaaggacaagcctgtggcccccagcaatgtgctgtccatggcccagctgcggaccctgcccctggccgaccagatcaagatcctgatgaagaatgtgaaggtgatgccctttgccaacctgatgagcctgctgggccccagcattgattctgtggccgtgctgcggggcatccagaaggtggccatgctggtgcagggcaactgggtggtgaagagtgacatcctgtaccccaaggacagcagcagcccccacagcggcgtgcctgctgaggtgctgtgccggggccgggactttgtgatgtggaagttcacccagagccgctgggtggtgaggaaggaggtggccaccgtgaccaagctgtgtgccgaggatgtgaaggacttcctggagcacatggctgtggtgcgcatcaacaagggctgggagttcatcctgccctatgatggagagttcatcaagaagcacccagatgtggtgcagaggcagcacatgctgtggacaggcatccaggccaagctggagaaggtgtacaacctggtgaaggagaccatgcccaagaagccagatgcccagagcggccctgctggcctggtgtgtggggaccagaggatccaggtggccaagaccaaggcccagcagaaccacgccctgctggagcgggagctgcagaggaggaaggagcagctgcgggtgcctgctgtgcccccaggagtgcgcatcaaggaggagcctgtgtctgaggagggggaggaggatgaggagcaggaggccgaggaggagcccatggacaccagccccagcggcctgcacagcaagctggccaacggcctgcccctgggccgggccgccggcacagacagcttcaacggccaccccccccagggctgtgccagcacccctgtggcccgggagctgaaggcctttgtggaggccaccttccagaggcagtttgtgctgaccctgtctgagctgaagaggctcttcaacctgcacctggccagcctgcccccaggccacaccctcttcagcggcatcagtgacaggatgctgcaggacacagtgctggccgccggctgcaagcagatcctggtgcccttccccccccagacagctgccagcccagatgagcagaaggtgtttgccctgtgggagagcggggacatgtctgaccagcaccggcaggtgctgctggagatcttcagcaagaactacagagtgagaagaaacatgatccagagccggctgacccaggagtgtggggaggacctgagcaagcaggaggtggacaaggtgctgaaggactgctgcgtgtcctatggaggcatgtggtacctgaagggcaccgtgcagagctag

SEQ ID NO: 16502 - DNA, 2064 bp, Artificial Sequence
  Description of Artificial Sequence: Synthetic coding sequence
atggccaatgaagaagatgatcctgtggtgcaggagattgatgtgtacctggccaagagcctggccgagaagctgtacctgttccagtaccctgtgcggcctgcctccatgacctatgatgacatcccccacctgagcgccaagatcaagcccaagcagcagaaggtggagctggagatggccatcgacaccctgaaccccaactactgccgcagcaaaggagagcagatcgccctgaatgtggatggagcctgtgctgatgagaccagcacctacagcagcaagctgatggacaagcagaccttctgcagcagccagaccaccagcaacaccagccgctatgctgctgccctgtaccggcagggcgagctgcacctgacccccctgcacggcatcctgcagctgcggcccagcttctcctacctggacaaggcagatgccaagcaccgggagcgggaggccgccaatgaggccggggacagcagccaggatgaagcagaagatgatgtgaagcagatcaccgtgcgcttcagcaggcctgagagcgagcaggcccggcagaggagagtgcagagctatgagttcctgcagaagaagcatgctgaggagccctgggtgcacctgcactactacggcctgcgggacagccgctctgagcacgagcggcagtacctgctgtgccccggcagcagtggagtggagaacacagagctggtgaagagccccagcgagtacctgatgatgctgatgccacccagccaggaggaggagaaggacaagcctgtggcccccagcaatgtgctgtccatggcccagctgcggaccctgcccctggccgaccagatcaagatcctgatgaagaatgtgaaggtgatgccctttgccaacctgatgagcctgctgggccccagcattgattctgtggccgtgctgcggggcatccagaaggtggccatgctggtgcagggcaactgggtggtgaagagtgacatcctgtaccccaaggacagcagcagcccccacagcggcgtgcctgctgaggtgctgtgccggggccgggactttgtgatgtggaagttcacccagagccgctgggtggtgaggaaggaggtggccaccgtgaccaagctgtgtgccgaggatgtgaaggacttcctggagcacatggctgtggtgcgcatcaacaagggctgggagttcatcctgccctatgatggagagttcatcaagaagcacccagatgtggtgcagaggcagcacatgctgtggacaggcatccaggccaagctggagaaggtgtacaacctggtgaaggagaccatgcccaagaagccagatgcccagagcggccctgctggcctggtgtgtggggaccagaggatccaggtggccaagaccaaggcccagcagaaccacgccctgctggagcgggagctgcagaggaggaaggagcagctgcgggtgcctgctgtgcccccaggagtgcgcatcaaggaggagcctgtgtctgaggagggggaggaggatgaggagcaggaggccgaggaggagcccatggacaccagccccagcggcctgcacagcaagctggccaacggcctgcccctgggccgggccgccggcacagacagcttcaacggccaccccccccagggctgtgccagcacccctgtggcccgggagctgaaggcctttgtggaggccaccttccagaggcagtttgtgctgaccctgtctgagctgaagaggctcttcaacctgcacctggccagcctgcccccaggccacaccctcttcagcggcatcagtgacaggatgctgcaggacacagtgctggccgccggctgcaagcagatcctggtgcccttccccccccagacagctgccagcccagatgagcagaaggtgtttgccctgtgggagagcggggacatgtctgaccagagccggctgacccaggagtgtggggaggacctgagcaagcaggaggtggacaaggtgctgaaggactgctgcgtgtcctatggaggcatgtggtacctgaagggcaccgtgcagagctag

SEQ ID NO: 16503 - DNA, 951 bp, Artificial Sequence
  Description of Artificial Sequence: Synthetic coding sequence
atggccgaggtgaaggtgaaggtgcagcccccagatgctgaccctgtggagattgaaaatcgcatcatcgagctgtgccaccagttcccccacggcatcacagaccaggtgatccagaatgagatgccccacatcgaggcccagcagagagctgtggccatcaaccggctgctgtccatgggccagctggacctgctgcggagcaacacaggcctgctgtaccgcatcaaggacagccagaatgctgggaagatgaagggcagtgacaaccaggagaagctggtgtaccagatcattgaagatgctggcaacaagggcatctggagccgggacatccgctacaagagcaacctgcccctgacagagatcaacaagatcctgaagaacctggagagcaagaagctgatcaaggctgtgaagtctgtggccgccagcaagaagaaggtgtacatgctgtacaacctgcagcctgacagatctgtgactggaggagcctggtacagcgaccaggactttgagagcgagtttgtggaggtgctgaaccagcagtgcttcaagttcctgcagagcaaggccgagacagcccgggagagcaagcagaaccccatgatccagaggaacagcagctttgccagcagccatgaggtgtggaagtacatctgtgagctgggcatcagcaaggtggagctgtccatggaggacatcgagaccatcctgaacaccctcatctatgatggcaaggtggagatgaccatcatcgccgccaaggagggcaccgtgggctctgtggatggccacatgaagctgtacagagctgtgaaccccatcatcccccccaccggcctggtgcgggccccctgtggcctgtgccctgtgtttgatgactgccatgaaggaggagagatcagccccagcaactgcatctacatgacagagtggctggagttctag

SEQ ID NO: 16504 - DNA, 672 bp, Artificial Sequence
  Description of Artificial Sequence: Synthetic coding sequence
atggccggcaacaagggccggggccgggccgcctacaccttcaacatcgaggccgtgggcttcagcaaaggagagaagctgcctgatgtggtgctgaagcccccacccctcttcccagacacagactacaagcctgtgcccctgaagacaggagagggggaggagtacatgctggccctgaagcaggagctgcgggagaccatgaagaggatgccctacttcatcgagaccccagaggagcggcaggacatcgagcgctacagcaagcgctacatgaaggtgtacaaggaggagtggatcccagactggaggcggctgccccgggagatgatgcccaggaacaagtgcaagaaggccggccccaagcccaagaaggccaaggatgctgggaagggcacccccctgaccaacacagaagatgtgctgaagaagatggaggagctggagaagagaggagatggagagaagagtgatgaggagaatgaggagaaggagggcagcaaggagaagagcaaggagggagatgatgatgatgatgatgatgctgctgagcaggaggagtatgatgaggaggagcaggaggaggagaatgactacatcaacagctactttgaagatggagatgactttggagctgacagtgatgacaacatggatgaggccacctactag

SEQ ID NO: 16505 - DNA, 672 bp, Artificial Sequence; identical to SEQ ID NO: 16504
  Description of Artificial Sequence: Synthetic coding sequence

SEQ ID NO: 16506 - DNA, 528 bp, Artificial Sequence
  Description of Artificial Sequence: Synthetic coding sequence
atgtttgtgctggtggagatggtggacacagtgcgcatccccccctggcagtttgagaggaagctgaatgacagcattgctgaggagctgaacaagaagctggccaacaaggtggtgtacaacgtgggcctgtgcatctgcctgtttgacatcaccaagctggaggatgcctacgtgtttcctggagatggagccagccacaccaaggtgtccctgggcttctttgatgacatcctgatccccccagagagcctgcagcagcctgccaagtttgatgaggccgagcaggtgtgggtgtgggagtatgaaacagaggagggcgcccatgacctgtacatggacacaggagaggagatccgcttccgggtggtggatgagagctttgtggacaccagccccaccggccccagcagcgcagatgccaccaccagcagcgaggagctgcccaagaaggaggccccctacaccctggtgggcagcatcagcgagcccggcctgggcctgctgtcctggtggaccagcaactag

SEQ ID NO: 16507 - DNA, 615 bp, Artificial Sequence
  Description of Artificial Sequence: Synthetic coding sequence
atgtttgtgctggtggagatggtggacacagtgcgcatccccccctggcagtttgagaggaagctgaatgacagcattgctgaggagctgaacaagaagctggccaacaaggtggtgtacaacgtgggcctgtgcatctgcctgtttgacatcaccaagctggaggatgcctacgtgtttcctggagatggagccagccacaccaaggtgcacttccgctgtgtggtgttccaccccttcctggatgagatcctgattggcaagatcaagggctgcagccctgagggcgtgcacgtgtccctgggcttctttgatgacatcctgatccccccagagagcctgcagcagcctgccaagtttgatgaagctgagcaggtgtgggtgtgggagtatgaaacagaggagggcgcccatgacctgtacatggacaccggggaggagatccgcttccgggtggtggatgagagctttgtggacaccagccccaccggccccagcagcgcagatgccaccaccagcagcgaggagctgcccaagaaggaggccccctacaccctggtgggcagcatcagcgagcccggcctgggcctgctgtcctggtggaccagcaactag

SEQ ID NO: 16508 - DNA, 615 bp, Artificial Sequence; identical to SEQ ID NO: 16507
  Description of Artificial Sequence: Synthetic coding sequence

SEQ ID NO: 16509 - DNA, 615 bp, Artificial Sequence; identical to SEQ ID NO: 16507
  Description of Artificial Sequence: Synthetic coding sequence

SEQ ID NO: 16510 - DNA, 327 bp, Artificial Sequence
  Description of Artificial Sequence: Synthetic coding sequence
atgctgctcttctgccccggctgtggaaatggcctgattgtggaggagggccagcgctgccaccgcttcagctgcaacacctgcccctacgtgcacaacatcaccaggaaggtgaccaacaggaagtaccccaagctgaaggaggtggatgatgtgctgggcggcgctgctgcctgggagaatgtggacagcacagctgagagctgccccaagtgtgagcacccccgggcctacttcatgcagctgcagaccaggtctgcagatgagcccatgaccaccttctacaagtgctgcaatgcccagtgtggccaccgctggagggactag

SEQ ID NO: 16511 - DNA, 771 bp, Artificial Sequence
  Description of Artificial Sequence: Synthetic coding sequence
atgagcaggaagaagacccccaagagcaagggggccagcaccccagctgccagcaccctgcccacagccaacggggcccggcctgcccggtctggaacagccctgagcggcccagatgcccccccaaatggccccctgcagcccggccggcccagcctgggcggcggcgtggacttctatgatgtggccttcaaggtgatgctggtgggggacagcggcgtgggcaagacctgcctgctggtgcgcttcaaggatggagccttcctggccggcaccttcatcagcacagtgggcatcgacttcaggaacaaggtgctggatgtggatggagtgaaggtgaagctgcagatgtgggacacagctggccaggagcgcttccgctctgtgacccacgcctactacagagatgcccacgccctgctgctgctgtatgatgtgaccaacaaggccagctttgacaacatccaggcctggctgacagagatccatgaatatgcccagcatgatgtggccctgatgctgctgggcaacaaggtggacagcgcccacgagcgggtggtgaagcgggaggatggagagaagctggccaaggagtatggcctgcccttcatggagaccagcgccaagacaggcctgaatgtggacctggccttcaccgccatcgccaaggagctgaagcagaggtccatgaaggcccccagcgagccccgcttccggctgcatgactatgtgaagcgggagggccgcggggccagctgctgccggccctag

SEQ ID NO: 16512 - DNA, 1668 bp, Artificial Sequence
  Description of Artificial Sequence: Synthetic coding sequence
atggatggagtggtgacagacctgatcaccgtgggcctgaagaggggcagtgatgagctgctgagcagcggcatcatcaatggccccttcaccatgaacagcagcacccccagcactggagtgtatgccaatggaaatgacagcaagaagttcaagagggaccggcccccctgcagccccagccgggtgctgcacctgaggaagatcccctgtgatgtgacagaggccgagatcatcagcctgggcctgccctttgggaaggtgaccaacctgctgatgctgaagggcaagagccaggccttcctggagatggccagcgaggaggccgctgtgaccatggtgaactactacacccccatcaccccccacctgcggagccagcctgtgtacatccagtacagcaaccaccgggagctgaagacagacaacctgcccaaccaggcccgggcccaggccgccctgcaggccgtgtctgctgtgcagagcggcagcctggccctgagcggcggccccagcaatgaaggcaccgtgctgcccggccagagccctgtgctgcgcatcatcatcgagaacctcttctaccctgtgaccctggaggtgctgcaccagatcttcagcaagtttggcaccgtgctgaagatcatcaccttcaccaagaacaaccagttccaggccctgctgcagtatgctgaccctgtgaatgcccactacgccaagatggccctggatggccagaacatctacaatgcctgctgcaccctgagaattgacttcagcaagctgaccagcctgaatgtgaagtacaacaatgacaagagccgggacttcacccggctggacctgcccactggagatggccagcccagcctggagccccccatggccgccgccttcggggcccctggcatcatcagcagcccctatgctggggccgccggctttgccccagccatcggcttcccccaggccaccggcctgtctgtgcctgctgtgcctggggccctgggccccctgaccatcaccagcagcgctgtgacaggccgcatggccatccctggggccagcggcatccctggcaacagcgtgctgctggtgaccaacctgaacccagacctgatcaccccccacggcctcttcatcctgtttggagtgtatggagatgtgcaccgggtgaagatcatgttcaacaagaaggaaaatgccctggtgcagatggctgatgccaaccaggcccagctggccatgaaccacctgagcggccagaggctgtatggcaaggtgctgcgggccaccctgagcaagcaccaggccgtgcagctgccccgggagggccaggaggaccagggcctgaccaaggacttcagcaacagccccctgcaccgcttcaagaagccaggcagcaagaacttccagaacatcttccccccatctgccaccctgcacctgagcaacatcccccccagcgtgacagtggatgacctgaagaacctcttcattgaagctggctgcagcgtgaaggccttcaagttcttccagaaggacaggaagatggccctgatccagctgggctctgtggaggaggccatccaggccctgattgagctgcacaaccacgacctgggggagaaccaccacctgcgggtgtccttcagcaagagcaccatctag

SEQ ID NO: 16513 - DNA, 1374 bp, Artificial Sequence
  Description of Artificial Sequence: Synthetic coding sequence
atggccttcctggagatggccagcgaggaggccgctgtgaccatggtgaactactacacccccatcaccccccacctgcggagccagcctgtgtacatccagtacagcaaccaccgggagctgaagacagacaacctgcccaaccaggcccgggcccaggccgccctgcaggccgtgtctgctgtgcagagcggcagcctggccctgagcggcggccccagcaatgaaggcaccgtgctgcccggccagagccctgtgctgcgcatcatcatcgagaacctcttctaccctgtgaccctggaggtgctgcaccagatcttcagcaagtttggcaccgtgctgaagatcatcaccttcaccaagaacaaccagttccaggccctgctgcagtatgctgaccctgtgaatgcccactacgccaagatggccctggatggccagaacatctacaatgcctgctgcaccctgagaattgacttcagcaagctgaccagcctgaatgtgaagtacaacaatgacaagagccgggacttcacccggctggacctgcccactggagatggccagcccagcctggagccccccatggccgccgccttcggggcccctggcatcatcagcagcccctatgctggggccgccggctttgccccagccatcggcttcccccaggccaccggcctgtctgtgcctgctgtgcctggggccctgggccccctgaccatcaccagcagcgctgtgacaggccgcatggccatccctggggccagcggcatccctggcaacagcgtgctgctggtgaccaacctgaacccagacctgatcaccccccacggcctcttcatcctgtttggagtgtatggagatgtgcaccgggtgaagatcatgttcaacaagaaggaaaatgccctggtgcagatggctgatgccaaccaggcccagctggccatgaaccacctgagcggccagaggctgtatggcaaggtgctgcgggccaccctgagcaagcaccaggccgtgcagctgccccgggagggccaggaggaccagggcctgaccaaggacttcagcaacagccccctgcaccgcttcaagaagccaggcagcaagaacttccagaacatcttccccccatctgccaccctgcacctgagcaacatcccccccagcgtgacagtggatgacctgaagaacctcttcattgaagctggctgcagcgtgaaggccttcaagttcttccagaaggacaggaagatggccctgatccagctgggctctgtggaggaggccatccaggccctgattgagctgcacaaccacgacctgggggagaaccaccacctgcgggtgtccttcagcaagagcaccatctag

SEQ ID NO: 16514 - DNA, 1659 bp, Artificial Sequence
  Description of Artificial Sequence: Synthetic coding sequence
atggatggagtggtgacagacctgatcaccgtgggcctgaagaggggcagtgatgagctgctgagcagcggcatcatcaatggccccttcaccatgaacagcagcacccccagcacagccaatggaaatgacagcaagaagttcaagagggacaggcctccctgcagccccagccgggtgctgcacctgaggaagatcccctgtgatgtgacagaagctgagatcatcagcctgggcctgccctttgggaaggtgaccaacctgctgatgctgaagggcaagagccaggccttcctggagatggccagcgaggaggccgctgtgaccatggtgaactactacacccccatcaccccccacctgcggagccagcctgtgtacatccagtacagcaaccaccgggagctgaagacagacaacctgcccaaccaggcccgggcccaggccgccctgcaggccgtgtctgctgtgcagagcggcagcctggccctgagcggcggccccagcaatgaaggaacagtgctgcccggccagagccctgtgctgcgcatcatcattgaaaatctcttctaccctgtgaccctggaggtgctgcaccagatcttcagcaagtttggaacagtgctgaagatcatcaccttcaccaagaacaaccagttccaggccctgctgcagtatgctgaccctgtgaatgcccactacgccaagatggccctggatggccagaacatctacaatgcctgctgcaccctgagaattgacttcagcaagctgaccagcctgaatgtgaagtacaacaatgacaagagccgggacttcacccggctggacctgcccactggagatggccagcccagcctggagccccccatggctgctgcctttggagcccctggcatcatcagcagcccctatgctggagctgctggctttgccccagccatcggcttcccccaggccaccggcctgtctgtgcctgctgtgcctggggccctgggccccctgaccatcaccagcagcgctgtgactggaaggatggccatccctggggccagcggcatccctggcaacagcgtgctgctggtgaccaacctgaacccagacctgatcacccctcatggcctcttcatcctgtttggagtgtatggagatgtgcaccgggtgaagatcatgttcaacaagaaggaaaatgccctggtgcagatggctgatgccaaccaggcccagctggccatgaaccacctgagcggccagaggctgtatggcaaggtgctgcgggccaccctgagcaagcaccaggccgtgcagctgccccgggagggccaggaggaccagggcctgaccaaggacttcagcaacagccccctgcaccgcttcaagaagccaggcagcaagaacttccagaacatcttcccccccagcgccaccctgcacctgagcaacatccccccatctgtgacagtggatgacctgaagaacctcttcatcgaggccggctgcagcgtgaaggccttcaagttcttccagaaggacaggaagatggccctgatccagctgggctctgtggaggaggccatccaggccctgattgagctgcacaaccacgacctgggggagaaccaccacctgcgggtgtccttcagcaagagcaccatctag

SEQ ID NO: 16515 - DNA, 1575 bp, Artificial Sequence
  Description of Artificial Sequence: Synthetic coding sequence
atgaacagcagcacccccagcactggagtgtatgccaatggaaatgacagcaagaagttcaagagggacaggcctccctgcagccccagccgggtgctgcacctgaggaagatcccctgtgatgtgacagaagctgagatcatcagcctgggcctgccctttgggaaggtgaccaacctgctgatgctgaagggcaagagccaggccttcctggagatggccagcgaggaggccgctgtgaccatggtgaactactacacccccatcaccccccacctgcggagccagcctgtgtacatccagtacagcaaccaccgggagctgaagacagacaacctgcccaaccaggcccgggcccaggccgccctgcaggccgtgtctgctgtgcagagcggcagcctggccctgagcggcggccccagcaatgaaggaacagtgctgcccggccagagccctgtgctgcgcatcatcattgaaaatctcttctaccctgtgaccctggaggtgctgcaccagatcttcagcaagtttggaacagtgctgaagatcatcaccttcaccaagaacaaccagttccaggccctgctgcagtatgctgaccctgtgaatgcccactacgccaagatggccctggatggccagaacatctacaatgcctgctgcaccctgagaattgacttcagcaagctgaccagcctgaatgtgaagtacaacaatgacaagagccgggacttcacccggctggacctgcccactggagatggccagcccagcctggagccccccatggctgctgcctttggagcccctggcatcatcagcagcccctatgctggagctgctggctttgccccagccatcggcttcccccaggccaccggcctgtctgtgcctgctgtgcctggggccctgggccccctgaccatcaccagcagcgctgtgactggaaggatggccatccctggggccagcggcatccctggcaacagcgtgctgctggtgaccaacctgaacccagacctgatcacccctcatggcctcttcatcctgtttggagtgtatggagatgtgcaccgggtgaagatcatgttcaacaagaaggaaaatgccctggtgcagatggctgatgccaaccaggcccagctggccatgaaccacctgagcggccagaggctgtatggcaaggtgctgcgggccaccctgagcaagcaccaggccgtgcagctgccccgggagggccaggaggaccagggcctgaccaaggacttcagcaacagccccctgcaccgcttcaagaagccaggcagcaagaacttccagaacatcttcccccccagcgccaccctgcacctgagcaacatccccccatctgtgacagtggatgacctgaagaacctcttcatcgaggccggctgcagcgtgaaggccttcaagttcttccagaaggacaggaagatggccctgatccagctgggctctgtggaggaggccatccaggccctgattgagctgcacaaccacgacctgggggagaaccaccacctgcgggtgtccttcagcaagagcaccatctag

SEQ ID NO: 16516 - DNA, 234 bp, Artificial Sequence
  Description of Artificial Sequence: Synthetic coding sequence
atggatggagtggtgacagacctgatcaccgtgggcctgaagaggggcagtgatgagctgctgagcagcggcatcatcaatggccccttcaccatgaacagcagcacccccagcactggagtgtatgccaatggaaatgacagcaagaagttcaagagggaccggcccccctgcagccccagccgggtgctgcacctgaggaagatcccctgtgatgtgacagaggccgagtag

SEQ ID NO: 16517 - DNA, 1677 bp, Artificial Sequence
  Description of Artificial Sequence: Synthetic coding sequence
atggatgccagccccagccccttcagcctgcccaagaagctgaatgagctgagcgcccggcggggcagtgatgagctgctgagcagcggcatcatcaatggccccttcaccatgaacagcagcacccccagcacagccaatggaaatgacagcaagaagttcaagagggacaggcctccctgcagccccagccgggtgctgcacctgaggaagatcccctgtgatgtgacagaagctgagatcatcagcctgggcctgccctttgggaaggtgaccaacctgctgatgctgaagggcaagagccaggccttcctggagatggccagcgaggaggccgctgtgaccatggtgaactactacacccccatcaccccccacctgcggagccagcctgtgtacatccagtacagcaaccaccgggagctgaagacagacaacctgcccaaccaggcccgggcccaggccgccctgcaggccgtgtctgctgtgcagagcggcagcctggccctgagcggcggccccagcaatgaaggaacagtgctgcccggccagagccctgtgctgcgcatcatcattgaaaatctcttctaccctgtgaccctggaggtgctgcaccagatcttcagcaagtttggaacagtgctgaagatcatcaccttcaccaagaacaaccagttccaggccctgctgcagtatgctgaccctgtgaatgcccactacgccaagatggccctggatggccagaacatctacaatgcctgctgcaccctgagaattgacttcagcaagctgaccagcctgaatgtgaagtacaacaatgacaagagccgggacttcacccggctggacctgcccactggagatggccagcccagcctggagccccccatggctgctgcctttggagcccctggcatcatcagcagcccctatgctggagctgctggctttgccccagccatcggcttcccccaggccaccggcctgtctgtgcctgctgtgcctggggccctgggccccctgaccatcaccagcagcgctgtgactggaaggatggccatccctggggccagcggcatccctggcaacagcgtgctgctggtgaccaacctgaacccagacctgatcacccctcatggcctcttcatcctgtttggagtgtatggagatgtgcaccgggtgaagatcatgttcaacaagaaggaaaatgccctggtgcagatggctgatgccaaccaggcccagctggccatgaaccacctgagcggccagaggctgtatggcaaggtgctgcgggccaccctgagcaagcaccaggccgtgcagctgccccgggagggccaggaggaccagggcctgaccaaggacttcagcaacagccccctgcaccgcttcaagaagccaggcagcaagaacttccagaacatcttcccccccagcgccaccctgcacctgagcaacatccccccatctgtgacagtggatgacctgaagaacctcttcatcgaggccggctgcagcgtgaaggccttcaagttcttccagaaggacaggaagatggccctgatccagctgggctctgtggaggaggccatccaggccctgattgagctgcacaaccacgacctgggggagaaccaccacctgcgggtgtccttcagcaagagcaccatctag

SEQ ID NO: 16518 - DNA, 1500 bp, Artificial Sequence
  Description of Artificial Sequence: Synthetic coding sequence
atggagaatggccagagcacagctgccaagctgggcctgccccccctgaccccagagcagcaggaggccctgcagaaggccaagaagtatgccatggagcagagcatcaagtctgtgctggtgaagcagaccatcgcccaccagcagcagcagctgaccaacctgcagatggccgcccagaggcagagggccctggccatcatgtgccgggtgtatgtgggcagcatctactatgagctgggggaggacaccatccggcaggcctttgcccccttcggccccatcaagagcattgacatgtcctgggacagcgtgaccatgaagcacaagggctttgcctttgtggagtatgaggtgcctgaggccgcccagctggccctggagcagatgaacagcgtgatgctgggcggcaggaacatcaaggtgggccggcccagcaacatcggccaggcccagcccatcatcgaccagctggccgaggaggcccgggccttcaaccgcatctacgtggcctctgtgcaccaggacctgagtgatgatgacatcaagtctgtgtttgaggccttcggcaagatcaagagctgcaccctggcccgggaccccaccaccgggaagcacaagggctacggcttcatcgagtatgagaaggcccagagcagccaggatgctgtgtcctccatgaacctgtttgacctgggcggccagtacctgcgggtgggcaaggctgtgaccccacccatgcccctgctgaccccagccaccccaggcggcctgcccccagctgctgctgtggccgctgctgctgccacagccaagatcacagcccaggaggccgtggccggggctgctgtgctgggcaccctgggcaccccaggcctggtgtccccagccctgaccctggcccagcccctgggcaccctgccccaggccgtgatggccgcccaggcccctggggtcatcactggagtgaccccagcccggccccccatccctgtgaccatccccagcgtgggcgtggtgaaccccatcctggccagcccccccaccctgggcctgctggagcccaagaaggagaaggaggaggaggagctgtttcctgagagcgagaggcctgagatgctgtctgagcaggagcacatgagcatcagcggcagcagcgcccggcacatggtgatgcagaagctgctgaggaagcaggagagcacagtgatggtgctgaggaacatggtggaccccaaggacattgatgatgacctggagggggaggtgacagaggagtgtgggaagtttggagctgtgaacagagtcatcatctaccaggagaagcagggcgaggaggaggatgctgagatcatcgtgaagatctttgtggagttcagcatcgccagcgagacccacaaggccatccaggccctgaatggccgctggtttgctggcaggaaggtggtggccgaggtgtatgaccaggagagatttgacaacagcgacctgagcgcctag

SEQ ID NO: 16519 - DNA, 1629 bp, Artificial Sequence
  Description of Artificial Sequence: Synthetic coding sequence
atggccacagccaccatcgccctgcaggtgaatggccagcagggcggcggcagcgagcctgctgctgctgctgctgtggtggccgccggggacaagtggaagccaccccagggcacagacagcatcaagatggagaatggccagagcacagctgccaagctgggcctgccccccctgaccccagagcagcaggaggccctgcagaaggccaagaagtatgccatggagcagagcatcaagtctgtgctggtgaagcagaccatcgcccaccagcagcagcagctgaccaacctgcagatggccgcccagaggcagagggccctggccatcatgtgccgggtgtatgtgggcagcatctactatgagctgggggaggacaccatccggcaggcctttgcccccttcggccccatcaagagcattgacatgtcctgggacagcgtgaccatgaagcacaagggctttgcctttgtggagtatgaggtgcctgaggccgcccagctggccctggagcagatgaacagcgtgatgctgggcggcaggaacatcaaggtgggccggcccagcaacatcggccaggcccagcccatcatcgaccagctggccgaggaggcccgggccttcaaccgcatctacgtggcctctgtgcaccaggacctgagtgatgatgacatcaagtctgtgtttgaggccttcggcaagatcaagagctgcaccctggcccgggaccccaccaccgggaagcacaagggctacggcttcattgaatatgagaaggcccagagcagccaggatgctgtgtcctccatgaacctgtttgacctgggcggccagtacctgcgggtgggcaaggctgtgaccccacccatgcccctgctgaccccagccacccctgggggcctgcccccagctgctgctgtggccgctgctgctgccacagccaagatcacagcccaggaggccgtggccggggctgctgtgctgggcaccctgggcaccccaggcctggtgtccccagccctgaccctggcccagcccctgggcaccctgccccaggccgtgatggccgcccaggcccctggggtcatcaccggggtgaccccagcccggccccccatccctgtgaccatccccagcgtgggcgtggtgaaccccatcctggccagcccccccaccctgggcctgctggagcccaagaaggagaaggaggaggaggagctgtttcctgagagcgagaggcctgagatgctgtctgagcaggagcacatgagcatcagcggcagcagcgcccggcacatggtgatgcagaagctgctgaggaagcaggagagcacagtgatggtgctgaggaacatggtggaccccaaggacattgatgatgacctggagggggaggtgacagaagaatgtgggaagtttggagctgtgaacagagtcatcatctaccaggagaagcagggcgaggaggaggatgctgagatcatcgtgaagatctttgtggagttcagcatcgccagcgagacccacaaggccatccaggccctgaatggccgctggtttgctggcaggaaggtggtggccgaggtgtatgaccaggagagatttgacaacagcgacctgagcgcctag

SEQ ID NO: 16520 - DNA, 1551 bp, Artificial Sequence
  Description of Artificial Sequence: Synthetic coding sequence
atggagaatggccagagcacagctgccaagctgggcctgccccccctgaccccagagcagcaggaggccctgcagaaggccaagaagtatgccatggagcagagcatcaagtctgtgctggtgaagcagaccatcgcccaccagcagcagcagctgaccaacctgcagatggctgctgtgaccatgggctttggagaccccctgagccccctgcagagcatggccgcccagaggcagagggccctggccatcatgtgccgggtgtatgtgggcagcatctactatgagctgggggaggacaccatccggcaggcctttgcccccttcggccccatcaagagcattgacatgtcctgggacagcgtgaccatgaagcacaagggctttgcctttgtggagtatgaggtgcctgaggccgcccagctggccctggagcagatgaacagcgtgatgctgggcggcaggaacatcaaggtgggccggcccagcaacatcggccaggcccagcccatcatcgaccagctggccgaggaggcccgggccttcaaccgcatctacgtggcctctgtgcaccaggacctgagtgatgatgacatcaagtctgtgtttgaggccttcggcaagatcaagagctgcaccctggcccgggaccccaccaccgggaagcacaagggctacggcttcattgaatatgagaaggcccagagcagccaggatgctgtgtcctccatgaacctgtttgacctgggcggccagtacctgcgggtgggcaaggctgtgaccccacccatgcccctgctgaccccagccacccctgggggcctgcccccagctgctgctgtggccgctgctgctgccacagccaagatcacagcccaggaggccgtggccggggctgctgtgctgggcaccctgggcaccccaggcctggtgtccccagccctgaccctggcccagcccctgggcaccctgccccaggccgtgatggccgcccaggcccctggggtcatcaccggggtgaccccagcccggccccccatccctgtgaccatccccagcgtgggcgtggtgaaccccatcctggccagcccccccaccctgggcctgctggagcccaagaaggagaaggaggaggaggagctgtttcctgagagcgagaggcctgagatgctgtctgagcaggagcacatgagcatcagcggcagcagcgcccggcacatggtgatgcagaagctgctgaggaagcaggagagcacagtgatggtgctgaggaacatggtggaccccaaggacattgatgatgacctggagggggaggtgacagaagaatgtgggaagtttggagctgtgaacagagtcatcatctaccaggagaagcagggcgaggaggaggatgctgagatcatcgtgaagatctttgtggagttcagcatcgccagcgagacccacaaggccatccaggccctgaatggccgctggtttgctggcaggaaggtggtggccgaggtgtatgaccaggagagatttgacaacagcgacctgagcgcctag

SEQ ID NO: 16521 - DNA, 1680 bp, Artificial Sequence
  Description of Artificial Sequence: Synthetic coding sequence
atggccacagccaccatcgccctgcaggtgaatggccagcagggcggcggcagcgagcctgctgctgctgctgctgtggtggccgccggggacaagtggaagccaccccagggcacagacagcatcaagatggagaatggccagagcacagctgccaagctgggcctgccccccctgaccccagagcagcaggaggccctgcagaaggccaagaagtatgccatggagcagagcatcaagtctgtgctggtgaagcagaccatcgcccaccagcagcagcagctgaccaacctgcagatggctgctgtgaccatgggctttggagaccccctgagccccctgcagagcatggccgcccagaggcagagggccctggccatcatgtgccgggtgtatgtgggcagcatctactatgagctgggggaggacaccatccggcaggcctttgcccccttcggccccatcaagagcattgacatgtcctgggacagcgtgaccatgaagcacaagggctttgcctttgtggagtatgaggtgcctgaggccgcccagctggccctggagcagatgaacagcgtgatgctgggcggcaggaacatcaaggtgggccggcccagcaacatcggccaggcccagcccatcatcgaccagctggccgaggaggcccgggccttcaaccgcatctacgtggcctctgtgcaccaggacctgagtgatgatgacatcaagtctgtgtttgaggccttcggcaagatcaagagctgcaccctggcccgggaccccaccaccgggaagcacaagggctacggcttcatcgagtatgagaaggcccagagcagccaggatgctgtgtcctccatgaacctgtttgacctgggcggccagtacctgcgggtgggcaaggctgtgaccccacccatgcccctgctgaccccagccaccccaggcggcctgcccccagctgctgctgtggccgctgctgctgccacagccaagatcacagcccaggaggccgtggccggggctgctgtgctgggcaccctgggcaccccaggcctggtgtccccagccctgaccctggcccagcccctgggcaccctgccccaggccgtgatggccgcccaggcccctggggtcatcactggagtgaccccagcccggccccccatccctgtgaccatccccagcgtgggcgtggtgaaccccatcctggccagcccccccaccctgggcctgctggagcccaagaaggagaaggaggaggaggagctgtttcctgagagcgagaggcctgagatgctgtctgagcaggagcacatgagcatcagcggcagcagcgcccggcacatggtgatgcagaagctgctgaggaagcaggagagcacagtgatggtgctgaggaacatggtggaccccaaggacattgatgatgacctggagggggaggtgacagaggagtgtgggaagtttggagctgtgaacagagtcatcatctaccaggagaagcagggcgaggaggaggatgctgagatcatcgtgaagatctttgtggagttcagcatcgccagcgagacccacaaggccatccaggccctgaatggccgctggtttgctggcaggaaggtggtggccgaggtgtatgaccaggagagatttgacaacagcgacctgagcgcctag

SEQ ID NO: 16522 - DNA, 2232 bp, Artificial Sequence
  Description of Artificial Sequence: Synthetic coding sequence
atgaacaaccccagcgagaccagcaagcccagcatggagagcggagatggcaacacaggcacccagaccaacggcctggacttccagaagcagcctgtgcctgtgggcggggccatcagcacagcccaggcccaggccttcctgggccacctgcaccaggtgcagctggccggcaccagcctgcaggccgccgcccagagcctgaatgtgcagagcaagagcaatgaggagagcggggacagccagcagcccagccagcccagccagcagcccagcgtgcaggccgccatcccccagacccagctgatgctggccggcggccagatcaccggcctgaccctgaccccagcccagcagcagctgctgctgcagcaggcccaggcccaggcccagctgctggccgctgctgtgcagcagcacagcgccagccagcagcacagcgctgctggggccaccatcagcgccagcgctgccacccccatgacccagatccccctgagccagcccatccagatcgcccaggacctgcagcagctgcagcagctgcagcagcagaacctgaacctgcagcagtttgtgctggtgcaccccaccaccaacctgcagcctgcccagttcatcatcagccagaccccccagggccagcagggcctgctgcaggcccagaacctgctgacccagctgccccagcagagccaggccaacctgctgcagagccagcccagcatcaccctgaccagccagcctgccacccccaccaggaccatcgccgccacccccatccagaccctgccccagagccagagcacccccaagagaattgacacccccagcctggaggagcccagcgacctggaggagctggagcagtttgccaagaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaacctgagcagtgacagcagcctgagcagccccagcgccctgaacagccctggcatcgagggcctgagcagaagaaggaagaagaggaccagcattgagaccaacatccgggtggccctggagaagagcttcctggagaaccagaagcccaccagcgaggagatcaccatgattgctgaccagctgaacatggagaaggaggtgatccgggtgtggttctgcaacagacggcagaaggagaagaggatcaacccccccagcagcggcggcaccagcagcagccccatcaaggccatcttccccagccccaccagcctggtggccaccacccccagcctggtgaccagcagcgctgccaccaccctgactgtgtcccctgtgctgcccctgaccagcgctgctgtgaccaacctgtctgtgacaggcaccagtgacaccaccagcaacaacacagccaccgtcatcagcacagcccccccagccagcagcgctgtgaccagccccagcctgagccccagccccagcgccagcgccagcaccagcgaggccagcagcgccagcgagaccagcaccacccagaccaccagcacccccctgagcagccccctgggcaccagccaggtgatggtgacagccagcggcctgcagacagctgctgctgctgccctgcagggcgccgcccagctgcctgccaatgccagcctggccgccatggctgctgctgctggcctgaaccccagcctgatggcccccagccagtttgctgctgggggcgccctgctgagcctgaaccctggcaccctgagcggggccctgagccctgccctgatgagcaacagcaccctggccaccatccaggccctggccagcggcggcagcctgcccatcaccagcctggatgccaccggcaacctggtgtttgccaatgctgggggcgcccccaacatcgtgacagcccccctcttcctgaacccccagaacctgagcctgctgaccagcaaccctgtgtccctggtgtctgctgctgctgccagcgctggcaacagcgcccctgtggccagcctgcacgccaccagcaccagcgctgagagcatccagaacagcctcttcaccgtggccagcgccagcggggccgccagcaccaccaccacagccagcaaggcccagtag

SEQ ID NO: 16523 - DNA, 2268 bp, Artificial Sequence
  Description of Artificial Sequence: Synthetic coding sequence
atgctggactgcagcgactatgtgctggacagcaggatgaacaaccccagcgagaccagcaagcccagcatggagagcggagatggcaacacaggcacccagaccaacggcctggacttccagaagcagcctgtgcctgtgggcggggccatcagcacagcccaggcccaggccttcctgggccacctgcaccaggtgcagctggccggcaccagcctgcaggccgccgcccagagcctgaatgtgcagagcaagagcaatgaggagagcggggacagccagcagcccagccagcccagccagcagcccagcgtgcaggccgccatcccccagacccagctgatgctggccggcggccagatcaccggcctgaccctgaccccagcccagcagcagctgctgctgcagcaggcccaggcccaggcccagctgctggccgctgctgtgcagcagcacagcgccagccagcagcacagcgctgctggggccaccatcagcgccagcgctgccacccccatgacccagatccccctgagccagcccatccagatcgcccaggacctgcagcagctgcagcagctgcagcagcagaacctgaacctgcagcagtttgtgctggtgcaccccaccaccaacctgcagcctgcccagttcatcatcagccagaccccccagggccagcagggcctgctgcaggcccagaacctgctgacccagctgccccagcagagccaggccaacctgctgcagagccagcccagcatcaccctgaccagccagcctgccacccccaccaggaccatcgccgccacccccatccagaccctgccccagagccagagcacccccaagagaattgacacccccagcctggaggagcccagcgacctggaggagctggagcagtttgccaagaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaacctgagcagtgacagcagcctgagcagccccagcgccctgaacagccctggcatcgagggcctgagcagaagaaggaagaagaggaccagcattgagaccaacatccgggtggccctggagaagagcttcctggagaaccagaagcccaccagcgaggagatcaccatgattgctgaccagctgaacatggagaaggaggtgatccgggtgtggttctgcaacagacggcagaaggagaagaggatcaacccccccagcagcggcggcaccagcagcagccccatcaaggccatcttccccagccccaccagcctggtggccaccacccccagcctggtgaccagcagcgctgccaccaccctgactgtgtcccctgtgctgcccctgaccagcgctgctgtgaccaacctgtctgtgacaggcaccagtgacaccaccagcaacaacacagccaccgtcatcagcacagcccccccagccagcagcgctgtgaccagccccagcctgagccccagccccagcgccagcgccagcaccagcgaggccagcagcgccagcgagaccagcaccacccagaccaccagcacccccctgagcagccccctgggcaccagccaggtgatggtgacagccagcggcctgcagacagctgctgctgctgccctgcagggcgccgcccagctgcctgccaatgccagcctggccgccatggctgctgctgctggcctgaaccccagcctgatggcccccagccagtttgctgctgggggcgccctgctgagcctgaaccctggcaccctgagcggggccctgagccctgccctgatgagcaacagcaccctggccaccatccaggccctggccagcggcggcagcctgcccatcaccagcctggatgccaccggcaacctggtgtttgccaatgctgggggcgcccccaacatcgtgacagcccccctcttcctgaacccccagaacctgagcctgctgaccagcaaccctgtgtccctggtgtctgctgctgctgccagcgctggcaacagcgcccctgtggccagcctgcacgccaccagcaccagcgctgagagcatccagaacagcctcttcaccgtggccagcgccagcggggccgccagcaccaccaccacagccagcaaggcccagtag

SEQ ID NO: 16524 - DNA, 2226 bp, Artificial Sequence
  Description of Artificial Sequence: Synthetic coding sequence
atgaagaccaggatgaagatctttgtgatgatccacttccacctgatgaacagcacccagaccaacggcctggacttccagaagcagcctgtgcctgtgggcggggccatcagcacagcccaggcccaggccttcctgggccacctgcaccaggtgcagctggccggcaccagcctgcaggccgccgcccagagcctgaatgtgcagagcaagagcaatgaggagagcggggacagccagcagcccagccagcccagccagcagcccagcgtgcaggccgccatcccccagacccagctgatgctggccggcggccagatcaccggcctgaccctgaccccagcccagcagcagctgctgctgcagcaggcccaggcccaggcccagctgctggccgctgctgtgcagcagcacagcgccagccagcagcacagcgctgctggggccaccatcagcgccagcgctgccacccccatgacccagatccccctgagccagcccatccagatcgcccaggacctgcagcagctgcagcagctgcagcagcagaacctgaacctgcagcagtttgtgctggtgcaccccaccaccaacctgcagcctgcccagttcatcatcagccagaccccccagggccagcagggcctgctgcaggcccagaacctgctgacccagctgccccagcagagccaggccaacctgctgcagagccagcccagcatcaccctgaccagccagcctgccacccccaccaggaccatcgccgccacccccatccagaccctgccccagagccagagcacccccaagagaattgacacccccagcctggaggagcccagcgacctggaggagctggagcagtttgccaagaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaacctgagcagtgacagcagcctgagcagccccagcgccctgaacagccctggcatcgagggcctgagcagaagaaggaagaagaggaccagcattgagaccaacatccgggtggccctggagaagagcttcctggagaaccagaagcccaccagcgaggagatcaccatgattgctgaccagctgaacatggagaaggaggtgatccgggtgtggttctgcaacagacggcagaaggagaagaggatcaacccccccagcagcggcggcaccagcagcagccccatcaaggccatcttccccagccccaccagcctggtggccaccacccccagcctggtgaccagcagcgctgccaccaccctgactgtgtcccctgtgctgcccctgaccagcgctgctgtgaccaacctgtctgtgacaggcaccagtgacaccaccagcaacaacacagccaccgtcatcagcacagcccccccagccagcagcgctgtgaccagccccagcctgagccccagccccagcgccagcgccagcaccagcgaggccagcagcgccagcgagaccagcaccacccagaccaccagcacccccctgagcagccccctgggcaccagccaggtgatggtgacagccagcggcctgcagacagctgctgctgctgccctgcagggcgccgcccagctgcctgccaatgccagcctggccgccatggctgctgctgctggcctgaaccccagcctgatggcccccagccagtttgctgctgggggcgccctgctgagcctgaaccctggcaccctgagcggggccctgagccctgccctgatgagcaacagcaccctggccaccatccaggccctggccagcggcggcagcctgcccatcaccagcctggatgccaccggcaacctggtgtttgccaatgctgggggcgcccccaacatcgtgacagcccccctcttcctgaacccccagaacctgagcctgctgaccagcaaccctgtgtccctggtgtctgctgctgctgccagcgctggcaacagcgcccctgtggccagcctgcacgccaccagcaccagcgctgagagcatccagaacagcctcttcaccgtggccagcgccagcggggccgccagcaccaccaccacagccagcaaggcccagtag

SEQ ID NO: 16525 - DNA, 2301 bp, Artificial Sequence
  Description of Artificial Sequence: Synthetic coding sequence
atggctgatggaggagctgccagccaggatgagagcagcgctgctgctgctgctgctgctgacagcaggatgaacaaccccagcgagaccagcaagcccagcatggagagcggagatggcaacacaggcacccagaccaacggcctggacttccagaagcagcctgtgcctgtgggcggggccatcagcacagcccaggcccaggccttcctgggccacctgcaccaggtgcagctggccggcaccagcctgcaggccgccgcccagagcctgaatgtgcagagcaagagcaatgaggagagcggggacagccagcagcccagccagcccagccagcagcccagcgtgcaggccgccatcccccagacccagctgatgctggccggcggccagatcaccggcctgaccctgaccccagcccagcagcagctgctgctgcagcaggcccaggcccaggcccagctgctggccgctgctgtgcagcagcacagcgccagccagcagcacagcgctgctggggccaccatcagcgccagcgctgccacccccatgacccagatccccctgagccagcccatccagatcgcccaggacctgcagcagctgcagcagctgcagcagcagaacctgaacctgcagcagtttgtgctggtgcaccccaccaccaacctgcagcctgcccagttcatcatcagccagaccccccagggccagcagggcctgctgcaggcccagaacctgctgacccagctgccccagcagagccaggccaacctgctgcagagccagcccagcatcaccctgaccagccagcctgccacccccaccaggaccatcgccgccacccccatccagaccctgccccagagccagagcacccccaagagaattgacacccccagcctggaggagcccagcgacctggaggagctggagcagtttgccaagaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaacctgagcagtgacagcagcctgagcagccccagcgccctgaacagccctggcatcgagggcctgagcagaagaaggaagaagaggaccagcattgagaccaacatccgggtggccctggagaagagcttcctggagaaccagaagcccaccagcgaggagatcaccatgattgctgaccagctgaacatggagaaggaggtgatccgggtgtggttctgcaacagacggcagaaggagaagaggatcaacccccccagcagcggcggcaccagcagcagccccatcaaggccatcttccccagccccaccagcctggtggccaccacccccagcctggtgaccagcagcgctgccaccaccctgactgtgtcccctgtgctgcccctgaccagcgctgctgtgaccaacctgtctgtgacaggcaccagtgacaccaccagcaacaacacagccaccgtcatcagcacagcccccccagccagcagcgctgtgaccagccccagcctgagccccagccccagcgccagcgccagcaccagcgaggccagcagcgccagcgagaccagcaccacccagaccaccagcacccccctgagcagccccctgggcaccagccaggtgatggtgacagccagcggcctgcagacagctgctgctgctgccctgcagggcgccgcccagctgcctgccaatgccagcctggccgccatggctgctgctgctggcctgaaccccagcctgatggcccccagccagtttgctgctggaggagccctgctgagcctgaaccctggcaccctgagcggggccctgagccctgccctgatgagcaacagcaccctggccaccatccaggccctggccagcggcggcagcctgcccatcaccagcctggatgccactggaaacctggtgtttgccaatgccggcggggcccccaacatcgtgacagcccccctcttcctgaacccccagaacctgagcctgctgaccagcaaccctgtgtccctggtgtctgctgctgctgccagcgctggcaacagcgcccctgtggccagcctgcacgccaccagcaccagcgctgagagcatccagaacagcctcttcaccgtggccagcgccagcggggccgccagcaccaccaccacagccagcaaggcccagtag

SEQ ID NO: 16526 - DNA, 1962 bp, Artificial Sequence
  Description of Artificial Sequence: Synthetic coding sequence
atgaacaaccccagcgagaccagcaagcccagcatggagagcggagatggcaacacaggcacccagaccaacggcctggacttccagaagcagcctgtgcctgtgggcggggccatcagcacagcccaggcccaggccttcctgggccacctgcaccaggtgcagctggccggcaccagcctgcaggccgccgcccagagcctgaatgtgcagagcaagagcaatgaggagagcggggacagccagcagcccagccagcccagccagcagcccagcgtgcaggccgccatcccccagacccagctgatgctggccggcggccagatcaccggcctgaccctgaccccagcccagcagcagctgctgctgcagcaggcccaggcccaggcccagctgctggccgctgctgtgcagcagcacagcgccagccagcagcacagcgctgctggggccaccatcagcgccagcgctgccacccccatgacccagatccccctgagccagcccatccagatcgcccaggacctgcagcagctgcagcagctgcagcagcagaacctgaacctgcagcagtttgtgctggtgcaccccaccaccaacctgcagcctgcccagttcatcatcagccagaccccccagggccagcagggcctgctgcaggcccagaacctgctgacccagctgccccagcagagccaggccaacctgctgcagagccagcccagcatcaccctgaccagccagcctgccacccccaccaggaccatcgccgccacccccatccagaccctgccccagagccagagcacccccaagagaattgacacccccagcctggaggagcccagcgacctggaggagctggagcagtttgccaagaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaacctgagcagtgacagcagcctgagcagccccagcgccctgaacagccctggcatcgagggcctgagcagaagaaggaagaagaggaccagcattgagaccaacatccgggtggccctggagaagagcttcctggagaaccagaagcccaccagcgaggagatcaccatgattgctgaccagctgaacatggagaaggaggtgatccgggtgtggttctgcaacagacggcagaaggagaagaggatcaacccccccagcagcggcggcaccagcagcagccccatcaaggccatcttccccagccccaccagcctggtggccaccacccccagcctggtgaccagcagcgctgccaccaccctgactgtgtcccctgtgctgcccctgaccagcgctgctgtgaccaacctgtctgtgacaggcaccagtgacaccaccagcaacaacacagccaccgtcatcagcacagcccccccagccagcagcgctgtgaccagccccagcctgagccccagccccagcgccagcgccagcaccagcgaggccagcagcgccagcgagaccagcaccacccagaccaccagcacccccctgagcagccccctgggcaccagccaggtgatggtgacagccagcggcctgcagacagctgctgctgctgccctgcagggcgccgcccagctgcctgccaatgccagcctggccgccatggctgctgctgctggcctgaaccccagcctgatggcccccagccagtttgctgctgggggcgccctgctgagcctgaaccctggcaccctgagcggggccctgagccctgccctgatgagcaacagcaccctggccaccatccagggcctgctgcacggcctggagaacttcctgaccaagaactag

SEQ ID NO: 16527 - DNA, 2112 bp, Artificial Sequence
  Description of Artificial Sequence: Synthetic coding sequence
atggctgatggaggagctgccagccaggatgagagcagcgctgctgctgctgctgctgctgacagcaggatgaacaaccccagcgagaccagcaagcccagcatggagagcggagatggcaacacaggcacccagaccaacggcctggacttccagaagcagcctgtgcctgtgggcggggccatcagcacagcccaggcccaggccttcctgggccacctgcaccaggtgcagctggccggcaccagcctgcaggccgccgcccagagcctgaatgtgcagagcaagagcaatgaggagagcggggacagccagcagcccagccagcccagccagcagcccagcgtgcaggccgccatcccccagacccagctgatgctggccggcggccagatcactggagacctgcagcagctgcagcagctgcagcagcagaacctgaacctgcagcagtttgtgctggtgcaccccaccaccaacctgcagcctgcccagttcatcatcagccagaccccccagggccagcagggcctgctgcaggcccagaacctgctgacccagctgccccagcagagccaggccaacctgctgcagagccagcccagcatcaccctgaccagccagcctgccacccccaccaggaccatcgccgccacccccatccagaccctgccccagagccagagcacccccaagagaattgacacccccagcctggaggagcccagcgacctggaggagctggagcagtttgccaagaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaacctgagcagtgacagcagcctgagcagccccagcgccctgaacagccctggcatcgagggcctgagcagaagaaggaagaagaggaccagcattgagaccaacatccgggtggccctggagaagagcttcctggagaaccagaagcccaccagcgaggagatcaccatgattgctgaccagctgaacatggagaaggaggtgatccgggtgtggttctgcaacagacggcagaaggagaagaggatcaacccccccagcagcggcggcaccagcagcagccccatcaaggccatcttccccagccccaccagcctggtggccaccacccccagcctggtgaccagcagcgctgccaccaccctgactgtgtcccctgtgctgcccctgaccagcgctgctgtgaccaacctgtctgtgacaggcaccagtgacaccaccagcaacaacacagccaccgtcatcagcacagcccccccagccagcagcgctgtgaccagccccagcctgagccccagccccagcgccagcgccagcaccagcgaggccagcagcgccagcgagaccagcaccacccagaccaccagcacccccctgagcagccccctgggcaccagccaggtgatggtgacagccagcggcctgcagacagctgctgctgctgccctgcagggcgccgcccagctgcctgccaatgccagcctggccgccatggctgctgctgctggcctgaaccccagcctgatggcccccagccagtttgctgctgggggcgccctgctgagcctgaaccctggcaccctgagcggggccctgagccctgccctgatgagcaacagcaccctggccaccatccaggccctggccagcggcggcagcctgcccatcaccagcctggatgccaccggcaacctggtgtttgccaatgctgggggcgcccccaacatcgtgacagcccccctcttcctgaacccccagaacctgagcctgctgaccagcaaccctgtgtccctggtgtctgctgctgctgccagcgctggcaacagcgcccctgtggccagcctgcacgccaccagcaccagcgctgagagcatccagaacagcctcttcaccgtggccagcgccagcggggccgccagcaccaccaccacagccagcaaggcccagtag

SEQ ID NO: 16528 - DNA, 279 bp, Artificial Sequence
  Description of Artificial Sequence: Synthetic coding sequence
atgaacaaccccagcgagaccagcaagcccagcatggagagcggagatggcaacacaggcacccagaccaacggcctggacttccagaagcagcctgtgcctgtgggcggggccatcagcacagcccaggcccaggccttcctgggccacctgcaccaggtgcagctggccggcaccagcctgcaggccgccgcccagagcctgaatgtgcagagcaagagcaatgaggagagcggggacagccagcagcccagccagcccagccagcagcccagctag

SEQ ID NO: 16529 - DNA, 765 bp, Artificial Sequence
  Description of Artificial Sequence: Synthetic coding sequence
atgaacaaccccagcgagaccagcaagcccagcatggagagcggagatggcaacacaggcacccagaccaacggcctggacttccagaagcagcctgtgcctgtgggcggggccatcagcacagcccaggcccaggccttcctgggccacctgcaccaggtgcagctggccggcaccagcctgcaggccgccgcccagagcctgaatgtgcagagcaagagcaatgaggagagcggggacagccagcagcccagccagcccagccagcagcccagcgtgcaggccgccatcccccagacccagctgatgctggccggcggccagatcaccggcctgaccctgaccccagcccagcagcagctgctgctgcagcaggcccaggcccaggcccagctgctggccgctgctgtgcagcagcacagcgccagccagcagcacagcgctgctggggccaccatcagcgccagcgctgccacccccatgacccagatccccctgagccagcccatccagatcgcccaggacctgcagcagctgcagcagctgcagcagcagaacctgaacctgcagcagtttgtgctggtgcaccccaccaccaacctgcagcctgcccagttcatcatcagccagaccccccagggccagcagggcctgctgcaggcccagaacctgctgacccagctgccccagcagagccaggccaacctgctgcagagccagcccagcatcaccctgaccagccagatctggcccagccctgcctag

SEQ ID NO: 16530 - DNA, 342 bp, Artificial Sequence
  Description of Artificial Sequence: Synthetic coding sequence
atgaacaaccccagcgagaccagcaagcccagcatggagagcggagatggcaacacaggaactggaacagctgctggctgctgcagcgctgctgccctgcggcagcctgctgcccagtgctgctggagccaccacctgcggctgtgctgccacgcccatgatgctgacccccctgtgtctgcccacacagacagaacaggcagcagcaccacagccacagccagcacagctgagagccagcctgccaccgtgtgtgtgggcgccagcaaccaccagtttgctgccagcgctgtgtaccacctgacagatgcccctggccctgctggcagccctgccagctag

SEQ ID NO: 16531 - DNA, 2232 bp, Artificial Sequence; identical to SEQ ID NO: 16522
  Description of Artificial Sequence: Synthetic coding sequence

SEQ ID NO: 16532 - DNA, 411 bp, Artificial Sequence
  Description of Artificial Sequence: Synthetic coding sequence
atgaacaaccccagcgagaccagcaagcccagcatggagagcggagatggcaacacaggcacccagaccaacggcctggacttccagaagcagcctgtgcctgtgggcggggccatcagcacagcccaggcccaggccttcctgggccacctgcaccaggtgcagctggccggcaccagcctgcaggccgccgcccagagcctgaatgtgcagagcaagagcaatgaggagagcggggacagccagcagcccagccagcccagccagcagcccagcgtgcaggccgccatcccccagacccagctgatgctggccggcggccagatcaccggcctgaccctgaccccagcccagcagcagctgctgctgcagcaggcccaggcccaggcccagctgctggccgccgcctag

SEQ ID NO: 16533 - DNA, 1587 bp, Artificial Sequence
  Description of Artificial Sequence: Synthetic coding sequence
atggctgatggaggagctgccagccaggatgagagcagcgctgctgctgctgctgctgctgacagcaggatgaacaaccccagcgagaccagcaagcccagcatggagagcggagatggcaacacaggcacccagaccaacggcctggacttccagaagcagcctgtgcctgtgggcggggccatcagcacagcccaggcccaggccttcctgggccacctgcaccaggtgcagctggccggcaccagcctgcaggccgccgcccagagcctgaatgtgcagagcaagagcaatgaggagagcggggacagccagcagcccagccagcccagccagcagcccagcgtgcaggccgccatcccccagacccagctgatgctggccggcggccagatcaccggcctgaccctgaccccagcccagcagcagctgctgctgcagcaggcccaggcccaggcccagctgctggccgctgctgtgcagcagcacagcgccagccagcagcacagcgctgctggggccaccatcagcgccagcgctgccacccccatgacccagatccccctgagccagcccatccagatcgcccaggacctgcagcagctgcagcagctgcagcagcagaacctgaacctgcagcagtttgtgctggtgcaccccaccaccaacctgcagcctgcccagttcatcatcagccagaccccccagggccagcagggcctgctgcaggcccagaacctgctgacccagctgccccagcagagccaggccaacctgctgcagagccagcccagcatcaccctgaccagccagcctgccacccccaccaggaccatcgccgccacccccatccagaccctgccccagagccagagcacccccaagagaattgacacccccagcctggaggagcccagcgacctggaggagctggagcagtttgccaagaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaacctgagcagtgacagcagcctgagcagccccagcgccctgaacagccctggcatcgagggcctgagcagaagaaggaagaagaggaccagcattgagaccaacatccgggtggccctggagaagagcttcctggagaaccagaagcccaccagcgaggagatcaccatgattgctgaccagctgaacatggagaaggaggtgatccgggtgtggttctgcaacagacggcagaaggagaagaggatcaacccccccagcagcggcggcaccagcagcagccccatcaaggccatcttccccagccccaccagcctggtggccaccacccccagcctggtgaccagcagcgctgccaccaccctgactgtgtcccctgtgctgcccctgaccagcgctgctgtgaccaacctgagcgccctgcagaccccaccacccaccacccagcagccctag

SEQ ID NO: 16534 - DNA, 165 bp, Artificial Sequence
  Description of Artificial Sequence: Synthetic coding sequence
atgaacaaccccagcgagaccagcaagcccagcatggagagcggagatggcaacacaggcacccagaccaacggcctggacttccagaagcagcctgtgcctgtgggcggggccatcagcacagcccaggcccaggccttcctgggccacctgcaccaggtgtag

SEQ ID NO: 16535 - DNA, 2268 bp, Artificial Sequence; identical to SEQ ID NO: 16523
  Description of Artificial Sequence: Synthetic coding sequence

SEQ ID NO: 16536 - DNA, 1230 bp, Artificial Sequence
  Description of Artificial Sequence: Synthetic coding sequence
atgatgatgatgagcctgaacagcaagcaggccttctccatgccccacggcggcagcctgcacgtggagcccaagtacagcgccctgcacagcaccagccctggcagcagcgcccccatcgcccccagcgccagcagccccagcagcagcagcaatgccggcggcggcggcggcggcggcggcggcggcggcggcggcggcggccgcagcagcagcagcagcagcagcggcagcagcggcggcggcggcagcgaggccatgaggcgggcctgcctgcccaccccacccagcaacatctttggaggcctggatgagagcctgctggcccgggcagaggccctggccgctgtggacatcgtgtcccagagcaagagccaccaccaccaccccccccaccacagccccttcaagccagatgccacctaccacaccatgaacaccatcccctgcaccagcgctgccagcagcagctctgtgcccatcagccaccccagcgccctggccggcacccaccaccaccaccaccaccaccaccaccaccaccaccagccccaccaggccctggagggggagctgctggagcacctgagccctggcctggccctgggcgccatggccggcccagatggagctgtggtgtccaccccagcccacgccccccacatggccaccatgaaccccatgcaccaggccgccctgtccatggcccacgcccacggcctgcccagccacatgggctgcatgtctgatgtggatgctgacccccgggacctggaggcctttgctgagcgcttcaagcagaggcgcatcaagctgggcgtgacccaggctgatgtgggcagcgccctggccaacctgaagatccctggggtgggcagcctgagccagagcaccatctgccgctttgagagcctgaccctgagccacaacaacatgattgccctgaagcccatcctgcaggcctggctggaggaggccgagaagagccaccgggagaagctgaccaagccagagctgttcaatggagctgagaagaagaggaagaggaccagcattgctgcccctgagaagaggagcctggaggcctactttgccatccagccccggcccagcagcgagaagattgctgccatcgccgagaagctggacctgaagaagaatgtggtgcgggtgtggttctgcaaccagaggcagaagcagaagaggatgaagtacagcgctggcatctag

SEQ ID NO: 16537 - DNA, 906 bp, Artificial Sequence
  Description of Artificial Sequence: Synthetic coding sequence
atgcctggcatcagcagccagatcctgaccaatgcccagggccaggtgattggcaccctgccctgggtggtgaacagcgcctctgtggccgccccagccccagcccagagcctgcaggtgcaggccgtgaccccccagctgctgctgaatgcccagggccaggtgattgccaccctggccagcagccccctgcccccacctgtggccgtgaggaagcccagcaccccagagagccctgccaagtctgaggtgcagcccatccagcccacccccaccgtgccccagcctgctgtggtgattgccagccctgccccagctgccaagcccagcgccagcgcccccatccccatcacctgcagcgagacccccaccgtgtcccagctggtgtccaagccccacacccccagcctggatgaagatggcatcaacctggaggagatccgggagtttgccaagaacttcaagatccggcggctgagcctgggcctgacccagacccaggtgggccaggccctgacagccacagagggccctgcctacagccagagcgccatctgccgctttgagaagctggacatcacccccaagagcgcccagaagctgaagcctgtgctggagaagtggctgaatgaggccgagctgaggaaccaggagggccagcagaacctgatggagtttgtgggcggggagcccagcaagaagaggaagaggaggaccagcttcaccccccaggccatcgaggccctgaatgcctactttgagaagaaccccctgcccaccggccaggagatcacagaaattgccaaggagctgaactatgaccgggaggtggtgcgggtgtggttctgcaacagacggcagaccctgaagaacaccagcaagctgaatgtgttccagatcccctag

SEQ ID NO: 16538 - DNA, 906 bp, Artificial Sequence; identical to SEQ ID NO: 16537
  Description of Artificial Sequence: Synthetic coding sequence

SEQ ID NO: 16539 - DNA, 90 bp, Artificial Sequence
  Description of Artificial Sequence: Synthetic coding sequence
atgcctggcatcagcagccagatcctgaccaatgcccagggccaggtgattggcaccctgccctgggtggtgaacagcgcctctgtgtag

SEQ ID NO: 16540 - DNA, 906 bp, Artificial Sequence; identical to SEQ ID NO: 16537
  Description of Artificial Sequence: Synthetic coding sequence

SEQ ID NO: 16541 - DNA, 1020 bp, Artificial Sequence
  Description of Artificial Sequence: Synthetic coding sequence
atggctgctgctgctgctgctgccctggagagctggcaggccgccgcccccaggaagagaagatctgctgcccggcggcccaggagaagagaggccgccccccggggccgggaggccgccccccggggccgggaggccgccccccggggccctgaggccgagtttgaaagtgacagcggcgtggtgctgcggcgcatctgggaggccgagaaggacctcttcatcagtgacttctggagcagcgccctggagaccatcaaccgctgcctgaccaagcacctggagcagctgaaggcccctgtgggcaccctgagtgacatcttcggcaacctgcacctggacagcctgcctgaggagagtgatgtggccacagacagcatcccccgggagatcctggtgacaggcacctgccacctgaagtgtgtgtgctacggcatcggcaactttgccacctgcatcgtggccaggaaccagctgaccttcctgctgctgctgctggagaagtgccagatccccaggagccactgctgggtgtatgaccccctcttcagccagctggagattgaggtgctgaacaccctgggcgtgacagtgctgtctgaaaatgaggagggcaagaggagcatccggggggagcccaccatcttctacatgctgcactgcggcacagccctgtacaacaacctgctgtggagcaactggagcgtggatgccctgagcaagatggtgatcatcggcaacagcttcaagggcctggaggagcggctgctggcccgcatcctgcagaagaactacccctacatcgccaagatcctgaagggcctggaggagctggagttcccccagaccagccagtacatggacatcttcaatgacacctctgtgcactggttccctgtgcagaagctggagcagctgagcattgacatctgggagttccgggaggagccagactaccaggactgtgaggacctggagatcatccggaacaagcgggaggaccccagcgccacagactag

SEQ ID NO: 16542 - DNA, 2064 bp, Artificial Sequence
  Description of Artificial Sequence: Synthetic coding sequence
atggagcgggtgaatgatgccagctgtggccccagcggctgctacacctaccaggtgagccgccacagcacagagatgctgcacaacctgaaccagcagaggaagaatggaggccgcttctgtgatgtgctgctgcgggtgggagatgagagcttccctgcccacagagctgtgctggccgcctgcagcgagtactttgagagcgtcttcagcgcccagctgggagatggaggagctgctgatggcggccctgcagatgtgggcggggccacagctgcccctgggggcggggccggcggcagccgggagctggagatgcacaccatcagcagcaaggtgtttggagacatcctggactttgcctacaccagccgcatcgtggtgcggctggagagcttccctgagctgatgacagctgccaagttcctgctgatgaggtctgtgattgagatctgccaggaggtgatcaagcagagcaatgtgcagatcctggtgcccccagcccgggctgacatcatgctgttccggcccccaggcaccagtgacctgggcttccccctggacatgaccaatggagctgccctggccgccaacagcaatggaattgctggctccatgcagcctgaggaggaggccgcccgggccgccggggccgccatcgccggccaggccagcctgcctgtgctgcccggggtggaccggctgcccatggtggccggccccctgagcccccagctgctgaccagccccttccccagcgtggccagcagcgccccacccctgaccgggaagaggggccggggccggcccaggaaggccaacctgctggacagcatgtttggcagccctgggggcctgcgggaggccggcatcctgccctgtggcctgtgtgggaaggtgttcacagatgccaaccggctgcggcagcacgaggcccagcacggcgtgaccagcctgcagctgggctacatcgacctgcccccaccccggctgggagaaaatggcctgcccatcagcgaggaccctgatggccccaggaagaggagcaggaccaggaagcaggtggcctgtgagatctgtgggaagatcttcagagatgtgtaccacctgaacagacacaagctgagccacagcggggagaagccctacagctgccctgtgtgtggcctgcgcttcaagaggaaggacaggatgagctaccacgtgcgcagccatgatggctctgtgggcaagccctacatctgccagagctgtgggaagggcttcagcaggccagaccacctgaatggccacatcaagcaggtgcacaccagcgagcggccccacaagtgccagacctgcaatgccagctttgccacccgggaccggctgcggagccacctggcctgccacgaggacaaggtgccctgccaggtgtgtgggaagtacctgcgggccgcctacatggctgaccacctgaagaagcacagcgagggccccagcaacttctgcagcatctgcaacagaggcttcagcagcgccagctacctgaaggtgcacgtgaagacccaccacggcgtgcccctgccccaggtgagccgccaccaggagcccatcctgaatggaggagctgccttccactgtgcccggacctacggcaacaaggagggccagaagtgcagccaccaggaccccatcgagagcagtgacagctatggagacctgagtgatgccagtgacctgaagaccccagagaagcagagcgccaacggcagcttcagctgtgacatggctgtgcccaagaacaagatggagagtgatggagagaagaagtacccctgcccagaatgtggcagcttcttccgcagcaagagctacctgaacaagcacatccagaaggtgcacgtgcgggccctgggcggccccctgggggacctgggccctgccctgggcagccccttcagcccccagcagaacatgagcctgctggagagctttggcttccagatcgtgcagagcgcctttgccagcagcctggtggaccctgaggtggaccagcagcccatgggccctgagggcaagtag

SEQ ID NO: 16543 - DNA, 1926 bp, Artificial Sequence
  Description of Artificial Sequence: Synthetic coding sequence
atggagcgggtgaatgatgccagctgtggccccagcggctgctacacctaccaggtgagccgccacagcacagagatgctgcacaacctgaaccagcagaggaagaatggaggccgcttctgtgatgtgctgctgcgggtgggagatgagagcttccctgcccacagagctgtgctggccgcctgcagcgagtactttgagagcgtcttcagcgcccagctgggagatggaggagctgctgatggcggccctgcagatgtgggcggggccacagctgcccctgggggcggggccggcggcagccgggagctggagatgcacaccatcagcagcaaggtgtttggagacatcctggactttgcctacaccagccgcatcgtggtgcggctggagagcttccctgagctgatgacagctgccaagttcctgctgatgaggtctgtgattgagatctgccaggaggtgatcaagcagagcaatgtgcagatcctggtgcccccagcccgggctgacatcatgctgttccggcccccaggcaccagtgacctgggcttccccctggacatgaccaatggagctgccctggccgccaacagcaatggaattgctggctccatgcagcctgaggaggaggccgcccgggccgccggggccgccatcgccggccaggccagcctgcctgtgctgcccggggtggaccggctgcccatggtggccggccccctgagcccccagctgctgaccagccccttccccagcgtggccagcagcgccccacccctgaccgggaagaggggccggggccggcccaggaaggccaacctgctggacagcatgtttggcagccctgggggcctgcgggaggccggcatcctgccctgtggcctgtgtgggaaggtgttcacagatgccaaccggctgcggcagcacgaggcccagcacggcgtgaccagcctgcagctgggctacatcgacctgcccccaccccggctgggagaaaatggcctgcccatcagcgaggaccctgatggccccaggaagaggagcaggaccaggaagcaggtggcctgtgagatctgtgggaagatcttcagagatgtgtaccacctgaacagacacaagctgagccacagcggggagaagccctacagctgccctgtgtgtggcctgcgcttcaagaggaaggacaggatgagctaccacgtgcgcagccatgatggctctgtgggcaagccctacatctgccagagctgtgggaagggcttcagcaggccagaccacctgaatggccacatcaagcaggtgcacaccagcgagcggccccacaagtgccagacctgcaatgccagctttgccacccgggaccggctgcggagccacctggcctgccacgaggacaaggtgccctgccaggtgtgtgggaagtacctgcgggccgcctacatggctgaccacctgaagaagcacagcgagggccccagcaacttctgcagcatctgcaaccgggagggccagaagtgcagccaccaggaccccatcgagagcagtgacagctatggagacctgagtgatgccagtgacctgaagaccccagagaagcagagcgccaacggcagcttcagctgtgacatggctgtgcccaagaacaagatggagagtgatggagagaagaagtacccctgcccagaatgtggcagcttcttccgcagcaagagctacctgaacaagcacatccagaaggtgcacgtgcgggccctgggcggccccctgggggacctgggccctgccctgggcagccccttcagcccccagcagaacatgagcctgctggagagctttggcttccagatcgtgcagagcgcctttgccagcagcctggtggaccctgaggtggaccagcagcccatgggccctgagggcaagtag

SEQ ID NO: 16544 - DNA, 1614 bp, Artificial Sequence
  Description of Artificial Sequence: Synthetic coding sequence
atggagcgggtgaatgatgccagctgtggccccagcggctgctacacctaccaggtgagccgccacagcacagagatgctgcacaacctgaaccagcagaggaagaatggaggccgcttctgtgatgtgctgctgcgggtgggagatgagagcttccctgcccacagagctgtgctggccgcctgcagcgagtactttgagagcgtcttcagcgcccagctgggagatggaggagctgctgatggcggccctgcagatgtgggcggggccacagctgcccctgggggcggggccggcggcagccgggagctggagatgcacaccatcagcagcaaggtgtttggagacatcctggactttgcctacaccagccgcatcgtggtgcggctggagagcttccctgagctgatgacagctgccaagttcctgctgatgaggtctgtgattgagatctgccaggaggtgatcaagcagagcaatgtgcagatcctggtgcccccagcccgggctgacatcatgctgttccggcccccaggcaccagtgacctgggcttccccctggacatgaccaatggagctgccctggccgccaacagcaatggaattgctggctccatgcagcctgaggaggaggccgcccgggccgccggggccgccatcgccggccaggccagcctgcctgtgctgcccggggtggaccggctgcccatggtggccggccccctgagcccccagctgctgaccagccccttccccagcgtggccagcagcgccccacccctgaccgggaagaggggccggggccggcccaggaaggccaacctgctggacagcatgtttggcagccctgggggcctgcgggaggccggcatcctgccctgtggcctgtgtgggaaggtgttcacagatgccaaccggctgcggcagcacgaggcccagcacggcgtgaccagcctgcagctgggctacatcgacctgcccccaccccggctgggagaaaatggcctgcccatcagcgaggaccctgatggccccaggaagaggagcaggaccaggaagcaggtggcctgtgagatctgtgggaagatcttcagagatgtgtaccacctgaacagacacaagctgagccacagcggggagaagccctacagctgccctgtgtgtggcctgcgcttcaagaggaaggacaggatgagctaccacgtgcgcagccatgatggctctgtgggcaagccctacatctgccagagctgtgggaagggcttcagcaggccagaccacctgaatggccacatcaagcaggtgcacaccagcgagcggccccacaagtgccagacctgcaatgccagctttgccacccgggaccggctgcggagccacctggcctgccacgaggacaaggtgccctgccaggtgtgtgggaagtacctgcgggccgcctacatggctgaccacctgaagaagcacagcgagggccccagcaacttctgcagcatctgcaacagaggcctgcaggcccctggggcccaccctgagtggggcagctctgtgcccctgcggcaggacctgtggcagcagaggaggcctgagatgctgaccagcggcagtgactag

SEQ ID NO: 16545 - DNA, 1104 bp, Artificial Sequence
  Description of Artificial Sequence: Synthetic coding sequence
atgatgggctctgtgctgcctgctgaggccctggtgctgaagacaggcctgaaggcccctggcctggccctggccgaggtgatcaccagtgacatcctgcacagcttcctgtatggccgctggagaaatgtgctgggggagcagctgtttgaggacaagagccaccacgccagccccaagacagccttcaccgctgaggtgctggcccagagcttctctggagaggtgcagaagctgagcagcctggtgctgcctgctgaggtgatcatcgcccagagcagcatccctggagagggcctgggcatcttcagcaagacctggatcaaggccggcacagagatgggccccttcaccggccgggtcatcgcccctgagcacgtggacatctgcaagaacaacaacctgatgtgggaggtgttcaatgaagatggcaccgtgcgctacttcattgatgccagccaggaggaccaccgctcctggatgacctacatcaagtgtgccagaaatgagcaggagcagaacctggaggtggtgcagatcggcaccagcatcttctacaaggccatcgagatgatccccccagaccaggagctgctggtgtggtacggcaacagccacaacaccttcctgggcatccctggggtgcccggcctggaggaggaccagaagaagaacaagcatgaggacttccaccctgctgacagcgctgctggccctgctggccgcatgagatgtgtgatctgccaccggggcttcaacagccgcagcaacctgcggagccacatgaggatccacaccctggacaagccctttgtgtgccgcttctgcaacagacgcttcagccagagcagcaccctgagaaatcatgtgcggctgcacactggagagcggccctacaagtgccaggtgtgccagagcgcctacagccagctggccggcctgcgggcccaccagaagagcgcccggcacaggcctcccagcacagccctgcaggcccacagccctgccctgcctgcccctcatgcccacgccccagccctggccgctgctgctgctgctgctgctgctgctgctgcccaccacctgcctgccatggtgctgtag

SEQ ID NO: 16546 - DNA, 2154 bp, Artificial Sequence
  Description of Artificial Sequence: Synthetic coding sequence
atgcacggggccgcccgggccccagccacctctgtgtctgctgactgctgcatcccagctggcctgcggctgggccctgtgcccggcaccttcaagctgggcaagtacctgagtgaccggcgggagcccggccccaagaagaaggtgctgaccatccagaccagcgcccaccaggtgaggatggtgcggggggagctggtggatgagagcggcggcagccccctggagtggattggcctcatccgggccgccaggaacagccaggagcagaccctggaggccatcgctgacctgcccggcggccagatcttctaccgggccctgagagatgtgcagcctggagaggagctgactgtgtggtacagcaacagcctggcccagtggtttgacatccccaccacagccacccccacccatgatgagaagggggaggagcgctacatctgctggtactgctggaggaccttccgctaccccaacagcctgaaggcccacctgcgcttccactgtgtgttttctgggggcggcggcggggccttcctgcaccatgaacatgctgcccggcagggcgctgtgcctgctgctgatggcctgggcctgagccccaagcccccagccccagactttgctgcccccagccaggccggcaccctgcggccccaccccctgggccccccacctgtgcaggcctgtggggcccgggagggcatcaagcgggaggccagcagcgcccccagcgccaccagccccacccctgggaagtggggccagcccaagaagggcaaggagcagctggaccgggccctggacatgtctggggccgcccggggccagggccacttcctgggcatcgtgggcggcagcagcgctggggtgggcagcctggccttctacccaggagtgcgcagcgccttcaagccagctggcctggcccgggctgctgctgctgcccacggggacccctaccgggaggagagcagcagcaagcagggcgccggcctggccctgggccgcctgctgggcggcggccgggcctgtggccggcccggcagcggagaaaattctgctgctggaggagctggccaccaccaccaccaccacgcccaccaccaccaccaccccaagtgcctgctggccggggaccccccacctcctcctcctcctggcctgccctgcagcggggccctgcggggcttccccctgctgtctgtgcccccagaggaggccagcgccttcaagcacgtggagcgggcccctcctgctgctgctgccctgcccggggcccgctatgcccagctgcccccagcccctggcctgcccctggagcgctgtgccctgccccccctggaccccggcggcctgaaggcctacccaggaggagaatgtagccacctgcctgctgtgatgcctgccttcaccgtgtacaacggggagctgctgtatggcagccctgccaccacagcctactaccccctgaagctgcactttggaggcctgctgaagtacccagagagcatctcctacttcagcggccctgctgctgctgccctgagccctgctgagctgggcagcctggccagcattgaccgggagatcgccatgcacaaccagcagctgtctgagatggccgccggcaagggccggggccgcctggacagcggcaccctgcccccagctgtggccgctgctgggggcaccggcggcggcggcagcggcggcagcggggccggcaagcccaagacaggccacctgtgcctgtactgtgggaagctgtacagcaggaaatatggcctgaagatccacatgaggacccacacaggctacaagcccctgaagtgcaaggtgtgcctgcggccctttggagaccccagcaacctgaacaagcacatccggctgcacgccgagggcaacaccccctaccgctgtgagttctgtgggaaggtgctggtgagaagaagagacctggagcggcacgtgaagagccgccaccctggccagagcctgctggccaaggctggagatggccctggagctgagcccggctacccacctgagcccggggaccccaagagtgatgacagtgatgtggatgtgtgcttcacagatgaccagagcgaccctgaggtgggcggcggcggggagcgggacctgtag

SEQ ID NO: 16547 - DNA, 2124 bp, Artificial Sequence
  Description of Artificial Sequence: Synthetic coding sequence
atgcacggggccgcccgggccccagccacctctgtgtctgctgactgctgcatcccagctggcctgcggctgggccctgtgcccggcaccttcaagctgggcaagtacctgagtgaccggcgggagcccggccccaagaagaaggtgaggatggtgcggggggagctggtggatgagagcggcggcagccccctggagtggattggcctcatccgggccgccaggaacagccaggagcagaccctggaggccatcgctgacctgcccggcggccagatcttctaccgggccctgagagatgtgcagcctggagaggagctgactgtgtggtacagcaacagcctggcccagtggtttgacatccccaccacagccacccccacccatgatgagaagggggaggagcgctacatctgctggtactgctggaggaccttccgctaccccaacagcctgaaggcccacctgcgcttccactgtgtgttttctgggggcggcggcggggccttcctgcaccatgaacatgctgcccggcagggcgctgtgcctgctgctgatggcctgggcctgagccccaagcccccagccccagactttgctgcccccagccaggccggcaccctgcggccccaccccctgggccccccacctgtgcaggcctgtggggcccgggagggcatcaagcgggaggccagcagcgcccccagcgccaccagccccacccctgggaagtggggccagcccaagaagggcaaggagcagctggaccgggccctggacatgtctggggccgcccggggccagggccacttcctgggcatcgtgggcggcagcagcgctggggtgggcagcctggccttctacccaggagtgcgcagcgccttcaagccagctggcctggcccgggctgctgctgctgcccacggggacccctaccgggaggagagcagcagcaagcagggcgccggcctggccctgggccgcctgctgggcggcggccgggcctgtggccggcccggcagcggagaaaattctgctgctggaggagctggccaccaccaccaccaccacgcccaccaccaccaccaccccaagtgcctgctggccggggaccccccacctcctcctcctcctggcctgccctgcagcggggccctgcggggcttccccctgctgtctgtgcccccagaggaggccagcgccttcaagcacgtggagcgggcccctcctgctgctgctgccctgcccggggcccgctatgcccagctgcccccagcccctggcctgcccctggagcgctgtgccctgccccccctggaccccggcggcctgaaggcctacccaggaggagaatgtagccacctgcctgctgtgatgcctgccttcaccgtgtacaacggggagctgctgtatggcagccctgccaccacagcctactaccccctgaagctgcactttggaggcctgctgaagtacccagagagcatctcctacttcagcggccctgctgctgctgccctgagccctgctgagctgggcagcctggccagcattgaccgggagatcgccatgcacaaccagcagctgtctgagatggccgccggcaagggccggggccgcctggacagcggcaccctgcccccagctgtggccgctgctgggggcaccggcggcggcggcagcggcggcagcggggccggcaagcccaagacaggccacctgtgcctgtactgtgggaagctgtacagcaggaaatatggcctgaagatccacatgaggacccacacaggctacaagcccctgaagtgcaaggtgtgcctgcggccctttggagaccccagcaacctgaacaagcacatccggctgcacgccgagggcaacaccccctaccgctgtgagttctgtgggaaggtgctggtgagaagaagagacctggagcggcacgtgaagagccgccaccctggccagagcctgctggccaaggctggagatggccctggagctgagcccggctacccacctgagcccggggaccccaagagtgatgacagtgatgtggatgtgtgcttcacagatgaccagagcgaccctgaggtgggcggcggcggggagcgggacctgtag

SEQ ID NO: 16548 - DNA, 4524 bp, Artificial Sequence
  Description of Artificial Sequence: Synthetic coding sequence
atgccccggcggcggcccccagccagcggggccgcccagtttcctgagcgcatcgccaccaggagcccagaccccatccccctgtgcaccttccagaggcagcccagggctgcccctgtgcagcccccctgccgcctcttctttgtgacctttgctggctgcggccaccgctggaggtctgagagcaagccaggctggatcagccgcagccgcagcggcatcgccctgcgggccgcccggcccccaggcagcagcccccccaggcctgctgccccccggcccccacctcctggaggagtggtggccgaggcccctggagatgtggtgatcccccggccccgggtgcagcccatgagggtggcccggggcggcccctggacccccaacccagccttccgggaggccgagagctggagccagatcggcaaccagagggtgtctgagcagctgctggagaccagcctgggcaatgaggtgtctgacacagagcccctgagccctgccagcgctggcctgcggaggaacccagccctgcccccaggcccctttgcccagaacttctcctggggcaaccaggagaacctgcccccagccctgggcaagatcgccaacggcggcggcaccggggccggcaaggccgagtgtggctatgaaacagagagccacctgctggagccccatgagatccccctgaatgtgaacacccacaagttcagtgactgtgagttcccctatgagttctgcaccgtgtgcttcagccccttcaagctgctgggcatgtctggagtggagggcgtgtggaaccagcacagccgcagcgcctccatgcacaccttcctgaaccacagcgccaccggcatccgggaggccggctgcaggaaggacatgcctgtgtctgagatggctgaagatggcagcgaggagatcatgttcatctggtgtgaggactgcagccagtaccatgattctgagtgcccagagctgggccctgtggtgatggtgaaggacagctttgtgctgagccgggcccgctcctggccagccagcggccacgtgcacacccaggccggccagggcatgaggggctatgaggaccgggacagagctgacccccagcagctgcctgaggccgtgcctgctggcctggtgcggcggctgagcggccagcagctgccctgccgcagcaccctgacctggggccgcctgtgccacctggtggcccagggccgcagcagcctgccccccaacctggagatccggcggctggaggatggagctgagggcgtgtttgccatcacccagctggtgaagaggacccagtttggcccctttgagagcagaagagtggccaagtgggagaaggagagcgccttccccctgaaggtgttccagaaggatggccaccctgtgtgctttgacaccagcaatgaagatgactgcaactggatgatgctggtgcggcctgctgctgaggccgagcaccagaacctgacagcctaccagcacggcagtgatgtgtacttcaccaccagccgggacatccccccaggcacagagctgcgggtgtggtatgctgccttctacgccaagaagatggacaagcccatgctgaagcaggccggcagcggcgtgcacgccgccggcaccccagaaaattctgcccctgtggagagcgagcccagccagtgggcctgcaaggtgtgcagcgccaccttcctggagctgcagctgctgaatgagcacctgctgggccacctggagcaggccaagagcctgcccccaggcagccagagcgaggccgccgcccctgagaaggagcaggacaccccaagaggagagcccccagctgtgcctgagagtgaaaatgtggccaccaaggagcagaagaagaagccccggcggggcaggaagcccaaggtgtccaaggccgagcagcccctggtgattgtggaggacaaggagcccacagagcaggtggccgagatcatcacagaggtgcccccagatgagcctgtgtctgccaccccagatgagcgcatcatggagctggtgctgggcaagctggccaccaccaccacagacaccagctctgtgcccaagttcacccaccaccagaacaacaccatcaccctgaagaggagcctcatcctgagcagcagacatggcatccggaggaagctgatcaagcagctgggggagcacaagagggtgtaccagtgcaacatctgcagcaagatcttccagaacagcagcaacctgagccgccacgtgcgcagccacggggacaagctgttcaagtgtgaagaatgtgccaagctgttcagcaggaaggagagcctgaagcagcacgtgtcctacaagcacagcagaaatgaggtggatggagagtaccgctaccgctgtggcacctgtgagaagaccttccgcatcgagagcgccctggagttccacaactgcaggacagatgacaagaccttccagtgtgagatgtgcttccgcttcttcagcaccaacagcaacctgagcaagcacaagaagaagcacggggacaagaagtttgcctgtgaggtgtgcagcaagatgttctacaggaaggatgtgatgctggaccaccagaggaggcacctggagggcgtgcggcgggtgaagcgggaggacctggaggccggcggggagaacctggtgcgctacaagaaggagcccagcggctgccctgtgtgtgggaaggtgttcagctgccgcagcaacatgaacaagcacctgctgacccacggggacaagaagtacacctgtgagatctgtggcaggaagttcttccgggtggatgtgctgcgggaccacatccacgtgcacttcaaggacatcgccctgatggatgaccaccagcgggaggagttcatcggcaagattggcatcagcagcgaggagaatgatgacaacagtgatgagagcgctgacagcgagccccacaagtacagctgcaagcgctgccagctgaccttcggccggggcaaggagtacctgaagcacatcatggaggtgcacaaggagaagggctacggctgcagcatctgcaacagaagatttgccctgaaggccacctaccacgcccacatggtgatccaccgggagaacctgcctgaccccaacgtgcagaagtacatccacccctgtgagatctgtggccgcatcttcaacagcatcggcaacctggagcggcacaagctgatccacactggagtgaagagccacgcctgtgagcagtgtgggaagagctttgccaggaaggacatgctgaaggagcacatgagggtgcatgacaacgtgcgggagtacctgtgtgccgagtgtgggaagggcatgaagaccaagcacgccctgcggcaccacatgaagctgcacaagggcatcaaggagtatgagtgcaaggagtgccacagaagatttgcccagaaggtgaacatgctgaagcactgcaagaggcacacaggcatcaaggacttcatgtgtgagctgtgtgggaagaccttcagcgagaggaacaccatggagacccacaagctgatccacacagtgggcaagcagtggacctgcagcgtgtgtgacaagaagtatgtgacagagtacatgctgcagaagcacgtgcagctgacccatgacaaggtggaggcccagagctgccagctgtgtggcaccaaggtgtccacccgggcctccatgagccgccacatgaggaggaagcaccctgaggtgctggccgtgagaattgatgacctggaccacctgcctgagaccaccaccattgatgccagcagcattggaattgtgcagcctgagctgaccctggagcaggaggacctggccgagggcaagcacggcaaggccgccaagaggagccacaagaggaagcagaagccagaggaggaggccggggcccctgtgcctgaagatgccaccttcagcgagtacagcgagaaggagacagagttcaccggctctgtgggagatgagaccaacagcgctgtgcagagcatccagcaggtggtggtgaccctgggggaccccaacgtgaccacccccagcagctctgtgggcctgaccaacatcaccgtgacccccatcaccacagctgctgccacccagttcaccaacctgcagcctgtggccgtgggccacctgaccaccccagagcggcagctgcagctggacaacagcatcctgactgtgacctttgacacagtgtctggcagcgccatgctgcacaaccggcagaatgatgtgcagatccacccccagcctgaggccagcaacccccagagcgtggcccacttcatcaacctgaccaccctggtgaacagcatcacccccctgggcagccagctgagtgaccagcaccccctgacctggagggctgtgccccagacagatgtgctgccccccagccagccccaggccccaccccagcaggccgcccagccccaggtgcaggccgagcagcagcagcagcagatgtacagctactag

SEQ ID NO: 16549 - DNA, 1557 bp, Artificial Sequence
  Description of Artificial Sequence: Synthetic coding sequence
atggctgaagatggcagcgaggagatcatgttcatctggtgtgaggactgcagccagtaccatgattctgagtgcccagagctgggccctgtggtgatggtgaaggacagctttgtgctgagccgggcccggagcagcctgccccccaacctggagatccggcggctggaggatggagctgagggcgtgtttgccatcacccagctggtgaagaggacccagtttggcccctttgagagcagaagagtggccaagtgggagaaggagagcgccttccccctgaaggtgttccagaaggatggccaccctgtgtgctttgacaccagcaatgaagatgactgcaactggatgatgctggtgcggcctgctgctgaggccgagcaccagaacctgacagcctaccagcacggcagtgatgtgtacttcaccaccagccgggacatccccccaggcacagagctgcgggtgtggtatgctgccttctacgccaagaagatggacaagcccatgctgaagcaggccggcagcggcgtgcacgccgccggcaccccagaaaattctgcccctgtggagagcgagcccagccagtgggcctgcaaggtgtgcagcgccaccttcctggagctgcagctgctgaatgagcacctgctgggccacctggagcaggccaagagcctgcccccaggcagccagagcgaggccgccgcccctgagaaggagcaggacaccccaagaggagagcccccagctgtgcctgagagtgaaaatgtggccaccaaggagcagaagaagaagccccggcggggcaggaagcccaaggtgtccaaggccgagcagcccctggtgattgtggaggacaaggagcccacagagcaggtggccgagatcatcacagaggtgcccccagatgagcctgtgtctgccaccccagatgagcgcatcatggagctggtgctgggcaagctggccaccaccaccacagacaccagctctgtgcccaagttcacccaccaccagaacaacaccatcaccctgaagaggagcctcatcctgagcagcagacatggcatccggaggaagctgatcaagcagctgggggagcacaagagggtgtaccagtgcaacatctgcagcaagatcttccagaacagcagcaacctgagccgccacgtgcgcagccacggggacaagctgttcaagtgtgaagaatgtgccaagctgttcagcaggaaggagagcctgaagcagcacgtgtcctacaagcacagcagaaatgaggtggatggagagtaccgctaccgctgtggcacctgtgagaagaccttccgcatcgagagcgccctggagttccacaactgcaggacaggcctcatcgcccaccctggagagggcggccctgggggcagccggctgcgggacctgcctgccaccagccccagcacccggcgcagcacagccaccaggagcctgcctgtgcgctctgctgcccgctgcagcacagcccggaccagctgctggaccaccagcgctggcacctggaagacctgtgccgcctag

SEQ ID NO: 16550 - DNA, 3537 bp, Artificial Sequence
  Description of Artificial Sequence: Synthetic coding sequence
atgccccggcggcggcccccagccagcggggccgcccagtttcctgagcgcatcgccaccaggagcccagaccccatccccctgtgcaccttccagaggcaggtgtctgagatggccgaggatggcagcgaggagatcatgttcatctggtgtgaggactgcagccagtaccatgacagtgaatgtcctgagctgggccctgtggtgatggtgaaggacagctttgtgctgagccgggcccggagcagcctgccccccaacctggagatccggcggctggaggatggagctgagggcgtgtttgccatcacccagctggtgaagaggacccagtttggcccctttgagagccggcgggtggccaagtgggagaaggagagcgccttccccctgaaggtgttccagaaggatggccaccctgtgtgctttgacaccagcaatgaagatgactgcaactggatgatgctggtgcggcctgctgctgaggccgagcaccagaacctgacagcctaccagcacggcagtgatgtgtacttcaccaccagccgggacatccccccaggcacagagctgcgggtgtggtacgccgccttctacgccaagaagatggacaagcccatgctgaagcaggccggcagcggcgtgcatgctgctggcaccccagagaacagcgcccctgtggagagcgagcccagccagtgggcctgcaaggtgtgcagcgccaccttcctggagctgcagctgctgaatgagcacctgctgggccacctggagcaggccaagagcctgcccccaggcagccagagcgaggccgccgcccctgagaaggagcaggacaccccaagaggagagcccccagctgtgcctgagagtgaaaatgtggccaccaaggagcagaagaagaagccccggcggggcaggaagcccaaggtgtccaaggccgagcagcccctggtgattgtggaggacaaggagcccacagagcaggtggccgagatcatcacagaggtgcccccagatgagcctgtgtctgccaccccagatgagcgcatcatggagctggtgctgggcaagctggccaccaccaccacagacaccagctctgtgcccaagttcacccaccaccagaacaacaccatcaccctgaagaggagcctcatcctgagcagccgccacggcatccggaggaagctgatcaagcagctgggggagcacaagagggtgtaccagtgcaacatctgcagcaagatcttccagaacagcagcaacctgagcagacatgtgcgcagccatggagacaagctgttcaagtgtgaggagtgtgccaagctgttcagcaggaaggagagcctgaagcagcacgtgtcctacaagcacagcagaaatgaggtggatggagagtaccgctaccgctgtggcacctgtgagaagaccttcagaattgaaagtgccctggagttccacaactgcaggacagatgacaagaccttccagtgtgagatgtgcttccgcttcttcagcaccaacagcaacctgagcaagcacaagaagaagcatggagacaagaagtttgcctgtgaggtgtgcagcaagatgttctacaggaaggatgtgatgctggaccaccagaggaggcacctggagggcgtgagaagagtgaagcgggaggacctggaggccggaggagagaacctggtgcgctacaagaaggagcccagcggctgccctgtgtgtgggaaggtgttcagctgccgcagcaacatgaacaagcacctgctgacccatggagacaagaagtacacctgtgagatctgtggcaggaagttcttccgggtggatgtgctgcgggaccacatccacgtgcacttcaaggacatcgccctgatggatgaccaccagcgggaggagttcatcggcaagattggcatcagcagtgaagaaaatgatgacaacagtgatgaatctgctgacagcgagccccacaagtacagctgcaagcgctgccagctgaccttcggccggggcaaggagtacctgaagcacatcatggaggtgcacaaggagaagggctacggctgcagcatctgcaacagaagatttgccctgaaggccacctaccacgcccacatggtgatccaccgggagaacctgcctgaccccaacgtgcagaagtacatccacccctgtgagatctgtggccgcatcttcaacagcatcggcaacctggagcggcacaagctgatccacactggagtgaagagccacgcctgtgagcagtgtgggaagagctttgccaggaaggacatgctgaaggagcacatgagggtgcatgacaacgtgcgggagtacctgtgtgctgaatgtgggaagggcatgaagaccaagcacgccctgcggcaccacatgaagctgcacaagggcatcaaggagtatgagtgcaaggagtgccacagaagatttgcccagaaggtgaacatgctgaagcactgcaagaggcacacaggcatcaaggacttcatgtgtgagctgtgtgggaagaccttcagcgagaggaacaccatggagacccacaagctgatccacacagtgggcaagcagtggacctgcagcgtgtgtgacaagaagtatgtgacagagtacatgctgcagaagcacgtgcagctgacccatgacaaggtggaggcccagagctgccagctgtgtggcaccaaggtgtccacccgggcctccatgagccgccacatgaggaggaagcaccctgaggtgctggccgtgagaattgatgacctggaccacctgcctgagaccaccaccattgatgccagcagcatcggcatcgtgcagcctgagctgaccctggagcaggaggacctggccgagggcaagcacggcaaggccgccaagaggagccacaagaggaagcagaagccagaggaggaggccggggcccctgtgcctgaagatgccaccttcagcgagtacagcgagaaggagacagagttcaccggctctgtgggagatgagaccaacagcgctgtgcagagcatccagcaggtggtggtgaccctgggggaccccaacgtgaccacccccagcagctctgtgggcctgaccaacatcaccgtgacccccatcaccacagctgctgccacccagttcaccaacctgcagcctgtggccgtgggccacctgaccaccccagagcggcagctgcagctggacaacagcatcctgactgtgacctttgacacagtgtctggcagcgccatgctgcacaaccggcagaatgatgtgcagatccacccccagcctgaggccagcaacccccagagcgtggcccacttcatcaacctgaccaccctggtgaacagcatcacccccctgggcagccagctgagtgaccagcaccccctgacctggagggctgtgccccagacagatgtgctgccccccagccagccccaggccccaccccagcaggccgcccagccccaggtgcaggccgagcagcagcagcagcagatgtacagctactag

SEQ ID NO: 16551 - DNA, 4524 bp, Artificial Sequence; identical to SEQ ID NO: 16548
  Description of Artificial Sequence: Synthetic coding sequence

SEQ ID NO: 16552 - DNA, 1437 bp, Artificial Sequence
  Description of Artificial Sequence: Synthetic coding sequence
atggctgaagatggcagcgaggagatcatgttcatctggtgtgaggactgcagccagtaccatgattctgagtgcccagagctgggccctgtggtgatggtgaaggacagctttgtgctgagccgggcccggagcagcctgccccccaacctggagatccggcggctggaggatggagctgagggcgtgtttgccatcacccagctggtgaagaggacccagtttggcccctttgagagcagaagagtggccaagtgggagaaggagagcgccttccccctgaaggtgttccagaaggatggccaccctgtgtgctttgacaccagcaatgaagatgactgcaactggatgatgctggtgcggcctgctgctgaggccgagcaccagaacctgacagcctaccagcacggcagtgatgtgtacttcaccaccagccgggacatccccccaggcacagagctgcgggtgtggtatgctgccttctacgccaagaagatggacaagcccatgctgaagcaggccggcagcggcgtgcacgccgccggcaccccagaaaattctgcccctgtggagagcgagcccagccagtgggcctgcaaggtgtgcagcgccaccttcctggagctgcagctgctgaatgagcacctgctgggccacctggagcaggccaagagcctgcccccaggcagccagagcgaggccgccgcccctgagaaggagcaggacaccccaagaggagagcccccagctgtgcctgagagtgaaaatgtggccaccaaggagcagaagaagaagccccggcggggcaggaagcccaaggtgtccaaggccgagcagcccctggtgattgtggaggacaaggagcccacagagcaggtggccgagatcatcacagaggtgcccccagatgagcctgtgtctgccaccccagatgagcgcatcatggagctggtgctgggcaagctggccaccaccaccacagacaccagctctgtgcccaagcacggcatccggaggaagctgatcaagcagctgggggagcacaagagggtgtaccagtgcaacatctgcagcaagatcttccagaacagcagcaacctgagccgccacgtgcgcagccacggggacaagctgttcaagtgtgaagaatgtgccaagctgttcagcaggaaggagagcctgaagcagcacgtgtcctacaagcacagcagaaatgaggtggatggagagtaccgctaccgctgtggcacctgtgagaagaccttccgcatcgagagcgccctggagttccacaactgcaggacagccaccagccccagcacccggcgcagcacagccaccaggagcctgcctgtgcgctctgctgcccgctgcagcacagcccggaccagctgctggaccaccagcgctggcacctggaaggaatgtggggagtag

SEQ ID NO: 16553 - DNA, 3426 bp, Artificial Sequence
  Description of Artificial Sequence: Synthetic coding sequence
atggctgaagatggcagcgaggagatcatgttcatctggtgtgaggactgcagccagtaccatgattctgagtgcccagagctgggccctgtggtgatggtgaaggacagctttgtgctgagccgggcccggagcagcctgccccccaacctggagatccggcggctggaggatggagctgagggcgtgtttgccatcacccagctggtgaagaggacccagtttggcccctttgagagcagaagagtggccaagtgggagaaggagagcgccttccccctgaaggtgttccagaaggatggccaccctgtgtgctttgacaccagcaatgaagatgactgcaactggatgatgctggtgcggcctgctgctgaggccgagcaccagaacctgacagcctaccagcacggcagtgatgtgtacttcaccaccagccgggacatccccccaggcacagagctgcgggtgtggtatgctgccttctacgccaagaagatggacaagcccatgctgaagcaggccggcagcggcgtgcacgccgccggcaccccagaaaattctgcccctgtggagagcgagcccagccagtgggcctgcaaggtgtgcagcgccaccttcctggagctgcagctgctgaatgagcacctgctgggccacctggagcaggccaagagcctgcccccaggcagccagagcgaggccgccgcccctgagaaggagcaggacaccccaagaggagagcccccagctgtgcctgagagtgaaaatgtggccaccaaggagcagaagaagaagccccggcggggcaggaagcccaaggtgtccaaggccgagcagcccctggtgattgtggaggacaaggagcccacagagcaggtggccgagatcatcacagaggtgcccccagatgagcctgtgtctgccaccccagatgagcgcatcatggagctggtgctgggcaagctggccaccaccaccacagacaccagctctgtgcccaagttcacccaccaccagaacaacaccatcaccctgaagaggagcctcatcctgagcagcagacatggcatccggaggaagctgatcaagcagctgggggagcacaagagggtgtaccagtgcaacatctgcagcaagatcttccagaacagcagcaacctgagccgccacgtgcgcagccacggggacaagctgttcaagtgtgaagaatgtgccaagctgttcagcaggaaggagagcctgaagcagcacgtgtcctacaagcacagcagaaatgaggtggatggagagtaccgctaccgctgtggcacctgtgagaagaccttccgcatcgagagcgccctggagttccacaactgcaggacagatgacaagaccttccagtgtgagatgtgcttccgcttcttcagcaccaacagcaacctgagcaagcacaagaagaagcacggggacaagaagtttgcctgtgaggtgtgcagcaagatgttctacaggaaggatgtgatgctggaccaccagaggaggcacctggagggcgtgcggcgggtgaagcgggaggacctggaggccggcggggagaacctggtgcgctacaagaaggagcccagcggctgccctgtgtgtgggaaggtgttcagctgccgcagcaacatgaacaagcacctgctgacccacggggacaagaagtacacctgtgagatctgtggcaggaagttcttccgggtggatgtgctgcgggaccacatccacgtgcacttcaaggacatcgccctgatggatgaccaccagcgggaggagttcatcggcaagattggcatcagcagcgaggagaatgatgacaacagtgatgagagcgctgacagcgagccccacaagtacagctgcaagcgctgccagctgaccttcggccggggcaaggagtacctgaagcacatcatggaggtgcacaaggagaagggctacggctgcagcatctgcaacagaagatttgccctgaaggccacctaccacgcccacatggtgatccaccgggagaacctgcctgaccccaacgtgcagaagtacatccacccctgtgagatctgtggccgcatcttcaacagcatcggcaacctggagcggcacaagctgatccacactggagtgaagagccacgcctgtgagcagtgtgggaagagctttgccaggaaggacatgctgaaggagcacatgagggtgcatgacaacgtgcgggagtacctgtgtgccgagtgtgggaagggcatgaagaccaagcacgccctgcggcaccacatgaagctgcacaagggcatcaaggagtatgagtgcaaggagtgccacagaagatttgcccagaaggtgaacatgctgaagcactgcaagaggcacacaggcatcaaggacttcatgtgtgagctgtgtgggaagaccttcagcgagaggaacaccatggagacccacaagctgatccacacagtgggcaagcagtggacctgcagcgtgtgtgacaagaagtatgtgacagagtacatgctgcagaagcacgtgcagctgacccatgacaaggtggaggcccagagctgccagctgtgtggcaccaaggtgtccacccgggcctccatgagccgccacatgaggaggaagcaccctgaggtgctggccgtgagaattgatgacctggaccacctgcctgagaccaccaccattgatgccagcagcattggaattgtgcagcctgagctgaccctggagcaggaggacctggccgagggcaagcacggcaaggccgccaagaggagccacaagaggaagcagaagccagaggaggaggccggggcccctgtgcctgaagatgccaccttcagcgagtacagcgagaaggagacagagttcaccggctctgtgggagatgagaccaacagcgctgtgcagagcatccagcaggtggtggtgaccctgggggaccccaacgtgaccacccccagcagctctgtgggcctgaccaacatcaccgtgacccccatcaccacagctgctgccacccagttcaccaacctgcagcctgtggccgtgggccacctgaccaccccagagcggcagctgcagctggacaacagcatcctgactgtgacctttgacacagtgtctggcagcgccatgctgcacaaccggcagaatgatgtgcagatccacccccagcctgaggccagcaacccccagagcgtggcccacttcatcaacctgaccaccctggtgaacagcatcacccccctgggcagccagctgagtgaccagcaccccctgacctggagggctgtgccccagacagatgtgctgccccccagccagccccaggccccaccccagcaggccgcccagccccaggtgcaggccgagcagcagcagcagcagatgtacagctactag

SEQ ID NO: 16554 - DNA, 1668 bp, Artificial Sequence
  Description of Artificial Sequence: Synthetic coding sequence
atgccccggcggcggcccccagccagcggggccgcccagtttcctgagcgcatcgccaccaggagcccagaccccatccccctgtgcaccttccagaggcaggtgtctgagatggccgaggatggcagcgaggagatcatgttcatctggtgtgaggactgcagccagtaccatgacagtgaatgtcctgagctgggccctgtggtgatggtgaaggacagctttgtgctgagccgggcccggagcagcctgccccccaacctggagatccggcggctggaggatggagctgagggcgtgtttgccatcacccagctggtgaagaggacccagtttggcccctttgagagccggcgggtggccaagtgggagaaggagagcgccttccccctgaaggtgttccagaaggatggccaccctgtgtgctttgacaccagcaatgaagatgactgcaactggatgatgctggtgcggcctgctgctgaggccgagcaccagaacctgacagcctaccagcacggcagtgatgtgtacttcaccaccagccgggacatccccccaggcacagagctgcgggtgtggtacgccgccttctacgccaagaagatggacaagcccatgctgaagcaggccggcagcggcgtgcatgctgctggcaccccagagaacagcgcccctgtggagagcgagcccagccagtgggcctgcaaggtgtgcagcgccaccttcctggagctgcagctgctgaatgagcacctgctgggccacctggagcaggccaagagcctgcccccaggcagccagagcgaggccgccgcccctgagaaggagcaggacaccccaagaggagagcccccagctgtgcctgagagtgaaaatgtggccaccaaggagcagaagaagaagccccggcggggcaggaagcccaaggtgtccaaggccgagcagcccctggtgattgtggaggacaaggagcccacagagcaggtggccgagatcatcacagaggtgcccccagatgagcctgtgtctgccaccccagatgagcgcatcatggagctggtgctgggcaagctggccaccaccaccacagacaccagctctgtgcccaagttcacccaccaccagaacaacaccatcaccctgaagaggagcctcatcctgagcagccgccacggcatccggaggaagctgatcaagcagctgggggagcacaagagggtgtaccagtgcaacatctgcagcaagatcttccagaacagcagcaacctgagcagacatgtgcgcagccatggagacaagctgttcaagtgtgaggagtgtgccaagctgttcagcaggaaggagagcctgaagcagcacgtgtcctacaagcacagcagaaatgaggtggatggagagtaccgctaccgctgtggcacctgtgagaagaccttcagaattgaaagtgccctggagttccacaactgcaggacaggcctgattgcccaccctggagagggcggccctgggggcagccggctgcgggacctgcctgccaccagccccagcaccaggaggagcacagccaccaggagcctgcctgtgcgctctgctgcccgctgcagcacagcccggaccagctgctggaccaccagcgctggcacctggaaggaatgtggggagtag

SEQ ID NO: 16555 - DNA, 3486 bp, Artificial Sequence
  Description of Artificial Sequence: Synthetic coding sequence
atggctgaagatggcagcgaggagatcatgttcatctggtgtgaggactgcagccagtaccatgattctgagtgcccagagctgggccctgtggtgatggtgaaggacagctttgtgctgagccgggcccggagcagcctgccccccaacctggagatccggcggctggaggatggagctgagggcgtgtttgccatcacccagctggtgaagaggacccagtttggcccctttgagagcagaagagtggccaagtgggagaaggagagcgccttccccctgaaggtgttccagaaggatggccaccctgtgtgctttgacaccagcaatgaagatgactgcaactggatgatgctggtgcggcctgctgctgaggccgagcaccagaacctgacagcctaccagcacggcagtgatgtgtacttcaccaccagccgggacatccccccaggcacagagctgcgggtgtggtatgctgccttctacgccaagaagatggacaagcccatgctgaagcaggccggcagcggcgtgcacgccgccggcaccccagaaaattctgcccctgtggagagcgagcccagccagtgggcctgcaaggtgtgcagcgccaccttcctggagctgcagctgctgaatgagcacctgctgggccacctggagcaggccaagagcctgcccccaggcagccagagcgaggccgccgcccctgagaaggagcaggacaccccaagaggagagcccccagctgtgcctgagagtgaaaatgtggccaccaaggagcagaagaagaagccccggcggggcaggaagcccaaggtgtccaaggccgagcagcccctggtgattgtggaggacaaggagcccacagagcaggtggccgagatcatcacagaggtgcccccagatgagcctgtgtctgccaccccagatgagcgcatcatggagctggtgctgggcaagctggccaccaccaccacagacaccagctctgtgcccaagttcacccaccaccagaacaacaccatcaccctgaagaggagcctcatcctgagcagcagacatggcatccggaggaagctgatcaagcagctgggggagcacaagagggtgtaccagtgcaacatctgcagcaagatcttccagaacagcagcaacctgagccgccacgtgcgcagccacggggacaagctgttcaagtgtgaagaatgtgccaagctgttcagcaggaaggagagcctgaagcagcacgtgtcctacaagcacagcagaaatgaggtggatggagagtaccgctaccgctgtggcacctgtgagaagaccttccgcatcgagagcgccctggagttccacaactgcaggacaggcctcatcgcccaccctggagagggcggccctgggggcagccggctgcgggacctgcctgatgacaagaccttccagtgtgagatgtgcttccgcttcttcagcaccaacagcaacctgagcaagcacaagaagaagcacggggacaagaagtttgcctgtgaggtgtgcagcaagatgttctacaggaaggatgtgatgctggaccaccagaggaggcacctggagggcgtgcggcgggtgaagcgggaggacctggaggccggcggggagaacctggtgcgctacaagaaggagcccagcggctgccctgtgtgtgggaaggtgttcagctgccgcagcaacatgaacaagcacctgctgacccacggggacaagaagtacacctgtgagatctgtggcaggaagttcttccgggtggatgtgctgcgggaccacatccacgtgcacttcaaggacatcgccctgatggatgaccaccagcgggaggagttcatcggcaagattggcatcagcagcgaggagaatgatgacaacagtgatgagagcgctgacagcgagccccacaagtacagctgcaagcgctgccagctgaccttcggccggggcaaggagtacctgaagcacatcatggaggtgcacaaggagaagggctacggctgcagcatctgcaacagaagatttgccctgaaggccacctaccacgcccacatggtgatccaccgggagaacctgcctgaccccaacgtgcagaagtacatccacccctgtgagatctgtggccgcatcttcaacagcatcggcaacctggagcggcacaagctgatccacactggagtgaagagccacgcctgtgagcagtgtgggaagagctttgccaggaaggacatgctgaaggagcacatgagggtgcatgacaacgtgcgggagtacctgtgtgccgagtgtgggaagggcatgaagaccaagcacgccctgcggcaccacatgaagctgcacaagggcatcaaggagtatgagtgcaaggagtgccacagaagatttgcccagaaggtgaacatgctgaagcactgcaagaggcacacaggcatcaaggacttcatgtgtgagctgtgtgggaagaccttcagcgagaggaacaccatggagacccacaagctgatccacacagtgggcaagcagtggacctgcagcgtgtgtgacaagaagtatgtgacagagtacatgctgcagaagcacgtgcagctgacccatgacaaggtggaggcccagagctgccagctgtgtggcaccaaggtgtccacccgggcctccatgagccgccacatgaggaggaagcaccctgaggtgctggccgtgagaattgatgacctggaccacctgcctgagaccaccaccattgatgccagcagcattggaattgtgcagcctgagctgaccctggagcaggaggacctggccgagggcaagcacggcaaggccgccaagaggagccacaagaggaagcagaagccagaggaggaggccggggcccctgtgcctgaagatgccaccttcagcgagtacagcgagaaggagacagagttcaccggctctgtgggagatgagaccaacagcgctgtgcagagcatccagcaggtggtggtgaccctgggggaccccaacgtgaccacccccagcagctctgtgggcctgaccaacatcaccgtgacccccatcaccacagctgctgccacccagttcaccaacctgcagcctgtggccgtgggccacctgaccaccccagagcggcagctgcagctggacaacagcatcctgactgtgacctttgacacagtgtctggcagcgccatgctgcacaaccggcagaatgatgtgcagatccacccccagcctgaggccagcaacccccagagcgtggcccacttcatcaacctgaccaccctggtgaacagcatcacccccctgggcagccagctgagtgaccagcaccccctgacctggagggctgtgccccagacagatgtgctgccccccagccagccccaggccccaccccagcaggccgcccagccccaggtgcaggccgagcagcagcagcagcagatgtacagctactag

SEQ ID NO: 16556 - DNA, 1788 bp, Artificial Sequence
  Description of Artificial Sequence: Synthetic coding sequence
atgctgaagccaggggaccccggcggcagcgccttcctgaaggtggaccctgcctacctgcagcactggcagcagctgttcccccatggaggagctggccccctgaagggcagcggggctgctggcctgctgagcgccccccagcccctgcagcccccacctcctcctcctcctcctgagcgggcagagcccccaccagacagcctgcggcccaggcctgccagcctgagcagcgccagcagcaccccagccagcagcagcaccagcgccagcagcgccagcagctgtgccgctgctgctgctgctgctgccctggccggcctgagcgccctgcctgtgtcccagctgcctgtgtttgcccccctggccgctgctgctgtggccgctgagcccctgccccccaaggagctgtgcctgggcgccaccagcggccctggccctgtgaagtgtggcggcggcggcggcggcggcggggagggccgcggggccccccgcttccgctgcagcgctgaggagctggactactacctgtatggccagcagaggatggagatcatccccctgaaccagcacaccagtgaccccaacaacagatgtgacatgtgtgccgacaacagaaatggagaatgtcccatgcacggccccctgcacagcctgcggcggctggtgggcaccagcagcgctgctgctgctgcccctcctcctgagctgcctgagtggctgcgggacctgccccgggaggtgtgcctgtgcaccagcacagtgcccggcctggcctacggcatctgtgccgcccagaggatccagcagggcacctggattggccccttccagggcgtgctgctgcccccagagaaggtgcaggccggggctgtgaggaacacccagcacctgtgggagatctatgaccaggacggcaccctgcagcacttcattgatggaggagagcccagcaagagctcctggatgagatacatccgctgtgcccggcactgtggggagcagaacctgactgtggtgcagtaccgcagcaacatcttctaccgggcctgcatcgacatcccccggggcacagagctgctggtgtggtacaatgacagctacaccagcttcttcggcatccccctgcagtgcatcgcccaggatgagaacctgaatgtgcccagcacagtgatggaggccatgtgccggcaggatgccctgcagcccttcaacaagagcagcaagctggcccccaccacccagcagaggtctgtggtgttcccccagaccccctgcagcaggaacttcagcctgctggacaagagcggccccattgaaagtggcttcaaccagatcaacgtgaagaaccagagggtgctggccagccccaccagcaccagccagctgcacagcgagttcagtgactggcacctgtggaagtgtggccagtgcttcaagaccttcacccagaggatcctgctgcagatgcacgtgtgcacccagaacccagaccggccctaccagtgtggccactgcagccagagcttcagccagcccagcgagctgagaaatcatgtggtgacccacagcagtgaccggcccttcaagtgtggctactgcggccgggcctttgctggggccaccaccctgaacaaccacatccgcacccacactggagagaagcccttcaagtgtgagcgctgtgagaggagcttcacccaggccacccagctgagccgccaccagaggatgcccaatgaatgcaagcccatcacagagagccctgagagcattgaggtggactag

SEQ ID NO: 16557 - DNA, 516 bp, Artificial Sequence
  Description of Artificial Sequence: Synthetic coding sequence
atgtgccagaacttcttcatcgacagctgtgccgcccacggcccccccacctttgtgaaggacagcgctgtggacaagggccaccccaacagaagtgccctgagcctgcccccaggcctgcgcatcggccccagcggcatcccccaggccggcctgggcgtgtggaatgaggccagtgacctgcccctgggcctgcacttcggcccctatgagggccgcatcacagaagatgaggaggccgccaacagcggctacagctggctgatcaccaagggcaggaactgctatgaatatgtggatggcaaggacaagagcagcgccaactggatgaggaccaaggcccgggaccccagcatgagcctgatgctgagcggcctcttcaagagcaagatcagccagagcacctgtggcacccagagcctgctgtctgagctgcccaggaccatctgcaagaagaccagccccacccgggagagcctgccccggggcagcgagagcggggccgccatcttctag

SEQ ID NO: 16558 - DNA, 516 bp, Artificial Sequence; identical to SEQ ID NO: 16557
  Description of Artificial Sequence: Synthetic coding sequence

SEQ ID NO: 16559 - DNA, 417 bp, Artificial Sequence
  Description of Artificial Sequence: Synthetic coding sequence
atgagccctgagaggagccaggaggagagccctgagggggacacagagaggacagagaggaagcccatggtgaaggatgccttcaaggacatcagcatctacttcaccaaggaggagtgggccgagatgggagactgggagaagacccgctacagaaatgtgaagatgaactacaatgccctgatcaccgtgggcctgcgggccaccaggcctgccttcatgtgccaccggcggcaggccatcaagctgcaggtggatgacacagaagattctgatgaggagtggaccccccggcagcaggtgaagccaccctggatggccttccggggggagcagagcaagcaccagaagatcgtgcgctgtgtgaggaccagcagcctgacagctgtgctgctgatgggccccctgcacctgtag

SEQ ID NO: 16560 - DNA, 1479 bp, Artificial Sequence
  Description of Artificial Sequence: Synthetic coding sequence
atgagccctgagaggagccaggaggagagccctgagggggacacagagaggacagagaggaagcccatggtgaaggatgccttcaaggacatcagcatctacttcaccaaggaggagtgggccgagatgggagactgggagaagacccgctacagaaatgtgaagatgaactacaatgccctgatcaccgtgggcctgcgggccaccaggcctgccttcatgtgccaccggcggcaggccatcaagctgcaggtggatgacacagaagattctgatgaggagtggaccccccggcagcaggtgaagccaccctggatggccttccggggggagcagagcaagcaccagaagggcatgcccaaggccagcttcaacaatgaaagcagcctgcgggagctgagcggcacccccaacctgctgaacaccagtgacagcgagcaggcccagaagcctgtgagccccccaggagaggccagcaccagcggccagcacagccggctgaagctggagctgcggaggaaggagacagagggcaagatgtacagcctgcgggagaggaaaggacatgcctacaaggagatcagcgagccccaggatgatgactacctgtactgtgagatgtgccagaacttcttcatcgacagctgtgccgcccacggcccccccacctttgtgaaggacagcgctgtggacaagggccaccccaacagaagtgccctgagcctgcccccaggcctgcgcatcggccccagcggcatcccccaggccggcctgggcgtgtggaatgaggccagtgacctgcccctgggcctgcacttcggcccctatgagggccgcatcacagaagatgaggaggccgccaacagcggctacagctggctgatcaccaagggcaggaactgctatgaatatgtggatggcaaggacaagagcagcgccaactggatgagatatgtgaactgtgccagagatgatgaggagcagaacctggtggccttccagtaccaccggcagatcttctaccgcacctgcagggtcatccggcccggctgtgagctgctggtgtggagcggagatgaatatggccaggagctgggcatccgcagcagcattgagcctgctgagagcctgggccaggccgtgaactgctggagcggcatgggcatgtccatggccaggaactgggccagcagcggggccgccagcggcaggaagagctcctggcagggcgagaaccagagccagaggagcatccacgtgccccatgctgtgtggcccttccaggtgaagaacttctctgtgaacatgtggaatgccatcacccccctgcggaccagccaggaccacctgcaggagaacttcagcaaccagaggatcccagcccagggcatccgcatccgcagcggcaacatcctgattcatgctgctgtgatgaccaagcccaaggtgaagaggagcaagaagggccccaacagctag

SEQ ID NO: 16561 - DNA, 2070 bp, Artificial Sequence
  Description of Artificial Sequence: Synthetic coding sequence
atggaggacaccggcatccagaggggcatctgggatggagatgccaaggctgtgcagcagtgcctgacagacatcttcacctctgtgtacaccacctgtgacatcccagaaaatgccatcttcggcccctgtgtgctgagccacaccagcctgtatgacagcatcgccttcatcgccctgaagagcacagacaagaggacagtgccctacatcttccgggtggacaccagcgctgccaacggcagcagcgagggcctgatgtggctgcggctggtgcagagcgcccgggacaaggaggagcagaacctggaggcctacatcaagaatggccagctgttctaccgcagcctgcggcgcatcgccaaggatgaggagctgctggtgtggtacggcaaggagctgacagagctgctgctgctgtgccccagccgcagccacaacaagatgaatggcagcagcccctacacctgcctggagtgcagccagcgcttccagtttgagttcccctacgtggcccacctgcgcttccgctgccccaagaggctgcacagcgctgacatcagcccccaggatgagcagggcggcggcgtgggcaccaaggaccacggcggcggcggcggcggcggcaaggaccagcagcagcagcagcaggaggcccccctgggccctggccccaagttctgcaaggccggccccctgcaccactaccccagccccagccctgagagcagcaaccccagcgctgctgctgggggcagcagcgccaagcccagcacagacttccacaacctggcccgggagctggagaacagcagaggaggcagcagctgcagccctgcccagagcctgagcagcggcagcggcagcggcggcggcggcggccaccaggaggccgagctgagcccagatggcatcgccactggaggcggcaagggcaagaggaagtttcctgaggaggccgctgagggcggcggcggggccggcctggtgggcggccggggccgctttgtggagcggcccctgcctgccagcaaggaggacctggtgtgcaccccccagcagtaccgggccagcggcagctacttcggcctggaggagaatggccgcctgtttgccccacccagccctgagaccggggaggccaagaggtctgcctttgtggaggtgaagaaggccgcccgggccgccagcctgcaggaggagggcacagcagatggagctggggtggccagcgaggaccaggatgctgggggcggcggcggcagcagcaccccagctgctgccagccctgtgggcgctgagaagctgctggcccccaggcctgggggccccctgcccagccggctggagggcggcagccctgcccggggcagcgccttcacctctgtgccccagctgggcagcgctggcagcaccagcggcggcggcggcaccggggccggggctgctggaggagctgggggcggccagggcgccgccagtgatgagaggaagagcgccttcagccagcctgcccgctccttcagccagctgagccccctggtgctgggccagaagctgggcgccctggagccctgccacccagcagatggagtgggccccacccggctgtacccagctgctgctgaccccctggccgtgaagctgcagggcgctgctgacctgaatggaggctgcggcagcctgcccagcggcggcggcggcctgcccaagcagagccccttcctgtatgccacagccttctggcccaagagcagcgctgctgctgctgctgctgctgctgctgctgctgctggccccctgcagctgcagctgcccagcgccctgaccctgctgcccccatccttcaccagcctgtgcctgcctgcccagaactggtgtgccaagtgcaatgccagcttcaggatgaccagtgacctggtgtaccacatgaggagccaccacaagaaggagtatgccatggagcccctggtgaagagaagaagagaggagaagctgaagtgccccatctgcaatgaaagcttccgggagcggcaccacctgagccgccacatgaccagccacaactag

SEQ ID NO: 16562 - DNA, 2070 bp, Artificial Sequence; identical to SEQ ID NO: 16561
  Description of Artificial Sequence: Synthetic coding sequence

SEQ ID NO: 16563 - DNA, 2070 bp, Artificial Sequence; identical to SEQ ID NO: 16561
  Description of Artificial Sequence: Synthetic coding sequence

SEQ ID NO: 16564 - DNA, 1287 bp, Artificial Sequence
  Description of Artificial Sequence: Synthetic coding sequence
atggaggacaccggcatccagaggggcatctgggatggagatgccaaggctgtgcagcagtgcctgacagacatcttcacctctgtgtacaccacctgtgacatcccagaaaatgccatcttcggcccctgtgtgctgagccacaccagcctgtatgacagcatcgccttcatcgccctgaagagcacagacaagaggacagtgccctacatcttccgggtggacaccagcgctgccaacggcagcagcgagggcctgatgtggctgcggctggtgcagagcgcccgggacaaggaggagcagaacctggaggcctacatcaagaatggccagctgttctaccgcagcctgcggcgcatcgccaaggatgaggagctgctggtgtggtacggcaaggagctgacagagctgctgctgctgtgccccagccgcagccacaacaagatgaatggcagcagcccctacacctgcctggagtgcagccagcgcttccagtttgagttcccctacgtggcccacctgcgcttccgctgccccaagaggctgcacagcgctgacatcagcccccaggatgagcagggcggcggcgtgggcaccaaggaccacggcggcggcggcggcggcggcaaggaccagcagcagcagcagcaggaggcccccctgggccctggccccaagttctgcaaggccggccccctgcaccactaccccagccccagccctgagagcagcaaccccagcgctgctgctgggggcagcagcgccaagcccagcacagacttccacaacctggcccgggagctggagaacagcagaggaggcagcagctgcagccctgcccagagcctgagcagcggcagcggcagcggcggcggcggcggccaccaggaggccgagctgagcccagatggcatcgccactggaggcggcaagggcaagaggaagtttcctgaggaggccgctgagggcggcggcggggccggcctggtgggcggccggggccgctttgtggagcggcccctgcctgccagcaaggaggacctggtgtgcaccccccagcagtaccgggccagcggcagctacttcggcctggaggagaatggccgcctgtttgccccacccagccctgagaccggggaggccaagaggtctgcctttgtggaggtgaagaaggccgcccgggccgccagcctgcaggaggagggcacagcagatggagctggggtggccagcgaggaccaggatgctgggggcggcggcggcagcagcaccccagctgctgcctag

SEQ ID NO: 16565 - DNA, 1125 bp, Artificial Sequence
  Description of Artificial Sequence: Synthetic coding sequence
atggccgccccacccaggcctgcccccagccccccagccccccggcggctggacaccagtgatgtgctgcagcagatcatggccatcacagaccagagcctggatgaggcccaggccaggaagcacgccctgaactgccacaggatgaagccagccctcttctctgtgctgtgtgagatcaaggagaagacagtggtgtccatccggggcatccaggatgaggaccccccagatgcccagctgctgcggctggacaacatgctgctggccgagggcgtgtgcaggcctgagaagaggggccggggcggcgctgtggcccgggccggcacagccaccccaggcggctgccccaatgacaacagcattgagcacagcgactaccgggccaagctgagccagatccggcagatctaccacagcgagctggagaagtatgagcaggcctgccgggagttcaccacccacgtgaccaacctgctgcaggagcagagcaggatgaggcctgtgagccccaaggagattgaaagaatggtgggcgccatccacggcaagttcagcgccatccagatgcagctgaagcagagcacctgtgaggccgtgatgaccctgcggagccggctgctggatgcccggaggaagagaagaaacttcagcaagcaggccacagaggtgctgaatgagtacttctacagccacctgaacaacccctaccccagcgaggaggccaaggaggagctggccaggaaaggaggcctgaccatcagccaggtgagcaactggtttggaaacaagaggatccgctacaagaagaacatgggcaagttccaggaggaggccaccatctacacaggcaagacagctgtggacaccacagaggtgggcgtgcccggcaaccacgccagctgcctgagcacccccagcagcggcagcagcggccccttccccctgcccagcgctggagatgccttcctgaccctgcggaccctggccagcctgcagcccccacctgggggcggctgcctgcagagccaggcccagggctcctggcagggcgccaccccccagcctgccacagccagccctgctggggaccccggcagcatcaacagcagcaccagcaactag

SEQ ID NO: 16566 - DNA, 945 bp, Artificial Sequence
  Description of Artificial Sequence: Synthetic coding sequence
atgctggtgtctggaagaagaaggctgctgactgtgctgctgcaggcccagaagtggcccttccagcccagccgggacatgaggctggtgcagttccgggccccccacctggtgggcccccacctgggcctggagactggaaatggaggaggagtcatcaacctgaatgcctttgaccccaccctgcccaagaccatgacccagttcctggagcagggcgaggccaccctgtctgtggcccggcgggccctggccgcccagctgcctgtgctgcccaggtctgaggtgaccttcctggcccctgtgaccaggccagacaaggtggtgtgtgtgggcatgaactacgtggaccactgcaaggagcagaatgtgcctgtgcccaaggagcccatcatcttcagcaagtttgccagcagcatcgtgggcccctatgatgaggtggtgctgcccccccagagccaggaggtggactgggaggtggagctggccgtggtgattggcaagaagggcaagcacatcaaggccacagatgccatggcccacgtggccggcttcaccgtggcccatgatgtgtctgcccgggactggcagatgagaagaaatggcaagcagtggctgctgggcaagacctttgacaccttctgccccctgggccctgccctggtgaccaaggacagcgtggccgacccccacaacctgaagatctgctgccgggtgaatggagaggtggtgcagagcggcaacaccaaccagatggtgttcaagacagaagatctcatcgcctgggtgtcccagtttgtgaccttctacccaggagatgtgatcctgaccggcaccccacctggggtgggcgtcttcaggaagccccctgtgttcctgaagaagggagatgaggtgcagtgtgaaattgaggagctgggcgtcatcatcaacaaggtggtgtag

SEQ ID NO: 16567 - DNA, 1059 bp, Artificial Sequence
  Description of Artificial Sequence: Synthetic coding sequence
atgtctgtgcagaacagcggctggccccaccaggaggacagccccaagccccaggaccccggccccccagccaacagcgacagcgacagcggccacctgcccggggaggaccctgaggacacccacgcccagggccctgctgtgctgagcctgggcagcctgtgcctggacaccaaccaggcccccaactggacaggcctgcagaccctgctgcagcagctgcccccccaggacattgatgagcgctactgcctggccctgggggaggaggagagagctgagctgcagctgttctgtgcccggaggaagcaggaggccctgggccagggcgtggcccggctggtgctgcccaagctggagggccacacctgtgagaagtgccgggagctgctgaagccaggagaatatggagtgtttgctgcccgggccggggagcagcgctgctggcaccagccctgctttgcctgccaggcctgtggccaggccctgatcaacctgatctacttctaccatgatggccagctgtactgcggccgccaccacgccgagctgctgcggccccgctgcccagcctgtgaccagctgatcttctcctggcgctgcacagaggccgagggccagcgctggcatgagaaccacttctgctgccaggactgtgccggccccctgggcggcggccgctatgccctgcccggcggcagcccctgctgccccagctgctttgagaaccgctacagtgatgctggcagctcctgggccggggccctggagggccaggccttcctgggcgcccccccaccccaccccccagaccccagcctgggcgcccggagcagccaccgggccagcctggccggggccttccagggccccccagagcccaccccaagaagaggccggggctgtggggcccggctgcccccaagaagaggccgccgcacccccagcggcggcggcggcggcccctggaggggcctgtctgctgctgctgctgccaggacagcccagggcctgggcggggccggcggctgggccagcccccccctggccgctgtgtag

SEQ ID NO: 16568 - DNA, 939 bp, Artificial Sequence
  Description of Artificial Sequence: Synthetic coding sequence
atgagcccccagggccctgctgtgctgagcctgggcagcctgtgcctggacaccaaccaggcccccaactggacaggcctgcagaccctgctgcagcagctgcccccccaggacattgatgagcgctactgcctggccctgggggaggaggagagagctgagctgcagctgttctgtgcccggaggaagcaggaggccctgggccagggcgtggcccggctggtgctgcccaagctggagggccacacctgtgagaagtgccgggagctgctgaagccaggagaatatggagtgtttgctgcccgggccggggagcagcgctgctggcaccagccctgctttgcctgccaggcctgtggccaggccctgatcaacctgatctacttctaccatgatggccagctgtactgcggccgccaccacgccgagctgctgcggccccgctgcccagcctgtgaccagctgatcttctcctggcgctgcacagaggccgagggccagcgctggcatgagaaccacttctgctgccaggactgtgccggccccctgggcggcggccgctatgccctgcccggcggcagcccctgctgccccagctgctttgagaaccgctacagtgatgctggcagctcctgggccggggccctggagggccaggccttcctgggcgcccccccaccccaccccccagaccccagcctgggcgcccggagcagccaccgggccagcctggccggggccttccagggccccccagagcccaccccaagaagaggccggggctgtggggcccggctgcccccaagaagaggccgccgcacccccagcggcggcggcggcggcccctggaggggcctgtctgctgctgctgctgccaggacagcccagggcctgggcggggccggcggctgggccagcccccccctggccgctgtgtag

SEQ ID NO: 16569 - DNA, 1035 bp, Artificial Sequence
  Description of Artificial Sequence: Synthetic coding sequence
atgagcccccagggccctgctgtgctgagcctgggcagcctgtgcctggacaccaaccaggcccccaactggacaggcctgcagaccctgctgcagcagctgcccccccaggacattgatgagcgctactgcctggccctgggggaggaggagagagctgagctgcagctgttctgtgcccggaggaagcaggaggccctgggccagggcgtggcccggctggtgctgcccaagctggagggccacacctgtgagaagtgccgggagctgctgaagccaggagaatatggagtgtttgctgcccgggccggggagcagcgctgctggcaccagccctgctttgcctgccaggcctgtggccaggccctgatcaacctgatctacttctaccatgatggccagctgtactgcggccgccaccacgccgagctgctgcggccccgctgcccagcctgtgaccagctgatcttctcctggcgctgcacagaggccgagggccagcgctggcatgagaaccacttctgctgccaggactgtgccggccccctgggcggcggccgctatgccctgcccggcggcagcccctgctgccccagctgctttgagaaccgctacagtgatgctggcagctcctgggccggggccctggagggccaggccttcctgggggagaccggcctggacagaacagagggccgggaccagacctctgtgaacagcgccaccctgagcaggaccctgctggccgctgctgggggcagcagcctgcagacccagaggggcctgcccggcagcagcccccagcaggagaacagacctggggacaaggccgaggcccccaagggccaggagcagtgccgcctggagaccatccgggaccccaaggacacccccttcagcacctgcagcagcagcagtgacagcgagcctgagggcttcttcctgggggagcggctgccccagagctggaagaccccaggcagcctgcaggccgaggacagcaatgccagcaagacccactgcaccatgtgctag

SEQ ID NO: 16570 - DNA, 1155 bp, Artificial Sequence
  Description of Artificial Sequence: Synthetic coding sequence
atgtctgtgcagaacagcggctggccccaccaggaggacagccccaagccccaggaccccggccccccagccaacagcgacagcgacagcggccacctgcccggggaggaccctgaggacacccacgcccagggccctgctgtgctgagcctgggcagcctgtgcctggacaccaaccaggcccccaactggacaggcctgcagaccctgctgcagcagctgcccccccaggacattgatgagcgctactgcctggccctgggggaggaggagagagctgagctgcagctgttctgtgcccggaggaagcaggaggccctgggccagggcgtggcccggctggtgctgcccaagctggagggccacacctgtgagaagtgccgggagctgctgaagccaggagaatatggagtgtttgctgcccgggccggggagcagcgctgctggcaccagccctgctttgcctgccaggcctgtggccaggccctgatcaacctgatctacttctaccatgatggccagctgtactgcggccgccaccacgccgagctgctgcggccccgctgcccagcctgtgaccagctgatcttctcctggcgctgcacagaggccgagggccagcgctggcatgagaaccacttctgctgccaggactgtgccggccccctgggcggcggccgctatgccctgcccggcggcagcccctgctgccccagctgctttgagaaccgctacagtgatgctggcagctcctgggccggggccctggagggccaggccttcctgggggagaccggcctggacagaacagagggccgggaccagacctctgtgaacagcgccaccctgagcaggaccctgctggccgctgctgggggcagcagcctgcagacccagaggggcctgcccggcagcagcccccagcaggagaacagacctggggacaaggccgaggcccccaagggccaggagcagtgccgcctggagaccatccgggaccccaaggacacccccttcagcacctgcagcagcagcagtgacagcgagcctgagggcttcttcctgggggagcggctgccccagagctggaagaccccaggcagcctgcaggccgaggacagcaatgccagcaagacccactgcaccatgtgctag

SEQ ID NO: 16571 - DNA, 213 bp, Artificial Sequence
  Description of Artificial Sequence: Synthetic coding sequence
atgtctgtgcagaacagcggctggccccaccaggaggacagccccaagccccaggaccccggccccccagccaacagcgacagcgacagcggccacctgcccggggaggaccctgaggacacccacgcccaggagttcctgagcctgcacctgctgcggacctggggctttgacttcaagctgatccacatgagcatccactacctgtcctag

SEQ ID NO: 16572 - DNA, 474 bp, Artificial Sequence
  Description of Artificial Sequence: Synthetic coding sequence
atgaagaacccagacaaggctgtgcccatccctgagaagatgtctgagtgggcccccaggcctcctcctgagtttgtgagagatgtgatgggcagcagcgctggggccggcagcggggagttccacgtgtaccgccacctgcggcggcgggagtaccagaggcaggactacatggatgccatggccgagaagcagaagctggatgctgagttccagaagaggctggagaagaacaagattgctgctgaggagcagacagccaagaggaggaagaagaggaccaggtctgcccagggcgctggggtgcagcagctgtgtggcggcatctggaacagaggaggcggcggcagcgcccagttccaccacggggccatgaccatgtttgccacagccagcgcctggaacctggcccgggctgtgacccggcgggagcggcggctgtttggcagcttctccccagcccggaccaggtag

SEQ ID NO: 16573 - DNA, 555 bp, Artificial Sequence
  Description of Artificial Sequence: Synthetic coding sequence
atggccagccctgctgccagctctgtgcggcccccccggcccaagaaggagccccagaccctggtgatccccaagaatgctgctgaggagcagaagctgaagctggagcggctgatgaagaacccagacaaggctgtgcccatccctgagaagatgtctgagtgggcccccaggcctcctcctgagtttgtgagagatgtgatgggcagcagcgctggggccggcagcggggagttccacgtgtaccgccacctgcggcggcgggagtaccagaggcaggactacatggatgccatggccgagaagcagaagctggatgctgagttccagaagaggctggagaagaacaagattgctgctgaggagcagacagccaagaggaggaagaagaggcagaagctgaaggagaagaagctgctggccaagaagatgaagctggagcagaagaagcaggagggccctggccagcccaaggagcagggcagcagcagcagcgctgaggccagcggcacagaggaggaggaggaggtgcccagcttcaccatgggccgctag

SEQ ID NO: 16574 - DNA, 555 bp, Artificial Sequence; identical to SEQ ID NO: 16573
  Description of Artificial Sequence: Synthetic coding sequence

SEQ ID NO: 16575 - DNA, 3075 bp, Artificial Sequence
  Description of Artificial Sequence: Synthetic coding sequence
atgagcaatgccaaggagaggaagcacgccaagaagatgaggaaccagcccaccaacgtgaccctgagcagcggctttgtggccgacagaggagtgaagcaccacagcggcggggagaagcccttccaggcccagaagcaggagccccaccctggcaccagccggcagaggcagaccagggtgaacccccacagcctgcctgaccctgaggtgaatgagcagagcagcagcaagggcatgttcaggaagaagggcggctggaaggccggccctgagggcaccagccaggagatccccaagtacatcacagccagcacctttgcccaggcccgggctgctgagatcagcgccatgctgaaggctgtgacccagaagagcagcaacagcctggtgttccagaccctgcccaggcacatgagaagaagagccatgagccacaacgtgaagaggctgccccggcggctgcaggagatcgcccagaaggaggccgagaaggctgtgcaccagaagaaggagcacagcaagaacaagtgccacaaggcccggcgctgccacatgaacagaaccctggagttcaacagacggcagaagaagaacatctggctggagacccacatctggcacgccaagcgcttccacatggtgaagaagtggggctactgcctgggggagcggcccaccgtgaagagccaccgggcctgctaccgggccatgaccaaccgctgcctgctgcaggacctgagctactactgctgcctggagctgaagggcaaggaggaggagatcctgaaggccctgagcggcatgtgcaacatcgacaccggcctgacctttgctgctgtgcactgcctgagcggcaagaggcagggcagcctggtgctgtacagagtgaacaagtacccccgggagatgctgggccctgtgaccttcatctggaagagccagaggacccctggggaccccagcgagagccggcagctgtggatctggctgcaccccaccctgaagcaggacatcctggaggagatcaaggccgcctgccagtgtgtggagcccatcaagtctgctgtgtgcatcgctgaccccctgcccacccccagccaggagaagagccagacagagctgcctgatgagaagattggcaagaagaggaagaggaaggatgatggagaaaatgccaagcccatcaagaagatcattggagatggcacccgggacccctgcctgccctacagctggatcagccccaccaccggcatcatcatcagtgacctgaccatggagatgaaccgcttccggctgattggccccctgagccacagcatcctgacagaggccatcaaggccgcctctgtgcacacagtgggggaggacacagaggagaccccccaccgctggtggattgagacctgcaagaagccagacagcgtgtccctgcactgccggcaggaggccatctttgagctgctgggcggcatcaccagccctgctgagatcccagctggcaccatcctgggcctgactgtgggggacccccgcatcaacctgccccagaagaagagcaaggccctgcccaaccctgagaagtgccaggacaatgagaaggtgcggcagctgctgctggagggcgtgcctgtggagtgcacccacagcttcatctggaaccaggacatctgcaagtctgtgacagagaacaagatcagtgaccaggacctgaacaggatgaggtctgagctgctggtgcccggcagccagctgatcctgggcccccatgagagcaagatccccatcctgctgatccagcagcccgggaaggtgactggagaagatcggctgggctggggcagcggctgggatgtgctgctgcccaagggctggggcatggccttctggatccccttcatctaccggggcgtgcgggtgggcggcctgaaggagagcgctgtgcacagccagtacaagaggagccccaacgtgcctggggacttcccagactgcccagctggcatgctgtttgctgaggagcaggccaagaacctgctggagaagtacaagaggcggcccccagccaagaggcccaactacgtgaagctgggcaccctggcccccttctgctgcccctgggagcagctgacccaggactgggagagccgggtgcaggcctatgaggagcccagcgtggccagcagccccaacgggaaggagagtgacctgcggcgctctgaggtgccctgtgcccccatgcccaagaagacccaccagcccagtgatgaggtgggcaccagcattgagcacccccgggaggccgaggaggtgatggatgctggctgccaggagagcgctggccctgagcgcatcacagaccaggaggcctctgaaaatcatgtggccgccaccggcagccacctgtgtgtgctgcggagcaggaagctgctgaagcagctgagcgcctggtgtggccccagcagcgaggacagccggggcggccggcgggcccctggccggggccagcagggcctgacccgggaggcctgcctgagcatcctgggccacttcccccgggccctggtgtgggtgtccctgagcctgctgagcaagggcagccctgagccccacaccatgatctgtgtgcctgccaaggaggacttcctgcagctgcacgaggactggcactactgcggcccccaggagagcaagcacagcgaccccttccgcagcaagatcctgaagcagaaggagaagaagaagcgggagaagaggcagaagccaggccgggccagcagtgatggccctgctggggaggagcctgtggccggccaggaggccctgaccctgggcctgtggagcggccccctgccccgggtgaccctgcactgcagcaggaccctgctgggctttgtgacccagggcgacttctccatggctgtgggctgtggggaggccctgggctttgtgtccctgaccggcctgctggacatgctgagcagccagcctgctgcccagaggggcctggtgctgctgcggcccccagccagcctgcagtacagatttgcccgcatcgccatcgaggtgtag

SEQ ID NO: 16576 - DNA, 3075 bp, Artificial Sequence; identical to SEQ ID NO: 16575
  Description of Artificial Sequence: Synthetic coding sequence

SEQ ID NO: 16577 - DNA, 552 bp, Artificial Sequence
  Description of Artificial Sequence: Synthetic coding sequence
atgagcaatgccaaggagaggaagcacgccaagaagatgaggaaccagcccaccaacgtgaccctgagcagcggctttgtggccgacagaggagtgaagcaccacagcggcggggagaagcccttccaggcccagaagcaggagccccaccctggcaccagccggcagaggcagaccagggtgaacccccacagcctgcctgaccctgaggtgaatgagcagagcagcagcaagggcatgttcaggaagaagggcggctggaaggccggccctgagggcaccagccaggagatccccaagtacatcacagccagcacctttgcccaggcccgggctgctgagatcagcgccatgctgaaggctgtgacccagaagagcagcaacagcctggtgttccagaccctgcccaggcacatgagaagaagagccatgagccacaacgtgaagaggctgccccggcggctgcaggagatcgcccagaaggaggccgagaaggctgtgcaccagaagaaggagcacagcaagaacaagtgccacaaggcccggaggtag

SEQ ID NO: 16578 - DNA, 297 bp, Artificial Sequence
  Description of Artificial Sequence: Synthetic coding sequence
atgtggaaccccaatgctgggggccccccccaccctgtgccccagcccggctacccaggctgccagcccctgggcccctaccccccaccctacccacctccagcccctggcatcccccctgtgaaccccctggcccctggcatggtgggccctgctgtgattgtggacaagaagatgcagaagaagatgaagaaggcccacaagaagatgcacaagcaccagaagcaccacaagtaccacaagcacggcaagcacagcagcagcagcagcagcagcagcagcagtgacagcgactag

SEQ ID NO: 16579 - DNA, 447 bp, Artificial Sequence
  Description of Artificial Sequence: Synthetic coding sequence
atgtggaaccccaatgccggccagcccggccccaacccctacccacccaacatcggctgccctgggggcagcaacccagcccaccccccacccatcaacccccccttccccccaggcccctgccccccacctcctggggcccctcatggcaacccagccttccccccaggcggccccccccaccctgtgccccagcccggctacccaggctgccagcccctgggcccctaccccccaccctacccacctccagcccctggcatcccccctgtgaaccccctggcccctggcatggtgggccctgctgtgattgtggacaagaagatgcagaagaagatgaagaaggcccacaagaagatgcacaagcaccagaagcaccacaagtaccacaagcacggcaagcacagcagcagcagcagcagcagcagcagcagtgacagcgactag

SEQ ID NO: 16580 - DNA, 489 bp, Artificial Sequence
  Description of Artificial Sequence: Synthetic coding sequence
atgggctacctggacagcatcggctggaggacccacctgaacatgtggaaccccaatgccggccagcccggccccaacccctacccacccaacatcggctgccctgggggcagcaacccagcccaccccccacccatcaacccccccttccccccaggcccctgccccccacctcctggggcccctcatggcaacccagccttccccccaggcggccccccccaccctgtgccccagcccggctacccaggctgccagcccctgggcccctaccccccaccctacccacctccagcccctggcatcccccctgtgaaccccctggcccctggcatggtgggccctgctgtgattgtggacaagaagatgcagaagaagatgaagaaggcccacaagaagatgcacaagcaccagaagcaccacaagtaccacaagcacggcaagcacagcagcagcagcagcagcagcagcagcagtgacagcgactag

SEQ ID NO: 16581 - DNA, 447 bp, Artificial Sequence; identical to SEQ ID NO: 16579
  Description of Artificial Sequence: Synthetic coding sequence

SEQ ID NO: 16582 - DNA, 447 bp, Artificial Sequence; identical to SEQ ID NO: 16579
  Description of Artificial Sequence: Synthetic coding sequence

SEQ ID NO: 16583 - DNA, 1779 bp, Artificial Sequence
  Description of Artificial Sequence: Synthetic coding sequence
atggaccccaacagcatcctgctgagcccccagccccagatctgcagccacctggccgaggcctgcacagaaggagagaggagcagcagccccccagagctggaccgggacagccccttcccctggagccaggtgcccagcagcagccccacagatcctgagtggtttggagatgagcacatccaggccaagagggcccgggtggagaccatcgtgcggggcatgtgcctgagccccaaccccctggtgcctggaaatgcccaggccggcgtgagcccccgctgccccaagaaggcccgggagaggaagaggaagcagaacctgcccaccccccagggcctgctgatgcctgccccagcctgggaccagggcaacagaaaaggaggcccccgggtgcgggagcagctgcacctgctgaagcagcagctgcggcacctgcaggagcacatcctgcaggccgccaagccccgggacacagcccagggccctgggggctgcggcaccgggaagggccccctgagcgccaagcagggcaatggctgcggcccccggccctgggtggtggatggagaccaccagcagggcaccagcaaggacctgtctggagctgagaagcaccaggagagcgagaagcccagcttcctgcccagcggggccccagccagcctggagatcctgaggaaggagctgaccagggctgtgtcccaggccgtggacagcgtgctgcagaaggtgctgctggaccccccaggccacctgacccagctgggccgctccttccagggccaggtggccgagggccgctctgagcccagcccccctgtgggcggggcctgcaaggaccccctggccctggccgccctgccccggcgggtgcagctgcaggccggcgtgcctgtgggcaacctgagcctggccaagaggctggacagcccccgctaccccatcccccccaggatgacccccaagccctgccaggaccccccagccaacttccccctgacagcccccagccacatccaggagaaccagatcctgagccagctgctgggccaccgctacaacaacggccactggagcagcagccccccccaggacagcagcagccagaggcaccccagcagcgagcccgccctgcggccctggaggaccaccaagccccagcccctggtgctgagccagcagcagtgccccctgcccttcaccagcgcccacctggagagcctgcccctgctgcccagcgtgaagatggagcagaggggcctgcatgctgtgatggaggccctgcccttcagcctggtgcacatcagcgagggcctgaaccctggccacctgaagaaggccaagctgatgttcttcttcacccgctaccccagcagcaacctgctgaaggtgtacttcccagatgtgcagttcaaccgctgcatcaccagccagatgatcaagtggttcagcaacttccgggagttctactacatccagatggagaagagcgcccggcaggccatcagtgatggagtgaccaaccccaagatgctggtggtgctgagaaattctgagctgttccaggccctgaacatgcactacaacaagggaaatgactttgaggtgcctgactgcttcctggagatcgccagcctgaccctgcaggagttcttccgggctgtgtctgctggccgggacagcgaccccagctggaagaagcccatctacaagatcatcagcaagctggacagcgacatccctgagatcttcaagagcagcagctacccccagtag

SEQ ID NO: 16584 - DNA, 1779 bp, Artificial Sequence
  Description of Artificial Sequence: Synthetic coding sequence
atggaccccaacagcatcctgctgagcccccagccccagatctgcagccacctggccgaggcctgcacagaaggagagaggagcagcagccccccagagctggaccgggacagccccttcccctggagccaggtgcccagcagcagccccacagatcctgagtggtttggagatgagcacatccaggccaagagggcccgggtggagaccatcgtgcggggcatgtgcctgagccccaaccccctggtgcctggaaatgcccaggccggcgtgagcccccgctgccccaagaaggcccgggagaggaagaggaagcagaacctgcccaccccccagggcctgctgatgcctgccccagcctgggaccagggcaacagaaaaggaggcccccgggtgcgggagcagctgcacctgctgaagcagcagctgcggcacctgcaggagcacatcctgcaggccgccaagccccgggacacagcccagggccctgggggctgcggcaccgggaagggccccctgagcgccaagcagggcaatggctgcggcccccggccctgggtggtggatggagaccaccagcagggcaccagcaaggacctgtctggagctgagaagcaccaggagagcgagaagcccagcttcctgcccagcggggccccagccagcctggagatcctgaggaaggagctgaccagggctgtgtcccaggccgtggacagcgtgctgcagaaggtgctgctggaccccccaggccacctgacccagctgggccgctccttccagggccaggtggccgagggccgctctgagcccagcccccctgtgggcggggcctgcaaggaccccctggccctggccgccctgccccggcgggtgcagctgcaggccggcgtgcctgtgggcaacctgagcctggccaagaggctggacagcccccgctaccccatcccccccaggatgacccccaagccctgccaggaccccccagccaacttccccctgacagcccccagccacatccaggagaaccagatcctgagccagctgctgggccaccgctacaacaacggccactggagcagcagccccccccaggacagcagcagccagaggcaccccagcagcgagcccgccctgcggccctggaggaccaccaagccccagcccctggtgctgagccagcagcagtgccccctgcccttcaccagcgcccacctggagagcctgcccctgctgcccagcgtgaagatggagcagaggggcctgcatgctgtgatggaggccctgcccttcagcctgctgcacatccaggagggcctgaaccctggccacctgaagaaggccaagctgatgttcttcttcacccgctaccccagcagcaacctgctgaaggtgtacttcccagatgtgcagttcaaccgctgcatcaccagccagatgatcaagtggttcagcaacttccgggagttctactacatccagatggagaagagcgcccggcaggccatcagtgatggagtgaccaaccccaagatgctggtggtgctgagaaattctgagctgttccaggccctgaacatgcactacaacaagggaaatgactttgaggtgcctgactgcttcctggagatcgccagcctgaccctgcaggagttcttccgggctgtgtctgctggccgggacagcgaccccagctggaagaagcccatctacaagatcatcagcaagctggacagcgacatccctgagatcttcaagagcagcagctacccccagtag

SEQ ID NO: 16585 - DNA, 1779 bp, Artificial Sequence
  Description of Artificial Sequence: Synthetic coding sequence
atggaccccaacagcatcctgctgagcccccagccccagatctgcagccacctggccgaggcctgcacagaaggagagaggagcagcagccccccagagctggaccgggacagccccttcccctggagccaggtgcccagcagcagccccacagatcctgagtggtttggagatgagcacatccaggccaagagggcccgggtggagaccatcgtgcggggcatgtgcctgagccccaaccccctggtgcctggaaatgcccaggccggcgtgagcccccgctgccccaagaaggcccgggagaggaagaggaagcagaacctgcccaccccccagggcctgctgatgcctgccccagcctgggaccagggcaacagaaaaggaggcccccgggtgcgggagcagctgcacctgctgaagcagcagctgcggcacctgcaggagcacatcctgcaggccgccaagccccgggacacagcccagggccctgggggctgcggcaccgggaagggccccctgagcgccaagcagggcaatggctgcggcccccggccctgggtggtggatggagaccaccagcagggcaccagcaaggacctgtctggagctgagaagcaccaggagagcgagaagcccagcttcctgcccagcggggccccagccagcctggagatcctgaggaaggagctgaccagggctgtgtcccaggccgtggacagcgtgctgcagaaggtgctgctggaccccccaggccacctgacccagctgggccgctccttccagggccaggtggccgagggccgctctgagcccagcccccctgtgggcggggcctgcaaggaccccctggccctggccgccctgccccggcgggtgcagctgcaggccggcgtgcctgtgggcaacctgagcctggccaagaggctggacagcccccgctaccccatcccccccaggatgacccccaagccctgccaggaccccccagccaacttccccctgacagcccccagccacatccaggagaaccagatcctgagccagctgctgggccaccgctacaacaacggccactggagcagcagccccccccaggacagcagcagccagaggcaccccagcagcgagcccgccctgcggccctggaggaccaccaagccccagcccctggtgctgagccagcagcagtgccccctgcccttcaccagcgcccacctggagagcctgcccctgctgcccagcgtgaagatggagcagaggggcctgcatgctgtgatggaggccctgcccttcagcctggtgcacatccaggagggcctgaaccctggccacctgaagaaggccaagctgatgttcttcttcacccgctaccccagcagcaacctgctgaaggtgtacttcccagatgtgcagttcaaccgctgcatcaccagccagatgatcaagtggttcagcaacttccgggagttctactacatccagatggagaagagcgcccggcaggccatcagtgatggagtgaccaaccccaagatgctggtggtgctgagaaattctgagctgttccaggccctgaacatgcactacaacaagggaaatgactttgaggtgcctgactgcttcctggagatcgccagcctgaccctgcaggagttcttccgggctgtgtctgctggccgggacagcgaccccagctggaagaagcccatctacaagatcatcagcaagctggacagcgacatccctgagatcttcaagagcagcagctacccccagtag

SEQ ID NO: 16586 - DNA, 174 bp, Artificial Sequence
  Description of Artificial Sequence: Synthetic coding sequence
atgctgtgtgcccacttcagtgaccagggccctgcccacctgaccaccagcaagagcgccttcctgagcaacaagaagaccagcaccctgaagcacctgctgggggagaccaggagtgatggcagcgcctgcaacagcggcatcagcggcggccggggcaggaagatcccctag

SEQ ID NO: 16587 - DNA, 5439 bp, Artificial Sequence
  Description of Artificial Sequence: Synthetic coding sequence
atggctgtggacagcgccatggagctgctcttcctggacaccttcaagcaccccagcgctgagcagagcagccacattgatgtggtgcgcttcccctgtgtggtgtacatcaatgaggtgcgggtcatccccccaggagtgcgggcccacagcagcctgcctgacaacagagcctatggagagaccagcccccacaccttccagctggacctcttcttcaacaacgtgtccaagcccagcgcccctgtgtttgaccggctgggcagcctggagtatgatgagaacaccagcatcatcttccggcccaacagcaaggtgaacacagatggcctggtgctgcggggctggtacaactgcctgaccctggccatctacggctctgtggacagagtcatcagccatgaccgggacagccccccacctcctcctcctcctcctcctccaccccagccccagcccagcctgaagaggaaccccaagcatgctgatggagagaaggaggaccagttcaacggcagccccccccggccccagccccggggccccaggaccccacctggccccccacctccagatgatgatgaagatgatcctgtgcccctgcctgtgtctggggacaaggaggaggatgccccccaccgggaggactactttgagcccatcagcccagacagaaattctgtgccccaggagggccagtacagtgatgaaggagaggtggaggaggagcagcaggaggagggggaggaggatgaagatgatgtggatgtggaggaggaggaggatgaagatgaagatgacagaagaacagtggacagcatccctgaggaggaggaggaggatgaggaggaggagggggaggaggatgaggagggggagggagatgatggctatgagcagatcagcagtgatgaagatggcattgctgacctggagcgggagaccttcaagtaccccaactttgatgtggagtacacagctgaggacctggcctctgtgccccccatgacctatgacccctatgaccgggagctggtgcccctgctgtacttcagctgcccctacaagaccacctttgaaattgagatcagcaggatgaaggaccagggccctgacaaggagaacagcggggccatcgaggcctctgtgaagctgacagagctgctggacctgtaccgggaggacagaggagccaagtgggtgacagccctggaggagatccccagcctcatcatcaagggcctgagctacctgcagctgaagaacaccaagcaggacagcctgggccagctggtggactggaccatgcaggccctgaacctgcaggtggccctgcggcagcccatcgccctgaatgtgcggcagctgaaggccggcaccaagctggtgagcagcctggccgagtgtggggcccagggcgtgacaggcctgctgcaggccggggtcatcagcggcctgtttgagctgctgtttgctgaccacgtgagcagcagcctgaagctgaatgccttcaaggccctggacagcgtcatctccatgacagagggcatggaggccttcctgcggggccggcagaatgagaagagcggctaccagaagctgctggagctgatcctgctggaccagacagtgcgggtggtgacagctggcagcgccatcctgcagaagtgccacttctatgaggtgctgtctgagatcaagaggctgggggaccacctggccgagaagaccagcagcctgcccaaccacagcgagccagaccatgacacagatgctggcctggagaggaccaacccagaatatgaaaatgaggtggaggcctccatggacatggacctgctggagagcagcaacatcagcgagggggagattgaaagactcatcaacctgctggaggaggtgttccacctgatggagacagccccccacaccatgatccagcagcctgtgaagagcttccccaccatggcccgcatcaccggccccccagagagagatgacccctaccctgtgctcttccgctacctgcacagccaccacttcctggagctggtgaccctgctgctgagcatccctgtgaccagcgcccaccctggggtgctgcaggccaccaaggatgtgctgaagttcctggcccagagccagaagggcctgctcttcttcatgtctgaatatgaggccaccaacctgctgatccgggccctgtgccacttctatgaccaggatgaggaggagggcctgcagagtgatggagtgattgatgatgcctttgccctgtggctgcaggacagcacccagaccctgcagtgcatcacagagctgttcagccacttccagcgctgcacagccagcgaggagacagaccacagcgacctgctgggcaccctgcacaacctgtacctgatcaccttcaaccctgtgggccgctctgctgtgggccacgtgttcagcctggagaagaacctgcagagcctcatcaccctgatggagtactacagcaaggaggccctgggggacagcaagagcaagaagtctgtggcctacaactatgcctgcatcctgatcctggtggtggtgcagagcagcagtgatgtgcagatgctggagcagcacgccgccagcctgctgaagctgtgcaaggcagatgaaaataatgccaagctgcaggagctgggcaagtggctggagcccctgaagaacctgcgctttgagatcaactgcatccccaacctgattgaatatgtgaagcagaacatcgacaacctgatgaccccagagggcgtgggcctgaccacagccctgcgggtgctgtgcaatgtggcctgccccccacctcctgtggagggccagcagaaggacctgaagtggaacctggccgtcatccagctgttctctgctgagggcatggacaccttcatccgggtgctgcagaagctgaacagcatcctgacccagccctggaggctgcacgtgaacatgggcaccaccctgcaccgggtgaccaccatctccatggcccgctgcaccctgaccctgctgaagaccatgctgacagagctgctgcggggcggcagctttgagttcaaggacatgagggtgcccagcgccctggtgaccctgcacatgctgctgtgcagcatccccctgagcggccgcctggacagtgatgagcagaagatccagaatgacatcatcgacatcctgctgaccttcacccagggcgtgaatgagaagctgaccatcagcgaggagaccctggccaacaacacctggagcctgatgctgaaggaggtgctgagcagcatcctgaaggtgcctgagggcttcttcagcggcctcatcctgctgtctgagctgctgcccctgcccctgcccatgcagaccacccaggtgattgagccccatgacatctctgtggccctgaacaccaggaagctgtggagcatgcacctgcacgtgcaggccaagctgctgcaggagatcgtgcgctccttcagcggcaccacctgccagcccatccagcacatgctgcggcgcatctgtgtgcagctgtgtgacctggccagccccacagccctgctgatcatgaggacagtgctggacctgattgtggaggacctgcagagcaccagcgaggacaaggagaagcagtacaccagccagaccacccggctgctggccctgctggatgccctggccagccacaaggcctgcaagctggccatcctgcacctgatcaatggcaccatcaagggagatgaaagatatgcagagatcttccaggacctgctggccctggtgcgcagccctggggacagcgtcatccggcagcagtgtgtggagtatgtgaccagcatcctgcagagcctgtgtgaccaggacatcgccctgatcctgcccagcagcagcgagggcagcatcagcgagctggagcagctgagcaacagcctgcccaacaaggagctgatgaccagcatctgtgactgcctgctggccaccctggccaacagcgagagcagctacaactgcctgctgacctgtgtgaggaccatgatgttcctggccgagcatgactatggcctcttccacctgaagagcagcctgaggaagaacagcagcgccctgcacagcctgctgaagagggtggtgtccaccttcagcaaggacaccggggagctggccagcagcttcctggagttcatgaggcagatcctgaacagcgacaccatcggctgctgcggagatgacaatggcctgatggaggtggagggcgcccacaccagcaggaccatgagcatcaatgctgctgagctgaagcagctgctgcagagcaaggaggagagccctgagaacctcttcctggagctggagaagctggtgctggagcacagcaaggatgatgacaacctggacagcctgctggacagcgtggtgggcctgaagcagatgctggagagcagcggggaccccctgcccctgagtgaccaggatgtggagcctgtgctgagcgcccctgagagcctgcagaacctcttcaacaacagaacagcctacgtgctggctgatgtgatggatgaccagctgaagtccatgtggttcacccccttccaggccgaggagattgacacagacctggacctggtgaaggtggacctgattgagctgtctgagaagtgctgcagcgactttgacctgcacagcgagctggagaggagcttcctgtctgagcccagcagccctggccgcaccaagaccaccaagggcttcaagctgggcaagcacaagcatgagaccttcatcaccagcagcggcaagtctgagtacattgaaccagccaagagggcccacgtggtgcccccaccccggggccggggccggggcggcttcggccagggcatccggccccatgacatcttccggcagaggaagcagaacaccagcaggcctccttccatgcacgtggatgactttgtggccgctgagagcaaggaggtggtgccccaggacggcatccccccacccaagaggcccctgaaggtgtcccagaagatcagcagccggggcggcttcagcggcaacagaggaggccgcggggccttccacagccagaaccgcttcttcaccccaccagccagcaaaggaaactacagccggcgggagggcacccggggcagctcctggagcgcccagaacaccccccggggcaactacaatgaaagccggggcggccagagcaacttcaacagaggccccctgccccccctgcggcccctgagcagcacaggctaccggcccagcccccgggaccgggccagccggggccggggcggcctgggccccagctgggccagcgccaacagcggcagcggcggcagccggggcaagtttgtgtctgggggcagcggccggggccgccacgtgcgctccttcaccaggtag

SEQ ID NO: 16588 - DNA, 1038 bp, Artificial Sequence
  Description of Artificial Sequence: Synthetic coding sequence
atgaagcagctgaagaggaagaggaagagcaacttctctgtgcaggagacccagaccctgctgaaggagatcaccaagaggaaggaggtgatcttcagcaagcagctgaacaccaccatcaacgtgatgaagaggatggcctgggaggagatcgcccagtgtgtgaatgctgtgggggagggggagcagaggactggaacagaggtgaagaggcgctacctggactggagggccctgatgaagaggaagaggatgaaggccaacatcaagctggtgggcagcggcttccccctgcccagcagtgacctggatgacagcctgacagaggagattgatgagaagattggcttcagaaatgatgccaactttgactggcagaatgtggccgacttcagagatgctgggggcagcctgacagaggtgaaggtggaggaggaggagcgggacccccagagccctgagtttgaaattgaggaggaggaggagatgctgagcagcgtcatcccagacagccggcgggagaatgagctgcctgacttcccccacattgatgagttcttcaccctgaacagcacccccagccgcagcgcctatgatgagccccacctgctggtgaacatcgagaagcagaagctggagctggagaagaggcggctggacattgaagctgagcggctgcaggtggagaaggagcggctgcagatcgagaaggagcggctgcggcacctggacatggagcacgagcggctgcagctggagaaggagcggctgcagatcgagcgggagaagctgcggctgcagatcgtgaacagcgagaagcccagcctggagaatgagctgggccagggcgagaagtccatgctgcagccccaggacattgaaacagagaagctgaagctggagcgggagcggctgcagctggagaaggaccggctgcagttcctgaagtttgaaagtgagaagctgcagatcgagaaggagcggctgcaggtggagaaggaccggctgcgcatccagaaggagggccacctgcagtag

SEQ ID NO: 16589 - DNA, 6738 bp, Artificial Sequence
  Description of Artificial Sequence: Synthetic coding sequence
atgcctgagatgacagaaaatgagacccccaccaagaagcagcacaggaagaagaaccgggagacccacaatgctgtggagcggcacaggaagaagaagatcaatgccggcatcaacagaattggagagctgatcccctgcagccctgccctgaagcagagcaagaacatgatcctggaccaggccttcaagtacatcacagagctgaagaggcagaatgatgagctgctgctgaatggaggcaacaatgagcaggccgaggagatcaagaagctgaggaagcagctggaggagatccagaaggaaaatggccgctacatcgagctgctgaaggccaatgacatctgcctgtatgatgaccccaccatccactggaagggcaacctgaagaacagcaaggtgtctgtggtgatccccagcgaccaggtgcagaagaagatcatcgtgtacagcaatggaaaccagcccggcggcaacagccagggcacagctgtgcagggcatcaccttcaacgtgagccacaacctgcagaagcagacagccaacgtggtgcctgtgcagaggacctgcaacctggtgacccctgtgtccatctctggagtgtaccccagcgagaacaagccctggcaccagaccaccgtgcctgccctggccaccaaccagcctgtgcccctgtgcctgcctgctgccatcagcgcccagagcatcctggagctgcccaccagcgagagcgagagcaatgtgctgggcgccaccagcggcagcctgattgctgtgtccattgaaagtgagccccaccagcaccacagcctgcacacctgcctgaatgaccagaacagcagcgagaacaagaatggccaggagaaccccaaggtgctgaagaagatgaccccctgtgtgaccaacatcccccacagcagcagcgccacagccaccaaggtgcaccacggcaacaagagctgcctgagcatccaggacttccggggggacttccagaacacctttgtggtgtctgtgaccaccaccgtgtgcagccagccccccaggacagctggggacagcagccccatgagcatcagcaagtctgctgacctgaccagcacagccaccgtggtggccagcagcgcccctggggtgggcaaggccaccatccccatcagcaccctgagcggcaaccccctggacaatggctggaccctgagctgcagcctgcccagcagctctgtgtccaccagtgacctgaagaacatcaacagcctgacccgcatcagcagcgctggcaacacccagaccacctggaccaccctgcagctggccggcaacaccatccagcccctgagccagacccccagcagcgctgtgacccctgtgctgaatgaaagtggcaccagccccaccaccagcaaccacagccgctacgtggccacagacatcaacctgaacaacagcttcccagcagatggccagcctgtggagcaggtggtggtgaccctgcccagctgccccagcctgcccatgcagcccctcatcgcccagccccaggtgaagagccagccccccaagaacatcctgcccctgaacagcgccatgcaggtgatccagatggcccagcctgtgggcagcgctgtgaacagcgcccccaccaaccagaatgtcatcatcctgcagccccccagcaccaccccctgccccaccgtgatgagagctgaggtgagcaaccagacagtgggccagcagatcgtcatcatccaggccgccaaccagaaccccctgcccctgctgcctgcccctcctcctggctctgtgcggctgcccatcaatggagccaacacagtgattggcagcaacaacagcgtgcagaatgtgcccaccccccagaccttcggcggcaagcacctggtgcacatcctgccccggcccagcagcctgagcgccagcaacagcacccagaccttctctgtgaccatgagcaaccagcagccccagaccatcagcctgaatggccagctgtttgccctgcagcctgtgatgagcagcagcggcaccaccaaccagacccccatgcagatcatccagcccaccaccagcgaggaccccaacaccaacgtggccctgaacaccttcggggccctggccagcctgaaccagagcatcagccagatggccggccagagctgtgtgcagctgagcatcagccagcctgccaacagccagacagctgccaacagccagaccaccacagccaactgtgtgtccctgaccaccacagctgcccctcctgtgaccacagacagcagcgccaccctggccagcacctacaacctggtgtccaccagctccatgaacacagtggcctgcctgcccaacatgaagagcaagaggctgaacaagaagccaggcggcaggaagcacctggccgccaacaagagcgcctgccccctgaacagcgtgagagatgtgtccaagctggactgccccaacacagagggcagcgctgagcccccctgcaatgatggcctgctggagagcttccctgctgtgctgcccagcgtgtctgtgtcccaggccaacagcgtgtctgtgtctgccagccacagcctgggcgtgctgagcagcgagagcctcatccctgagagcgtgtccaagagcaagtctgctgagaagagcagcccccccagccaggagagcgtgaccagcgagcactttgccatggccgccgccaagagcaaggacagcacccccaacctgcagcaggagaccagccaggacaagccacccagcagcctggccctgagtgatgctgccaagccctgtgccagcgccaacgtgctgatccccagccccagcgacccccacatcctggtgtcccaggtgcccggcctgagcagcaccaccagcaccaccagcacagactgtgtgtctgaggtggagatcatcgccgagccctgccgggtggagcaggacagcagtgacaccatgcagaccaccggcctgctgaagggccagggcctgaccaccctgctgagtgacctggccaagaagaagaacccccagaagagcagcctgagtgaccagatggaccacccagacttcagcagcgagaaccccaagatcgtggacagctctgtgaacctgcaccccaagcaggagctgctgctgatgaacaatgatgaccgggaccccccccagcaccacagctgcctgcctgaccaggaggtgatcaatggcagcctcatcaatggccggcaggccgacagccccatgagcaccagcagcggcagcagccgctccttctctgtggcctccatgctgcctgagaccacccgggaggatgtgaccagcaatgccaccaccaacacctgtgacagctgcacctttgtggagcagacagacatcgtggccctggccgcccgggccatctttgaccaggagaacctggagaagggccgggtgggcctgcaggccgacatccgggaggtggccagcaagcccagcgaggccagcctgctggagggggacccccccttcaagagccagatccccaaggagagcggcaccggccaggccgaggccaccccaaatgagttcaacagccagggcagcattgaggccaccatggagcggcccctggagaagcccagctgcagcctgggcatcaagaccagcaatgccagcctgcaggacagcaccagccagcccccatccatcaccagcctgtctgtgaacaacctgatccaccagagcagcatcagccaccccctggccagctgtgccggcctgagccccaccagcgagcagaccaccgtgcctgccaccgtgaacctgactgtgagcagcagcagctatggcagccagcccccaggccccagcctgatgacagagtacagccaggagcagctgaacaccatgaccagcaccatccccaacagccagatccaggagcccctgctgaagcccagccatgagagcaggaaggacagcgccaagagagctgtgcaggatgacctgctgctgagcagcgccaagaggcagaagcactgccagcctgcccccctgcggctggagagcatgagcctgatgagcaggaccccagacaccatcagtgaccagacccagatgatggtgtcccagatcccccccaacagcagcaacagcgtggtgcctgtgagcaacccagcccatggagatggcctgaccaggctcttcccccccagcaacaactttgtgaccccagccctgcggcagacagaggtgcagtgtggcagccagcccagcgtggccgagcagcagcagacccaggccagccagcacctgcaggccctgcagcagcacgtgcctgcccagggcgtgagccacctgcacagcaaccacctgtacatcaagcagcagcagcagcagcagcagcagcagcagcagcagcagcagcagcagcaggccggccagctgcgggagcggcaccacctgtaccagatgcagcaccacgtgccccacgccgagagctctgtgcacagccagccccacaacgtgcaccagcagaggaccctgcagcaggaggtgcagatgcagaagaagaggaacctggtgcagggcacccagaccagccagctgagcctgcagcccaagcaccacggcacagaccagagccgcagcaagacaggccagccccacccccaccaccagcagatgcagcagcagatgcagcagcacttcggcagcagccagacagagaagagctgtgagaaccccagcaccagcaggaaccaccacaaccacccccagaaccacctgaaccaggacatcatgcaccagcagcaggatgtgggcagccggcagcagggcagcggcgtgagcagcgagcacgtgtctggccacaaccccatgcagaggctgctgaccagccggggcctggagcagcagatggtgtcccagcccagcatcgtgaccaggagcagtgacatgacctgcaccccccacaggcctgagaggaacagagtgtcctcctacagcgctgaggccctgattggcaagaccagcagcaacagcgagcagaggatgggcatcagcatccagggcagccgggtgtctgaccagctggagatgaggagctacctggatgtgcccaggaacaagagcctggccatccacaacatgcagggccgggtggaccacacagtggccagtgacatccggctgagtgactgccagaccttcaagcccagcggggccagccagcagccccagagcaactttgaggtgcagagcagcaggaacaatgagatcggcaaccctgtgagcagcctgcgctccatgcagagccaggccttccgcatcagccagaacacaggccccccacccatcgaccggcagaagaggctgagctacccacctgtgcagagcatccccactggaaatggcatccccagccgggacagcgagaacacctgccaccagagcttcatgcagagcctgctggccccccacctgagtgaccaggtgattggcagccagaggagcctgtctgagcaccagaggaacacccagtgtggccccagcagcgccatcgagtacaactgcccccccacccatgaaaatgtgcacatccggcgggagagcgagagccagaaccgggagagctgtgacatgagcctgggcgccatcaacaccaggaacagcaccctgaacatccccttcagcagcagcagcagcagcggggacatccagggcaggaacaccagccccaacgtgtctgtgcagaagagcaaccccatgaggatcacagagagccacgccaccaagggccacatgaacccccctgtgaccaccaacatgcacggcgtggcccggcctgccctgccccaccccagcgtgagccacggcaatggagaccagggccctgctgtgcggcaggccaacagctctgtgccccagaggagccgccaccccctgcaggacagcagcggcagcaagatccggcagcctgagaggaacagaagtggcaaccagaggcagagcacagtgtttgaccccagcctgccccacctgcccctgagcactggaggctccatgatcctgggccggcagcagcctgccacagagaagaggggcagcatcgtgcgcttcatgccagacagcccccaggtgcccaatgacaacagcggccctgaccagcacaccctgagccagaactttggcttctccttcatccctgagggcggcatgaacccccccatcaatgccaatgccagcttcatcccccaggtgacccagcccagcgccaccaggaccccagccctgatccctgtggacccccagaacaccctgcccagcttctacccaccctacagccctgcccaccccaccctgagcaatgacatcagcatcccctacttccccaaccagatgttcagcaaccccagcacagagaaggtgaacagcggcagcctgaacaaccgcttcggcagcatcctgagcccccccaggcctgtgggctttgcccagcccagcttccccctgctgcctgacatgccacccatgcacatgaccaacagccacctgagcaacttcaacatgaccagcctcttccctgagatcgccaccgtgctgcctgatggcagcgccatgagccccctgctgaccatcgccaacagcagcgccagtgacagcagcaagcagagcagcaacagacctgcccacaacatcagccacatcctgggccatgactgcagcagcgctgtgtag

SEQ ID NO: 16590 - DNA, 3444 bp, Artificial Sequence
  Description of Artificial Sequence: Synthetic coding sequence
atggctgtggacagcgccatggagctgctcttcctggacaccttcaagcaccccagcgctgagcagagcagccacattgatgtggtgcgcttcccctgtgtggtgtacatcaatgaggtgcgggtcatccccccaggagtgcgggcccacagcagcctgcctgacaacagagcctatggagagaccagcccccacaccttccagctggacctcttcttcaacaacgtgtccaagcccagcgcccctgtgtttgaccggctgggcagcctggagtatgatgagaacaccagcatcatcttccggcccaacagcaaggtgaacacagatggcctggtgctgcggggctggtacaactgcctgaccctggccatctacggctctgtggacagagtcatcagccatgaccgggacagccccccacctcctcctcctcctcctcctccaccccagccccagcccagcctgaagaggaaccccaagcatgctgatggagagaaggaggaccagttcaacggcagccccccccggccccagccccggggccccaggaccccacctggccccccacctccagatgatgatgaagatgatcctgtgcccctgcctgtgtctggggacaaggaggaggatgccccccaccgggaggactactttgagcccatcagcccagacagaaattctgtgccccaggagggccagtacagtgatgaaggagaggtggaggaggagcagcaggaggagggggaggaggatgaagatgatgtggatgtggaggaggaggaggatgaagatgaagatgacagaagaacagtggacagcatccctgaggaggaggaggaggatgaggaggaggagggggaggaggatgaggagggggagggagatgatggctatgagcagatcagcagtgatgaagatggcattgctgacctggagcgggagaccttcaagtaccccaactttgatgtggagtacacagctgaggacctggcctctgtgccccccatgacctatgacccctatgaccgggagctggtgcccctgctgtacttcagctgcccctacaagaccacctttgaaattgagatcagcaggatgaaggaccagggccctgacaaggagaacagcggggccatcgaggcctctgtgaagctgacagagctgctggacctgtaccgggaggacagaggagccaagtgggtgacagccctggaggagatccccagcctcatcatcaagggcctgagctacctgcagctgaagaacaccaagcaggacagcctgggccagctggtggactggaccatgcaggccctgaacctgcaggtggccctgcggcagcccatcgccctgaatgtgcggcagctgaaggccggcaccaagctggtgagcagcctggccgagtgtggggcccagggcgtgacaggcctgctgcaggccggggtcatcagcggcctgtttgagctgctgtttgctgaccacgtgagcagcagcctgaagctgaatgccttcaaggccctggacagcgtcatctccatgacagagggcatggaggccttcctgcggggccggcagaatgagaagagcggctaccagaagctgctggagctgatcctgctggaccagacagtgcgggtggtgacagctggcagcgccatcctgcagaagtgccacttctatgaggtgctgtctgagatcaagaggctgggggaccacctggccgagaagaccagcagcctgcccaaccacagcgagccagaccatgacacagatgctggcctggagaggaccaacccagaatatgaaaatgaggtggaggcctccatggacatggacctgctggagagcagcaacatcagcgagggggagattgaaagactcatcaacctgctggaggaggtgttccacctgatggagacagccccccacaccatgatccagcagcctgtgaagagcttccccaccatggcccgcatcaccggccccccagagagagatgacccctaccctgtgctcttccgctacctgcacagccaccacttcctggagctggtgaccctgctgctgagcatccctgtgaccagcgcccaccctggggtgctgcaggccaccaaggatgtgctgaagttcctggcccagagccagaagggcctgctcttcttcatgtctgaatatgaggccaccaacctgctgatccgggccctgtgccacttctatgaccaggatgaggaggagggcctgcagagtgatggagtgattgatgatgcctttgccctgtggctgcaggacagcacccagaccctgcagtgcatcacagagctgttcagccacttccagcgctgcacagccagcgaggagacagaccacagcgacctgctgggcaccctgcacaacctgtacctgatcaccttcaaccctgtgggccgctctgctgtgggccacgtgttcagcctggagaagaacctgcagagcctcatcaccctgatggagtactacagcaaggaggccctgggggacagcaagagcaagaagtctgtggcctacaactatgcctgcatcctgatcctggtggtggtgcagagcagcagtgatgtgcagatgctggagcagcacgccgccagcctgctgaagctgtgcaaggcagatgaaaataatgccaagctgcaggagctgggcaagtggctggagcccctgaagaacctgcgctttgagatcaactgcatccccaacctgattgaatatgtgaagcagaacatcgacaacctgatgaccccagagggcgtgggcctgaccacagccctgcgggtgctgtgcaatgtggcctgccccccacctcctgtggagggccagcagaaggacctgaagtggaacctggccgtcatccagctgttctctgctgagggcatggacaccttcatccgggtgctgcagaagctgaacagcatcctgacccagccctggaggctgcacgtgaacatgggcaccaccctgcaccgggtgaccaccatctccatggcccgctgcaccctgaccctgctgaagaccatgctgacagagctgctgcggggcggcagctttgagttcaaggacatgagggtgcccagcgccctggtgaccctgcacatgctgctgtgcagcatccccctgagcggccgcctggacagtgatgagcagaagatccagaatgacatcatcgacatcctgctgaccttcacccagggcgtgaatgagaagctgaccatcagcgaggagaccctggccaacaacacctggagcctgatgctgaaggaggtgctgagcagcatcctgaaggtgcctgagggcttcttcagcggcctcatcctgctgtctgagctgctgcccctgcccctgcccatgcagaccacccaggtgtccctgccctacaacatgcacctgatcaatgactgcagcaacaccttctag

SEQ ID NO: 16591 - DNA, 4134 bp, Artificial Sequence
  Description of Artificial Sequence: Synthetic coding sequence
atggctgtggacagcgccatggagctgctcttcctggacaccttcaagcaccccagcgctgagcagagcagccacattgatgtggtgcgcttcccctgtgtggtgtacatcaatgaggtgcgggtcatccccccaggagtgcgggcccacagcagcctgcctgacaacagagcctatggagagaccagcccccacaccttccagctggacctcttcttcaacaacgtgtccaagcccagcgcccctgtgtttgaccggctgggcagcctggagtatgatgagaacaccagcatcatcttccggcccaacagcaaggtgaacacagatggcctggtgctgcggggctggtacaactgcctgaccctggccatctacggctctgtggacagagtcatcagccatgaccgggacagccccccacctcctcctcctcctcctcctccaccccagccccagcccagcctgaagaggaaccccaagcatgctgatggagagaaggaggaccagttcaacggcagccccccccggccccagccccggggccccaggaccccacctggccccccacctccagatgatgatgaagatgatcctgtgcccctgcctgtgtctggggacaaggaggaggatgccccccaccgggaggactactttgagcccatcagcccagacagaaattctgtgccccaggagggccagtacagtgatgaaggagaggtggaggaggagcagcaggaggagggggaggaggatgaagatgatgtggatgtggaggaggaggaggatgaagatgaagatgacagaagaacagtggacagcatccctgaggaggaggaggaggatgaggaggaggagggggaggaggatgaggagggggagggagatgatggctatgagcagatcagcagtgatgaagatggcattgctgacctggagcgggagaccttcaagtaccccaactttgatgtggagtacacagctgaggacctggcctctgtgccccccatgacctatgacccctatgaccgggagctggtgcccctgctgtacttcagctgcccctacaagaccacctttgaaattgagatcagcaggatgaaggaccagggccctgacaaggagaacagcggggccatcgaggcctctgtgaagctgacagagctgctggacctgtaccgggaggacagaggagccaagtgggtgacagccctggaggagatccccagcctcatcatcaagggcctgagctacctgcagctgaagaacaccaagcaggacagcctgggccagctggtggactggaccatgcaggccctgaacctgcaggtggccctgcggcagcccatcgccctgaatgtgcggcagctgaaggccggcaccaagctggtgagcagcctggccgagtgtggggcccagggcgtgacaggcctgctgcaggccggggtcatcagcggcctgtttgagctgctgtttgctgaccacgtgagcagcagcctgaagctgaatgccttcaaggccctggacagcgtcatctccatgacagagggcatggaggccttcctgcggggccggcagaatgagaagagcggctaccagaagctgctggagctgatcctgctggaccagacagtgcgggtggtgacagctggcagcgccatcctgcagaagtgccacttctatgaggtgctgtctgagatcaagaggctgggggaccacctggccgagaagaccagcagcctgcccaaccacagcgagccagaccatgacacagatgctggcctggagaggaccaacccagaatatgaaaatgaggtggaggcctccatggacatggacctgctggagagcagcaacatcagcgagggggagattgaaagactcatcaacctgctggaggaggtgttccacctgatggagacagccccccacaccatgatccagcagcctgtgaagagcttccccaccatggcccgcatcaccggccccccagagagagatgacccctaccctgtgctcttccgctacctgcacagccaccacttcctggagctggtgaccctgctgctgagcatccctgtgaccagcgcccaccctggggtgctgcaggccaccaaggatgtgctgaagttcctggcccagagccagaagggcctgctcttcttcatgtctgaatatgaggccaccaacctgctgatccgggccctgtgccacttctatgaccaggatgaggaggagggcctgcagagtgatggagtgattgatgatgcctttgccctgtggctgcaggacagcacccagaccctgcagtgcatcacagagctgttcagccacttccagcgctgcacagccagcgaggagacagaccacagcgacctgctgggcaccctgcacaacctgtacctgatcaccttcaaccctgtgggccgctctgctgtgggccacgtgttcagcctggagaagaacctgcagagcctcatcaccctgatggagtactacagcaaggaggccctgggggacagcaagagcaagaagtctgtggcctacaactatgcctgcatcctgatcctggtggtggtgcagagcagcagtgatgtgcagatgctggagcagcacgccgccagcctgctgaagctgtgcaaggcagatgaaaataatgccaagctgcaggagctgggcaagtggctggagcccctgaagaacctgcgctttgagatcaactgcatccccaacctgattgaatatgtgaagcagaacatcgacaacctgatgaccccagagggcgtgggcctgaccacagccctgcgggtgctgtgcaatgtggcctgccccccacctcctgtggagggccagcagaaggacctgaagtggaacctggccgtcatccagctgttctctgctgagggcatggacaccttcatccgggtgctgcagaagctgaacagcatcctgacccagccctggaggctgcacgtgaacatgggcaccaccctgcaccgggtgaccaccatctccatggcccgctgcaccctgaccctgctgaagaccatgctgacagagctgctgcggggcggcagctttgagttcaaggacatgagggtgcccagcgccctggtgaccctgcacatgctgctgtgcagcatccccctgagcggccgcctggacagtgatgagcagaagatccagaatgacatcatcgacatcctgctgaccttcacccagggcgtgaatgagaagctgaccatcagcgaggagaccctggccaacaacacctggagcctgatgctgaaggaggtgctgagcagcatcctgaaggtgcctgagggcttcttcagcggcctcatcctgctgtctgagctgctgcccctgcccctgcccatgcagaccacccaggtgattgagccccatgacatctctgtggccctgaacaccaggaagctgtggagcatgcacctgcacgtgcaggccaagctgctgcaggagatcgtgcgctccttcagcggcaccacctgccagcccatccagcacatgctgcggcgcatctgtgtgcagctgtgtgacctggccagccccacagccctgctgatcatgaggacagtgctggacctgattgtggaggacctgcagagcaccagcgaggacaaggagaagcagtacaccagccagaccacccggctgctggccctgctggatgccctggccagccacaaggcctgcaagctggccatcctgcacctgatcaatggcaccatcaagggagatgaaagatatgcagagatcttccaggacctgctggccctggtgcgcagccctggggacagcgtcatccggcagcagtgtgtggagtatgtgaccagcatcctgcagagcctgtgtgaccaggacatcgccctgatcctgcccagcagcagcgagggcagcatcagcgagctggagcagctgagcaacagcctgcccaacaaggagctgatgaccagcatctgtgactgcctgctggccaccctggccaacagcgagagcagctacaactgcctgctgacctgtgtgaggaccatgatgttcctggccgagcatgactatggcctcttccacctgaagagagatgctgtggagatgatcatggtgtcctggaagtag

SEQ ID NO: 16592 - DNA, 288 bp, Artificial Sequence
  Description of Artificial Sequence: Synthetic coding sequence
atggctgatgagaagcccaaggagggcgtgaagacagaaaataatgaccacatcaacctgaaggtggccggccaggacggctctgtggtgcagttcaagatcaagaggcacacccccctgagcaagctgatgaaggcctactgtgagcggcagggcctgtctgtgcggcagatccgcttccgctttgatggccagcccatcaatgaaacagacaccccagcccagctggagatggaggatgaggacaccattgatgtgttccagcagcagacaggaggagtgtactag

SEQ ID NO: 16593 - DNA, 6738 bp, Artificial Sequence; identical to SEQ ID NO: 16589
  Description of Artificial Sequence: Synthetic coding sequence

SEQ ID NO: 16594 - DNA, 216 bp, Artificial Sequence
  Description of Artificial Sequence: Synthetic coding sequence
atgaagcagctgaagaggaagaggaagagcaacttctctgtgcaggagacccagaccctgctgaaggagatcaccaagaggaaggaggtgatcttcagcaagcagctgaacaccaccatcaacgtgatgaagaggatggcctgggaggagatcgcccagtgtgtgaatgctgtgggggagggggagcagaggactggaacagaggtgaagaggtag

SEQ ID NO: 16595 - DNA, 591 bp, Artificial Sequence
  Description of Artificial Sequence: Synthetic coding sequence
atgaagcagctgaagaggaagaggaagagcaacttctctgtgcaggagacccagaccctgctgaaggagatcaccaagaggaaggaggtgatcttcagcaagcagctgaacaccaccatcaacgtgatgaagaggatggcctgggaggagatcgcccagtgtgtgaatgctgtgggggagggggagcagaggactggaacagaggtgaagaggcgctacctggactggagggccctgatgaagaggaagaggatgaaggccaacatcaagctggtgggcagcggcttccccctgcccagcagtgacctggatgacagcctgacagaggagattgatgagaagattggcttcagaaatgatgccaactttgactggcagaatgtggccgacttcagagatgctgggggcagcctgacagaggtgaaggtggaggaggaggagcgggacccccagagccctgagtttgaaattgaggaggaggaggagatgctgagcagcgtcatcccagacagccggcgggagaatgagctgcctgacttcccccacattgatgagttcttcaccctgaacagcacccccagccgctcctag

SEQ ID NO: 16596 - DNA, 336 bp, Artificial Sequence
  Description of Artificial Sequence: Synthetic coding sequence
atgaagcagctgaagaggaagaggaagagcaacttctctgtgcaggagacccagaccctgctgaaggagatcaccaagaggaaggaggtgatcttcagcaagcagctgaacaccaccatcaacgtgatgaagaggatggcctgggaggagatcgcccagtgtgtgaatgctgtgggggagggggagcagaggactggaacagaggtgaagaggcgctacctggactggagggccctgatgaagaggaagaggatgaaggccaacatcaagctggtgggcagcggcttccccctgcccagcagtgacctggatgacagcctgacagaggagatctag

SEQ ID NO: 16597 - DNA, 1158 bp, Artificial Sequence
  Description of Artificial Sequence: Synthetic coding sequence
atgcaggcctgtggcggcggcgctgctggaagaagagcctttgacagcatctgccccaacaggatgctggccctgcccggccgggccctgctgtgcaagccaggcaagccagagaggaagtttgccccacccaggaagttcttccctggctgcaccggcggcagccctgtgtctgtgtatgaagatcctccagatgctgagcccacagccctgcctgccctgaccaccatcgacctgcaggacctggccgactgcagcagcctgctgggcagtgatgcccctcctggaggagacctggccgccagccagaaccacagccaccagacagaagctgacttcaacctgcaggacttccgggacacagtggatgacctgatcagtgacagcagctccatgatgagccccaccctggccagcggggacttccccttcagcccctgtgacatcagccccttcggcccctgcctgagcccccccctggacccccgggccctgcagagcccccccctgcggcccccagatgtgcccccacctgagcagtactggaaggaggtggccgaccagaaccagagggccctgggagatgccctggtggagaacaaccagctgcacgtgaccctgacccagaagcaggaggagatcgccagcctgaaggagagaaatgtgcagctgaaggagctggccagcaggaccaggcacctggcctctgtgctggacaagctgatgatcacccagagccgggactgtggggctgctgctgagcccttcctgctgaaggccaaggccaagaggagcctggaggagctggtgtctgctgctggccaggactgtgccgaggtggatgccatcctgcgggagatcagcgagcgctgtgatgaggccctgcagagccgggaccccaagaggccccggctgctgcctgagcccgccaacacagacacccggcccggcaacctgcacggggccttccggggcctgaggacagactgcagccgcagcgccctgaacctgagccacagcgagctggaggagggcggcagcttcagcacccgcatccgcagccacagcaccatccgcaccctggccttcccccagggcaatgccttcaccatcagaacagccaatggaggctacaagttccgctgggtgcccagctag

SEQ ID NO: 16598 - DNA, 1866 bp, Artificial Sequence
  Description of Artificial Sequence: Synthetic coding sequence
atggctgactttgaggagctgaggaacatggtgtcctccttccgggtgtctgagctgcaggtgctgctgggctttgctggcaggaacaagagcggcaggaagcatgacctgctgatgagggccctgcacctgctgaagagcggctgcagccctgctgtgcagatcaagatccgggagctgtacagaagacgctaccccaggaccctggagggcctgagtgacctgagcaccatcaagagctctgtgttcagcctggatggcggcagcagccctgtggagccagacctggccgtggccggcatccacagcctgcccagcacctctgtgaccccccacagccccagcagccctgtgggctctgtgctgctgcaggacaccaagcccacctttgagatgcagcagcccagcccccccatcccccctgtgcacccagatgtgcagctgaagaacctgcccttctatgatgtgctggatgtgctgatcaagcccaccagcctggtgcagagcagcatccagcgcttccaggagaagttcttcatctttgccctgaccccccagcaggtgcgggagatctgcatcagccgggacttcctgcccggcggccggcgggactacacagtgcaggtgcagctgcggctgtgcctggccgagaccagctgcccccaggaggacaactaccccaacagcctgtgcatcaaggtgaatggcaagctgttccccctgcccggctacgcccccccacccaagaatggcatcgagcagaagaggcctggccggcccctgaacatcaccagcctggtgcggctgagcagcgctgtgcccaaccagatcagcatctcctgggccagcgagatcggcaagaactacagcatgtctgtgtacctggtgcggcagctgaccagcgccatgctgctgcagaggctgaagatgaagggcatccggaacccagaccacagccgggccctgatcaaggagaagctgacagctgaccctgattctgaaattgccaccaccagcctgcgggtgtccctgatgtgccccctgggcaagatgaggctgaccatcccctgcagagctgtgacctgcacccacctgcagtgctttgatgctgccctgtacctgcagatgaatgagaagaagcccacctggatctgccctgtgtgtgacaagaaggccgcctatgagagcctcatcctggatggcctcttcatggagatcctgaatgactgcagtgatgtggatgagatcaagttccaggaggatggctcctggtgccccatgaggcccaagaaggaggccatgaaggtgagcagccagccctgcaccaagattgagagcagctctgtgctgagcaagccctgcagcgtgacagtggccagcgaggccagcaagaagaaggtggatgtgattgacctgaccatcgagagcagcagtgatgaggaggaggaccccccagccaagaggaagtgcatcttcatgtctgagacccagagcagccccaccaagggcgtgctgatgtaccagcccagctctgtgcgggtgcccagcgtgacctctgtggaccctgctgccatcccccccagcctgacagactacagcgtgcccttccaccacacccccatcagctccatgagcagtgacctgcccggcctggacttcctgagcctcatccctgtggacccccagtactgcccccccatgttcctggacagcctgaccagccccctgacagccagcagcacctctgtgaccaccaccagcagccatgagagcagcacccacgtgagcagcagcagcagccgctctgagaccggggtcatcaccagcagcggcagcaacatcccagacatcatcagcctggactag

SEQ ID NO: 16599 - DNA, 1866 bp, Artificial Sequence
  Description of Artificial Sequence: Synthetic coding sequence
atggccaactttgaggagatcatcaacatggtgtcctccttccgggtgtctgagctgcaggtgctgctgggctttgctggcaggaacaagagcggcaggaagcatgacctgctgatgagggccctgcacctgctgaagagcggctgcagccctgctgtgcagatcaagatccgggagctgtacagaagacgctaccccaggaccctggagggcctgagtgacctgagcaccatcaagagctctgtgttcagcctggatggcggcagcagccctgtggagccagacctggccgtggccggcatccacagcctgcccagcacctctgtgaccccccacagccccagcagccctgtgggctctgtgctgctgcaggacaccaagcccacctttgagatgcagcagcccagcccccccatcccccctgtgcacccagatgtgcagctgaagaacctgcccttctatgatgtgctggatgtgctgatcaagcccaccagcctggtgcagagcagcatccagcgcttccaggagaagttcttcatctttgccctgaccccccagcaggtgcgggagatctgcatcagccgggacttcctgcccggcggccggcgggactacacagtgcaggtgcagctgcggctgtgcctggccgagaccagctgcccccaggaggacaactaccccaacagcctgtgcatcaaggtgaatggcaagctgttccccctgcccggctacgcccccccacccaagaatggcatcgagcagaagaggcctggccggcccctgaacatcaccagcctggtgcggctgagcagcgctgtgcccaaccagatcagcatctcctgggccagcgagatcggcaagaactacagcatgtctgtgtacctggtgcggcagctgaccagcgccatgctgctgcagaggctgaagatgaagggcatccggaacccagaccacagccgggccctgatcaaggagaagctgacagctgaccctgattctgaaattgccaccaccagcctgcgggtgtccctgatgtgccccctgggcaagatgaggctgaccatcccctgcagagctgtgacctgcacccacctgcagtgctttgatgctgccctgtacctgcagatgaatgagaagaagcccacctggatctgccctgtgtgtgacaagaaggccgcctatgagagcctcatcctggatggcctcttcatggagatcctgaatgactgcagtgatgtggatgagatcaagttccaggaggatggctcctggtgccccatgaggcccaagaaggaggccatgaaggtgagcagccagccctgcaccaagattgagagcagctctgtgctgagcaagccctgcagcgtgacagtggccagcgaggccagcaagaagaaggtggatgtgattgacctgaccatcgagagcagcagtgatgaggaggaggaccccccagccaagaggaagtgcatcttcatgtctgagacccagagcagccccaccaagggcgtgctgatgtaccagcccagctctgtgcgggtgcccagcgtgacctctgtggaccctgctgccatcccccccagcctgacagactacagcgtgcccttccaccacacccccatcagctccatgagcagtgacctgcccggcctggacttcctgagcctcatccctgtggacccccagtactgcccccccatgttcctggacagcctgaccagccccctgacagccagcagcacctctgtgaccaccaccagcagccatgagagcagcacccacgtgagcagcagcagcagccgctctgagaccggggtcatcaccagcagcggcagcaacatcccagacatcatcagcctggactag

SEQ ID NO: 16600 - DNA, 1719 bp, Artificial Sequence
  Description of Artificial Sequence: Synthetic coding sequence
atggctgactttgaggagctgaggaacatggtgtcctccttccgggtgtctgagctgcaggtgctgctgggctttgctggcaggaacaagagcggcaggaagcatgacctgctgatgagggccctgcacctgctgaagagcggctgcagccctgctgtgcagatcaagatccgggagctgtacagaagacgctaccccaggaccctggagggcctgagtgacctgagcaccatcaagagctctgtgttcagcctggatggcggcagcagccctgtggagccagacctggccgtggccggcatccacagcctgcccagcacctctgtgaccccccacagccccagcagccctgtgggctctgtgctgctgcaggacaccaagcccacctttgagatgcagcagcccagcccccccatcccccctgtgcacccagatgtgcagctgaagaacctgcccttctatgatgtgctggatgtgctgatcaagcccaccagcctggtgcagagcagcatccagcgcttccaggagaagttcttcatctttgccctgaccccccagcaggtgcgggagatctgcatcagccgggacttcctgcccggcggccggcgggactacacagtgcaggtgcagctgcggctgtgcctggccgagaccagctgcccccaggaggacaactaccccaacagcctgtgcatcaaggtgaatggcaagctgttccccctgcccggctacgcccccccacccaagaatggcatcgagcagaagaggcctggccggcccctgaacatcaccagcctggtgcggctgagcagcgctgtgcccaaccagatcagcatctcctgggccagcgagatcggcaagaactacagcatgtctgtgtacctggtgcggcagctgaccagcgccatgctgctgcagaggctgaagatgaagggcatccggaacccagaccacagccgggccctgatcaaggagaagctgacagctgaccctgattctgaaattgccaccaccagcctgcgggtgtccctgatgtgccccctgggcaagatgaggctgaccatcccctgcagagctgtgacctgcacccacctgcagtgctttgatgctgccctgtacctgcagatgaatgagaagaagcccacctggatctgccctgtgtgtgacaagaaggccgcctatgagagcctcatcctggatggcctcttcatggagatcctgaatgactgcagtgatgtggatgagatcaagttccaggaggatggctcctggtgccccatgaggcccaagaaggaggccatgaaggtgagcagccagccctgcaccaagattgagagcagctctgtgctgagcaagccctgcagcgtgacagtggccagcgaggccagcaagaagaaggtggatgtgattgacctgaccatcgagagcagcagtgatgaggaggaggaccccccagccaagaggaagtgcatcttcatgtctgagacccagagcagccccaccaagggcgtgctgatgtaccagcccagctctgtgcgggtgcccagcgtgacctctgtggaccctgctgccatcccccccagcctgacagactacagcgtgcccttccaccacacccccatcagctccatgagcagtgacctgcctggagagcagaggagaaatgacatcaacaatgagctgaagctgggcaccagcagtgacacagtgcagcagtag

SEQ ID NO: 16601 - DNA, 1191 bp, Artificial Sequence
  Description of Artificial Sequence: Synthetic coding sequence
agaaacctgaacaacatggtgtcctccttccgggtgtctgagctgcaggtgctgctgggctttgctggcaggaacaagagcggcaggaagcatgacctgctgatgagggccctgcacctgctgaagagcggctgcagccctgctgtgcagatcaagatccgggagctgtacagaagacgctaccccaggaccctggagggcctgagtgacctgagcaccatcaagagctctgtgttcagcctggatggcggcagcagccctgtggagccagacctggccgtggccggcatccacagcctgcccagcacctctgtgaccccccacagccccagcagccctgtgggctctgtgctgctgcaggacaccaagcccacctttgagatgcagcagcccagcccccccatcccccctgtgcacccagatgtgcagctgaagaacctgcccttctatgatgtgctggatgtgctgatcaagcccaccagcctggtgcagagcagcatccagcgcttccaggagaagttcttcatctttgccctgaccccccagcaggtgcgggagatctgcatcagccgggacttcctgcccggcggccggcgggactacacagtgcaggtgcagctgcggctgtgcctggccgagaccagctgcccccaggaggacaactaccccaacagcctgtgcatcaaggtgaatggcaagctgttccccctgcccggctacgcccccccacccaagaatggcatcgagcagaagaggcctggccggcccctgaacatcaccagcctggtgcggctgagcagcgctgtgcccaaccagatcagcatctcctgggccagcgagatcggcaagaactacagcatgtctgtgtacctggtgcggcagctgaccagcgccatgctgctgcagaggctgaagatgaagggcatccggaacccagaccacagccgggccctgatcaaggagaagctgacagctgaccctgattctgaaattgccaccaccagcctgcgggtgtccctgatgtgccccctgggcaagatgaggctgaccatcccctgcagagctgtgacctgcacccacctgcagtgctttgatgctgccctgtacctgcagatgaatgagaagaagcccacctggatctgccctgtgtgtgacaagaaggccgcctatgagagcctcatcctggactag

SEQ ID NO: 16602 - DNA, 1866 bp, Artificial Sequence; identical to SEQ ID NO: 16598
  Description of Artificial Sequence: Synthetic coding sequence

SEQ ID NO: 16603 - DNA, 849 bp, Artificial Sequence
  Description of Artificial Sequence: Synthetic coding sequence
atgtctgtgtacctggtgcggcagctgaccagcgccatgctgctgcagaggctgaagatgaagggcatccggaacccagaccacagccgggccctgatcaaggagaagctgacagctgaccctgattctgaaattgccaccaccagcctgcgggtgtccctgatgtgccccctgggcaagatgaggctgaccatcccctgcagagctgtgacctgcacccacctgcagtgctttgatgctgccctgtacctgcagatgaatgagaagaagcccacctggatctgccctgtgtgtgacaagaaggccgcctatgagagcctcatcctggatggcctcttcatggagatcctgaatgactgcagtgatgtggatgagatcaagttccaggaggatggctcctggtgccccatgaggcccaagaaggaggccatgaaggtgagcagccagccctgcaccaagattgagagcagctctgtgctgagcaagccctgcagcgtgacagtggccagcgaggccagcaagaagaaggtggatgtgattgacctgaccatcgagagcagcagtgatgaggaggaggaccccccagccaagaggaagtgcatcttcatgtctgagacccagagcagccccaccaagggcgtgctgatgtaccagcccagctctgtgcgggtgcccagcgtgacctctgtggaccctgctgccatcccccccagcctgacagactacagcgtgcccttccaccacacccccatcagctccatgagcagtgacctgcctggagagcagaggagaaatgacatcaacaatgagctgaagctgggcaccagcagtgacacagtgcagcagtag

SEQ ID NO: 16604 - DNA, 1023 bp, Artificial Sequence
  Description of Artificial Sequence: Synthetic coding sequence
atggagaccgtcatcagcagtgacagcagccctgctgtggagaatgagcacccccaggagaccccagagagcaacaacagcgtgtacaccagcttcatgaagagccaccgctgctatgacctgatccccaccagcagcaagctggtggtgtttgacaccagcctgcaggtgaagaaggccttctttgccctggtgaccaatggagtgcgggccgcccccctgtgggacagcaagaagcagagctttgtggtgctgcgggccctgagctgccccctgggcatgctgaccatcacagacttcatcaacatcctgcaccgctactacaagagcgccctggtgcagatctatgagctggaggagcacaagattgagacctggagggaggtgtacctgcaggacagcttcaagcccctggtgtgcatcagccccaatgccagcctgtttgatgctgtgagcagcctcatccggaacaagatccaccggctgcctgtgattgatcctgagagcggcaacaccctgtacatcctgacccacaagaggatcctgaagttcctgaagctgttcatcacagagttccccaagccagagttcatgagcaagagcctggaggagctgcagatcggcacctacgccaacatcgccatggtgaggaccaccacccctgtgtatgtggccctgggcatctttgtgcagcaccgggtgtctgccctgcctgtggtggatgagaagggccgggtggtggacatctacagcaagtttgatgtgatcaacctggccgctgagaagacctacaacaacctggatgtgtctgtgaccaaggccctgcagcacaggagccactactttgagggcgtgctgaagtgctacctgcacgagaccctggagaccatcatcaaccggctggtggaggccgaggtgcaccggctggtggtggtggatgaaaatgatgtggtgaagggcatcgtgtccctgagtgacatcctgcaggccctggtgctgaccggcggggagaagaagccctag

SEQ ID NO: 16605 - DNA, 900 bp, Artificial Sequence
  Description of Artificial Sequence: Synthetic coding sequence
atgaagagccaccgctgctatgacctgatccccaccagcagcaagctggtggtgtttgacaccagcctgcaggtgaagaaggccttctttgccctggtgaccaatggagtgcgggccgcccccctgtgggacagcaagaagcagagctttgtgggcatgctgaccatcacagacttcatcaacatcctgcaccgctactacaagagcgccctggtgcagatctatgagctggaggagcacaagattgagacctggagggaggtgtacctgcaggacagcttcaagcccctggtgtgcatcagccccaatgccagcctgtttgatgctgtgagcagcctcatccggaacaagatccaccggctgcccgtcatcgaccctgagagcggcaacaccctgtacatcctgacccacaagaggatcctgaagttcctgaagctgttcatcacagagttccccaagccagagttcatgagcaagagcctggaggagctgcagatcggcacctacgccaacatcgccatggtgaggaccaccacccctgtgtatgtggccctgggcatctttgtgcagcaccgggtgtctgccctgcctgtggtggatgagaagggccgggtggtggacatctacagcaagtttgatgtgatcaacctggccgctgagaagacctacaacaacctggatgtgtctgtgaccaaggccctgcagcacaggagccactactttgaaggagtgctgaagtgctacctgcacgagaccctggagaccatcatcaaccggctggtggaggccgaggtgcaccggctggtggtggtggatgaaaatgatgtggtgaagggcatcgtgtccctgagtgacatcctgcaggccctggtgctgactggaggagagaagaagccctag

SEQ ID NO: 16606 - DNA, 2823 bp, Artificial Sequence
  Description of Artificial Sequence: Synthetic coding sequence
atgggcagcggccccatcgaccccaaggagctgctgaagggcctggacagcttcctgaacagagatggagaggtgaagtctgtggatggcatcagcaagatcttcagcctgatgaaggaggccaggaagatggtgagccgctgcacctacctgaacatcctgctgcagaccaggagccctgagatcctggtgaagttcattgatgtgggcggctacaagctgctgaacaactggctgacctacagcaagaccaccaacaacatccccctgctgcagcagatcctgctgaccctgcagcacctgcccctgactgtggaccacctgaagcagaacaacacagccaagctggtgaagcagctgagcaagagcagtgaagatgaggagctgaggaagctggcctctgtgctggtgtctgactggatggccgtcatccgcagccagagcagcacccagcctgctgagaaggacaagaagaagaggaaggatgagggcaagagcaggaccaccctgcctgagcggcccctgacagaggtgaaggccgagaccagggctgaggaggcccctgagaagaagcgggagaagcccaagagcctgcggaccacagcccccagccacgccaagttccgcagcacaggcctggagctggagacccccagcctggtgcctgtgaagaagaatgccagcacagtggtggtgtctgacaagtacaacctgaagcccatccccctgaagaggcagagcaatgtggccgcccctggagatgccaccccacctgctgagaagaagtacaagcccctgaacaccaccccaaatgccaccaaggagatcaaggtgaagatcatccccccccagcccatggagggcctgggcttcctggatgccctgaacagcgcccctgtgcccggcatcaagatcaagaagaagaagaaggtgctgagccccacagctgccaagcccagcccctttgagggcaagaccagcacagagcccagcacagccaagcccagcagccctgagcccgccccacccagcgaggccatggatgctgaccggcccggcacccctgtgccccctgtggaggtgcctgagctgatggacacagccagcctggagcccggggccctggatgccaagcctgtggagagccctggggaccccaaccagctgaccaggaagggcaggaagaggaagtctgtgacctggccagaggagggcaagctgcgggagtacttctactttgagctggatgaaacagagcgggtgaatgtgaacaagatcaaggactttggagaggccgccaagcgggagatcctgagtgacagacatgcctttgaaacagcccggcggctgagccatgacaacatggaggagaaggtgccctgggtgtgcccccggcccctggtgctgcccagccccctggtgaccccaggcagcaacagccaggagcgctacatccaggccgagcgggagaagggcatcctgcaggagctgttcctgaacaaggagagcccccatgagccagaccctgagccctatgagcccatcccccccaagctgatccccctggatgaagaatgttccatggatgagaccccctacgtggagaccctggagcccggcggcagcggcggcagcccagatggagctgggggcagcaagctgccccctgtgctggccaacctgatgggctccatgggcgctgggaagggcccccagggccctgggggcggcggcatcaacgtgcaggagatcctgaccagcatcatgggcagccccaacagccaccccagcgaggagctgctgaagcagcctgactacagcgacaagatcaagcagatgctggtgccccacggcctgctgggccctggccccatcgccaacggcttccccccaggcggccctgggggccccaagggcatgcagcacttccccccaggccctgggggccccatgcctggcccccatggaggccctgggggccctgtgggcccccggctgctgggccccccacctccaccccggggcggggaccccttctgggatggccctggggaccccatgagaggaggccccatgaggggcggccctggccctggccctggcccctaccaccggggccggggcggccggggcggcaatgaacctcctcctcctcctccacccttccggggggcccggggcggccgcagcggcggcggcccccccaacggccggggcggccctgggggcggcatggtgggcggcggcggccaccggccccatgagggccctgggggcggcatgggcaacagcagcggccaccggccccatgagggccctgggggcggcatgggcagcggccaccggccccatgagggccctgggggctccatgggcggcggcggcggccaccggccccatgagggccctgggggcggcatcagcggcggcagcggccaccggccccatgagggccctgggggcggcatgggcgccggcggcggccaccggccccatgagggccctgggggctccatgggcggcagcggcggccaccggccccatgagggccctggccatggaggcccccacggccaccggccccatgatgtgcccggccaccggggccatgaccaccggggccccccacctcatgagcaccggggccatgatggccctggccacggcggcggcggccaccggggccatgatggcggccacagccacggcggggacatgagcaacagacctgtgtgccgccacttcatgatgaagggcaactgccgctatgagaacaactgtgccttctaccaccctggggtgaatggaccacccctgccctag

SEQ ID NO: 16607 - DNA, 2823 bp, Artificial Sequence; identical to SEQ ID NO: 16606
  Description of Artificial Sequence: Synthetic coding sequence

SEQ ID NO: 16608 - DNA, 2823 bp, Artificial Sequence; identical to SEQ ID NO: 16606
  Description of Artificial Sequence: Synthetic coding sequence

SEQ ID NO: 16609 - DNA, 2823 bp, Artificial Sequence; identical to SEQ ID NO: 16606
  Description of Artificial Sequence: Synthetic coding sequence

SEQ ID NO: 16610 - DNA, 2823 bp, Artificial Sequence; identical to SEQ ID NO: 16606
  Description of Artificial Sequence: Synthetic coding sequence

SEQ ID NO: 16611 - DNA, 2823 bp, Artificial Sequence; identical to SEQ ID NO: 16606
  Description of Artificial Sequence: Synthetic coding sequence

SEQ ID NO: 16612 - DNA, 2823 bp, Artificial Sequence; identical to SEQ ID NO: 16606
  Description of Artificial Sequence: Synthetic coding sequence

SEQ ID NO: 16613 - DNA, 939 bp, Artificial Sequence
  Description of Artificial Sequence: Synthetic coding sequence
atgggcagcggccccatcgaccccaaggagctgctgaagggcctggacagcttcctgaacagagatggagaggtgaagtctgtggatggcatcagcaagatcttcagcctgatgaaggaggccaggaagatggtgagccgctgcacctacctgaacatcctgctgcagaccaggagccctgagatcctggtgaagttcattgatgtgggcggctacaagctgctgaacaactggctgacctacagcaagaccaccaacaacatccccctgctgcagcagatcctgctgaccctgcagcacctgcccctgactgtggaccacctgaagcagaacaacacagccaagctggtgaagcagctgagcaagagcagtgaagatgaggagctgaggaagctggcctctgtgctggtgtctgactggatggccgtcatccgcagccagagcagcacccagcctgctgagaaggacaagaagaagaggaaggatgagggcaagagcaggaccaccctgcctgagcggcccctgacagaggtgaaggccgagaccagggctgaggaggcccctgagaagaagcgggagaagcccaagagcctgcggaccacagcccccagccacgccaagttccgcagcacaggcctggagctggagacccccagcctggtgcctgtgaagaagaatgccagcacagtggtggtgtctgacaagtacaacctgaagcccatccccctgaagaggcagagcaatgtggccgcccctggagatgccaccccacctgctgagaagaagtacaagcccctgaacaccaccccaaatgccaccaaggagatcaaggtgaagatcatccccccccagcccatggagggcctgggcttcctggatgccctgaacagcgcccctgtgcccggcatcaagatcaagaagaagaagaagaagaagtag

SEQ ID NO: 16614 - DNA, 939 bp, Artificial Sequence; identical to SEQ ID NO: 16613
  Description of Artificial Sequence: Synthetic coding sequence

SEQ ID NO: 16615 - DNA, 939 bp, Artificial Sequence; identical to SEQ ID NO: 16613
  Description of Artificial Sequence: Synthetic coding sequence

SEQ ID NO: 16616 - DNA, 939 bp, Artificial Sequence; identical to SEQ ID NO: 16613
  Description of Artificial Sequence: Synthetic coding sequence

SEQ ID NO: 16617 - DNA, 939 bp, Artificial Sequence; identical to SEQ ID NO: 16613
  Description of Artificial Sequence: Synthetic coding sequence

SEQ ID NO: 16618 - DNA, 939 bp, Artificial Sequence; identical to SEQ ID NO: 16613
  Description of Artificial Sequence: Synthetic coding sequence

SEQ ID NO: 16619 - DNA, 939 bp, Artificial Sequence; identical to SEQ ID NO: 16613
  Description of Artificial Sequence: Synthetic coding sequence

SEQ ID NO: 16620 - DNA, 3630 bp, Artificial Sequence
  Description of Artificial Sequence: Synthetic coding sequence
atgttcctgatgaatgccagccctgtggtggccctgcagagcaagtgggaggcctttggacctcctggcagctgccgcttcccccgctgcttcagcgaggctgatgaaggagtggagagcgcctctgtgtctgcccgggtgcagatgctgatcagcaccctgcagagagatggagctgcccggggcaccagtgatgagcgggccgcccagaggggccacagagctgagggctgccatgatgcccggcctgctgccaagcccaccgtgcacaaggagcccccagccctggccgtgtgtggcctggtggccgactttgaccccatgggagaggaggagaccacagactttggccccctggtgctggacagcgacagtgatgacagcgtggaccgggacatcgaggaggccatccaggagtacctgaaggccaagtctggagctgcccagcccggggccggcggggcccagcctggagctgcccagcccagcagagctgctgggggcggcagccgctgcaagccagagcccgcccacggcagcgcccccacagccctgtgcccccccaagctggtgcccggcagcggcggcggccctggcagccaggtgggcagcagcaaggaccagggcagcgccagccctgtgtctgtgtccagtgatgacagctttgagcagagcatccgggcagaaattgagcagttcctgaatgagaagaggcagcacgagacccagaagtgtgatggctctgtggagaagaagccagacaccaatgaaaattctgccaagagcctgctgaagagccaccaggagccccccaccaaggtggtgcaccggcagggcctgctgggcgtgcagaaggagtttgccttcaggaagccaccccggctggccaagatgaatgtgcagcccaggagcctgcggagcaaggtgaccaccacccaggagaatgaaggcagcaccaagccagccaccccctgccggcccagcgaggccgcccagaacaagggcggcatcaagaggtctgccagcgctgcccggcggggcaagagggtgatgtctgctgcccaggccagcgaggccagtgacagcagcagtgatgatggcatcgaggaggccatccagctgtaccagctgcagaagaccaggaaggaggctgatggagacctgccccagagggtgcagctgcgggaggagcgggccccagaccccccagcccacagcaccagcagcgccaccaagagcgccctgcctgagacccacaggaagacccccagcaagaagaagctggtggccaccaagaccatggaccccggccctgggggcctggacacagaccacgcccccaagctgctgaaggagaccaaggcccctcctccagccagccctgccagccgctcagaatttgtggagaggagcagctgcagagctgacaccagcgctgagctgatgtgtgccgaggccatcctggacatcagcaagaccatcctgcctgcccctgtggagggcagtgatggcagcctgagcgccagccccctcttctacagccccaacgtgcccagcagaagtgatggagacagcagctctgtggacagtgatgacagcattgagcaggagatccgcaccttcctggccctgaaggcccagagcggcagcctgctggcccggggggagagctgcccccaggccgcccagggccccctgctgcccccaggcctgaacagccagacaggaggccacaagacccccctgagcaagaccccagaccccctgctgggctgcaagaggaagaggcggggcggcggccacgtgcggcccagcacccccaagaagatgcaggaggtggtgaaggatggcagccaggatgctgaccacagccagggccgggcagagcccggccacgagcggcgggacctgcccatccagggcaaggccagcgaggccctgggcggggagggcacagcccggggccctggggacaccaggatgagccagggccagggcaagacagatgaggcccggcggctggatgagaaggagagcagcgaggacaagagcagcagcctggacagtgatgaggacctggacacagccatcaaggacctgctgcggagcaagaggaagctgaagaagcgctgccgggagccccgggccgcctgcaggaagaaggtgcgcttcagcacagcccagacccacttcctggagcagctgggcggcctgcggcgggactggaaggaccggggcccccctgtgctgaagagctgcctgagcaagagcaagagggacagcggggagggccctgggaagaagcccccatctgtgtttggcagcacagctgagaggatgaggcaggagggcgccgccagccaggatgctgccctggccttccgggtgagaagacctgccagcgccagcgccagcgagggcaaccccttcccccgggagagccagggccctgcccccagccctggcagcctgagtgatgacagcagctctgtggacagcaatgacagcattgagctggagatcaggaagttcctggccgagaaggccaaggagagcgtgagcagcagcgaggtgcaggccgagggccccacagccctgggcaccggcggccctgcccggcctgaggtgctgtgcaggaaggagcccgcccctcctcctggggtgtgcaccaggagccagagggcccggggcgtgccccacctggccgagggcctgcggggcacagagagcgctggggcccagggcacagctggcctcttcagccagggcggcaagggcctgcctgctgccccagcccggggggaccctgtgccccccaggagcaccagcggaggagtgtctgccaagggcctgtctgtgtccagaagaaatgtgtatgtgcacaaggaccagagccccagaggagctgagcctgctgccaagagcgccttcggccagctgcccagctgtgccacagctggaacagaggccggcggggcccggggcaccttccacatgggctgcggcagccccagcttcctgacccccagccctggagctgagagagatgctggggcccaggccgacaggaccccaccctggagcgactttgcccaccagagccggctgcccagcccctgggtgctgcggtctgagggcagagatgctgtgtggaggggcggcgtgggcagcgagcgggacaagggcagcgagggccctgcccggggcctgcccagcctgcccctggccggcttcagccccctgctgagcacccagctgttccactttggaaaaggagtgtcctggggcggccggcaggccggcctcttcagcccccacctgggcctgcccctgcagggccccagcttcagcgccttccgggaggcccaggccggccccagccctgtgtttggcagcccccacctgctggccaagaaggatggcggcccctggcccaccaggaaggcccaggccggcctgagcctgcatgaccggcgcagcagcggcagcgaggagagcatcctggacctgcgctacagaagaagagtgaacagagatgaccaggagcaggatgccctgggcagtgatgccagtgacttcagtgacaccagcacagaagattctgggggcagctctgtggtgaaggtgtag

SEQ ID NO: 16621 - DNA, 327 bp, Artificial Sequence
  Description of Artificial Sequence: Synthetic coding sequence
atgttcctgatgaatgccagccctgtggtggccctgcagagcaagtgggaggcctttggacctcctggcagctgccgcttcccccgctgcttcagcgaggctgatgaaggagtggagagcgcctctgtgtctgcccgggtgcagatgctgatcagcaccctgcagagagatggagctgcccggggcaccagtgatgagcgggccgcccagaggggccacagagctgagggctgccatgatgcccggcctgctgccaagcccaccgtgcacaaggagcccccagccctggccgtgtgtggcctggtggccgactttgaccccatgtag

SEQ ID NO: 16622 - DNA, 1728 bp, Artificial Sequence
  Description of Artificial Sequence: Synthetic coding sequence
atgcctcctgggaaggtgctgcagcctgtgctgaagatgaaggtggatgagctgttcctgtactggctgtctgaggccagcacccagaggatgctgcaggactgcctgcggcgcatcaaggcccctggccgggaccagcccaccccaggagatggagagcagcccggggcctggcccacagcccccctggccgccccccggcccagcggcctggagcccccaggcaccccaggccctggccctgccctgcccctgggcgccgccagcagccccagaaatgccccccacgtgcggggcaccaggagatctgctggcaccagggtggtgcagaccaggaaggaggagcccctgcccccagccaccagccagagcatccccaccttctacttcccccggggccggccccaggacagcgtgaatgtggatgctgtgatcagcaagattgagagcacctttgcccgcttcccccatgagcgggccaccatggatgacatgggcctggtggccaaggcctgtggctgccccctgtactggaagggccccctcttctacggggccggcggggagaggactggatctgtgtctgtgcacaagtttgtggccatgtggaggaagatcctgcagaactgccatgatgatgctgccaagtttgtgcacctgctgatgagccctggctgcaactacctggtgcaggaggactttgtgcccttcctgcaggatgtggtgaacacccaccctggcctgtccttcctgaaggaggccagcgagttccacagccgctacatcaccaccgtcatccagaggatcttctatgctgtgaacagatcctggagcggccgcatcacctgtgccgagctgcggcgcagcagcttcctgcagaatgtggccctgctggaggaggaggccgacatcaaccagctgacagagttcttctcctatgagcacttctacgtgatctactgcaagttctgggagctggacacagaccatgacctgctgattgatgctgatgacctggcccggcacaatgaccacgccctgagcaccaagatgattgaccgcatcttctctggagctgtgacccggggcaggaaggtgcagaaggagggcaagatctcctatgctgactttgtgtggttcctgatcagcgaggaggacaagaagacccccaccagcattgagtactggttccgctgcatggacctggatggagatggagccctgtccatgtttgagctggagtacttctatgaggagcagtgccggcggctggacagcatggccatcgaggccctgcccttccaggactgcctgtgccagatgctggacctggtgaagcccaggacagagggcaagatcaccctgcaggacctgaagcgctgcaagctggccaacgtgttctttgacaccttcttcaacatcgagaagtacctggaccacgagcagaaggagcagatcagcctgctgagagatggagacagcggcggccctgagctgagtgactgggagaagtatgctgctgaggagtatgacatcctggtggccgaggagacagctggggagccctgggaggatggctttgaagctgagctgagccctgtggagcagaagctgagcgccctgcggagccccctggcccagaggcccttctttgaggcccccagccccctgggcgctgtggacctgtatgaatatgcctgtggagatgaggacctggagcccctgtag

SEQ ID NO: 16623 - DNA, 2286 bp, Artificial Sequence
  Description of Artificial Sequence: Synthetic coding sequence
atgcccaacttctgtgccgcccccaactgcaccaggaagagcacccagagcgacctggccttcttccgcttcccccgggaccctgcccgctgccagaagtgggtggagaactgcagaagagctgacctggaggacaagaccccagaccagctgaacaagcactaccgcctgtgtgccaagcactttgagacctccatgatctgcaggaccagcccctacagaacagtgctgcgggacaatgccatccccaccatctttgacctgaccagccacctgaacaacccccacagccgccacaggaagaggatcaaggagctgtctgaagatgagatccgcaccctgaagcagaagaagattgatgagaccagcgagcaggagcagaagcacaaggagaccaacaacagcaatgcccagaaccccagcgaggaggagggggagggccaggatgaggacatcctgcccctgaccctggaggagaaggagaacaaggagtacctgaagagcctgtttgagatcctgatcctgatgggcaagcagaacatccccctggatggccacgaggctgatgagatccctgagggcctcttcaccccagacaacttccaggccctgctggagtgccgcatcaacagcggggaggaggtgctgaggaagagatttgagaccacagctgtgaacaccctcttctgcagcaagacccagcagaggcagatgctggagatctgtgagagctgcatccgggaggagaccctgcgggaggtgcgggacagccacttcttcagcatcatcacagatgatgtggtggacattgctggggaggagcacctgcctgtgctggtgcgctttgtggatgagagccacaacctgcgggaggagttcatcggcttcctgccctatgaagcagatgctgagatcctggccgtgaagttccacaccatgatcacagagaagtggggcctgaacatggagtactgccggggccaggcctacatcgtgagcagcggcttcagcagcaagatgaaggtggtggccagccggctgctggagaagtacccccaggccatctacaccctgtgcagcagctgtgccctgaacatgtggctggccaagtctgtgcctgtgatgggcgtgtctgtggccctgggcaccatcgaggaggtgtgcagcttcttccacaggagcccccagctgctgctggagctggacaacgtcatctctgtgctcttccagaacagcaaggagcggggcaaggagctgaaggagatctgccacagccagtggacaggaagacatgatgcctttgagatcctggtggagctgctgcaggccctggtgctgtgcctggatggcatcaacagcgacaccaacatccgctggaacaactacatcgccggccgggcctttgtgctgtgcagcgctgtgtctgactttgacttcatcgtgaccatcgtggtgctgaagaatgtgctgtccttcacccgggccttcggcaagaacctgcagggccagaccagtgatgtgttctttgctgctggcagcctgacagctgtgctgcacagcctgaatgaggtgatggagaacatcgaggtgtaccacgagttctggtttgaggaggccaccaacctggccaccaagctggacatccagatgaagctgcccgggaagttcagaagagcccaccagggcaacctggagagccagctgaccagcgagagctactacaaggagaccctgtctgtgcccaccgtggagcacatcatccaggagctgaaggacatcttcagcgagcagcacctgaaggccctgaagtgcctgagcctggtgcccagcgtgatgggccagctgaagttcaacaccagcgaggagcaccacgccgacatgtacagaagtgacctgcccaacccagacaccctgtctgctgagctgcactgctggaggatcaagtggaagcaccggggcaaggacatcgagctgcccagcaccatctatgaggccctgcacctgcctgacatcaagttcttccccaacgtgtatgccctgctgaaggtgctgtgcatcctgcctgtgatgaaggtggagaatgaaagatatgaaaatggaaggaagaggctgaaggcctacctgaggaacaccctgacagaccagaggagcagcaacctggccctgctgaacatcaactttgacatcaagcatgacctggacctgatggtggacacctacatcaagctgtacaccagcaagtctgagctgcccacagacaacagcgagaccgtggagaacacctag

SEQ ID NO: 16624 - DNA, 1761 bp, Artificial Sequence
  Description of Artificial Sequence: Synthetic coding sequence
atgggcaagcagaacatccccctggatggccatgaagcagatgagatccctgagggcctcttcaccccagacaacttccaggccctgctggagtgccgcatcaacagcggggaggaggtgctgaggaagagatttgagaccacagctgtgaacaccctcttctgcagcaagacccagcagaggcagatgctggagatctgtgagagctgcatccgggaggagaccctgcgggaggtgcgggacagccacttcttcagcatcatcacagatgatgtggtggacattgctggggaggagcacctgcctgtgctggtgcgctttgtggatgagagccacaacctgcgggaggagttcatcggcttcctgccctatgaagcagatgctgagatcctggccgtgaagttccacaccatgatcacagagaagtggggcctgaacatggagtactgccggggccaggcctacatcgtgagcagcggcttcagcagcaagatgaaggtggtggccagccggctgctggagaagtacccccaggccatctacaccctgtgcagcagctgtgccctgaacatgtggctggccaagtctgtgcctgtgatgggcgtgtctgtggccctgggcaccatcgaggaggtgtgcagcttcttccacaggagcccccagctgctgctggagctggacaacgtcatctctgtgctcttccagaacagcaaggagcggggcaaggagctgaaggagatctgccacagccagtggacaggaagacatgatgcctttgagatcctggtggagctgctgcaggccctggtgctgtgcctggatggcatcaacagcgacaccaacatccgctggaacaactacatcgccggccgggcctttgtgctgtgcagcgctgtgtctgactttgacttcatcgtgaccatcgtggtgctgaagaatgtgctgtccttcacccgggccttcggcaagaacctgcagggccagaccagtgatgtgttctttgctgctggcagcctgacagctgtgctgcacagcctgaatgaggtgatggagaacatcgaggtgtaccacgagttctggtttgaggaggccaccaacctggccaccaagctggacatccagatgaagctgcccgggaagttccggcgggcccaccagggcaacctggagagccagctgaccagcgagagctactacaaggagaccctgtctgtgcccaccgtggagcacatcatccaggagctgaaggacatcttcagcgagcagcacctgaaggccctgaagtgcctgagcctggtgcccagcgtgatgggccagctgaagttcaacaccagcgaggagcaccacgccgacatgtacagaagtgacctgcccaacccagacaccctgtctgctgagctgcactgctggaggatcaagtggaagcaccggggcaaggacatcgagctgcccagcaccatctatgaggccctgcacctgcctgacatcaagttcttccccaacgtgtatgccctgctgaaggtgctgtgcatcctgcctgtgatgaaggtggagaatgaaagatatgaaaatggaaggaagaggctgaaggcctacctgaggaacaccctgacagaccagaggagcagcaacctggccctgctgaacatcaactttgacatcaagcatgacctggacctgatggtggacacctacatcaagctgtacaccagcaagtctgagctgcccacagacaacagcgagaccgtggagaacacctag

SEQ ID NO: 16625 - DNA, 939 bp, Artificial Sequence
  Description of Artificial Sequence: Synthetic coding sequence
atggccaacagaacagtgaaggatgcccacagcatccacggcaccaacccccagtacctggtggagaagatcatccgcacccgcatctatgagagcaagtactggaaggaggagtgcttcggcctgacagctgagctggtggtggacaaggccatggagctgcgctttgtgggcggcgtgtatggaggcaacatcaagcccacccccttcctgtgcctgaccctgaagatgctgcagatccagcctgagaaggacatcatcgtggagttcatcaagaatgaagacttcaagtatgtgaggatgctgggcgccctgtacatgaggctgaccggcacagccatcgactgctacaagtacctggagcccctgtacaatgactacaggaagatcaagagccagaacagaaatggagaatttgagctgatgcacgtggatgagttcattgatgagctgctgcacagcgagcgggtgtgtgacatcatcctgccccggctgcagaagagatatgtgctggaggaggccgagcagctggagccccgggtgtctgccctggaggaggacatggatgatgtggagagcagcgaggaggaggaggaggaggatgagaagctggagcgggtgcccagcccagaccacagaagaagaagctacagagacctggacaagccccggcgcagccccaccctgcgctaccgccgcagccgcagccgcagccccaggagaagaagccgcagccccaagaggaggagccccagcccccggcgggagcggcacaggagcaagagcccccggcggcacaggagccgcagccgggacagaagacacaggagccgcagcaagagccctggccaccacaggagccaccgccacaggagccacagcaagagccctgagaggagcaagaagagccacaagaagagcagaagaggaaatgaatag

SEQ ID NO: 16626 - DNA, 1308 bp, Artificial Sequence
  Description of Artificial Sequence: Synthetic coding sequence
atgtgtggcggcgtgcggggcgtgggcaccggcggcatcgtgtccacagccttctgcctgctgtacaagctgttcaccctgaagctgaccaggaagcaggtgatgggcctcatcacccacacagacagcccctacatccgggccctgggcttcatgtacatccgctacacccagcccccaacagacctgtgggactggtttgagagcttcctggatgatgaggaggacctggatgtgaaggccggcggcggctgtgtgatgaccatcggggagatgctgcgctccttcctgaccaagctggagtggttcagcaccctcttcccccgcatccctgtgcctgtgcagaagaacatcgaccagcagatcaagacccggcccaggaagatcaagaaggatggcaaggagggcgctgaggagattgacagacatgtggagaggagaagaagccgcagccccaggaggagcctgagccccaggaggagccccaggaggagccgcagccgcagccaccaccgggagggccacggcagcagcagctttgaccgggagctggagcgggagaaggagcggcagaggctggagcgggaggccaaggagcgggagaaggagaggagaagaagccgcagcattgaccggggcctggagaggagaagaagccgcagccgggagcggcacaggagccgcagccgcagccgggacagaaaaggagaccggcgggaccgggaccgggagcgggagaaggaaaatgaaagaggaagaagaagagaccgggactatgacaaggagagaggaaatgaaagagagaaggagcgggagaggagccgggagaggagcaaggagcagaggagcagaggagaggtggaggagaagaagcacaaggaggacaaggatgacagaagacacagagatgacaagagggacagcaagaaggagaagaagcacagccgcagccgcagccgggagaggaagcacaggagccgcagccgcagcagaaatgccggcaagaggagccgcagccgcagcaaggagaagagcagcaagcacaagaatgaaagcaaggagaagagcaacaagaggagccgcagcggcagccagggccgcacagacagcgtggagaagagcaagaagcgggagcacagccccagcaaggagaagagcaggaagaggagccgcagcaaggagaggagccacaagagggaccacagcgacagcaaggaccagagcgacaagcatgacagaagaagaagccagagcattgagcaggagagccaggagaagcagcacaagaacaaggatgagaccgtgtag

SEQ ID NO: 16627 - DNA, 573 bp, Artificial Sequence
  Description of Artificial Sequence: Synthetic coding sequence
atggccaacaacagccctgccctgactggaaacagccagccccagcaccaggccgctgctgctgctgcccagcagcagcagcagtgtggcggcggcggggccaccaagccagctgtgtctgggaagcagggcaatgtgctgcccctgtggggcaatgagaagaccatgaacctgaaccccatgatcctgaccaacatcctgagcagcccctacttcaaggtgcagctgtatgagctgaagacctaccacgaggtggtggatgagatctacttcaaggtgacccacgtggagccctgggagaagggcagcaggaagacagctggccagacaggcatgtgtggcggcgtgcggggcgtgggcactggaggcatcgtgtccacagccttctgcctgctgtacaagctgttcaccctgaagctgaccaggaagcaggtgatgggcctcatcacccacacagacagcccctacatccgggccctgggcttcatgtacatccgctacacccagcccccaacagacctgtgggactggtttgagagcttcctggatgatgaggagttcttcaccctgtag

SEQ ID NO: 16628 - DNA, 1641 bp, Artificial Sequence
  Description of Artificial Sequence: Synthetic coding sequence
atggccaacaacagccctgccctgactggaaacagccagccccagcaccaggccgctgctgctgctgcccagcagcagcagcagtgtggcggcggcggggccaccaagccagctgtgtctgggaagcagggcaatgtgctgcccctgtggggcaatgagaagaccatgaacctgaaccccatgatcctgaccaacatcctgagcagcccctacttcaaggtgcagctgtatgagctgaagacctaccacgaggtggtggatgagatctacttcaaggtgacccacgtggagccctgggagaagggcagcaggaagacagctggccagacaggcatgtgtggcggcgtgcggggcgtgggcactggaggcatcgtgtccacagccttctgcctgctgtacaagctgttcaccctgaagctgaccaggaagcaggtgatgggcctcatcacccacacagacagcccctacatccgggccctgggcttcatgtacatccgctacacccagcccccaacagacctgtgggactggtttgagagcttcctggatgatgaggaggacctggatgtgaaggccggcggcggctgtgtgatgaccatcggggagatgctgcggagcttcctgaccaagctggagtggttcagcaccctcttcccccgcatccctgtgcctgtgcagaagaacatcgaccagcagatcaagacccggcccaggaagatcaagaaggatggcaaggagggcgctgaggagattgacagacatgtggagcggcggcgcagccgcagcccccggcgcagcctgagcccccggcgcagcccccggcgcagccgcagccgcagccaccaccgggagggccacggcagcagcagctttgaccgggagctggagcgggagaaggagcggcagaggctggagcgggaggccaaggagcgggagaaggagcggcggcgcagccgcagcattgaccggggcctggagcggcggcgcagccgcagccgggagcggcacaggagccgcagccgcagccgggacaggaagggggacagaagagaccgggaccgggagcgggagaaggaaaatgaaagaggaagaagaagagaccgggactatgacaaggagagaggaaatgaaagagagaaggagcgggagaggagccgggagaggagcaaggagcagaggagcagaggagaggtggaggagaagaagcacaaggaggacaaggatgaccggcggcacagagatgacaagagggacagcaagaaggagaagaagcacagccgcagccgcagccgggagaggaagcacaggagccgcagccgcagcagaaatgctgggaagaggagccgcagccgcagcaaggagaagagcagcaagcacaagaatgaaagcaaggagaagagcaacaagaggagccgcagcggcagccagggccgcacagattctgtggagaagagcaagaagcgggagcacagccccagcaaggagaagagcaggaagaggagccgcagcaaggagaggagccacaagagggaccacagcgacagcaaggaccagagcgacaagcatgacagaagaagaagccagagcattgagcaggagagccaggagaagcagcacaagaacaaggatgaaacagtgtag

SEQ ID NO: 16629 - DNA, 2010 bp, Artificial Sequence
  Description of Artificial Sequence: Synthetic coding sequence
atgcagaacagccacatggatgagtacagaaacagcagcaatggcagcactggaaacagcagcgaggtggtggtggagcaccccacagacttcagcacagagatcatgaatgtgacagagatggagcagagcccagatgacagccccaacgtgaatgccagcacagaggagacagagatggccagcgctgtggacctgcctgtgaccctgacagaaacagaggccaacttccccccagaatatgagaagttctggaagacagtggagaacaacccccaggacttcaccggctgggtgtacctgctgcagtatgtggagcaggagaaccacctgatggccgccaggaaggcctttgaccgcttcttcatccactacccctactgctacggctactggaagaagtatgctgacctggagaagagacatgacaacatcaagcccagtgatgaggtgtacagaagaggcctgcaggccatccccctgtctgtggacctgtggatccactacatcaacttcctgaaggagaccctggaccccggggaccctgagaccaacaacaccatccggggcacctttgagcacgctgtgctggccgccggcacagacttcagaagtgaccggctgtgggagatgtacatcaactgggagaatgagcagggcaacctgcgggaggtgacagccatctatgaccgcatcctgggcatccccacccagctgtacagccaccacttccagcgcttcaaggagcacgtgcagaacaacctgccccgggacctgctgactggagagcagttcatccagctgcggcgggagctggcctctgtgaatggccacagcggagatgatggccccccaggagatgacctgcccagcggcatcgaggacatcacagatcctgccaagctgatcacagaaattgagaacatgaggcaccgcatcatcgagatccaccaggagatgttcaactacaatgagcacgaggtgtccaagcgctggacctttgaggagggcatcaagaggccctacttccacgtgaagcccctggagaaggcccagctgaagaactggaaggagtacctggagtttgaaattgaaaatggcacccatgagcgggtggtggtgctgtttgagcgctgtgtgatcagctgtgccctgtatgaggagttctggatcaagtatgccaagtacatggagaaccacagcattgagggcgtgagacatgtgttcagccgggcctgcaccatccacctgcccaagaagcccatggtgcacatgctgtgggccgcctttgaggagcagcagggcaacatcaatgaggccaggaacatcctgaagacctttgaagaatgtgtgctgggcctggccatggtgcggctgcggcgggtgtccctggagcggcggcacggcaacctggaggaggccgagcacctgctgcaggatgccatcaagaatgccaagagcaacaatgaaagcagcttctatgctgtgaagctggcccggcacctgttcaagatccagaagaacctgcccaagagcaggaaggtgctgctggaggccatcgagcgggacaaggagaacaccaagctgtacctgaacctgctggagatggagtacagcggggacctgaagcagaatgaggagaacatcctgaactgctttgacaaggctgtgcacggcagcctgcccatcaagatgaggatcaccttcagccagaggaaggtggagttcctggaggactttggaagtgatgtgaacaagctgctgaatgcctatgatgagcaccagaccctgctgaaggagcaggacagcctgaagaggaaggcagaaaatggcagcgaggagcctgaggagaagaaggcccacacagaggacaccaccagcagcagcacccagatgattgatggagacctgcaggccaaccaggccgtgtacaactacagcgcctggtaccagtacaactaccagaacccctggaactacggccagtactacccacctccacccacctag

SEQ ID NO: 16630 - DNA, 723 bp, Artificial Sequence
  Description of Artificial Sequence: Synthetic coding sequence
atgcagggcctgctgcgctttgaggaccaggacagcgcccggggggaccagaacatcgccatgttctaccccaccagcacccagatggtgtaccgccggggcctgcaggccatccccctgtctgtggacctgtggatccactacatcaacttcctgaaggagaccctggaccccggggaccctgagaccaacaacaccatccggggcacctttgaacatgctgtgctggccgccggcacagacttcagaagtgaccggctgtgggagatgtacatcaactgggagaatgagcagggcaacctgcgggaggtgacagccatctatgaccgcatcctgggcatccccacccagctgtacagccaccacttccagcgcttcaaggagcacgtgcagaacaacctgccccgggacctgctgaccggggagcagttcatccagctgcggcgggagctggcctctgtgaatggccacagcggagatgatggccccccaggagatgacctgcccagcggcatcgaggacatcacagatcctgccaagctgatcacagaaattgagaacatgaggcaccgcatcatcgagatccaccaggagatgttcaactacaatgaacatgaggtgtccaagcgctggacctttgaggagggcatcaagaggccctacttccacgtgaagcccctggagaaggcccagaagaagctggagcgcatcctgcgcatctag

SEQ ID NO: 16631 - DNA, 2577 bp, Artificial Sequence
  Description of Artificial Sequence: Synthetic coding sequence
atgcctcctcctggcatccccccacccttcccccccatgggcctgccccccatgagccagaggcccccagccatcccccccatgcctcctggcatcctgccccccatgctgccccccatgggcgcccccccacccctgacccagatccctggcatggtgccccccatgatgcctggcatgctgatgcctgctgtgcctgtgacagctgccacagcccctggagctgacacagccagcagcgctgtggccggcactggaccaccccgggccctgtggagcgagcacgtggccccagatggccgcatctactactacaatgctgatgacaagcagagcgtgtgggagaagcccagcgtgctgaagagcaaggccgagctgctgctgagccagtgcccctggaaggagtacaagagtgacaccgggaagccctactactacaacaaccagagcaaggagagccgctggacccggcccaaggacctggatgacctggaggtgctggtgaagcaggaggccgccggcaagcagcagcagcagctgccccagaccctgcagccccagcccccccagccccagcctgaccccccacctgtgcccccaggccccacccctgtgcccaccggcctgctggagcctgagcccggcggcagcgaggactgtgatgtgctggaggccacccagcccctggagcagggcttcctgcagcagctggaggagggccccagcagcagcggccagcaccagccccagcaggaggaggaggagagcaagccagagcctgagaggagcggcctgtcctggagcaaccgggagaaggccaagcaggccttcaaggagctgctgcgggacaaggctgtgcccagcaatgcctcctgggagcaggccatgaagatggtggtgacagacccccgctacagcgccctgcccaagctgtctgagaagaagcaggccttcaatgcctacaaggcccagcgggagaaggaggagaaggaggaggcccggctgcgggccaaggaggccaagcagaccctgcagcacttcctggagcagcacgagaggatgaccagcaccacccgctacagaagagctgagcagacctttggagagctggaggtgtgggccgtggtgcctgagcgggacaggaaggaggtgtatgatgatgtgctcttcttcctggccaagaaggagaaggagcaggccaagcagctgcggcggaggaacatccaggccctgaagagcatcctggatggcatgagctctgtgaacttccagaccacctggagccaggcccagcagtacctgatggacaaccccagctttgcccaggaccaccagctgcagaacatggacaaggaggatgccctgatctgctttgaggagcacatccgggccctggagcgggaggaggaggaggagcgggagcgggcccggctgcgggagcggcggcagcagaggaagaaccgggaggccttccagaccttcctggatgagctgcatgaaacaggccagctgcacagcatgagcacctggatggagctgtacccagctgtgtccacagatgtgcgctttgccaacatgctgggccagcccggcagcacccccctggacctcttcaagttctacgtggaggagctgaaggcccgcttccatgatgagaagaagatcatcaaggacatcctgaaggtgaacacagcctttgaagattttgcccacgtgatcagctttgacaagagagctgctgccctggatgctggcaacatcaagctgaccttcaacagcctgctggagaaggccgaggcccgggagcgggagcgggagaaggaggaggcccggaggatgagaagaagagaggccgccttccgctccatgctgcggcaggccgtgcctgccctggagctgggcacagcctgggaggaggtgcgggagagatttgtgtgtgacagcgcctttgagcagatcaccctggagagcgagcgcatccgcctcttccgggagttcctgcaggtgctggagcagacagagtgccagcacctgcacaccaagggcaggaagcacggcaggaagggcaagaagcaccaccacaagaggagccacagccccagcggcagcgagagcgaggaggaggagctgcccccacccagcctgcggccccccaagagaagaagaagaaaccccagcgagagcggcagcgagcccagcagcagcctggacagcgtggagagcggcggggccgccctgggcggccggggcagccccagcagccacctgctgggcgctgaccacggcctgaggaaggccaagaagcccaagaagaagaccaagaagaggaggcacaagagcaacagccctgagagcgagacagatcctgaggagaaggccggcaaggagagtgatgagaaggagcaggagcaggacaaggaccgggagctgcagcaggccgagctgcccaacagaagccctggcttcggcatcaagaaggagaagacaggctgggacaccagcgagagcgagctgtctgagggggagctggagaggagaagaaggaccctgctgcagcagctggatgaccaccagtag

SEQ ID NO: 16632 - DNA, 2616 bp, Artificial Sequence
  Description of Artificial Sequence: Synthetic coding sequence
atgatgcccccacccttcatgcctcctcctggcatccccccacccttcccccccatgggcctgccccccatgagccagaggcccccagccatcccccccatgcctcctggcatcctgccccccatgctgccccccatgggcgcccccccacccctgacccagatccctggcatggtgccccccatgatgcctggcatgctgatgcctgctgtgcctgtgacagctgccacagcccctggagctgacacagccagcagcgctgtggccggcactggaccaccccgggccctgtggagcgagcacgtggccccagatggccgcatctactactacaatgctgatgacaagcagagcgtgtgggagaagcccagcgtgctgaagagcaaggccgagctgctgctgagccagtgcccctggaaggagtacaagagtgacaccgggaagccctactactacaacaaccagagcaaggagagccgctggacccggcccaaggacctggatgacctggaggtgctggtgaagcaggaggccgccggcaagcagcagcagcagctgccccagaccctgcagccccagcccccccagccccagcctgaccccccacctgtgcccccaggccccacccctgtgcccaccggcctgctggagcctgagcccggcggcagcgaggactgtgatgtgctggaggccacccagcccctggagcagggcttcctgcagcagctggaggagggccccagcagcagcggccagcaccagccccagcaggaggaggaggagagcaagccagagcctgagaggagcggcctgtcctggagcaaccgggagaaggccaagcaggccttcaaggagctgctgcgggacaaggctgtgcccagcaatgcctcctgggagcaggccatgaagatggtggtgacagacccccgctacagcgccctgcccaagctgtctgagaagaagcaggccttcaatgcctacaaggcccagcgggagaaggaggagaaggaggaggcccggctgcgggccaaggaggccaagcagaccctgcagcacttcctggagcagcacgagaggatgaccagcaccacccgctacagaagagctgagcagacctttggagagctggaggtgtgggccgtggtgcctgagcgggacaggaaggaggtgtatgatgatgtgctcttcttcctggccaagaaggagaaggagcaggccaagcagctgcggcggaggaacatccaggccctgaagagcatcctggatggcatgagctctgtgaacttccagaccacctggagccaggcccagcagtacctgatggacaaccccagctttgcccaggaccaccagctgcagaacatggacaaggaggatgccctgatctgctttgaggagcacatccgggccctggagcgggaggaggaggaggagcgggagcgggcccggctgcgggagcggcggcagcagaggaagaaccgggaggccttccagaccttcctggatgagctgcatgaaacaggccagctgcacagcatgagcacctggatggagctgtacccagctgtgtccacagatgtgcgctttgccaacatgctgggccagcccggcagcacccccctggacctcttcaagttctacgtggaggagctgaaggcccgcttccatgatgagaagaagatcatcaaggacatcctgaaggaccggggcttctgtgtggaggtgaacacagcctttgaggactttgcccacgtgatcagctttgacaagagagctgctgccctggatgctggcaacatcaagctgaccttcaacagcctgctggagaaggccgaggcccgggagcgggagcgggagaaggaggaggcccggaggatgagaagaagagaagctgccttccgctccatgctgcggcaggccgtgcctgccctggagctgggcacagcctgggaggaggtgcgggagagatttgtgtgtgacagcgcctttgagcagatcaccctggagagcgagcgcatccgcctcttccgggagttcctgcaggtgctggagcagacagagtgccagcacctgcacaccaagggcaggaagcacggcaggaagggcaagaagcaccaccacaagaggagccacagccccagcggcagcgagagcgaggaggaggagctgcccccacccagcctgcggccccccaagagaagaagaagaaaccccagcgagagcggcagcgagcccagcagcagcctggacagcgtggagagcggcggggccgccctgggcggccggggcagccccagcagccacctgctgggcgctgaccacggcctgaggaaggccaagaagcccaagaagaagaccaagaagagaagacacaagagcaacagccctgagagcgagacagatcctgaggagaaggccggcaaggagagtgatgagaaggagcaggagcaggacaaggaccgggagctgcagcaggccgagctgcccaacagaagccctggcttcggcatcaagaaggagaagacaggctgggacaccagcgagagcgagctgtctgagggggagctggagaggagaagaaggaccctgctgcagcagctggatgaccaccagtag

SEQ ID NO: 16633 - DNA, 21 bp, Artificial Sequence
  Description of Artificial Sequence: Synthetic coding sequence
atgatgcccccacccttctag

SEQ ID NO: 16634 - DNA, 1791 bp, Artificial Sequence
  Description of Artificial Sequence: Synthetic coding sequence
atggaggccgagccccccctgtaccccatggccggggccgccggcccccagggagatgaggacctgctgggcgtgcctgatggccctgaggcccccctggatgagctggtgggcgcctaccccaactacaatgaggaggaggaggagcggcgctactacagaaggaagaggctgggcgtgctgaagaatgtgctggccgccagcgctgggggcatgctgacctatggagtgtacctgggcctgctgcagatgcagctgatcctgcactatgatgagacctaccgggaggtgaagtatggcaacatgggcctgcctgacatcgacagcaagatgctgatgggcatcaacgtgacccccatcgccgccctgctgtacacccctgtgctgatccgcttcttcggcaccaagtggatgatgttcctggccgtgggcatctatgccctgtttgtgtccaccaactactgggagcgctactacaccctggtgcccagcgctgtggccctgggcatggccatcgtgcccctgtgggcctccatgggcaactacatcaccaggatggcccagaagtaccacgagtacagccactacaaggagcaggacggccagggcatgaagcagaggcctccccggggcagccacgccccctacctgctggtgttccaggccatcttctacagcttcttccacctgagctttgcctgtgcccagctgcccatgatctacttcctgaaccactacctgtatgacctgaaccacaccctgtacaacgtgcagagctgtggcaccaacagccacggcatcctgagcggcttcaacaagacagtgctgcggaccctgcccaggagcggcaacctgattgtggtggagagcgtgctgatggctgtgttcctggccatgctgctggtgctgggcctgtgtggggccgcctaccggcccacagaggagattgacctgcggtctgtgggctggggcaacatcttccagctgcccttcaagcacgtgcgggactaccgcctgcggcacctggtgcccttcttcatctacagcggctttgaggtgctgtttgcctgcaccggcatcgccctgggctacggcgtgtgcagcgtgggcctggagcggctggcctacctgctggtggcctacagcctgggcgccagcgctgccagcctgctgggcctgctgggcctgtggctgcccaggcctgtgcccctggtggccggggccggcgtgcacctgctgctgaccttcatcctcttcttctgggcccctgtgccccgggtgctgcagcacagctggatcctgtatgtggccgccgccctgtggggcgtgggcagcgccctgaacaagacaggcctgagcaccctgctgggcatcctgtatgaggacaaggagcggcaggacttcatcttcaccatctaccactggtggcaggccgtggccatcttcaccgtgtacctgggcagcagcctgcacatgaaggccaagctggccgtgctgctggtgaccctggtggccgctgctgtgtcctacctgaggatggagcagaagctgcggcggggcgtggccccccggcagccccgcatcccccggccccagcacaaggtgcggggctaccgctacctggaggaggacaacagtgatgaaagtgatgctgagggggagcacggagatggagctgaggaggaggcccccccagctggcccccggcccggccctgagcctgctggcctgggcagaagaccctgcccctatgagcaggcccagggcggagatggccctgaggagcagtag

SEQ ID NO: 16635 - DNA, 1446 bp, Artificial Sequence
  Description of Artificial Sequence: Synthetic coding sequence
atggcctacaatgacacagacaggaaccagacagagaagctgctgaagagggtgcgggagctggagcaggaggtgcagaggctgaagaaggagcaggccaagaacaaggaggacagcaacatcagagaaaattctgctggggccggcaagaccaagagggcctttgacttcagcgcccacggccgccgccacgtggccctgagaattgcctacatgggctggggctaccagggctttgccagccaggagaacaccaacaacaccatcgaggagaagctgtttgaggccctgaccaagacccggctggtggagagccggcagaccagcaactaccaccgctgtggccgcacagacaagggcgtgtctgccttcggccaggtgatcagcctggacctgcggagccagttcccccggggccgggacagcgaggacttcaacgtgaaggaggaggccaatgctgctgctgaggagatccgctacacccacatcctgaacagagtgctgcccccagacatccgcatcctggcctgggcccctgtggagcccagcttcagcgcccgcttcagctgcctggagaggacctaccgctacttcttccccagggctgacctggacatcgtgaccatggactatgctgcccagaagtatgtgggcacccatgacttcaggaacctgtgcaagatggatgtggccaacggggtcatcaacttccagaggaccatcctgagcgcccaggtgcagctggtgggccagagccctggagagggccgctggcaggagcccttccagctgtgccagtttgaggtgacaggccaggccttcctgtaccaccaggtgcgctgcatgatggccatcctcttcctgattggccagggcatggagaagccagagatcattgatgagctgctgaacatcgagaagaacccccagaagccccagtacagcatggctgtggagttccccctggtgctgtatgactgcaagtttgaaaatgtgaagtggatctatgaccaggaggcccaggagttcaacatcacccacctgcagcagctgtgggccaaccacgctgtgaagacccacatgctgtacagcatgctgcagggcctggacacagtgcctgtgccctgtggcatcggccccaagatggatggcatgacagagtggggcaatgtgaagcccagcgtcatcaagcagaccagcgcctttgtggagggcgtgaagatgaggacctacaagcccctgatggaccggcccaagtgccagggcctggagagccgcatccagcactttgtgcggcggggccgcatcgagcacccccacctgttccacgaggaggagaccaaggccaagagggactgcaatgacaccctggaggaggagaacaccaacctggagacccccaccaagagggtgtgtgtggacacagagatcaagagcatcatctag

SEQ ID NO: 16636 - DNA, 939 bp, Artificial Sequence
  Description of Artificial Sequence: Synthetic coding sequence
atggctgatggagacagcggcagcgagcggggcggcggcggcggcccctgtggcttccagcctgccagcagaggaggaggagagcaggagacccaggagctggccagcaagaggctggacatccagaacaagcgcttctacctggatgtgaagcagaatgccaagggccgcttcctgaagattgctgaggtgggcgctgggggcagcaagagccggctgaccctgtccatggctgtggccgctgagttccgggacagcctgggggacttcatcgagcactacgcccagctgggccccagcagccctgagcagctggccgccggggctgaggagggcggcggcccccggcgggccctgaagtctgagttcctggtgagagaaaataggaagtactacctggacctgaaggagaaccagaggggccgcttcctgcgcatccggcagacagtgaacagaggaggcggcggctttggagctggccctggccctgggggcctgcagagcggccagaccatcgccctgcctgcccagggcctcatcgagttcagagatgccctggccaagctgattgatgattatggaggagaagatgatgagctggccggcggccctgggggcggggccggcggccctgggggcggcctgtatggagagctgcctgagggcaccagcatcaccgtggacagcaagcgcttcttctttgatgtgggctgcaacaagtatggagtcttcctgcgggtgtctgaggtgaagcccagctacagaaatgccatcaccgtgcccttcaaggcctggggcaagtttggaggagccttctgccgctatgcagatgagatgaaggagatccaggagcggcagagggacaagctgtatgaaagaagaggaggcggcagcggcggcggggaggagagcgagggggaggaggtggatgaagattag

SEQ ID NO: 16637 - DNA, 969 bp, Artificial Sequence
  Description of Artificial Sequence: Synthetic coding sequence
atggagcgggcccggcggcggggcggcggcggcggccggggccggggcggcaagaatgtgggcggcagcggcctgagcaagagccggctgtacccccaggcccagcacagccactacccccactatgctgccagcgccacccccaaccaggccggcggcgctgctgagatccaggagctggccagcaagagggtggacatccagaagaagcgcttctacctggatgtgaagcagagcagccggggccgcttcctgaagattgctgaggtgtggattggccggggccggcaggacaacatcaggaagagcaagctgaccctgagcctgtctgtggccgctgagctgaaggactgcctgggggacttcatcgagcactacgcccacctgggcctgaagggccaccggcaggagcacggccacagcaaggagcagggcagcagaagacggcagaagcacagcgcccccagcccccctgtgtctgtgggcagcgaggagcacccccacagcgtgctgaagacagactacatcgagcgggacaacaggaagtactacctggacctgaaggagaaccagaggggccgcttcctgcgcatccggcagaccatgatgaggggcaccggcatgattggctacttcggccacagcctgggccaggagcagaccatcgtgctgcctgcccagggcatgattgagttcagagatgccctggtgcagctgattgaagattatggagagggggacatcgaggagaggagaggaggagatgatgaccccctggagctgcctgagggcaccagcttccgggtggacaacaagcgcttctactttgatgtgggcagcaacaagtatggcatcttcctgaagctgaccaactaccccaagagccgggagaacatcaacctcttccactgctgccagatcaagcacaaggagcagccccatgacaccaccaagacagtggaggagtag

SEQ ID NO: 16638 - DNA, 1044 bp, Artificial Sequence
  Description of Artificial Sequence: Synthetic coding sequence
atggagcgggcccggcggcggggcggcggcggcggccggggccggggcggcaagaatgtgggcggcagcggcctgagcaagagccggctgtacccccaggcccagcacagccactacccccactatgctgccagcgccacccccaaccaggccggcggcgctgctgagatccaggagctggccagcaagagggtggacatccagaagaagcgcttctacctggatgtgaagcagagcagccggggccgcttcctgaagattgctgaggtgtggattggccggggccggcaggacaacatcaggaagagcaagctgaccctgagcctgtctgtggccgctgagctgaaggactgcctgggggacttcatcgagcactacgcccacctgggcctgaagggccaccggcaggagcacggccacagcaaggagcagggcagcagaagacggcagaagcacagcgcccccagcccccctgtgtctgtgggcagcgaggagcacccccacagcgtgctgaagacagactacatcgagcgggacaacaggaagtactacctggacctgaaggagaaccagaggggccgcttcctgcgcatccggcagaccatgatgaggggcaccggcatgattggctacttcggccacagcctgggccaggagcagaccatcgtgctgcctgcccagggcatgattgagttcagagatgccctggtgcagctgattgaagattatggagagggggacatcgaggagaggagaggaggagatgatgaccccctggagctgcctgagggcaccagcttccgggtggacaacaagcgcttctactttgatgtgggcagcaacaagtatggcatcttcctgaaggtgtctgaggtgcggcccccctacagaaacaccatcaccgtgcccttcaaggcctggaccaggtttggagagaacttcatcaagtatgaggaggagatgaggaagatctgcaacagccacaaggagaagaggatggatggcaggaaggccagcggggaggagcaggagtgcctggactag

SEQ ID NO: 16639 - DNA, 429 bp, Artificial Sequence
  Description of Artificial Sequence: Synthetic coding sequence
atggcccctgtgaagatcagccacgtggtgtccttcagcagccaggaccccaagtaccctgtggagaacctgctgaacccagacagcccccggcggccctggctgggctgcccccaggacaagagcggccagctgaaggtggagctgcagctggagagagctgtgcccaccggctacattgatgtgggcaactgtggctgtgccttcctgcagattgatgtgggccacagctcctggcccctggaccggcccttcatcaccctgctgcctgccaccaccctgatgagcctgacagacagcaagcagggcaagaacagaagtggagtgaggatgttcaaggatggcaaggagggcaagagcaggaaggatggcggcggcctgtatgagaagcagcgctgcagcaccaaggaggactgtgagtgctactag

SEQ ID NO: 16640 - DNA, 1506 bp, Artificial Sequence
  Description of Artificial Sequence: Synthetic coding sequence
atgaacagaagccggcaggtgacctgtgtggcctgggtgcgctgtggggtggccaaggagaccccagacaaggtggagctgagcaaggaggaggtgaagaggctgattgctgaggccaaggagaagctgcaggaggagggcggcggcagtgatgaggaggagaccggcagccccagtgaagatggcatgcagagcgcccggacccaggcccggccccgggagcccctggaggatggagaccctgaagatgacaggaccctggatgatgatgagctggccgagtatgacctggacaagtatgatgaggagggggaccctgatgctgagaccctgggggagagcctgctgggcctgactgtgtatggcagcaatgaccaggacccctacgtgaccctgaaggacacagagcagtatgaaagagaggacttcctgatcaagcccagcgacaacctgattgtgtgtggccgggcagagcaggaccagtgcaacctggaggtgcacgtgtacaaccaggaggaggacagcttctacgtgcaccacgacatcctgctgagcgcctaccccctgtctgtggagtggctgaactttgaccccagcccagatgacagcacaggcaactacatcgctgtgggcaacatgacccctgtgattgaggtgtgggacctggacatcgtggacagcctggagcccgtcttcaccctgggcagcaagctgagcaagaagaagaagaagaagggcaagaagagcagcagcgctgagggccacacagatgctgtgctggacctgtcctggaacaagctgatcagaaatgtgctggccagcgccagcgctgacaacacagtcatcctgtgggacatgagcctgggcaagccagctgccagcctggccgtgcacacagacaaggtgcagaccctgcagttccacccctttgaggcccagaccctcatcagcggcagctatgacaagtctgtggccctgtatgactgccgcagcccagatgagagccacaggatgtggaggttcagcggccagatcgagcgggtgacctggaaccacttcagcccctgccacttcctggccagcacagatgatggctttgtgtacaacctggatgcccggagtgacaagcccatcttcaccctgaatgcccacaatgatgagatcagcggcctggacctgagcagccagatcaagggctgcctggtgacagccagcgctgacaagtatgtgaagatctgggacatcctgggggaccggcccagcctggtgcacagccgggacatgaagatgggcgtgctcttctgcagcagctgctgcccagacctgcccttcatctatgccttcggcggccagaaggagggcctgcgggtgtgggacatcagcacagtgtcctctgtgaatgaggccttcggccggcgggagcggctggtgctgggcagcgccaggaacagcagcatcagcggccccttcggcagccgcagcagtgacacccccatggagagctag

SEQ ID NO: 16641 - DNA, 762 bp, Artificial Sequence
  Description of Artificial Sequence: Synthetic coding sequence
atgaacagaagccggcaggtgacctgtgtggcctgggtgcgctgtggggtggccaaggagaccccagacaaggtggagctgagcaaggaggaggtgaagaggctgattgctgaggccaaggagaagctgcaggaggagggcggcggcagtgatgaggaggagaccggcagccccagtgaagatggcatgcagagcgcccggacccaggcccggccccgggagcccctggaggatggagaccctgaagatgacaggaccctggatgatgatgagctggccgagtatgacctggacaagtatgatgaggagggggaccctgatgctgagaccctgggggagagcctgctgggcctgactgtgtatggcagcaatgaccaggacccctacgtgaccctgaaggacacagagcagtatgaaagagaggacttcctgatcaagcccagcgacaacctgattgtgtgtggccgggcagagcaggaccagtgcaacctggaggtgcacgtgtacaaccaggaggaggacagcttctacgtgcaccacgacatcctgctgagcgcctaccccctgtctgtggagtggctgaactttgaccccagcccagatgacagcacaggcaactacatcgctgtgggcaacatgacccctgtgattgaggtgtgggacctggacatcgtggacagcctggagcccgtcttcaccctgggcagcaagctgagcaagaagaagaagaagaagggcaagaaggtgaagaagaagaggtag

SEQ ID NO: 16642 - DNA, 750 bp, Artificial Sequence
  Description of Artificial Sequence: Synthetic coding sequence
atgaacagaagccggcaggtgacctgtgtggcctgggtgcgctgtggggtggccaaggagaccccagacaaggtggagctgagcaaggaggaggtgaagaggctgattgctgaggccaaggagaagctgcaggaggagggcggcggcagtgatgaggaggagaccggcagccccagtgaagatggcatgcagagcgcccggacccaggcccggccccgggagcccctggaggatggagaccctgaagatgacaggaccctggatgatgatgagctggccgagtatgacctggacaagtatgatgaggagggggaccctgatgctgagaccctgggggagagcctgctgggcctgactgtgtatggcagcaatgaccaggacccctacgtgaccctgaaggacacagagcagtatgaaagagaggacttcctgatcaagcccagcgacaacctgattgtgtgtggccgggcagagcaggaccagtgcaacctggaggtgcacgtgtacaaccaggaggaggacagcttctacgtgcaccacgacatcctgctgagcgcctaccccctgtctgtggagtggctgaactttgaccccagcccagatgacagcacaggcaactacatcgctgtgggcaacatgacccctgtgattgaggtgtgggacctggacatcgtggacagcctggagcccgtcttcaccctgggcagcaagctgagcaagaagaagaagaagaagggcaagaagaagtag

SEQ ID NO: 16643 - DNA, 297 bp, Artificial Sequence
  Description of Artificial Sequence: Synthetic coding sequence
atgcagagcgcccggacccaggcccggccccgggagcccctggaggatggagaccctgaagatgacaggaccctggatgatgatgagctggccgagtatgacctggacaagtatgatgaggagggggaccctgatgctgagaccctgggggagagcctgctgggcctgactgtgtatggcagcaatgaccaggacccctacgtgaccctgaaggacacagagcagtatgaaagagaggacttcctgatcaagcccagcgacaacctgattgtgtgtggccgggcagagcaggactag

SEQ ID NO: 16644 - DNA, 1260 bp, Artificial Sequence
  Description of Artificial Sequence: Synthetic coding sequence
atgcctgctgagaacagccctgccccagcctacaaggtgagcagccacggcggggacagcggcctggatggcctgggcggccctggggtgcagctgggcagcccagacaagaagaagaggaaggccaacacccagggccccagcttcccccccctgtctgaatatgcccccccacccaaccccaacagcgaccacctggtggccgccaacccctttgatgacaactacaacaccatctcctacaagcccctgcccagcagcaacccctacctgggccctggctacccaggctttggaggctacagcaccttcaggatgcctcctcatgtgccccccaggatgagcagcccctactgcggcccctacagcctgaggaaccagccccaccccttcccccagaaccccctgggcatgggcttcaaccggccccacgccttcaactttggcccccatgacaacagcagctttggaaaccccagctacaacaatgccctgagccagaatgtgaacatgcccaaccagcacttccggcagaacccagctgagaacttcagccagatccccccccagaatgccagccaggtgagcaacccagacctggccagcaactttgtgcccggcaacaacagcaacttcaccagccccctggagagcaaccacagcttcatccccccacccaacaccttcggccaggccaaggcccccccacccaagcaggacttcacccagggcgccaccaagaacaccaaccagaacagcagcgcccaccccccccacctgaacatggatgacacagtgaaccagagcaacatcgagctgaagaatgtgaacagaaataatgctgtgaaccaggagaacagccgcagcagcagcacagaggccaccaacaacaacccagccaacggcacccagaacaagccccggcagcccagaggagctgctgatgcctgcaccacagagaagagcaacaagagcagcctgcaccccaacagacatggccacagcagcagtgaccctgtgtacccctgtggcatctgcaccaatgaggtgaatgatgaccaggatgccatcctgtgtgaggccagctgccagaagtggttccaccgcatctgcaccggcatgacagaaacagcctacggcctgctgacagctgaggccagcgctgtgtggggctgtgacacctgcatggctgacaaggatgtgcagctgatgaggacccgggagaccttcggccccagcgctgtgggcagtgatgcctag

SEQ ID NO: 16645 - DNA, 1260 bp, Artificial Sequence
  Description of Artificial Sequence: Synthetic coding sequence
atgtctgctgagcaggagaaggaccccatcagcctgaagagggtgcggggcggggacagcggcctggatggcctgggcggccctggggtgcagctgggcagcccagacaagaagaagaggaaggccaacacccagggccccagcttcccccccctgtctgaatatgcccccccacccaaccccaacagcgaccacctggtggccgccaacccctttgatgacaactacaacaccatctcctacaagcccctgcccagcagcaacccctacctgggccctggctacccaggctttggaggctacagcaccttcaggatgcctcctcatgtgccccccaggatgagcagcccctactgcggcccctacagcctgaggaaccagccccaccccttcccccagaaccccctgggcatgggcttcaaccggccccacgccttcaactttggcccccatgacaacagcagctttggaaaccccagctacaacaatgccctgagccagaatgtgaacatgcccaaccagcacttccggcagaacccagctgagaacttcagccagatccccccccagaatgccagccaggtgagcaacccagacctggccagcaactttgtgcccggcaacaacagcaacttcaccagccccctggagagcaaccacagcttcatccccccacccaacaccttcggccaggccaaggcccccccacccaagcaggacttcacccagggcgccaccaagaacaccaaccagaacagcagcgcccaccccccccacctgaacatggatgacacagtgaaccagagcaacatcgagctgaagaatgtgaacagaaataatgctgtgaaccaggagaacagccgcagcagcagcacagaggccaccaacaacaacccagccaacggcacccagaacaagccccggcagcccagaggagctgctgatgcctgcaccacagagaagagcaacaagagcagcctgcaccccaacagacatggccacagcagcagtgaccctgtgtacccctgtggcatctgcaccaatgaggtgaatgatgaccaggatgccatcctgtgtgaggccagctgccagaagtggttccaccgcatctgcaccggcatgacagaaacagcctacggcctgctgacagctgaggccagcgctgtgtggggctgtgacacctgcatggctgacaaggatgtgcagctgatgaggacccgggagaccttcggccccagcgctgtgggcagtgatgcctag

SEQ ID NO: 16646 - DNA, 2931 bp, Artificial Sequence
  Description of Artificial Sequence: Synthetic coding sequence
atgagcaacagcaacaccacccaggagaccctggagatcatgaaggagagcgagaagaagctggtggaggagagcgtgaacaagaacaagttcatcagcaagacccccagcaaggaggagattgagaaggaatgtgaggacaccagcctgcggcaggagacccagaggaggaccagcaaccacggccacgccaggaagagggccaagagcaacagcaagctgaagctggtgcgcagcctggccgtgtgtgaggagagcagcaccccatttgctgatggccccctggagacccaggacatcatccagctgcacatcagctgccccagcgacaaggaggaggagaagagcaccaaggatgtgtctgagaaggaggacaaggacaagaacaaggagaagatccccaggaagatgctgagccgggacagcagccaggagtacacagacagcacaggcatcgacctgcacgagttcctggtgaacaccctgaagaagaacccccgggacaggatgatgctgctgaagctggagcaggagatcctggagttcatcaatgacaacaacaaccagttcaagaagttcccccagatgaccagctaccacaggatgctgctgcaccgggtggccgcctacttcggcatggaccacaacgtggaccagacaggcaaggctgtgatcatcaacaagaccagcaacacccgcatccctgagcagcgcttcagcgagcacatcaaggatgagaagaacacagagttccagcagcgcttcatcctgaagagagatgatgcctccatggacagagatgacaaccagacaggccagaatggctacctgaatgacatccggctgagcaaggaggccttcagcagcagcagccacaagaggcggcagatcttccggggcaaccgggagggcctgagcaggaccagcagcagccggcagagcagcacagacagcgagctgaagagcctggagccccggccctggagcagcacagacagtgatggctctgtgcgctccatgaggcctcctgtgaccaaggccagcagcttcagcggcatcagcatcctgaccaggggggacagcatcggcagcagcaagggcggcagcgctggccgcatcagccggcccggcatggccctgggcgcccctgaggtgtgcaaccaggtgaccagcagccagagcgtgcggggcctgctgccctgcacagcccagcagcagcagcagcagcagcagcagcagctgcctgccctgccccccaccccccagcagcagccccccctgaacaaccacatgatcagccaggctgatgacctgagcaaccccttcggccagatgagcctgagccggcagggcagcacagaagctgctgaccccagcgctgccctcttccagacccccctcatcagccagcacccccagcagaccagcttcatcatggccagcacaggccagcccctgcccaccagcaactacagcaccagcagccacgccccacccacccagcaggtgctgcccccccagggctacatgcagcccccccagcagatccaggtgtcctactacccacctggccagtaccccaacagcaaccagcagtaccggcccctgagccaccctgtggcctacagcccccagaggggccagcagctgccccagcccagccagcagcccggcctgcagcccatgatgcccaaccagcagcaggccgcctaccagggcatgattggagtgcagcagccccagaaccagggcctgctgagcagccagaggagctccatgggcggccagatgcagggcctggtggtgcagtacacccccctgcccagctaccaggtgcctgtgggcagtgacagccagaatgtggtgcagccccccttccagcagcccatgctggtgcctgtgtcccagagcgtgcagggcggcctgcctgctgctggggtgcctgtgtactacagcatgatccccccagcccagcagaatggcaccagccccagcgtgggcttcctgcagcccccaggcagcgagcagtaccagatgccccagagccccagcccctgcagccccccccagatgccccagcagtacagcggcgtgagccccagcggccctggggtggtggtgatgcagctgaatgtgcccaacggcccccagcccccccagaaccccagcatggtgcagtggagccactgcaagtactacagcatggaccagaggggccagaagccaggggacctgtacagcccagacagcagcccccaggccaacacccagatgagcagcagccctgtgaccagccccacccagagccctgcccccagccctgtgaccagcctgagctctgtgtgcaccggcctgagccccctgcctgtgctgacccagttccccaggcctgggggccctgcccagggagatggccgctacagcctgctgggccagcccctgcagtacaacctgagcatctgcccccccctgctgcacggccagagcacctacacagtgcaccagggccagagcggcctgaagcacggcaacagaggcaagaggcaggccctgaagagcgccagcacagacctgggcacagcagatgtggtgctgggccgggtgctggaggtgacagacctgcctgagggcatcaccaggacagaagctgacaagctgttcacccagctggccatgtctggggccaagatccagtggctgaaggatgcccagggcctgcccggcggcggcggcggggacaacagcggcacagcagaaaatggccgccacagcgacctggccgccctgtacaccatcgtggccgtgttccccagccccctggccgcccagaatgccagcctgcggctgaacaacagcgtgagccgcttcaagctgaggatggccaagaagaactatgacctgcgcatcctggagcgggccagcagccagtag

SEQ ID NO: 16647 - DNA, 2931 bp, Artificial Sequence; identical to SEQ ID NO: 16646
  Description of Artificial Sequence: Synthetic coding sequence

SEQ ID NO: 16648 - DNA, 2112 bp, Artificial Sequence
  Description of Artificial Sequence: Synthetic coding sequence
atgaggcgcatccagaacttcaacagaggcagcttcagccgggagatgatgcctgtgtggacagagatgatcacccggggcaaccgggagggcctgagcaggaccagcagcagccggcagagcagcacagattctgagctgaagagcctggagccccggccctggagcagcacagacagtgatggctctgtgcgctccatgaggcctcctgtgaccaaggccagcagcttcagcggcatcagcatcctgaccaggggggacagcatcggcagcagcaaaggaggcagcgctggccgcatcagcaggcctggcatggccctgggcgcccctgaggtgtgcaaccaggtgaccagcagccagagcgtgcggggcctgctgccctgcacagcccagcagcagcagcagcagcagcagcagcagctgcctgccctgccccccaccccccagcagcagccccccctgaacaaccacatgatcagccaggctgatgacctgagcaaccccttcggccagatgagcctgagccggcagggcagcacagaggccgctgaccccagcgctgccctcttccagacccccctcatcagccagcacccccagcagaccagcttcatcatggccagcacaggccagcccctgcccaccagcaactacagcaccagcagccacgccccacccacccagcaggtgctgcccccccagggctacatgcagcccccccagcagatccaggtgtcctactacccacctggccagtaccccaacagcaaccagcagtaccggcccctgagccaccctgtggcctacagcccccagaggggccagcagctgccccagcccagccagcagcccggcctgcagcccatgatgcccaaccagcagcaggccgcctaccagggcatgattggagtgcagcagccccagaaccagggcctgctgagcagccagaggagctccatgggcggccagatgcagggcctggtggtgcagtacacccccctgcccagctaccaggtgcctgtgggcagtgacagccagaatgtggtgcagccccccttccagcagcccatgctggtgcctgtgtcccagagcgtgcagggcggcctgcctgctgctggggtgcctgtgtactacagcatgatccccccagcccagcagaatggcaccagccccagcgtgggcttcctgcagcccccaggcagcgagcagtaccagatgccccagagccccagcccctgcagccccccccagatgccccagcagtacagcggcgtgagccccagcggccctggggtggtggtgatgcagctgaatgtgcccaacggcccccagcccccccagaaccccagcatggtgcagtggagccactgcaagtactacagcatggaccagaggggccagaagccaggggacctgtacagcccagacagcagcccccaggccaacacccagatgagcagcagccctgtgaccagccccacccagagccctgcccccagccctgtgaccagcctgagctctgtgtgcaccggcctgagccccctgcctgtgctgacccagttccccaggcctgggggccctgcccagggagatggccgctacagcctgctgggccagcccctgcagtacaacctgagcatctgcccccccctgctgcacggccagagcacctacacagtgcaccagggccagagcggcctgaagcacggcaacagaggcaagaggcaggccctgaagagcgccagcacagacctgggcacagcagatgtggtgctgggccgggtgctggaggtgacagacctgcctgagggcatcaccaggacagaggccgacaagctgttcacccagctggccatgtctggggccaagatccagtggctgaaggatgcccagggcctgcccggcggcggcggcggggacaacagcggcacagcagaaaatggccgccacagcgacctggccgccctgtacaccatcgtggccgtgttccccagccccctggccgcccagaatgccagcctgcggctgaacaacagcgtgagccgcttcaagctgaggatggccaagaagaactatgacctgcgcatcctggagcgggccagcagccagtag

SEQ ID NO: 16649 - DNA, 1791 bp, Artificial Sequence
  Description of Artificial Sequence: Synthetic coding sequence
atgaggcgcatccagaacttcaacagaggcagcttcagccgggagatgatgcctgtgtggacagagatgatcacccggggcaaccgggagggcctgagcaggaccagcagcagccggcagagcagcacagattctgagctgaagagcctggagccccggccctggagcagcacagacagtgatggctctgtgcgctccatgaggcctcctgtgaccaaggccagcagcttcagcggcatcagcatcctgaccaggggggacagcatcggcagcagcaaaggaggcagcgctggccgcatcagcaggcctggcatggccctgggcgcccctgaggtgtgcaaccaggtgaccagcagccagagcgtgcggggcctgctgccctgcacagcccagcagcagcagcagcagcagcagcagcagctgcctgccctgccccccaccccccagcagcagccccccctgaacaaccacatgatcagccaggctgatgacctgagcaaccccttcggccagatgagcctgagccggcagggcagcacagaggccgctgaccccagcgctgccctcttccagacccccctcatcagccagcacccccagcagaccagcttcatcatggccagcacaggccagcccctgcccaccagcaactacagcaccagcagccacgccccacccacccagcaggtgctgcccccccagggctacatgcagcccccccagcagatccaggtgtcctactacccacctggccagtaccccaacagcaaccagcagtaccggcccctgagccaccctgtggcctacagcccccagaggggccagcagctgccccagcccagccagcagcccggcctgcagcccatgatgcccaaccagcagcaggccgcctaccagggcatgattggagtgcagcagccccagaaccagggcctgctgagcagccagaggagctccatgggcggccagatgcagggcctggtggtgcagtacacccccctgcccagctaccaggtgcctgtgggcagtgacagccagaatgtggtgcagccccccttccagcagcccatgctggtgcctgtgtcccagagcgtgcagggcggcctgcctgctgctggggtgcctgtgtactacagcatgatccccccagcccagcagaatggcaccagccccagcgtgggcttcctgcagcccccaggcagcgagcagtaccagatgccccagagccccagcccctgcagccccccccagatgccccagcagtacagcggcgtgagccccagcggccctggggtggtggtgatgcagctgaatgtgcccaacggcccccagcccccccagaaccccagcatggtgcagtggagccactgcaagtactacagcatggaccagaggggccagaagccaggggacctgtacagcccagacagcagcccccaggccaacacccagatgagcagcagccctgtgaccagccccacccagagccctgcccccagccctgtgaccagcctgagctctgtgtgcaccggcctgagccccctgcctgtgctgacccagttccccaggcctgggggccctgcccagggagatggccgctacagcctgctgggccagcccctgcagtacaacctgagcatctgcccccccctgctgcacggccagagcacctacacagtgcaccagggccagagcggcctgaagcacggcaacagaggcaagaggcaggccctgaagagcgccagcacagacctgggcacagcagatgtggccctgtccttccagccctag

SEQ ID NO: 16650 - DNA, 2016 bp, Artificial Sequence
  Description of Artificial Sequence: Synthetic coding sequence
atgaggcctcctgtgaccaaggccagcagcttcagcggcatcagcatcctgaccaggggggacagcatcggcagcagcaaaggaggcagcgctggccgcatcagcaggcctggcatggccctgggcgcccctgaggtgtgcaaccaggtgaccagcagccagagcgtgcggggcctgctgccctgcacagcccagcagcagcagcagcagcagcagcagcagctgcctgccctgccccccaccccccagcagcagccccccctgaacaaccacatgatcagccagcctgtgcctgccctgcagcccagcccccagcctgtgcagttcagccccagcagctgcccccaggtgctgctgcctgtgtccccaccccagcagtacaacatggctgatgacctgagcaaccccttcggccagatgagcctgagccggcagggcagcacagaggccgctgaccccagcgctgccctcttccagacccccctcatcagccagcacccccagcagaccagcttcatcatggccagcacaggccagcccctgcccaccagcaactacagcaccagcagccacgccccacccacccagcaggtgctgcccccccagggctacatgcagcccccccagcagatccaggtgtcctactacccacctggccagtaccccaacagcaaccagcagtaccggcccctgagccaccctgtggcctacagcccccagaggggccagcagctgccccagcccagccagcagcccggcctgcagcccatgatgcccaaccagcagcaggccgcctaccagggcatgattggagtgcagcagccccagaaccagggcctgctgagcagccagaggagctccatgggcggccagatgcagggcctggtggtgcagtacacccccctgcccagctaccaggtgcctgtgggcagtgacagccagaatgtggtgcagccccccttccagcagcccatgctggtgcctgtgtcccagagcgtgcagggcggcctgcctgctgctggggtgcctgtgtactacagcatgatccccccagcccagcagaatggcaccagccccagcgtgggcttcctgcagcccccaggcagcgagcagtaccagatgccccagagccccagcccctgcagccccccccagatgccccagcagtacagcggcgtgagccccagcggccctggggtggtggtgatgcagctgaatgtgcccaacggcccccagcccccccagaaccccagcatggtgcagtggagccactgcaagtactacagcatggaccagaggggccagaagccaggggacctgtacagcccagacagcagcccccaggccaacacccagatgagcagcagccctgtgaccagccccacccagagccctgcccccagccctgtgaccagcctgagctctgtgtgcaccggcctgagccccctgcctgtgctgacccagttccccaggcctgggggccctgcccagggagatggccgctacagcctgctgggccagcccctgcagtacaacctgagcatctgcccccccctgctgcacggccagagcacctacacagtgcaccagggccagagcggcctgaagcacggcaacagaggcaagaggcaggccctgaagagcgccagcacagacctgggcacagcagatgtggtgctgggccgggtgctggaggtgacagacctgcctgagggcatcaccaggacagaggccgacaagctgttcacccagctggccatgtctggggccaagatccagtggctgaaggatgcccagggcctgcccggcggcggcggcggggacaacagcggcacagcagaaaatggccgccacagcgacctggccgccctgtacaccatcgtggccgtgttccccagccccctggccgcccagaatgccagcctgcggctgaacaacagcgtgagccgcttcaagctgaggatggccaagaagaactatgacctgcgcatcctggagcgggccagcagccagtag

SEQ ID NO: 16651 - DNA, 90 bp, Artificial Sequence; identical to SEQ ID NO: 9247
  Description of Artificial Sequence: Synthetic coding sequence

SEQ ID NO: 16652 - DNA, 198 bp, Artificial Sequence
  Description of Artificial Sequence: Synthetic coding sequence
atgttctacacccacgtgctgatgagcaagaggggccccctggccaagatctggctggccgcccactgggagaagaagctgaccaaggcccacgtgtttgagtgcaacctggagatcaccatcgagaagatcctgagccccaaggtgaagatcgccctgcggaccagcggccacctgctgctgggcgtggtgaggtag

SEQ ID NO: 16653 - DNA, 1566 bp, Artificial Sequence
  Description of Artificial Sequence: Synthetic coding sequence
atgttctacacccacgtgctgatgagcaagaggggccccctggccaagatctggctggccgcccactgggagaagaagctgaccaaggcccacgtgtttgagtgcaacctggagatcaccatcgagaagatcctgagccccaaggtgaagatcgccctgcggaccagcggccacctgctgctgggcgtggtgcgcatctacaacaggaaggccaagtacctgctggccgactgcagcgaggccttcctgaagatgaagatgaccttctgccccggcctggtggacctgcccaaggaaaattttgaggccagctacaatgccatcaccctgcctgaggagttccatgactttgacacccagaacatgaatgccattgatgtgtctgagcacttcacccagaaccagagcaggcctgaggagatcaccctgagagaaaattttgacaatgacctgatcttccaggccgagagctttggagaggagagcgagatcctgcggcggcacagcttctttgatgacaacatcctgctgaacagcagcggccccctcatcgagcacagcagcggcagcctgaccggggagaggagcctcttctatgattctggagatggctttggagatgaaggagctgctggggagatgattgacaacctgctgcaggatgaccagaacatcctgctggaggacatgcacctgaaccgggagatcagcctgcccagcgagccccccaacagcctggccgtggagccagacaacagcgagtgcatctgtgtgcctgaaaatgagaagatgaatgagaccatcctgctgagcacagaggaggagggcttcaccctggaccccatcgacatcagtgacattgctgagaagaggaagggcaagaagaggcggctgctgattgaccccatcaaggagctgagcagcaaggtgatccacaagcagctgaccagctttgctgacaccctgatggtgctggagctggccccacccacccagaggctgatgatgtggaagaagagaggaggagtgcacaccctgctgagcacagctgcccaggacctgattcatgctgagctgaagatgctgttcaccaagtgcttcctgagcagcggcttcaagctgggcaggaagatgatccagaaggagagcgtgcgggaggaggtgggcaaccagaacatcgtggagacctccatgatgcaggagcccaactaccagcaggagctgagcaagccccagacctggaaggatgtgattggaggcagccagcacagcagccatgaggacaccaacaagaacatcaacagcgaggagagcctgagcaatgaagaaaatattgaaacagagcgctggaatggccgcatcctgcagatgctgaaccggctgcgggtggccgaccagggccaggccgctgctgctgccacagctgaggccctgcggcaggccggccctgagtggtgtgagcctgctggcctgcggcgggccagcggcctgagcccccgggacacagcccaccccaccccctacagcgacccccagccccacggccacgtgcctgccaggaagtag

SEQ ID NO: 16654 - DNA, 1566 bp, Artificial Sequence; identical to SEQ ID NO: 16653
  Description of Artificial Sequence: Synthetic coding sequence

SEQ ID NO: 16655 - DNA, 1671 bp, Artificial Sequence
  Description of Artificial Sequence: Synthetic coding sequence
atgttctacacccacgtgctgatgagcaagaggggccccctggccaagatctggctggccgcccactgggagaagaagctgaccaaggcccacgtgtttgagtgcaacctggagatcaccatcgagaagatcctgagccccaaggtgaagatcgccctgcggaccagcggccacctgctgctgggcgtggtgcgcatctacaacaggaaggccaagtacctgctggccgactgcagcgaggccttcctgaagatgaagatgaccttctgccccggcctggtggacctgcccaaggaaaattttgaggccagctacaatgccatcaccctgcctgaggagttccatgactttgacacccagaacatgaatgccattgatgtgtctgagcacttcacccagaaccagagcaggcctgaggagatcaccctgagagaaaattttgacaatgacctgatcttccaggccgagagctttggagaggagagcgagatcctgcggcggcacagcttctttgatgacaacatcctgctgaacagcagcggccccctcatcgagcacagcagcggcagcctgaccggggagaggagcctcttctatgattctggagatggctttggagatgaaggagctgctggggagatgattgacaacctgctgcaggatgaccagaacatcctgctggaggacatgcacctgaaccgggagatcagcctgcccagcgagccccccaacagcctggccgtggagccagacaacagcgagtgcatctgtgtgcctgaaaatgagaagatgaatgagaccatcctgctgagcacagaggaggagggcttcaccctggaccccatcgacatcagtgacattgctgagaagaggaagggcaagaagaggcggctgctgattgaccccatcaaggagctgagcagcaaggtgatccacaagcagctgaccagctttgctgacaccctgatggtgctggagctggccccacccacccagaggctgatgatgtggaagaagagaggaggagtgcacaccctgctgagcacagctgcccaggacctgattcatgctgagctgaagatgctgttcaccaagtgcttcctgagcagcggcttcaagctgggcaggaagatgatccagaaggagagcgtgcgggaggaggtgggcaaccagaacatcgtggagacctccatgatgcaggagcccaactaccagcaggagctgagcaagccccagacctggaaggatgtgattggaggcagccagcacagcagccatgaggacaccaacaagaacatcaacagcgagcaggacatcgtggagatggtgtccctggccgctgaggagagcagcctgatgaatgacctgtttgcccaggagattgagtacagccctgtggagctggagagcctgagcaatgaagaaaatattgaaacagagcgctggaatggccgcatcctgcagatgctgaaccggctgcgggagagcaacaagatgggcatgcagagcttcagcctgatgaagctgtgcaggaacagcgacaggaagcaggccgccgccaagttctacagcttcctggtgctgaagaagcagctggccatcgagctgagccagagcgccccctatgctgacatcatcgccaccatgggccccatgttctacaacatctag

SEQ ID NO: 16656 - DNA, 3486 bp, Artificial Sequence
  Description of Artificial Sequence: Synthetic coding sequence
atgggcctgggcaagaccctgcaggtgatctccttcattgatgtgctcttccgccacaccccagccaagacagtgctggccatcgtgcctgtgaacaccctgcagaactggctggccgagttcaacatgtggctgcccccacctgaggccctgcctgctgacaacaagccagaggaggtgcagccccgcttcttcaaggtgcacatcctgaatgatgagcacaagaccatggccagccgggccaaggtgatggctgactgggtgtctgagggcggcgtgctgctgatgggctatgagatgtaccgcctgctgaccctgaagaagagctttgccaccggccggcccaagaagaccaagaagaggagccaccctgtgatcatcgacctggatgaggaggaccggcagcaggagttcagaagagaatttgagaaggccctgtgcaggcctggcccagatgtggtgatctgtgatgagggccaccgcatcaagaactgccaggccagcaccagccaggccctgaagaacatccgcagcagaagaagagtggtgctgaccggctaccccctgcagaacaacctgattgagtactggtgcatggtggactttgtgcggccagacttcctgggcacccggcaggagttcagcaacatgtttgagcggcccatcctgaatggccagtgcatcgacagcaccccccaggatgtgcggctgatgagataccgcagccacgtgctgcacagcctgctggagggctttgtgcagaggcggggccacacagtgctgaagatccacctgcctgccaaggaggagaatgtcatcctggtgcggctgagcaagatccagagggacctgtacacccagttcatggaccgcttccgggactgtggcagcagcggctggctgggcctgaaccccctgaaggccttctgtgtgtgctgcaagatctggaaccacccagatgtgctgtatgaggccctgcagaaggagagcctggccaatgagcaggacctggatgtggaggagctgggcagcgctggcaccagcgcccgctgccccccccagggcaccaagggcaaaggagaggacagcaccctggccagctccatgggagaggccaccaacagcaagttcctgcagggcgtgggcttcaaccccttccaggagcggggcaacaacatcgtgacctatgagtgggccaaggacctgctgaccaactaccagacaggagtgctggagaacagccccaagatggtgctgctcttccacctgattgaggagagcgtgaagctgggggacaagatcctggtgttcagccagagcctgagcaccctggccctgattgaggagttcctgggcaagcgggaggtgccctgccccccaggcacagagggccagggcgcccagaagtgggtgaggaacatctcctacttccggctggatggcagcaccccagcctttgagcgggagcggctcatcaaccagttcaatgaccccagcaacctgaccacctggctgttcctgctgagcacccgggccggctgcctgggcgtgaacctgattggagccaacagagtggtggtgtttgatgcctcctggaacccctgccatgatgcccaggccgtgtgccgggtgtaccgctatggccagaagaagccctgctacatctaccgcctggtggccgactacaccctggagaagaagatctatgaccggcagatcagcaagcagggcatgtctgacagagtggtggatgacctgaaccccatgctgaacttcaccaggaaggaggtggagaacctgctgcactttgtggagaaggagcccgccccccaggtgtccctgaatgtgaagggcatcaaggagagcgtgctgcagctggcctgcctgaagtacccccacctgatcaccaaggagccctttgagcacgagagcctgctgctgaacaggaaggaccacaagctgaccaaggccgagaagaaggccgccaagaagagctatgaggaggacaagaggacctctgtgccctacacccggcccagctatgcccagtactacccagccagtgaccagagcctgaccagcatcccagccttcagccagaggaactggcagcccaccctgaagggagatgagaagcctgtggcctctgtgcggcctgtgcagagcacccccatccccatgatgcccaggcatgtgcccctgggcggctctgtgagcagcgccagcagcaccaaccccagcatgaacttccccatcaactacctgcagagagctggggtgctggtgcagaaggtggtgaccaccacagacatcgtcatccctggcctgaacagcagcacagatgtgcaggcccgcatcaatgctggggagagcatccacatcatccggggcaccaagggcacctacatccgcaccagtgatggccgcatctttgctgtgcgggccaccgggaagcccaaggtgcctgaagatggccgcatggccgccagcggcagccagggccccagctgtgagagcaccagcaatggccgccacagcgccagcagccccaaggccccagaccctgagggcctggcccggcctgtgtccccagacagccctgagatcatcagcgagctgcagcagtatgcagatgtggccgccgcccgggagagccggcagagcagccccagcaccaatgctgccctgcccggccccccagcccagctgatggacagcagcgctgtgcccggcacagccctgggcacagagccccggctgggcggccactgcctgaacagcagcctgctggtgacaggccagccctgtggggacagacaccctgtgctggacctgcggggccacaagaggaagctggccaccccacctgctgcccaggagagcagcagaagaagaagcaggaagggccacctgcctgcccctgtgcagccctatgagcacggctaccctgtgtctgggggctttgccatgcctcctgtgtccctgaaccacaacctgaccacccccttcaccagccaggccggggagaacagcctcttcatgggcagcacccccagctactaccagctgagcaacctgctggctgatgcccggctggtgtttcctgtgaccacagaccccctggtgcctgctggccctgtgagcagcagcagcacagccacctctgtgacagccagcaaccccagcttcatgctgaaccccagcgtgcccggcatcctgcccagctacagcctgcccttcagccagcccctgctgtctgagcccaggatgtttgcccccttccccagccctgtgctgcccagcaacctgagccggggcatgagcatctacccaggctacatgagcccccacgccggctacccagctgggggcctgctgcggagccaggtgcccccatttgacagccatgaggtggccgaggtgggcttcagcagcaatgatgatgaggacaaggatgatgatgtgattgaggtgacaggcaagtag

SEQ ID NO: 16657 - DNA, 4404 bp, Artificial Sequence
  Description of Artificial Sequence: Synthetic coding sequence
atgtctgatgaaagtgccagcggcagtgaccctgacctggaccctgatgtggagctggaggatgctgaggaggaggaggaggaggaggaggtggccgtggaggagtgtgacagagatgatgaggaggacctgctggatgaccccagcctggagggcatgtgtggcacagagcacgcccagctgggagaagatggccagcagcccccacgctgcaccagcaccaccagcagccagagcgagcccagcgagcagctgcggcggcaccagggcaagaacctggccagcgaggaccccaagaagaagagggcccagaagcccagccacatgagaagaaacatcaggaagctgctgcgggaggaccagctggagcctgtgaccaaggccgcccagcaggaggagctggagaggaggaagaggctggagcagcagaggaaggactatgctgcccccatccccaccgtgcccctggagttcctgcctgaggagatcgccctgcgggccagtgatggcccccagctgcccccccgggtgctggcccaggaggtgatctgcctggacagcagcagcggctctgaagatgagaagagcagcagagatgaagtcatcgagctgagcagcggggaggaggacaccctgcacatcgtggacagcagcgagagcgtgtctgaagatgatgaggaggaggagaagggcggcacccacgtgaatgatgtgctgaaccagagagatgccctgggccgggtgctggtgaacctgaaccaccccccagaggaggagaatgtgttcctggccccccagctggcccgggctgtgaagccccaccagatcggcggcatccgcttcctgtatgacaacctggtggagagcctggagcgcttcaagaccagcagcggcttcggctgcatcctggcccacagcatgggcctgggcaagaccctgcaggtgatctccttcattgatgtgctcttccgccacaccccagccaagacagtgctggccatcgtgcctgtgaacaccctgcagaactggctggccgagttcaacatgtggctgcccccacctgaggccctgcctgctgacaacaagccagaggaggtgcagccccgcttcttcaaggtgcacatcctgaatgatgagcacaagaccatggccagccgggccaaggtgatggctgactgggtgtctgagggcggcgtgctgctgatgggctatgagatgtaccgcctgctgaccctgaagaagagctttgccaccggccggcccaagaagaccaagaagaggagccaccctgtgatcatcgacctggatgaggaggaccggcagcaggagttcagaagagaatttgagaaggccctgtgcaggcctggcccagatgtggtgatctgtgatgagggccaccgcatcaagaactgccaggccagcaccagccaggccctgaagaacatccgcagcagaagaagagtggtgctgaccggctaccccctgcagaacaacctgattgagtactggtgcatggtggactttgtgcggccagacttcctgggcacccggcaggagttcagcaacatgtttgagcggcccatcctgaatggccagtgcatcgacagcaccccccaggatgtgcggctgatgagataccgcagccacgtgctgcacagcctgctggagggctttgtgcagaggcggggccacacagtgctgaagatccacctgcctgccaaggaggagaatgtcatcctggtgcggctgagcaagatccagagggacctgtacacccagttcatggaccgcttccgggactgtggcagcagcggctggctgggcctgaaccccctgaaggccttctgtgtgtgctgcaagatctggaaccacccagatgtgctgtatgaggccctgcagaaggagagcctggccaatgagcaggacctggatgtggaggagctgggcagcgctggcaccagcgcccgctgccccccccagggcaccaagggcaaaggagaggacagcaccctggccagctccatgggagaggccaccaacagcaagttcctgcagggcgtgggcttcaaccccttccaggagcggggcaacaacatcgtgacctatgagtgggccaaggacctgctgaccaactaccagacaggagtgctggagaacagccccaagatggtgctgctcttccacctgattgaggagagcgtgaagctgggggacaagatcctggtgttcagccagagcctgagcaccctggccctgattgaggagttcctgggcaagcgggaggtgccctgccccccaggcacagagggccagggcgcccagaagtgggtgaggaacatctcctacttccggctggatggcagcaccccagcctttgagcgggagcggctcatcaaccagttcaatgaccccagcaacctgaccacctggctgttcctgctgagcacccgggccggctgcctgggcgtgaacctgattggagccaacagagtggtggtgtttgatgcctcctggaacccctgccatgatgcccaggccgtgtgccgggtgtaccgctatggccagaagaagccctgctacatctaccgcctggtggccgactacaccctggagaagaagatctatgaccggcagatcagcaagcagggcatgtctgacagagtggtggatgacctgaaccccatgctgaacttcaccaggaaggaggtggagaacctgctgcactttgtggagaaggagcccgccccccaggtgtccctgaatgtgaagggcatcaaggagagcgtgctgcagctggcctgcctgaagtacccccacctgatcaccaaggagccctttgagcacgagagcctgctgctgaacaggaaggaccacaagctgaccaaggccgagaagaaggccgccaagaagagctatgaggaggacaagaggacctctgtgccctacacccggcccagctatgcccagtactacccagccagtgaccagagcctgaccagcatcccagccttcagccagaggaactggcagcccaccctgaagggagatgagaagcctgtggcctctgtgcggcctgtgcagagcacccccatccccatgatgcccaggcatgtgcccctgggcggctctgtgagcagcgccagcagcaccaaccccagcatgaacttccccatcaactacctgcagagagctggggtgctggtgcagaaggtggtgaccaccacagacatcgtcatccctggcctgaacagcagcacagatgtgcaggcccgcatcaatgctggggagagcatccacatcatccggggcaccaagggcacctacatccgcaccagtgatggccgcatctttgctgtgcgggccaccgggaagcccaaggtgcctgaagatggccgcatggccgccagcggcagccagggccccagctgtgagagcaccagcaatggccgccacagcgccagcagccccaaggccccagaccctgagggcctggcccggcctgtgtccccagacagccctgagatcatcagcgagctgcagcagtatgcagatgtggccgccgcccgggagagccggcagagcagccccagcaccaatgctgccctgcccggccccccagcccagctgatggacagcagcgctgtgcccggcacagccctgggcacagagccccggctgggcggccactgcctgaacagcagcctgctggtgacaggccagccctgtggggacagacaccctgtgctggacctgcggggccacaagaggaagctggccaccccacctgctgcccaggagagcagcagaagaagaagcaggaagggccacctgcctgcccctgtgcagccctatgagcacggctaccctgtgtctgggggctttgccatgcctcctgtgtccctgaaccacaacctgaccacccccttcaccagccaggccggggagaacagcctcttcatgggcagcacccccagctactaccagctgagcaacctgctggctgatgcccggctggtgtttcctgtgaccacagaccccctggtgcctgctggccctgtgagcagcagcagcacagccacctctgtgacagccagcaaccccagcttcatgctgaaccccagcgtgcccggcatcctgcccagctacagcctgcccttcagccagcccctgctgtctgagcccaggatgtttgcccccttccccagccctgtgctgcccagcaacctgagccggggcatgagcatctacccaggctacatgagcccccacgccggctacccagctgggggcctgctgcggagccaggtgcccccatttgacagccatgaggtggccgaggtgggcttcagcagcaatgatgatgaggacaaggatgatgatgtgattgaggtgacaggcaagtag

SEQ ID NO: 16658 - DNA, 675 bp, Artificial Sequence
  Description of Artificial Sequence: Synthetic coding sequence
atgccacccaggaagaagaggcggcagcccagccagaaggcccccctgctcttccaccagcagcccctggagggccccaagcacagctgtgccagcacccagctgcccatcacccacacccggcaggtgtccccagactttgacacagctgctggcagcctcttccctgcctaccagaagcaccagaacagagcccggcacagcagcaggaagcccaccaccagcaagttcccccacctgacctttgagagcccccagagcagcagcagcgagaccctgggcatccccctcatccgggagtgccccagcgagagcgagaaggatgtgtccagaagacccctggtgcctgtgctgagcccccagagctgtggcaacatgtctgtgcaggccctgcagagcctgccctacgtgttcatccccccagacatccagaccccagagagcagctctgtgaaggaggagctgatcccccaggaccagaaggagaacagcctgctgagctgcaccctgcacacaggcacccccaacagccctgagcccggccctgtgctggtgaaggacaccccagaggacaagtatggcatcaaggtgacctggaggcggcggcagcacctgctggcctacctgcgggagcggggcaagctgagccgcagccagttcctggtgaagagctag

SEQ ID NO: 16659 - DNA, 1335 bp, Artificial Sequence
  Description of Artificial Sequence: Synthetic coding sequence
atgggcagcagccggctgcgggtgtttgacccccacctggagaggaaggacagcgctgctgccctgagtgaccgggagctgcccctgcccacctttgatgtgccctacttcaagtacattgatgaagaagatgaagatgatgagtggagcagccgcagccagagcagcacagaagatgattctgtggacagcctgctgagtgaccgctacgtggtggtgtctggcaccccagagaagatcctggagcacctgctgaatgacctgcacctggaggaggtgcaggacaaggagacagagaccctgctggatgacttcctgctgacctacaccgtcttcatgaccacagatgacctgtgccaggccctgctgcgcatctacagcgccaagaagtaccagggcaaggaggagaacagtgatgtgcccaggaggaagaggaaggtgctgcacctggtgtcccagtggatcgccctgtacaaggactggctgcctgaagatgagcacagcaagatgttcctgaagaccatctacagaaatgtgctggatgatgtgtatgagtaccccatcctggagaaggagctgaaggagttccagaagatcctgggcatgcaccggcggcacacagtggatgagtacagcccccagaagaagaacaaggccctcttccaccagttcagcctgaaggagaactggctgcagcaccggggcaccgtgacagaaacagaggagatcttctgccacgtgtacatcacagagcacagctatgtgtctgtgaaggccaaggtgagcagcatcgcccaggagatcctgctgtgcagccagctgggcaagagggtgcagctggtgaagaagttcatcaagattgctgcccactgcaaggcccagaggaacctgaacagcttctttgccatcgtgatgggcctgaacacagcctctgtgtcccggctgagccagacctgggagaagatccctgggaagttcaagaagctgttcagcgagctggagagcctgacagaccccagcctgaaccacaaggcctacagagatgccttcaagaagatgaagccacccaagatccccttcatgcccctgctgctgaaggatgtgaccttcatccacgagggcaacaagaccttcctggacaacctggtgaactttgagaagctgcacatgattgctgacacagtgaggaccctgcggcactgcaggaccaaccagtttggagacctgagccccaaggagcaccaggagctgaagagctatgtgaaccacctgtatgtgattgacagccagcaggccctgtttgagctgagccaccgcatcgagccccgggtgtag

SEQ ID NO: 16660 - DNA, 2193 bp, Artificial Sequence
  Description of Artificial Sequence: Synthetic coding sequence
atggccatcggcgtgtggcagctgctgctggacatgggcatcatgctgtctgtggaccagcacctgtacttccaggacacctacgtgttctaccagttcagcagtgatgaatgttcctacctgtactgtgaatttgagcgggaggaggagtggcagaatggagtgaagctgctgctgcagctggtgcccctcatcccagcccggggcggcatctgtgagctgagccaccagaagattgaggacagcgaggagagcagtgatgagatcctggtgcggctgaccagcgctgtgcagcgggagctggccgctgtgattgccctgaaggccaggaagagcgccatcgagcaggatgaagaaaataatgacaagcacgtggccgtgacagaggccgagagcgtgcctgacagccaggccggcgtgatgtgcaagctgcaggagagagatgagatcggcagaattgagctggtgcagaagctggccaaggagaactaccagttcctgcagacagacaagaaggagcaggagaagtctgagcaccaggatgatgaggtgaccaccgtgcaggtgaaggagcaggaccagagcgtgctggtgctgaagaaggtgcagtgctgcggccctgcccccacagctggcagcgctgagagccactggaggtatgtggtggtgtctggcaccccagagaagatcctggagcacctgctgaatgacctgcacctggaggaggtgcaggacaaggagacagagaccctgctggatgacttcctgctgacctacaccgtcttcatgaccacagatgacctgtgccaggccctgctgcggcactacagcgccaagaagtaccagggcaaggaggagaacagtgatgtgcccaggaggaagaggaaggtgctgcacctggtgtcccagtggatcgccctgtacaaggactggctgcctgaagatgagcacagcaagatgttcctgaagaccatctacagaaatgtgctggatgatgtgtatgagtaccccatcctggagaaggagctgaaggagttccagaagatcctgggcatgcaccggcggcacacagtggatgagtacagcccccagaagaagaacaaggccctcttccaccagttcagcctgaaggagaactggctgcagcaccggggcaccgtgacagaaacagaggagatcttctgccacgtgtacatcacagagcacagctatgtgtctgtgaaggccaaggtgagcagcatcgcccaggagatcctgaaggtggtggccgagaagatccagtatgcagaggaggacctggccctggtggccatcaccttctctggagagaagcatgagctgcagcccaatgacctggtgatcagcaagagcctggaggccagcggccgcatctacgtgtacaggaaggacctggccgacaccctgaacccctttgctgaaaatgaggagagccagcagaggtccatgaggatcctgggcatgaacacctgggacctggccctggagctgatgaactttgactggagcctcttcaacagcatccacgagcaggagctgatctacttcaccttcagccggcagggcagcggggagcacacagccaacctgagcctgctgctgcagcgctgcaatgaggtgcagctgtgggtggccacagagatcctgctgtgcagccagctgggcaagagggtgcagctggtgaagaagttcatcaagattgctgcccactgcaaggcccagaggaacctgaacagcttctttgccatcgtgatgggcctgaacacagcctctgtgtcccggctgagccagacctgggagaagatccctgggaagttcaagaagctgttcagcgagctggagagcctgacagaccccagcctgaaccacaaggcctacagagatgccttcaagaagatgaagccacccaagatccccttcatgcccctgctgctgaaggatgtgaccttcatccacgagggcaacaagaccttcctggacaacctggtgaactttgagaagctgcacatgattgctgacacagtgaggaccctgcggcactgcaggaccaaccagtttggagacctgagccccaaggagcaccaggagctgaagagctatgtgaaccacctgtatgtgattgacagccagcaggccctgtttgagctgagccaccgcatcgagccccgggtgtag

SEQ ID NO: 16661 - DNA, 1743 bp, Artificial Sequence
  Description of Artificial Sequence: Synthetic coding sequence
atgggcagcagccggctgcgggtgtttgacccccacctggagaggaaggacagcgctgctgccctgagtgaccgggagctgcccctgcccacctttgatgtgccctacttcaagtacattgatgaagaagatgaagatgatgagtggagcagccgcagccagagcagcacagaagatgattctgtggacagcctgctgagtgaccgctacgtggtggtgtctggcaccccagagaagatcctggagcacctgctgaatgacctgcacctggaggaggtgcaggacaaggagacagagaccctgctggatgacttcctgctgacctacaccgtcttcatgaccacagatgacctgtgccaggccctgctgcggcactacagcgccaagaagtaccagggcaaggaggagaacagtgatgtgcccaggaggaagaggaaggtgctgcacctggtgtcccagtggatcgccctgtacaaggactggctgcctgaagatgagcacagcaagatgttcctgaagaccatctacagaaatgtgctggatgatgtgtatgagtaccccatcctggagaaggagctgaaggagttccagaagatcctgggcatgcaccggcggcacacagtggatgagtacagcccccagaagaagaacaaggccctcttccaccagttcagcctgaaggagaactggctgcagcaccggggcaccgtgacagaaacagaggagatcttctgccacgtgtacatcacagagcacagctatgtgtctgtgaaggccaaggtgagcagcatcgcccaggagatcctgaaggtggtggccgagaagatccagtatgcagaggaggacctggccctggtggccatcaccttctctggagagaagcatgagctgcagcccaatgacctggtgatcagcaagagcctggaggccagcggccgcatctacgtgtacaggaaggacctggccgacaccctgaacccctttgctgaaaatgaggagagccagcagaggtccatgaggatcctgggcatgaacacctgggacctggccctggagctgatgaactttgactggagcctcttcaacagcatccacgagcaggagctgatctacttcaccttcagccggcagggcagcggggagcacacagccaacctgagcctgctgctgcagcgctgcaatgaggtgcagctgtgggtggccacagagatcctgctgtgcagccagctgggcaagagggtgcagctggtgaagaagttcatcaagattgctgcccactgcaaggcccagaggaacctgaacagcttctttgccatcgtgatgggcctgaacacagcctctgtgtcccggctgagccagacctgggagaagatccctgggaagttcaagaagctgttcagcgagctggagagcctgacagaccccagcctgaaccacaaggcctacagagatgccttcaagaagatgaagccacccaagatccccttcatgcccctgctgctgaaggatgtgaccttcatccacgagggcaacaagaccttcctggacaacctggtgaactttgagaagctgcacatgattgctgacacagtgaggaccctgcggcactgcaggaccaaccagtttggagacctgagccccaaggagcaccaggagctgaagagctatgtgaaccacctgtatgtgattgacagccagcaggccctgtttgagctgagccaccgcatcgagccccgggtgtag

SEQ ID NO: 16662 - DNA, 1749 bp, Artificial Sequence
  Description of Artificial Sequence: Synthetic coding sequence
atgggcagcagccggctgcgggtgtttgacccccacctggagaggaaggacagcgctgctgccctgagtgaccgggagctgcccctgcccacctttgatgtgccctacttcaagtacattgatgaagaagatgaagatgatgagtggagcagccgcagccagagcagcacagaagatgattctgtggacagcctgctgagtgaccgctacgtggtggtgtctggcaccccagagaagatcctggagcacctgctgaatgacctgcacctggaggaggtgcaggacaaggagacagagaccctgctggatgacttcctgctgacctacaccgtcttcatgaccacagatgacctgtgccaggccctgctgcgcatctacagcgccaagaagtaccagggcaaggaggagaacagtgatgtgcccaggaggaagaggaaggtgctgcacctggtgtcccagtggatcgccctgtacaaggactggctgcctgaagatgagcacagcaagatgttcctgaagaccatctacagaaatgtgctggatgatgtgtatgagtaccccatcctggagaaggagctgaaggagttccagaagatcctgggcatgcaccggcggcacacagtggatgagtacagcccccagaagaagaacaaggccctcttccaccagttcagcctgaaggagaactggctgcagcaccggggcaccgtgacagaaacagaggagatcttctgccacgtgtacatcacagagcacagctatgtgtctgtgaaggccaaggtgagcagcatcgcccaggagatcctgaaggtggtggccgagaagatccagtatgcagaggaggacctggccctggtggccatcaccttcagcggggacaaggagaagcatgagctgcagcccaatgacctggtgatcagcaagagcctggaggccagcggccgcatctacgtgtacaggaaggacctggccgacaccctgaacccctttgctgaaaatgaggagagccagcagaggtccatgaggatcctgggcatgaacacctgggacctggccctggagctgatgaactttgactggagcctcttcaacagcatccacgagcaggagctgatctacttcaccttcagccggcagggcagcggggagcacacagccaacctgagcctgctgctgcagcgctgcaatgaggtgcagctgtgggtggccacagagatcctgctgtgcagccagctgggcaagagggtgcagctggtgaagaagttcatcaagattgctgcccactgcaaggcccagaggaacctgaacagcttctttgccatcgtgatgggcctgaacacagcctctgtgtcccggctgagccagacctgggagaagatccctgggaagttcaagaagctgttcagcgagctggagagcctgacagaccccagcctgaaccacaaggcctacagagatgccttcaagaagatgaagccacccaagatccccttcatgcccctgctgctgaaggatgtgaccttcatccacgagggcaacaagaccttcctggacaacctggtgaactttgagaagctgcacatgattgctgacacagtgaggaccctgcggcactgcaggaccaaccagtttggagacctgagccccaaggagcaccaggagctgaagagctatgtgaaccacctgtatgtgattgacagccagcaggccctgtttgagctgagccaccgcatcgagccccgggtgtag

SEQ ID NO: 16663 - DNA, 1122 bp, Artificial Sequence
  Description of Artificial Sequence: Synthetic coding sequence
atgctgctgggcctggccgccatggagctgaaggtgtgggtggatggcatccagagggtggtgtgtggggtgtctgagcagaccacctgccaggaggtggtgattgccctggcccaggccatcggccagacaggccgctttgtgctggtgcagaggctgcgggagaaggagcggcagctgctgccccaggagtgccctgtgggcgcccaggccacctgtggccagtttgccagtgatgtgcagtttgtgctgcggaggacaggccccagcctggccggccggcccagcagtgacagctgccccccacctgagcgctgcctgatccgggccagcctgcctgtgaagccccgggccgccctgggctgtgagcccaggaagaccctgaccccagagcccgcccccagcctgagcaggcctggccctgctgcccctgtgacccccaccccaggctgctgcacagacctgcggggcctggagctgcgggtgcagagaaatgctgaggagctgggccacgaggccttctgggagcaggagctgcggcgggagcaggcccgggagcgggagggccaggcccggctgcaggccctgtctgctgccacagctgagcacgccgcccggctgcaggccctggatgcccaggcccgggccctggaggccgagctgcagctggccgctgaggcccctggcccccccagccccatggccagcgccacagagcggctgcaccaggacctggccgtgcaggagcggcagagcgctgaggtgcagggcagcctggccctggtgtcccgggccctggaggccgctgagcgggccctgcaggcccaggcccaggagctggaggagctgaaccgggagctgcggcagtgcaacctgcagcagttcatccagcagacaggagctgccctgcccccaccacccaggccagaccggggccccccaggcacccagggccccctgcccccagcccgggaggagagcctgctgggcgcccccagcgagagccatgctggggcccagccccggccccggggcggcccccatgatgctgagctgctggaggtggccgccgccccagcccctgagtggtgccccctggccgcccagccccaggccctgtag

SEQ ID NO: 16664 - DNA, 1014 bp, Artificial Sequence
  Description of Artificial Sequence: Synthetic coding sequence
atgctgctgggcctggccgccatggagctgaaggtgtgggtggatggcatccagagggtggtgtgtggggtgtctgagcagaccacctgccaggaggtggtgattgccctggcccaggccatcggccagacaggccgctttgtgctggtgcagaggctgcgggagaaggagcggcagctgctgccccaggagtgccctgtgggcgcccaggccacctgtggccagtttgccagtgatgtgcagtttgtgctgcggaggacaggccccagcctggccggccggcccagcagtgacagctgccccccacctgagcgctgcctgatccgggccagcctgcctgtgaagccccgggccgccctgggctgtgagcccaggaagaccctgaccccagagcccgcccccagcctgagcaggcctggccctgctgcccctgtgacccccaccccaggctgctgcacagacctgcggggcctggagctgcgggtgcagagaaatgctgaggagctgggccacgaggccttctgggagcaggagctgcggcgggagcaggcccgggagcgggagggccaggcccggctgcaggccctgtctgctgccacagctgagcacgccgcccggctgcaggccctggatgcccaggcccgggccctggaggccgagctgcagctggccgctgaggcccctggcccccccagccccatggccagcgccacagagcggctgcaccaggacctggccgtgcaggagcggcagagcgctgaggtgcagggcagcctggccctggtgtcccgggccctggaggccgctgagcgggccctgcaggcccaggcccaggagctggaggagctgaaccgggagctgcggcagtgcaacctgcagcagttcatccagcagacaggagctgccctgcccccaccacccaggccagaccggggccccccaggcacccaggtgggcgtggtgctgggcggcggctgggaggtgaggacctggcccagccccacccccagctag

SEQ ID NO: 16665 - DNA, 1122 bp, Artificial Sequence; identical to SEQ ID NO: 16663
  Description of Artificial Sequence: Synthetic coding sequence

SEQ ID NO: 16666 - DNA, 1014 bp, Artificial Sequence; identical to SEQ ID NO: 16664
  Description of Artificial Sequence: Synthetic coding sequence

SEQ ID NO: 16667 - DNA, 963 bp, Artificial Sequence
  Description of Artificial Sequence: Synthetic coding sequence
atgctgctgggcctggccgccatggagctgaaggtgtgggtggatggcatccagagggtggtgtgtggggtgtctgagcagaccacctgccaggaggtggtgattgccctggcccaggccatcggccagacaggccgctttgtgctggtgcagaggctgcgggagaaggagcggcagctgctgccccaggagtgccctgtgggcgcccaggccacctgtggccagtttgccagtgatgtgcagtttgtgctgcggaggacaggccccagcctggccggccggcccagcagtgacagctgccccccacctgagcgctgcctgatccgggccagcctgcctgtgaagccccgggccgccctgggctgtgagcccaggaagaccctgaccccagagcccgcccccagcctgagcaggcctggccctgctgcccctgtgacccccaccccaggctgctgcacagacctgcggggcctggagctgcgggtgcagagaaatgctgaggagctgggccacgaggccttctgggagcaggagctgcggcgggagcaggcccgggagcgggagggccaggcccggctgcaggccctgtctgctgccacagctgagcacgccgcccggctgcaggccctggatgcccaggcccgggccctggaggccgagctgcagctggccgctgaggcccctggcccccccagccccatggccagcgccacagagcggctgcaccaggacctggccgtgcaggagcggcagagcgctgaggtgcagggcagcctggccctggtgtcccgggccctggaggccgctgagcgggccctgcaggcccaggcccaggagctggaggagctgaaccgggagctgcggcagtgcaacctgcagcagttcatccagcagacaggagctgccctgcccccaccacccaggccagaccggggccccccaggcacccagtggcccccatag

SEQ ID NO: 16668 - DNA, 255 bp, Artificial Sequence
  Description of Artificial Sequence: Synthetic coding sequence
atgctgctgggcctggccgccatggagctgaaggtgtgggtggatggcatccagagggtggtgtgtggggtgtctgagcagaccacctgccaggaggtggtgattgccctggcccaggccatcggccagacaggccgctttgtgctggtgcagaggctgcgggagaaggagcggcagctgctgccccaggagtgccctgtgggcgcccaggccacctgtggccagtttgccagtgatgtgcagtttgtgctgtag

SEQ ID NO: 16669 - DNA, 2145 bp, Artificial Sequence
  Description of Artificial Sequence: Synthetic coding sequence
atgaacaccctgcagggccctgtgtccttcaaggatgtggccgtggacttcacccaggaggagtggcagcagctggaccctgatgagaagatcacctacagagatgtgatgctggagaactacagccacctggtgtctgtgggctatgacaccaccaagcccaacgtcatcatcaagctggagcagggcgaggagccctggatcatgggcggggagttcccctgccagcacagccctgaggcctggagggtggatgacctgattgaaagaatccaggagaatgaagacaagcacagccggcaggccgcctgcatcaacagcaagaccctgacagaggagaaggagaacaccttcagccagatctacatggagaccagcctggtgcccagcagcatcatcgcccacaactgtgtgtcctgtgggaagaacctggagagcatcagccagctgatcagcagtgatggcagctatgcccggaccaagccagatgagtgcaatgaatgtgggaagacctaccatggagagaagatgtgtgagttcaaccagaatggagacacctacagccacaatgaggagaacatcctgcagaagatcagcatcctggagaagccctttgagtacaatgaatgcatggaggccctggacaatgaggccgtgttcatcgcccacaagagggcctacatcggggagaagccctatgagtggaatgacagcggccctgacttcatccagatgagcaacttcaatgcctaccagaggagccagatggagatgaagccctttgagtgcagtgaatgtgggaagagcttctgcaagaagagcaagttcatcatccaccagagggcccacactggagagaagccctatgagtgcaatgtgtgtgggaagagcttcagccagaagggcaccctgactgtgcaccggcgcagccacctggaggagaagccctacaagtgcaatgaatgtgggaagaccttctgccagaagctgcacctgacccagcacctgcggacccacagcggggagaagccctatgagtgcagtgaatgtgggaagaccttctgccagaagacccacctgaccctgcaccagaggaaccacagcggggagcggccctacccctgcaatgaatgtgggaagagcttcagcaggaagagcgccctgagtgaccaccagaggacccacactggagagaagctgtacaagtgcaatgaatgtgggaagagctactacaggaagagcaccctcatcacccaccagaggacccacactggagagaagccctaccagtgcagtgaatgtgggaagttcttcagccgggtgtcctacctgaccatccactaccgcagccacctggaggagaagccctatgagtgcaatgaatgtgggaagaccttcaacctgaacagcgccttcatccgccacaggaaggtgcacacagaggagaagagccatgagtgcagtgaatgtgggaagttcagccagctgtacctgacagaccaccacacagcccacctggaggagaagccctatgagtgcaatgaatgtgggaagaccttcctggtgaacagcgcctttgatggccaccagcccctgcccaagggggagaagagctatgagtgcaatgtgtgtgggaagctgttcaatgagctgagctactacacagagcactaccgcagccacagcgaggagaagccctacggctgcagtgaatgtgggaagaccttcagccacaacagcagcctcttccgccaccagagggtgcacactggagagaagccctatgagtgctatgaatgtgggaagttcttcagccagaagagctacctgaccatccaccaccgcatccacagcggggagaagccctatgagtgcagcaaatgtgggaaggtgttcagcaggatgagcaacctgactgtgcactaccgcagccacagcggggagaagccctatgagtgcaatgaatgtgggaaggtgttcagccagaagagctacctgactgtgcactaccgcacccacagcggggagaagccctatgagtgcaatgaatgtgggaagaagttccaccacaggtctgccttcaacagccaccagaggatccaccggcggggcaacatgaatgtgctggatgtggagaacctgtag

SEQ ID NO: 16670 - DNA, 2145 bp, Artificial Sequence; identical to SEQ ID NO: 16669
  Description of Artificial Sequence: Synthetic coding sequence

SEQ ID NO: 16671 - DNA, 732 bp, Artificial Sequence
  Description of Artificial Sequence: Synthetic coding sequence
atgaacaccctgcagggccctgtgtccttcaaggatgtggccgtggacttcacccaggaggagtggcagcagctggaccctgatgagaagatcacctacagagatgtgatgctggagaactacagccacctggtgtctgtgggctatgacaccaccaagcccaacgtcatcatcaagctggagcagggcgaggagccctggatcatgggcggggagttcccctgccagcacagccctgaggcctggagggtggatgacctgattgaaagaatccaggagaatgaagacaagcacagcagcaggcctgcccggcggccctgtggcccccgctgctgctgctgctgctgctgcagccggccccccaggagccccccacccaagcccctgcccaccaggatgctgacccccaggaaggccttccgcacctgcagcaaggagagcggcctggccgagacagagagctgtggccagacccacacctggccccgggccctggccgtgctgatgggcctgtggtggccccgggaccagaaggccggggaggaggacctgcgcttccgggagaggaggcctggcctgcaggccacagccaccggcagcggggagcacggggccttccctgtgcacagccagggcgtgtgggccagcacccactggcagggcacagctgtgtgccccctgcagaccccacctccagatgccttcatccggaacaacaaggtgctgtcctag

SEQ ID NO: 16672 - DNA, 342 bp, Artificial Sequence
  Description of Artificial Sequence: Synthetic coding sequence
atgaacaccctgcagggccctgtgtccttcaaggatgtggccgtggacttcacccaggaggagtggcagcagctggaccctgatgagaagatcacctacagagatgtgatgctggagaactacagccacctggtgtctgtgggctatgacaccaccaagcccaacgtcatcatcaagctggagcagggcgaggagccctggatcatgggcggggagttcccctgccagcacagccctgctgccctgcctgctggccacgtggccccagctgtggccgctgctgctgctgcccctggccggcccggcccccaccggcagagccgcagccccccaggctgctag

SEQ ID NO: 16673 - DNA, 1554 bp, Artificial Sequence
  Description of Artificial Sequence: Synthetic coding sequence
atggaccctgctggagctgctgaccccagcgtgccccccaaccccctgacccacctgagcctgcaggacagaagtgagatgcagctgcagagcgaggccgacagaagaagcctgcccggcacctggaccaggagcagccctgagcacaccaccatcctgcggggcggcgtgcggcgctgcctgcagcagcagtgtgagcagacagtgcgcatcctgcacgccaaggtggcccagaagagctatggaaatgagaagcgcttcttctgccccccaccctgtgtgtacctgagcggccctggctggagggtgaagccaggccaggaccaggcccaccaggccggggagaccggccccaccgtgtgtggctacatgggcctggacagcgccagcggcagcgccacagagacccagaagctgaactttgagcagcagcctgacagccgggagtttggctgtgccaagaccctgtacatcagtgatgctgacaagaggaagcacttccggctggtgctgcggctggtgctgcggggcggccgggagctgggcaccttccacagccgcctcatcaaggtgatcagcaagcccagccagaagaagcagagcctgaagaacacagacctgtgcatcagcagcggcagcaaggtgtccctcttcaaccggctgcggagccagacagtgtccacccgctacctgtctgtggaggatggagcctttgtggccagcgcccggcagtgggccgccttcaccctgcacctggctgatggccacagcgcccagggcgacttccccccccgggagggctacgtgcgctatggcagcctggtgcagctggtgtgcaccgtgacaggcatcaccctgccccccatgatcatcaggaaggtggccaagcagtgtgccctgctggatgtggatgagcccatcagccagctgcacaagtgtgccttccagtttcctggcagccccccaggcggcggcggcacctacctgtgcctggccacagagaaggtggtgcagttccaggccagcccctgccccaaggaggccaacagagccctgctgaatgacagcagctgctggaccatcatcggcacagagagcgtggagttctccttcagcaccagcctggcctgcaccctggagcctgtgacccctgtgcccctcatcagcaccctggagctgagcggcggcggagatgtggccaccctggagctgcatggagagaacttccacgccggcctgaaggtgtggtttggagatgtggaggccgagaccatgtaccgcagccccaggagcctggtgtgtgtggtgcctgatgtggccgccttctgcagcgactggcgctggctgcgggcccccatcaccatccccatgagcctggtgcgggcagatggcctcttctaccccagcgccttctccttcacctacaccccagagtacagcgtgcggcccggccaccctggggtgcctgagcccgccacagatgctgatgccctgctggagagcatccaccaggagttcaccaggaccaacttccacctgttcatccagacctag

SEQ ID NO: 16674 - DNA, 1416 bp, Artificial Sequence
  Description of Artificial Sequence: Synthetic coding sequence
atggaccctgctggagctgctgaccccagcgtgccccccaaccccctgacccacctgagcctgcaggacagaagtgagatgcagctgcagagcgaggccgacagaagaagcctgcccggcacctggaccaggagcagccctgagcacaccaccatcctgcggggcggcgtgcggcgctgcctgcagcagcagtgtgagcagacagtgcgcatcctgcacgccaaggtggcccagaagagctatggaaatgagaagcgcttcttctgccccccaccctgtgtgtacctgagcggccctggctggagggtgaagccaggccaggaccaggcccaccaggccggggagaccggccccaccgtgtgtggctacatgggcctggacagcgccagcggcagcgccacagagacccagaagctgaactttgagcagcagcctgacagccgggagtttggctgtgccaagaccctgtacatcagtgatgctgacaagaggaagcacttccggctggtgctgcggctggtgctgcggggcggccgggagctgggcaccttccacagccgcctcatcaaggtgatcagcaagcccagccagaagaagcagagcctgaagaacacagacctgtgcatcagcagcggcagcaaggtgtccctcttcaaccggctgcggagccagacagtgtccacccgctacctgtctgtggaggatggagcctttgtggccagcgcccggcagtgggccgccttcaccctgcacctggctgatggccacagcgcccagggcgacttccccccccgggagggctacgtgcgctatggcagcctggtgcagctggtgtgcaccgtgacaggcatcaccctgccccccatgatcatcaggaaggtggccaagcagtgtgccctgctggatgtggatgagcccatcagccagctgcacaagtgtgccttccagtttcctggcagccccccaggcggcggcggcacctacctgtgcctggccacagagaaggtggtgcagttccaggccagcccctgccccaaggaggccaacagagccctgctgaatgacagcagctgctggaccatcatcggcacagagagcgtggagttctccttcagcaccagcctggcctgcaccctggagcctgtgacccctgtgcccctcatcagcaccctggagctgagcggcggcggagatgtggccaccctggagctgcatggagagaacttccacgccggcctgaaggtgtggtttggagatgtggaggccgagaccatgtaccgctatggagtggagcctgctgtgcctggggtgcggggggccggccggggcggcctgctgcagaggctggccctggccgcccggagccaccacaacccccatgagcccggggcccggcggcgggccctgctgccctag

SEQ ID NO: 16675 - DNA, 1551 bp, Artificial Sequence
  Description of Artificial Sequence: Synthetic coding sequence
atggaccctgctggagctgctgaccccagcgtgccccccaaccccctgacccacctgagcctgcaggacagaagtgagatgcagctgcagagcgaggccgacagaagaagcctgcccggcacctggaccaggagcagccctgagcacaccaccatcctgcggggcggcgtgcggcgctgcctgcagcagcagtgtgagcagacagtgcgcatcctgcacgccaaggtggcccagaagagctatggaaatgagaagcgcttcttctgccccccaccctgtgtgtacctgagcggccctggctggagggtgaagccaggccaggaccaggcccaccaggccggggagaccggccccaccgtgtgtggctacatgggcctggacagcgccagcggcagcgccacagagacccagaagctgaactttgagcagcagcctgacagccgggagtttggctgtgccaagaccctgtacatcagtgatgctgacaagaggaagcacttccggctggtgctgcggctggtgctgcggggcggccgggagctgggcaccttccacagccgcctcatcaaggtgatcagcaagcccagccagaagaagcagagcctgaagaacacagacctgtgcatcagcagcggcagcaaggtgtccctcttcaaccggctgcggagccagacagtgtccacccgctacctgtctgtggaggatggagcctttgtggccagcgcccggcagtgggccgccttcaccctgcacctggctgatggccacagcgcccagggcgacttccccccccgggagggctacgtgcgctatggcagcctggtgcagctggtgtgcaccgtgacaggcatcaccctgccccccatgatcatcaggaaggtggccaagcagtgtgccctgctggatgtggatgagcccatcagccagctgcacaagtgtgccttccagtttcctggcagccccccaggcggcggcggcacctacctgtgcctggccacagagaaggtggtgcagttccaggccagcccctgccccaaggaggccaacagagccctgctgaatgacagcagctgctggaccatcatcggcacagagagcgtggagttctccttcagcaccagcctggcctgcaccctggagcctgtgacccctgtgcccctcatcagcaccctggagctgagcggcggcggagatgtggccaccctggagctgcatggagagaacttccacgccggcctgaaggtgtggtttggagatgtggaggccgagaccatgtacagccccaggagcctggtgtgtgtggtgcctgatgtggccgccttctgcagcgactggcgctggctgcgggcccccatcaccatccccatgagcctggtgcgggcagatggcctcttctaccccagcgccttctccttcacctacaccccagagtacagcgtgcggcccggccaccctggggtgcctgagcccgccacagatgctgatgccctgctggagagcatccaccaggagttcaccaggaccaacttccacctgttcatccagacctag

SEQ ID NO: 16676 - DNA, 2124 bp, Artificial Sequence
  Description of Artificial Sequence: Synthetic coding sequence
atgcagaccagcgagaccggcagtgacaccggcagcacagtgaccctgcagacctctgtggccagccaggccgctgtgcccacccaggtggtgcagcaggtgcctgtgcagcagcaggtgcagcaggtgcagacagtgcagcaggtgcagcacgtgtacccagcccaggtgcagtatgtggagggcagtgacacagtgtacaccaatggagccatccgcaccaccacctacccctacacagagacccagatgtacagccagaacacaggaggcaactactttgacacccagggcagcagcgcccaggtgaccaccgtggtgagcagccacagcatggtgggcactggaggcatccagatgggcgtgactggaggccagctgatcagcagcagcggcggcacctacctgattggcaacagcatggagaacagcggccacagcgtgacccacaccacccgggccagccctgccaccatcgagatggccatcgagaccctgcagaagagtgatggcctgagcacccacaggagcagcctgctgaacagccacctgcagtggctgctggacaactatgaaacagctgagggcgtgtccctgcccaggagcaccctgtacaaccactacctgcggcactgccaggagcacaagctggaccctgtgaatgctgccagctttgggaagctgatccgcagcatcttcatgggcctgcggacccggcggctgggcacccggggcaacagcaagtaccactactacggcatccgggtgaagccagacagccccctgaaccggctgcaggaggacatgcagtacatggccatgaggcagcagcccatgcagcagaagcagcgctacaagcccatgcagaaggtggatggagtggctgatggcttcaccggcagcggccagcagacaggcacctctgtggagcagaccgtcatcgcccagagccagcaccaccagcagttcctggatgccagccgggccctgcctgagtttggagaggtggagatcagcagcctgcctgatggcaccacctttgaggacatcaagagcctgcagagcctgtaccgggagcactgtgaggccatcctggatgtggtggtgaacctgcagttcagcctcatcgagaagctgtggcagaccttctggagatacagccccagcacccccacagatggcaccaccatcacagagagcagcaacctgtctgaaattgagagccggctgcccaaggccaagctgatcaccctgtgcaagcatgagagcatcctgaagtggatgtgcaactgtgaccacggcatgtaccaggccctggtggagatcctgatcccagatgtgctgcggcccatccccagcgccctgacccaggccatccggaactttgccaagagcctggagggctggctgagcaatgccatgaacaacatcccccagaggatgatccagaccaaggtggccgctgtgtctgcctttgcccagaccctgcggcgctacaccagcctgaaccacctggcccaggccgcccgggctgtgctgcagaacaccagccagatcaaccagatgctgagtgacctgaacagagtggactttgccaacgtgcaggagcaggcctcctgggtgtgccagtgtgatgacaacatggtgcagaggctggagacagacttcaagatgaccctgcagcagcagagcaccctggagcagtgggccgcctggctggacaacgtgatgatgcaggccctgaagccctatgagggccggcccagcttccccaaggccgcccggcagttcctgctgaagtggagcttctacagctccatggtgatccgggacctgaccctgcggtctgctgccagctttggcagcttccacctgatccggctgctgtatgatgagtacatgttctacctggtggagcaccgggtggcccaggccaccggggagacccccatcgctgtgatgggagaggtgcgggaggccgagagagctgtgacccactgggtgatcaagaacaagccagagctgcacttcagcctgaacaccctgctgatcaagaccatggtgcccaaccaggtgtccctgcgggcccggcgggactgtggggtgattgcccgggtgccctag

SEQ ID NO: 16677 - DNA, 2124 bp, Artificial Sequence; identical to SEQ ID NO: 16676
  Description of Artificial Sequence: Synthetic coding sequence

SEQ ID NO: 16678 - DNA, 258 bp, Artificial Sequence
  Description of Artificial Sequence: Synthetic coding sequence
atgcagaccagcgagaccggcagtgacaccggcagcacagtgaccctgcagacctctgtggccagccaggccgctgtgcccacccaggtggtgcagcaggtgcctgtgcagcagcaggtgcagcaggtgcagacagtgcagcaggtgcagcacgtgtacccagcccaggtgcagtatgtggagggcagtgacacagtgtacaccaatggagccatgagccgggccccctggagcatgatcctggagagcagcccctag

SEQ ID NO: 16679 - DNA, 588 bp, Artificial Sequence
  Description of Artificial Sequence: Synthetic coding sequence
atgcagaccagcgagaccggcagtgacaccggcagcacagtgaccctgcagacctctgtggccagccaggccgctgtgcccacccaggtggtgcagcaggtgcctgtgcagcagcaggtgcagcaggtgcagacagtgcagcaggtgcagcacgtgtacccagcccaggtgcagtatgtggagggcagtgacacagtgtacaccaatggagccatccgcaccaccacctacccctacacagagacccagatgtacagccagaacacaggaggcaactactttgacacccagggcagcagcgcccaggtgaccaccgtggtgagcagccacagcatggtgggcactggaggcatccagatgggcgtgactggaggccagctgatcagcagcagcggcggcacctacctgattggcaacagcatggagaacagcggccacagcgtgacccacaccacccgggccagccctgccacagccaacagcgtgcctgagatgaagctgctgcggcagatcaccatgaacagactcttccccaccctgaaccacaagctgacagagggcagcggcccccacttccagagcatctag

SEQ ID NO: 16680 - DNA, 417 bp, Artificial Sequence
  Description of Artificial Sequence: Synthetic coding sequence
atgctgagtgacctgaacagagtggactttgccaacgtgcaggagcaggcctcctgggtgtgccagtgtgatgacaacatggtgcagaggctggagacagacttcaagatgaccctgcagcagcagagcaccctggagcagtgggccgcctggctggacaacgtgatgatgcaggccctgaagccctatgagggccggcccagcttccccaaggccgcccggcagttcctgctgaagtggagcttctacagctccatggtgatccgggacctgaccctgcggtctgctgccagctttggcagcttccacctgatccggctgctgtatgatgagtacatgttctacctggtggagcaccgggtggcccaggccactggagagacccccatcgctgtgatgggagaggtgcccatgtag

SEQ ID NO: 16681 - DNA, 651 bp, Artificial Sequence
  Description of Artificial Sequence: Synthetic coding sequence
atgcagaccagcgagaccggcagtgacaccggcagcacagtgaccctgcagacctctgtggccagccaggccgctgtgcccacccaggtggtgcagcaggtgcctgtgcagcagcaggtgcagcaggtgcagacagtgcagcaggtgcagcacgtgtacccagcccaggtgcagtatgtggagggcagtgacacagtgtacaccaatggagccatccgcaccaccacctacccctacacagagacccagatgtacagccagaacacaggaggcaactactttgacacccagggcagcagcgcccaggtgaccaccgtggtgagcagccacagcatggtgggcactggaggcatccagatgggcgtgactggaggccagctgatcagcagcagcggcggcacctacctgattggcaacagcatggagaacagcggccacagcgtgacccacaccacccgggccagccctgccaccctgcagtggctgctggacaactatgaaacagctgagggcgtgtccctgcccaggagcaccctgtacaaccactacctgcggcactgccaggagcacaagctggaccctgtgaatgctgccagctttgggaagctgatccgcagcatcttcatgggcctgcggacccggcggctgtag

SEQ ID NO: 16682 - DNA, 2250 bp, Artificial Sequence
  Description of Artificial Sequence: Synthetic coding sequence
atgcagaccagcgagaccggcagtgacaccggcagcacagtgaccctgcagacctctgtggccagccaggccgctgtgcccacccaggtggtgcagcaggtgcctgtgcagcagcaggtgcagcaggtgcagacagtgcagcaggtgcagcacgtgtacccagcccaggtgcagtatgtggagggcagtgacacagtgtacaccaatggagccatccgcaccaccacctacccctacacagagacccagatgtacagccagaacacaggaggcaactactttgacacccagggcagcagcgcccaggtgaccaccgtggtgagcagccacagcatggtgggcactggaggcatccagatgggcgtgactggaggccagctgatcagcagcagcggcggcacctacctgattggcaacagcatggagaacagcggccacagcgtgacccacaccacccgggccagccctgccaccatcgagatggccatcgagaccctgcagaagagtgatggcctgagcacccacaggagcagcctgctgaacagccacctgcagtggctgctggacaactatgaaacagctgagggcgtgtccctgcccaggagcaccctgtacaaccactacctgcggcactgccaggagcacaagctggaccctgtgaatgctgccagctttgggaagctgatccgcagcatcttcatgggcctgcggacccggcggctgggcacccggggcaacagcaagtaccactactacggcatccgggtgaagccagacagccccctgaaccggctgcaggaggacatgcagtacatggccatgaggcagcagcccatgcagcagaagcagcgctacaagcccatgcagaaggtggatggagtggctgatggcttcaccggcagcggccagcagacaggcacctctgtggagcagaccgtcatcgcccagagccagcaccaccagcagttcctggatgccagccgggccctgcctgagtttggagaggtggagatcagcagcctgcctgatggcaccacctttgaggacatcaagagcctgcagagcctgtaccgggagcactgtgaggccatcctggatgtggtggtgaacctgcagttcagcctcatcgagaagctgtggcagaccttctggagatacagccccagcacccccacagatggcaccaccatcacagagagcagcaacctgtctgaaattgagagccggctgcccaaggccaagctgatcaccctgtgcaagcatgagagcatcctgaagtggatgtgcaactgtgaccacggcatgtaccaggccctggtggagatcctgatcccagatgtgctgcggcccatccccagcgccctgacccaggccatccggaactttgccaagagcctggagggctggctgagcaatgccatgaacaacatcccccagaggatgatccagaccaaggtggccgctgtgtctgcctttgcccagaccctgcggcgctacaccagcctgaaccacctggcccaggccgcccgggctgtgctgcagaacaccagccagatcaaccagatgctgagtgacctgaacagagtggactttgccaacgtgcaggagcaggcctcctgggtgtgccagtgtgatgacaacatggtgcagaggctggagacagacttcaagatgaccctgcagcagcagagcaccctggagcagtgggccgcctggctggacaacgtgatgatgcaggccctgaagccctatgagggccggcccagcttccccaaggccgcccggcagttcctgctgaagtggagcttctacagctccatggtgatccgggacctgaccctgcggtctgctgccagctttggcagcttccacctgatccggctgctgtatgatgagtacatgttctacctggtggagcaccgggtggcccaggccaccggggagacccccatcgctgtgatgggagaatttggagacctgaatgctgtgtccccaggcaacctggacaaggatgagggcagcgaggtggagagcgagatggatgaggagctggatgacagcagcgagccccaggccaagcgggagaagacagagctgagccaggccttccctgtgggctgcatgcagcctgtgctggagaccggggtgcagcccagcctgctgaaccccatccacagcgagcacatcgtgaccagcacccagaccatccggcagtgcagcgccaccggcaacacctacacagctgtgtag

SEQ ID NO: 16683 - DNA, 471 bp, Artificial Sequence
  Description of Artificial Sequence: Synthetic coding sequence
gtgcagcaggtgcagacagtgcagcaggtgcagcacgtgtacccagcccaggtgcagtatgtggagggcagtgacacagtgtacaccaacggggccatccgcaccaccacctacccctacacagagacccagatgtacagccagaacacaggaggcaactactttgacacccagggcagcagcgcccaggtgaccaccgtggtgagcagccacagcatggtgggcaccggcggcatccagatgggcgtgactggaggccagctgatcagcagcagcggcggcacctacctgattggcaacagcatggagaacagcggccacagcgtgacccacaccacccgggccagccctgccacagccaacagcgtgcctgagatgaagctgctgcggcagatcaccatgaacagactcttccccaccctgaaccacaagctgacagagggcagcggcccccacttccagagcatctag

SEQ ID NO: 16684 - DNA, 408 bp, Artificial Sequence
  Description of Artificial Sequence: Synthetic coding sequence
gtgcagcaggtgcagacagtgcagcaggtgcagcacgtgtacccagcccaggtgcagtatgtggagggcagtgacacagtgtacaccaacggggccatccgcaccaccacctacccctacacagagacccagatgtacagccagaacacaggaggcaactactttgacacccagggcagcagcgcccaggtgaccaccgtggtgagcagccacagcatggtgggcaccggcggcatccagatgggcgtgactggaggccagctgatcagcagcagcggcggcacctacctgattggcaacagcatggagaacagcggccacagcgtgacccacaccacccgggccagccctgccaccctcttcctgttcagctgtgtgcccttcagcctgggccagctgagcccctag

SEQ ID NO: 16685 - DNA, 417 bp, Artificial Sequence
  Description of Artificial Sequence: Synthetic coding sequence
atgcagaccagcgagaccggcagtgacaccggcagcacagtgaccctgcagacctctgtggccagccaggccgctgtgcccacccaggtggtgcagcaggtgcctgtgcagcagcaggtgcagcaggtgcagacagtgcagcaggtgcagcacgtgtacccagcccaggtgcagtatgtggagggcagtgacacagtgtacaccaatggagccatccgcaccaccacctacccctacacagagacccagatgtacagccagaacacaggaggcaactactttgacacccagggcagcagcgcccaggtgaccaccgtggtgagcagccacagcatggtgggcactggaggcatccagatgggcgtgactggaggccagctgatcagcagcagcggcggcacctacctgattggatag

SEQ ID NO: 16686 - DNA, 375 bp, Artificial Sequence
  Description of Artificial Sequence: Synthetic coding sequence
gagcaggcctcctgggtgtgccagtgtgatgacaacatggtgcagaggctggagacagacttcaagatgaccctgcagcagcagagcaccctggagcagtgggccgcctggctggacaacgtgatgatgcaggccctgaagccctatgagggccggcccagcttccccaaggccgcccggcagttcctgctgaagtggagcttctacagctccatggtgatccgggacctgaccctgcggtctgctgccagctttggcagcttccacctgatccggctgctgtatgatgagtacatgttctacctggtggagcaccgggtggcccaggccactggagagacccccatcgctgtgatgggagaggtgcccatgtag

SEQ ID NO: 16687 - DNA, 555 bp, Artificial Sequence
  Description of Artificial Sequence: Synthetic coding sequence
atgcagaccagcgagaccggcagtgacaccggcagcacagtgaccctgcagacctctgtggccagccaggccgctgtgcccacccaggtggtgcagcaggtgcctgtgcagcagcaggtgcagcaggtgcagacagtgcagcaggtgcagcacgtgtacccagcccaggtgcagtatgtggagggcagtgacacagtgtacaccaatggagccatccgcaccaccacctacccctacacagagacccagatgtacagccagaacacaggaggcaactactttgacacccagggcagcagcgcccaggtgaccaccgtggtgagcagccacagcatggtgggcactggaggcatccagatgggcgtgactggaggccagctgatcagcagcagcggcggcacctacctgattggcaacagcatggagaacagcggccacagcgtgacccacaccacccgggccagccctgccaccatcgagatggccatcgagaccctgcagaagagtgatggcctgagcacccacaggagcagcctgctgaacagccacgtgtag

SEQ ID NO: 16688 - DNA, 651 bp, Artificial Sequence; identical to SEQ ID NO: 16681
  Description of Artificial Sequence: Synthetic coding sequence

SEQ ID NO: 16689 - DNA, 525 bp, Artificial Sequence
  Description of Artificial Sequence: Synthetic coding sequence
atgtgcaactgtgaccacggcatgtaccaggccctggtggagatcctgatcccagatgtgctgcggcccatccccagcgccctgacccaggccatccggaactttgccaagagcctggagggctggctgagcaatgccatgaacaacatcccccagaggatgatccagaccaaggtggccgctgtgtctgcctttgcccagaccctgcggcgctacaccagcctgaaccacctggcccaggccgcccgggctgtgctgcagaacaccagccagatcaaccagatgctgagtgacctgaacagagtggactttgccaacgtgcaggagcaggcctcctgggtgtgccagtgtgatgacaacatggtgcagaggctggagacagacttcaagatgaccctgcagcagcagagcaccctggagcagtgggccgcctggctggacaacgtgatgatgcaggccctgaagccctatgagggccggcccagcttccccaaggccgcccggcagttcctgctgaagtggtag

SEQ ID NO: 16690 - DNA, 330 bp, Artificial Sequence
  Description of Artificial Sequence: Synthetic coding sequence
atggctgtggtgggcgtgtcctctgtgtcccggctgctgggccgcagccggccccagctgggccggcccatgagcagcggggcccatggagaggagggcagcgccaggatgtggaagaccctgaccttctttgtggccctgcccggggtggccgtgtccatgctgaatgtgtacctgaagagccaccacggggagcacgagaggcctgagttcatcgcctacccccacctgcgcatccgcaccaagcccttcccctggggagatggcaaccacaccctcttccacaacccccacgtgaaccccctgcccaccggctatgaagatgaatag

SEQ ID NO: 16691 - DNA, 2235 bp, Artificial Sequence
  Description of Artificial Sequence: Synthetic coding sequence
atgatcaagaggcgggcccaccctggggccggcggggacaggacccggcccaggagaagaagaagcacagagagctggattgagcgctgcctgaatgaaagtgagaacaagcgctacagcagccacaccagcctgggcaatgtgtccaatgatgaaaatgaggagaaggagaacaacagagccagcaagccccacagcaccccagccaccctgcagtggctggaggagaactatgaaattgctgagggcgtgtgcatccccaggtctgccctgtacatgcactacctggacttctgtgagaagaatgacacccagcctgtgaatgctgccagctttgggaagatcatccggcagcagttcccccagctgaccacccggcggctgggcacccggggccagagcaagtaccactactatggaattgctgtgaaggagagcagccagtactatgatgtgatgtacagcaagaagggagctgcctgggtgtctgaaacaggcaagaaggaggtgtccaagcagacagtggcctacagccccaggagcaagctgggcaccctgctgcctgagttccccaacgtgaaggacctgaacctgcctgccagcctgcctgaggagaaggtgtccaccttcatcatgatgtaccgcacccactgccagaggatcctggacaccgtcatccgggccaactttgatgaggtgcagagcttcctgctgcacttctggcagggcatgccaccccacatgctgcctgtgctgggcagcagcacagtggtgaacatcgtgggcgtgtgtgacagcatcctgtacaaggccatctctggagtgctgatgcccaccgtgctgcaggccctgcctgacagcctgacccaggtgatcaggaagtttgccaagcagctggatgagtggctgaaggtggccctgcatgacctgcctgagaacctgaggaacatcaagtttgagctgagccgccgcttcagccagatcctgcggcggcagaccagcctgaaccacctgtgccaggccagcaggacagtcatccacagcgctgacatcaccttccagatgctggaggactggagaaatgtggacctgaacagcatcaccaagcagaccctgtacaccatggaggacagcagagatgagcacaggaagctgatcacccagctgtaccaggagtttgaccacctgctggaggagcagagccccatcgagagctacatcgagtggctggacaccatggtggacagatgtgtggtgaaggtggccgccaagaggcagggcagcctgaagaaggtggcccagcagttcctgctgatgtggagctgcttcggcaccagggtcatccgggacatgaccctgcacagcgcccccagctttggcagcttccacctgatccacctgatgtttgatgattatgtgctgtacctgctggagagcctgcactgccaggagcgggccaatgagctgatgagggccatgaagggggagggcagcacagctgaggtgcgggaggagatcatcctgacagaagctgctgcccccacccccagccctgtgcccagcttcagccctgccaagagcgccacctctgtggaggtgcccccacccagcagccctgtgagcaaccccagccctgagtacacaggcctgagcaccactggagccatgcagagctacacctggagcctgacctacacagtgaccacagctgctggcagccctgctgagaacagccagcagctgccctgcatgaggaacacccacgtgcccagcagctctgtgacccaccgcatccctgtgtacccccaccgggaggagcacggctacacaggcagctacaactacggcagctatggcaaccagcacccccaccccatgcagagccagtacccagccctgccccatgacacagccatcagcggccccctgcactacgccccctaccacaggagcagcgcccagtaccccttcaacagccccaccagcaggatggagccctgcctgatgagcagcaccccccggctgcaccccacccctgtgaccccccgctggccagaggtgcccagcgccaacacctgctacaccagccccagcgtgcacagcgcccgctatggcaacagcagtgacatgtacacccccctgaccaccaggaggaacagtgaatatgagcacatgcagcacttccctggctttgcctacatcaatggagaggccagcacaggctgggccaagtag

SEQ ID NO: 16692 - DNA, 2208 bp, Artificial Sequence
  Description of Artificial Sequence: Synthetic coding sequence
atgcactgcggcctgctggaggagccagacatggacagcacagagagctggattgagcgctgcctgaatgaaagtgagaacaagcgctacagcagccacaccagcctgggcaatgtgtccaatgatgaaaatgaggagaaggagaacaacagagccagcaagccccacagcaccccagccaccctgcagtggctggaggagaactatgaaattgctgagggcgtgtgcatccccaggtctgccctgtacatgcactacctggacttctgtgagaagaatgacacccagcctgtgaatgctgccagctttgggaagatcatccggcagcagttcccccagctgaccacccggcggctgggcacccggggccagagcaagtaccactactacggcattgctgtgaaggagagcagccagtactatgatgtgatgtacagcaagaagggggccgcctgggtgtctgagaccgggaagaaggaggtgtccaagcagacagtggcctacagccccaggagcaagctgggcaccctgctgcctgagttccccaacgtgaaggacctgaacctgcctgccagcctgcctgaggagaaggtgtccaccttcatcatgatgtaccgcacccactgccagaggatcctggacaccgtcatccgggccaactttgatgaggtgcagagcttcctgctgcacttctggcagggcatgccaccccacatgctgcctgtgctgggcagcagcacagtggtgaacatcgtgggcgtgtgtgacagcatcctgtacaaggccatcagcggcgtgctgatgcccaccgtgctgcaggccctgcctgacagcctgacccaggtgatcaggaagtttgccaagcagctggatgagtggctgaaggtggccctgcatgacctgcctgagaacctgaggaacatcaagtttgagctgagccgccgcttcagccagatcctgcggcggcagaccagcctgaaccacctgtgccaggccagcaggacagtcatccacagcgctgacatcaccttccagatgctggaggactggagaaatgtggacctgaacagcatcaccaagcagaccctgtacaccatggaggacagcagagatgagcacaggaagctgatcacccagctgtaccaggagtttgaccacctgctggaggagcagagccccatcgagagctacatcgagtggctggacaccatggtggacagatgtgtggtgaaggtggccgccaagaggcagggcagcctgaagaaggtggcccagcagttcctgctgatgtggagctgcttcggcaccagggtcatccgggacatgaccctgcacagcgcccccagctttggcagcttccacctgatccacctgatgtttgatgattatgtgctgtacctgctggagagcctgcactgccaggagcgggccaatgagctgatgagggccatgaagggggagggcagcacagctgaggtgcgggaggagatcatcctgacagaggccgccgcccccacccccagccctgtgcccagcttctccccagccaagagcgccacctctgtggaggtgcccccacccagcagccctgtgagcaaccccagccctgagtacacaggcctgagcaccaccggggccatgcagagctacacctggagcctgacctacacagtgaccacagctgctggcagccctgctgagaacagccagcagctgccctgcatgaggaacacccacgtgcccagcagctctgtgacccaccgcatccctgtgtacccccaccgggaggagcacggctacacaggcagctacaactacggcagctatggcaaccagcacccccaccccatgcagagccagtacccagccctgccccatgacacagccatcagcggccccctgcactacgccccctaccacaggagcagcgcccagtaccccttcaacagccccaccagcaggatggagccctgcctgatgagcagcaccccccggctgcaccccacccctgtgaccccccgctggccagaggtgcccagcgccaacacctgctacaccagccccagcgtgcacagcgcccgctatggcaacagcagtgacatgtacacccccctgaccaccaggagaaattctgaatatgagcacatgcagcacttccctggctttgcctacatcaacggggaggccagcacaggctgggccaagtag

SEQ ID NO: 16693 - DNA, 1761 bp, Artificial Sequence
  Description of Artificial Sequence: Synthetic coding sequence
atggccgagggcgtgcctgccagccccagcagtggagagggcagccggggcccccacagcggggtcatccagtggctggtggacaacttctgcatctgtgaagaatgttctgtgccccgctgcctgatgtatgagatctacgtggagacctgtggccagaacacagagaaccaggtgaacccagccaccttcggcaagctggtgcggctggtgtttcctgacctgggcacccggcggctgggcacccggggcagcgcccgctaccactatgatggcatctgcatcaagaagagcagcttcttctacgcccagtactgctacctgattggagagaagcgctaccacagcggagatgccatcgcctttgagaagagcaccaactacaacagcatcatccagcaggaggccacctgtgaggaccacagccccatgaagacagatcctgtgggcagccccctgtctgagttccgccgctgccccttcctggagcaggagcaggccaagaagtacagctgcaacatgatggccttcctggctgatgagtactgcaactactgccgggacatcctgagaaatgtggaggacctgctgaccagcttctggaagagcctgcagcaggacacagtgatgctgatgagcctgcctgatgtgtgccagctgttcaagtgctatgatgtgcagctgtacaagggcattgaagatgtgctgctgcatgacttcctggaggatgtgtccatccagtacctgaagtctgtgcagctgttcagcaagaagttcaagctgtggctgctgaatgccctggagggcgtgcctgccctgctgcagatcagcaagctgaaggaggtgaccctgtttgtgaagaggctgcggaggaagacctacctgagcaacatggccaagaccatgaggatggtgctgaagagcaagagaagagtgtctgtgctgaagagtgacctgcaggccatcatcaaccagggcaccctggccaccagcaagaaggccctggccagtgacagaagtggagcagatgagctggagaacaaccctgagatgaagtgcctgaggaacctgatcagcctgctgggcaccagcacagacctgcgggtcttcctgagctgcctgagcagccacctgcaggcctttgtgttccagaccagccgcagcaaggaggagttcaccaagctggccgccagcttccagctgcgctggaacctgctgctgacagctgtgtccaaggccatgaccctgtgccaccgggacagctttggctcctggcacctgttccacctgctgctgctggagtacatgatccacatcctgcagagctgcctggaggaggaggaggaggaggaggacatgggcaccgtgaaggagatgctgcctgatgaccccaccctgggccagcctgaccaggccctcttccacagcctgaacagcagcctgagccaggcctgtgccagccccagcatggagcccctgggcgtgatgcccacccacatgggccagggccgctaccctgtgggcgtgagcaacatggtgctgcgcatcctgggcttcctggtggacacagccatgggcaacaagctgatccaggtgctgctggaggatgagaccacagaatctgctgtgaagctgagcctgcccatgggccaggaggccctgatcaccctgaaggatggccagcagtttgtgatccagatcagtgatgtgccccagagcagcgaggacatctacttcagagaaaataatgccaacgtgtag

SEQ ID NO: 16694 - DNA, 1422 bp, Artificial Sequence
  Description of Artificial Sequence: Synthetic coding sequence
atgtatgagatctacgtggagacctgtggccagaacacagagaaccaggtgaacccagccaccttcggcaaatgtgaggaccacagccccatgaagacagatcctgtgggcagccccctgtctgagttccgccgctgccccttcctggagcaggagcaggccaagaagtacagctgcaacatgatggccttcctggctgatgagtactgcaactactgccgggacatcctgagaaatgtggaggacctgctgaccagcttctggaagagcctgcagcaggacacagtgatgctgatgagcctgcctgatgtgtgccagctgttcaagtgctatgatgtgcagctgtacaagggcattgaagatgtgctgctgcatgacttcctggaggatgtgtccatccagtacctgaagtctgtgcagctgttcagcaagaagttcaagctgtggctgctgaatgccctggagggcgtgcctgccctgctgcagatcagcaagctgaaggaggtgaccctgtttgtgaagaggctgcggaggaagacctacctgagcaacatggccaagaccatgaggatggtgctgaagagcaagagaagagtgtctgtgctgaagagtgacctgcaggccatcatcaaccagggcaccctggccaccagcaagaaggccctggccagtgacagaagtggagcagatgagctggagaacaaccctgagatgaagtgcctgaggaacctgatcagcctgctgggcaccagcacagacctgcgggtcttcctgagctgcctgagcagccacctgcaggcctttgtgttccagaccagccgcagcaaggaggagttcaccaagctggccgccagcttccagctgcgctggaacctgctgctgacagctgtgtccaaggccatgaccctgtgccaccgggacagctttggctcctggcacctgttccacctgctgctgctggagtacatgatccacatcctgcagagctgcctggaggaggaggaggaggaggaggacatgggcaccgtgaaggagatgctgcctgatgaccccaccctgggccagcctgaccaggccctcttccacagcctgaacagcagcctgagccaggcctgtgccagccccagcatggagcccctgggcgtgatgcccacccacatgggccagggccgctaccctgtgggcgtgagcaacatggtgctgcgcatcctgggcttcctggtggacacagccatgggcaacaagctgatccaggtgctgctggaggatgagaccacagagagcgctgtgaagctgagcctgcccatgggccaggaggccctgatcaccctgaaggatggccagcagtttgtgatccagatcagtgatgtgccccagagcagcgaggacatctacttccgggagaacaatgccaacgtgtag

SEQ ID NO: 16695 - DNA, 138 bp, Artificial Sequence
  Description of Artificial Sequence: Synthetic coding sequence
atgtatgagatctacgtggagacctgtggccagaacacagagaaccaggtgaacccagccaccttcggcaagatggccttcctggctgatgagtactgcaactactgccgggacatcctgagaaatgtgaggaactag

SEQ ID NO: 16696 - DNA, 1704 bp, Artificial Sequence
  Description of Artificial Sequence: Synthetic coding sequence
atgctggagcggcgctgccggggccccctggccatgggcctggcccagccccggctgctgagcggccccagccaggagagcccccagaccctgggcaaggagagccggggcctgcggcagcagggcacctctgtggcccagagcggggcccaggcccctggccgggcccaccgctgtgcccactgcagaagacacttccctggctgggtggccctgtggctgcacacccggcgctgccaggcccggctgcccctgccctgcccagaatgtggccgccgcttcagacatgcccccttcctggccctgcaccggcaggtgcacgccgccgccaccccagacctgggctttgcctgccacctgtgtggccagagcttccggggctgggtggccctggtgctgcacctgcgggcccacagcgctgccaagaggcccatcgcctgccccaagtgtgagcggcgcttctggaggaggaagcagctgcgggcccacctgcggcgctgccaccccccagcccctgaggcccggcccttcatctgtggcaactgtggccgcagctttgcccagtgggaccagctggtggcccacaagagggtgcacgtggccgaggccctggaggaggccgccgccaaggccctgggcccccggccccggggccggcctgctgtgacagcccccaggcctggaggagatgctgtggaccggcccttccagtgtgcctgctgcggcaagcgcttccgccacaagcccaacctgattgcccacagaagagtgcacactggagagcggccccaccagtgcccagaatgtgggaagcgcttcaccaacaagccctacctgaccagccaccggcgcatccacactggagagaagccctacccctgcaaggaatgtggccgccgcttccgccacaagcccaacctgctgagccacagcaagatccacaagaggtctgagggcagcgcccaggccgcccctggccctggcagcccccagctgcctgctggcccccaggagagcgctgctgagcccaccccagctgtgcccctgaagccagcccaggagcccccacctggggcccctcctgagcacccccaggaccccatcgaggccccacccagcctgtacagctgtgatgactgtggccgctccttccggctggagcgcttcctgcgggcccaccagaggcagcacactggagagcggcccttcacctgtgctgaatgtgggaagaactttgggaagaagacccacctggtggcccacagccgggtgcacagcggggagcggccctttgcctgtgaagaatgtggccgccgcttcagccagggcagccacctggccgcccaccggcgggaccacgccccagaccggccctttgtgtgcccagactgtgggaaggccttccgccacaagccctacctggccgcccaccggcgcatccacactggagagaagccctacgtgtgcccagactgtgggaaggccttcagccagaagagcaacctggtgagccaccggcgcatccacactggagagcggccctatgcctgcccagactgtgaccgctccttcagccagaagagcaacctgatcacccacaggaagagccacatcagagatggagccttctgctgtgccatctgtggccagacctttgatgatgaggagcggctgctggcccaccagaagaagcatgatgtgtag

SEQ ID NO: 16697 - DNA, 1704 bp, Artificial Sequence; identical to SEQ ID NO: 16696
  Description of Artificial Sequence: Synthetic coding sequence

SEQ ID NO: 16698 - DNA, 1704 bp, Artificial Sequence; identical to SEQ ID NO: 16696
  Description of Artificial Sequence: Synthetic coding sequence

SEQ ID NO: 16699 - DNA, 615 bp, Artificial Sequence
  Description of Artificial Sequence: Synthetic coding sequence
atgggcattggagtgtccctgctgctgcagttcagcctgaccccaggcggctacagatctgtgggccgcagccgccgctgcagccggggcagcatccccaggaacatccccaagaggtcctggaagaagccccacccccagctgtgcagcctgcaggccgaggaggagcccatgctggagcggcgctgccggggccccctggccatgggcctggcccagccccggctgctgagcggccccagccaggagagcccccagaccctgggcaaggagagccggggcctgcggcagcagggcacctctgtggcccagagcggggcccaggcccctggccgggcccaccgctgtgcccactgccgccgccacttccctggctgggtggccctgtggctgcacacccggcgctgccaggcccggctgcccctgccctgcccagaatgtggccgccgcttcagacatgcccccttcctggccctgcaccggcaggtgcatgctgctgccaccccagacctgggctttgcctgccacctgtgtggccagagcttccggggctgggtggccctggtgctgcacctgcgggcccacagcgctgccaagaggcccatcgcctgctag

SEQ ID NO: 16700 - DNA, 1875 bp, Artificial Sequence
  Description of Artificial Sequence: Synthetic coding sequence
atgggcattggagtgtccctgctgctgcagttcagcctgaccccaggcggctacagatctgtgggccgcagccgccgctgcagccggggcagcatccccaggaacatccccaagaggtcctggaagaagccccacccccagctgtgcagcctgcaggccgaggaggagcccatgctggagcggcgctgccggggccccctggccatgggcctggcccagccccggctgctgagcggccccagccaggagagcccccagaccctgggcaaggagagccggggcctgcggcagcagggcacctctgtggcccagagcggggcccaggcccctggccgggcccaccgctgtgcccactgccgccgccacttccctggctgggtggccctgtggctgcacacccggcgctgccaggcccggctgcccctgccctgcccagaatgtggccgccgcttcagacatgcccccttcctggccctgcaccggcaggtgcatgctgctgccaccccagacctgggctttgcctgccacctgtgtggccagagcttccggggctgggtggccctggtgctgcacctgcgggcccacagcgctgccaagaggcccatcgcctgccccaagtgtgaaagacgcttctggaggaggaagcagctgcgggcccacctgcggcgctgccaccccccagcccctgaggcccggcccttcatctgtggcaactgtggccgcagctttgcccagtgggaccagctggtggcccacaagagggtgcacgtggccgaggccctggaggaggccgccgccaaggccctgggcccccggccccggggccggcctgctgtgacagcccccaggcctggaggagatgctgtggaccggcccttccagtgtgcctgctgcggcaagcgcttccgccacaagcccaacctgattgcccaccggcgggtgcacactggagagcggccccaccagtgcccagaatgtgggaagcgcttcaccaacaagccctacctgaccagccaccggcgcatccacactggagagaagccctacccctgcaaggaatgtggccgccgcttccgccacaagcccaacctgctgagccacagcaagatccacaagaggtctgagggcagcgcccaggccgcccctggccctggcagcccccagctgcctgctggcccccaggagagcgctgctgagcccaccccagctgtgcccctgaagccagcccaggagcccccacctggggcccctcctgagcacccccaggaccccatcgaggccccacccagcctgtacagctgtgatgactgtggccgctccttccggctggagcgcttcctgcgggcccaccagaggcagcacactggagagcggcccttcacctgtgccgagtgtgggaagaactttgggaagaagacccacctggtggcccacagccgggtgcacagcggggagcggccctttgcctgtgaggagtgtggccgccgcttcagccagggcagccacctggccgcccacagaagagaccacgccccagaccggccctttgtgtgcccagactgtgggaaggccttccgccacaagccctacctggccgcccaccggcgcatccacactggagagaagccctacgtgtgcccagactgtgggaaggccttcagccagaagagcaacctggtgagccaccggcgcatccacactggagagcggccctatgcctgcccagactgtgacaggagcttcagccagaagagcaacctgatcacccacaggaagagccacatcagagatggagccttctgctgtgccatctgtggccagacctttgatgatgaggagcggctgctggcccaccagaagaagcatgatgtgtag

SEQ ID NO: 16701 - DNA, 441 bp, Artificial Sequence
  Description of Artificial Sequence: Synthetic coding sequence
atgctggagcggcgctgccggggccccctggccatgggcctggcccagccccggctgctgagcggccccagccaggagagcccccagaccctgggcaaggagagccggggcctgcggcagcagggcacctctgtggcccagagcggggcccaggcccctggccgggcccaccgctgtgcccactgcagaagacacttccctggctgggtggccctgtggctgcacacccggcgctgccaggcccggctgcccctgccctgcccagaatgtggccgccgcttcagacatgcccccttcctggccctgcaccggcaggtgcacgccgccgccaccccagacctgggctttgcctgccacctgtgtggccagagcttccggggctgggtggccctggtgctgcacctgcgggcccacagcgctgccaagaggcccatcgcctag

SEQ ID NO: 16702 - DNA, 1704 bp, Artificial Sequence; identical to SEQ ID NO: 16696
  Description of Artificial Sequence: Synthetic coding sequence

SEQ ID NO: 16703 - DNA, 1449 bp, Artificial Sequence
  Description of Artificial Sequence: Synthetic coding sequence
atggtggagaagggccctgaggtgtctgggaagaggcggggcagaaataatgctgctgccagcgccagcgctgctgctgccagcgctgctgccagcgctgcctgtgccagccctgctgccacagctgccagcggggctgctgccagcagcgccagcgctgctgctgccagcgctgctgctgcccccaacaacggccagaacaagagcctggccgctgctgcccccaacggcaacagcagcagcaacagctgggaggagggcagcagcggcagcagcagtgatgaggagcacggcggcggcggcatgagggtgggcccccagtaccaggccgtggtgcctgactttgatcctgccaagctggcccggcgcagccaggagcgggacaacctgggcatgctggtgtggagccccaaccagaacctgtctgaggccaagctggatgagtacatcgccatcgccaaggagaagcacggctacaacatggagcaggccctgggcatgctgttctggcacaagcacaacatcgagaagagcctggccgacctgcccaacttcacccccttcccagatgagtggacagtggaggacaaggtgctgtttgagcaggccttctccttccacggcaagaccttccaccgcatccagcagatgctgcctgacaagagcatcgccagcctggtgaagttctactacagctggaagaagaccaggaccaagacctctgtgatggacagacatgccaggaagcagaagcgggagcgggaggagagtgaagatgagctggaggaggccaatggaaacaaccccatcgacatcgaggtggaccagaacaaggagagcaagaaggaggtgcccccaacagaaacagtgccccaggtgaagaaggagaagcacagcacccaggccaagaacagagccaagaggaagccacccaagggcatgttcctgagccaggaggatgtggaggccgtgtctgccaatgccacagctgccaccaccgtgctgcggcagctggacatggagctggtgtctgtgaagaggcagatccagaacatcaagcagaccaacagcgccctgaaggagaagctggatggcggcatcgagccctaccgcctgcctgaggtgatccagaagtgcaatgcccgctggaccacagaggagcagctgctggccgtgcaggccatcagaaaatatggccgggacttccaggccatcagtgatgtgattggcaacaagtctgtggtgcaggtgaagaacttctttgtgaactacagaagacgcttcaacattgatgaggtgctgcaggagtgggaggccgagcacggcaaggaggagaccaacggccccagcaaccagaagcctgtgaagagcccagacaacagcatcaagatgcctgaggaggaggatgaggcccctgtgctggatgtgcgctatgccagcgccagctag

SEQ ID NO: 16704 - DNA, 1449 bp, Artificial Sequence; identical to SEQ ID NO: 16703
  Description of Artificial Sequence: Synthetic coding sequence

SEQ ID NO: 16705 - DNA, 1572 bp, Artificial Sequence
  Description of Artificial Sequence: Synthetic coding sequence
atgcccagcgtgatggagaagcccagcgctggcagcggcatcctgagccgcagccgggccaagacagtgcccaatggaggccagccccacagtgaagatgacagcagcgaggaggagcacagccatgacagcatgatccgggtgggcaccaactaccaggccgtcatccctgagtgcaagccagagagccctgcccgctacagcaacaaggagctgaagggcatgctggtgtggagccccaaccactgtgtgtctgatgccaagctggacaagtacatcgccatggccaaggagaagcacggctacaacatcgagcaggccctgggcatgctgctgtggcacaagcatgatgtggagaagagcctggccgacctggccaacttcacccccttcccagatgagtggacagtggaggacaaggtgctgtttgagcaggccttcggcttccacggcaagtgcttccagaggatccagcagatgctgcctgacaagctgatccccagcctggtgaagtactactacagctggaagaagaccaggagcaggacctctgtgatggaccggcaggcccggcggctgggcggcaggaaggacaaggaggacagtgatgagctggaggagggccggggcggcgtgtctgagggggagccagaccctgctgaccccaagcgggagcccctgcccagccggcccctgaatgcccggcccggccctgggaagaaggaggtgcaggtgtcccagtaccgccaccaccccctgcggaccaggagaagaccacccaagggcatgtacctgagccctgagggcctgacagctgtgtctggcagcccagacctggccaacctgaccctgcggggcctggacagccagctgatcagcctgaagaggcaggtgcagagcatgaagcagaccaacagcagcctgcggcaggccctggagggcggcatcgaccccctgcggcccccagaggccaacaccaagttcaacagccgctggaccacagatgagcagctgctggccgtgcaggccatcagaagatatggcaaggactttggagccatcgccgaggtgattggcaacaagaccctgacccaggtgaagaccttctttgtgtcctacagaagacgcttcaacctggaggaggtgctgcaggagtgggaggccgagcaggatggagcccctggggcccctgtgcccatggaggaggcccggcggggggcccccctgcctgccccagccctggaggaggatgatgaggtgcagatcacctctgtgtccacctctgtgcccaggtctgtgcccccagcccctcctcctcctcctccacccaccagcctgagccagcccccacccctgctgcggccccccctgcccacagcccccaccctgctgcggcagcccccacccctgcagcagggccgcttcctgcagccccggctggcccccaaccagcccccacctcctctcatccggcctgccctggccgcccccaggcacagcgcccggcccggcccccagcccccacccaccctcatcggcacccccctggagcccccagcccccagcctgtag

SEQ ID NO: 16706 - DNA, 1488 bp, Artificial Sequence
  Description of Artificial Sequence: Synthetic coding sequence
atgagggtgggcgctgagtaccaggcccgcatccctgagtttgaccccggggccaccaagtacacagacaaggacaatggaggcatgctggtgtggagcccctaccacagcatcccagatgccaagctggatgagtacatcgccatcgccaaggagaagcacggctacaacgtggagcaggccctgggcatgctgttctggcacaagcacaacatcgagaagagcctggccgacctgcccaacttcacccccttcccagatgagtggacagtggaggacaaggtgctgtttgagcaggccttctccttccacggcaagagcttccaccgcatccagcagatgctgcctgacaagaccatcgccagcctggtgaagtactactacagctggaagaagaccaggagcaggaccagcctgatggaccggcaggccaggaagctggccaacagacacaaccagggcgacagtgatgatgatgtggaggagacccaccccatggatggaaatgacagcgactatgaccccaagaaggaggccaagaaggagggcaacacagagcagcctgtgcagaccagcaagattggcctgggccggcgggagtaccagagcctgcagcaccgccaccacagccagaggagcaagtgcaggcctcccaagggcatgtacctgacccaggaggatgtggtggccgtgtcctgcagccccaatgctgccaacaccatcctgcggcagctggacatggagctgatcagcctgaagaggcaggtgcagaatgccaagcaggtgaacagcgccctgaagcagaagatggagggcggcatcgaggagttcaagcccccagagagcaaccagaagatcaatgcccgctggaccacagaggagcagctgctggccgtgcagggcgtgaggaaatatggcaaggacttccaggccatcgcagatgtgattggcaacaagacagtgggccaggtgaagaacttctttgtgaactacagaagacgcttcaacctggaggaggtgctgcaggagtgggaggccgagcagggcacccaggccagcaatggagatgccagcaccctgggggaggagaccaagagcgccagcaatgtgcccagcggcaagagcacagatgaggaggaggaggcccagaccccccaggcccccaggaccctgggccccagccccccagcccccagcagcacccccacccccacagcccccatcgccaccctgaaccagcccccacccctgctgcggcccaccctgcctgctgccccagccctgcaccggcagcccccacccctgcagcagcaggcccgcttcatccagccccggcccaccctgaaccagcccccacctcctctcatccggcctgccaacagcatgccaccccggctgaaccccaggcctgtgctgagcacagtgggcggccagcagccccccagcctcatcggcatccagacagacagccagagcagcctgcactag

SEQ ID NO: 16707 - DNA, 1311 bp, Artificial Sequence
  Description of Artificial Sequence: Synthetic coding sequence
atgcctggcatgatggagaagggccctgagctgctgggcaagaacagaagtgccaatggaagtgccaagagccctgctgggggcggcggcagcggggccagcagcaccaatggaggcctgcactacagcgagcctgagagcggctgcagcagtgatgatgaacatgatgtgggcatgagggtgggcgctgagtaccaggcccgcatccctgagtttgaccccggggccaccaagtacacagacaaggacaatggaggcatgctggtgtggagcccctaccacagcatcccagatgccaagctggatgagtacatcgccatcgccaaggagaagcacggctacaacgtggagcaggccctgggcatgctgttctggcacaagcacaacatcgagaagagcctggccgacctgcccaacttcacccccttcccagatgagtggacagtggaggacaaggtgctgtttgagcaggccttctccttccacggcaagagcttccaccgcatccagcagatgctgcctgacaagaccatcgccagcctggtgaagtactactacagctggaagaagaccaggagcaggaccagcctgatggaccggcaggccaggaagctggccaacagacacaaccagggcgacagtgatgatgatgtggaggagacccaccccatggatggaaatgacagcgactatgaccccaagaaggaggccaagaaggagggcaacacagagcagcctgtgcagaccagcaagattggcctgggccggcgggagtaccagagcctgcagcaccgccaccacagccagaggagcaagtgcaggcctcccaagggcatgtacctgacccaggaggatgtggtggccgtgtcctgcagccccaatgctgccaacaccatcctgcggcagctggacatggagctgatcagcctgaagaggcaggtgcagaatgccaagcaggtgaacagcgccctgaagcagaagatggagggcggcatcgaggagttcaagcccccagagagcaaccagaagatcaatgcccgctggaccacagaggagcagctgctggccgtgcagggcacagaccccaccggcagcagtgacaccggcagcatcaccagctgccccatcatccacagcaacaccaacagcccctactgccacagcgagcccgccagcaccaccagcagcagcaacacagcctgctgccccggcagcagccctgctgccagcagcaccccagctgctggctctgtgcacccagccccagccaacttcaagagcgccagcaccaccagctacagcccctgctag

SEQ ID NO: 16708 - DNA, 1662 bp, Artificial Sequence
  Description of Artificial Sequence: Synthetic coding sequence
atgcctggcatgatggagaagggccctgagctgctgggcaagaacagaagtgccaatggaagtgccaagagccctgctgggggcggcggcagcggggccagcagcaccaatggaggcctgcactacagcgagcctgagagcggctgcagcagtgatgatgaacatgatgtgggcatgagggtgggcgctgagtaccaggcccgcatccctgagtttgaccccggggccaccaagtacacagacaaggacaatggaggcatgctggtgtggagcccctaccacagcatcccagatgccaagctggatgagtacatcgccatcgccaaggagaagcacggctacaacgtggagcaggccctgggcatgctgttctggcacaagcacaacatcgagaagagcctggccgacctgcccaacttcacccccttcccagatgagtggacagtggaggacaaggtgctgtttgagcaggccttctccttccacggcaagagcttccaccgcatccagcagatgctgcctgacaagaccatcgccagcctggtgaagtactactacagctggaagaagaccaggagcaggaccagcctgatggaccggcaggccaggaagctggccaacagacacaaccagggcgacagtgatgatgatgtggaggagacccaccccatggatggaaatgacagcgactatgaccccaagaaggaggccaagaaggagggcaacacagagcagcctgtgcagaccagcaagattggcctgggccggcgggagtaccagagcctgcagcaccgccaccacagccagaggagcaagtgcaggcctcccaagggcatgtacctgacccaggaggatgtggtggccgtgtcctgcagccccaatgctgccaacaccatcctgcggcagctggacatggagctgatcagcctgaagaggcaggtgcagaatgccaagcaggtgaacagcgccctgaagcagaagatggagggcggcatcgaggagttcaagcccccagagagcaaccagaagatcaatgcccgctggaccacagaggagcagctgctggccgtgcagggcgtgaggaaatatggcaaggacttccaggccatcgcagatgtgattggcaacaagacagtgggccaggtgaagaacttctttgtgaactacagaagacgcttcaacctggaggaggtgctgcaggagtgggaggccgagcagggcacccaggccagcaatggagatgccagcaccctgggggaggagaccaagagcgccagcaatgtgcccagcggcaagagcacagatgaggaggaggaggcccagaccccccaggcccccaggaccctgggccccagccccccagcccccagcagcacccccacccccacagcccccatcgccaccctgaaccagcccccacccctgctgcggcccaccctgcctgctgccccagccctgcaccggcagcccccacccctgcagcagcaggcccgcttcatccagccccggcccaccctgaaccagcccccacctcctctcatccggcctgccaacagcatgccaccccggctgaaccccaggcctgtgctgagcacagtgggcggccagcagccccccagcctcatcggcatccagacagacagccagagcagcctgcactag

SEQ ID NO: 16709 - DNA, 1350 bp, Artificial Sequence
  Description of Artificial Sequence: Synthetic coding sequence
atgcctggcatgatggagaagggccctgagctgctgggcaagaacagaagtgccaatggaagtgccaagagccctgctgggggcggcggcagcggggccagcagcaccaatggaggcctgcactacagcgagcctgagagcggctgcagcagtgatgatgaacatgatgtgggcatgagggtgggcgctgagtaccaggcccgcatccctgagtttgaccccggggccaccaagtacacagacaaggacaatggaggcatgctggtgtggagcccctaccacagcatcccagatgccaagctggatgagtacatcgccatcgccaaggagaagcacggctacaacgtggagcaggccctgggcatgctgttctggcacaagcacaacatcgagaagagcctggccgacctgcccaacttcacccccttcccagatgagtggacagtggaggacaaggtgctgtttgagcaggccttctccttccacggcaagagcttccaccgcatccagcagatgctgcctgacaagaccatcgccagcctggtgaagtactactacagctggaagaagaccaggagcaggaccagcctgatggaccggcaggccaggaagctggccaacagacacaaccagggcgacagtgatgatgatgtggaggagacccaccccatggatggaaatgacagcgactatgaccccaagaaggaggccaagaaggagggcaacacagagcagcctgtgcagaccagcaagattggcctgggccggcgggagtaccagagcctgcagcaccgccaccacagccagaggagcaagtgcaggcctcccaagggcatgtacctgacccaggaggatgtggtggccgtgtcctgcagccccaatgctgccaacaccatcctgcggcagctggacatggagctgatcagcctgaagaggcaggtgcagaatgccaagcaggtgaacagcgccctgaagcagaagatggagggcggcatcgaggagttcaagcccccagagagcaaccagaagatcaatgcccgctggaccacagaggagcagctgctggccgtgcagggcgtgaggaaatatggcaaggacttccaggccatcgcagatgtgattggcaacaagacagtgggccaggtgaagaacttctttgtgaactacagaagacgcttcaacctggaggaggtgctgcaggagtgggaggccgagcagggcacccaggccagcaatggagatgccagcaccctgggggaggagaccaagagcgccagcaatgtgcccagcggcaagagcacagatgaggaggaggaggtgtgcctgtgcatggagtttgagctgatctag

SEQ ID NO: 16710 - DNA, 450 bp, Artificial Sequence
  Description of Artificial Sequence: Synthetic coding sequence
atgagggtgggcgctgagtaccaggcccgcatccctgagtttgaccccggggccaccaagtacacagacaaggacaatggaggcatgctggtgtggagcccctaccacagcatcccagatgccaagctggatgagtacatcgccatcgccaaggagaagcacggctacaacgtggagcaggccctgggcatgctgttctggcacaagcacaacatcgagaagagcctggccgacctgcccaacttcacccccttcccagatgagtggacagtggaggacaaggtgctgtttgagcaggccttctccttccacggcaagagcttccaccgcatccagcagatgctgcctgacaagaccatcgccagcctggtgaagtactactacagctggaagaagaccaggagcaggaccagcctgatggaccggcaggccaggaagctggccaactag

SEQ ID NO: 16711 - DNA, 261 bp, Artificial Sequence
  Description of Artificial Sequence: Synthetic coding sequence
atgagggtgggcgctgagtaccaggcccgcatccctgagtttgaccccggggccaccaagtacacagacaaggacaatggaggcatgctggtgtggagcccctaccacagcatcccagatgccaagctggatgagtacatcgccatcgccaaggagaagcacggctacaacgtggagcaggccctgggcatgctgttctggcacaagcacaacatcgagaagagcctggccgacctgcccaacttcacccccttcccctag

SEQ ID NO: 16712 - DNA, 555 bp, Artificial Sequence
  Description of Artificial Sequence: Synthetic coding sequence
atgttcctgagccctggagagggccctgccacagaaggaggcggcctgggccctggagaggaggcccccaagaagaagcacagaagaaacagaaccaccttcaccacctaccagctgcaccagctggagcgggcctttgaggccagccactacccagatgtgtacagccgggaggagctggccgccaaggtgcacctgcctgaggtgcgggtgcaggtgtggttccagaacagaagagccaagtggaggcggcaggagcggctggagagcggcagcggggctgtggccgccccccggctgcctgaggccccagccctgccctttgcccggcccccagccatgagcctgcccctggagccctggctgggccctggccccccagctgtgcccggcctgccccggctgctgggccctggccctggcctgcaggccagctttggcccccacgcctttgcccccacctttgctgatggctttgccctggaggaggccagcctgcggctgctggccaaggagcacgcccaggccctggaccgggcctggcccccagcctag

SEQ ID NO: 16713 - DNA, 693 bp, Artificial Sequence
  Description of Artificial Sequence: Synthetic coding sequence
atgcctgcccctgtggagggcacagacttccctggagctggccggcaggcctggggcagccctgccctgagcctgcctgtggcccctcctgctgtgagcccccccagcgtgcccctgcccagccaccaggtgggcgccatgttcctgagccctggagagggccctgccacagaaggaggcggcctgggccctggagaggaggcccccaagaagaagcacagaagaaacagaaccaccttcaccacctaccagctgcaccagctggagcgggcctttgaggccagccactacccagatgtgtacagccgggaggagctggccgccaaggtgcacctgcctgaggtgcgggtgcaggtgtggttccagaacagaagagccaagtggaggcggcaggagcggctggagagcggcagcggggctgtggccgccccccggctgcctgaggccccagccctgccctttgcccggcccccagccatgagcctgcccctggagccctggctgggccctggccccccagctgtgcccggcctgccccggctgctgggccctggccctggcctgcaggccagctttggcccccacgcctttgcccccacctttgctgatggctttgccctggaggaggccagcctgcggctgctggccaaggagcacgcccaggccctggaccgggcctggcccccagcctag

SEQ ID NO: 16714 - DNA, 615 bp, Artificial Sequence
  Description of Artificial Sequence: Synthetic coding sequence
tgagctggggccggcgtgccctggaagagcacagagggcctgccctgggccgtgggcgccatgttcctgagccctggagagggccctgccacagaaggaggcggcctgggccctggagaggaggcccccaagaagaagcacagaagaaacagaaccaccttcaccacctaccagctgcaccagctggagcgggcctttgaggccagccactacccagatgtgtacagccgggaggagctggccgccaaggtgcacctgcctgaggtgcgggtgcaggtgtggttccagaacagaagagccaagtggaggcggcaggagcggctggagagcggcagcggggctgtggccgccccccggctgcctgaggccccagccctgccctttgcccggcccccagccatgagcctgcccctggagccctggctgggccctggccccccagctgtgcccggcctgccccggctgctgggccctggccctggcctgcaggccagctttggcccccacgcctttgcccccacctttgctgatggctttgccctggaggaggccagcctgcggctgctggccaaggagcacgcccaggccctggaccgggcctggcccccagcctag

SEQ ID NO: 16715 - DNA, 1278 bp, Artificial Sequence
  Description of Artificial Sequence: Synthetic coding sequence
atggctgacaaggaggccgcctttgatgatgctgtggaggagagggtcatcaatgaggagtacaagatctggaagaagaacacccccttcctgtatgacctggtgatgacccacgccctggagtggcccagcctgacagcccagtggctgcctgatgtgaccaggcctgagggcaaggacttcagcatccaccggctggtgctgggcacccacaccagtgatgagcagaaccacctggtgattgcctctgtgcagctgcccaatgatgatgcccagtttgatgccagccactatgacagcgagaagggggagtttggaggcttcggctctgtgtctgggaagattgaaattgagatcaagatcaaccatgaaggagaggtgaacagagcccgctacatgccccagaacccctgcatcatcgccaccaagacccccagcagtgatgtgctggtgtttgactacaccaagcaccccagcaagccagaccccagcggggagtgcaacccagacctgcggctgcggggccaccagaaggagggctacggcctgtcctggaaccccaacctgagcggccacctgctgagcgccagtgatgaccacaccatctgcctgtgggacatctctgctgtgcccaaggagggcaaggtggtggatgccaagaccatcttcaccggccacacagctgtggtggaggatgtgtcctggcacctgctgcacgagagcctgtttggatctgtggctgatgaccagaagctgatgatctgggacaccaggagcaacaacaccagcaagcccagccacagcgtggatgcccacacagctgaggtgaactgcctgtccttcaacccctacagcgagttcatcctggccactggatctgctgacaagacagtggccctgtgggacctgaggaacctgaagctgaagctgcacagctttgagagccacaaggatgagatcttccaggtgcagtggagcccccacaatgagaccatcctggccagcagcggcacagaccggcggctgaatgtgtgggacctgagcaagatcggggaggagcagagcccagaagatgctgaagatggccccccagagctgctcttcatccacggcggccacacagccaagatcagtgacttctcctggaaccccaatgagccctgggtgatctgcagcgtgtctgaggacaacatcatgcaggtgtggcagatggccgagaacatctacaatgatgaggaccctgagggctctgtggaccctgagggccagggcagctag

SEQ ID NO: 16716 - DNA, 1275 bp, Artificial Sequence
  Description of Artificial Sequence: Synthetic coding sequence
atggctgacaaggaggcctttgatgatgctgtggaggagagggtcatcaatgaggagtacaagatctggaagaagaacacccccttcctgtatgacctggtgatgacccacgccctggagtggcccagcctgacagcccagtggctgcctgatgtgaccaggcctgagggcaaggacttcagcatccaccggctggtgctgggcacccacaccagtgatgagcagaaccacctggtgattgcctctgtgcagctgcccaatgatgatgcccagtttgatgccagccactatgattctgagaagggggagtttggaggctttggatctgtgtctgggaagattgaaattgagatcaagatcaaccacgagggggaggtgaacagagcccgctacatgccccagaacccctgcatcatcgccaccaagacccccagcagtgatgtgctggtgtttgactacaccaagcaccccagcaagccagaccccagcggggagtgcaacccagacctgcggctgcggggccaccagaaggagggctacggcctgtcctggaaccccaacctgagcggccacctgctgagcgccagtgatgaccacaccatctgcctgtgggacatctctgctgtgcccaaggagggcaaggtggtggatgccaagaccatcttcaccggccacacagctgtggtggaggatgtgtcctggcacctgctgcacgagagcctgtttggatctgtggctgatgaccagaagctgatgatctgggacaccaggagcaacaacaccagcaagcccagccacagcgtggatgcccacacagctgaggtgaactgcctgtccttcaacccctacagcgagttcatcctggccaccggcagcgctgacaagacagtggccctgtgggacctgaggaacctgaagctgaagctgcacagctttgagagccacaaggatgagatcttccaggtgcagtggagcccccacaatgagaccatcctggccagcagcggcacagaccggcggctgaatgtgtgggacctgagcaagattggagaggagcagagcccagaagatgctgaagatggccccccagagctgctcttcatccatggaggccacacagccaagatcagtgacttctcctggaaccccaatgagccctgggtgatctgcagcgtgtctgaggacaacatcatgcaggtgtggcagatggccgagaacatctacaatgatgaagatcctgagggctctgtggaccctgagggccagggcagctag

SEQ ID NO: 16717 - DNA, 264 bp, Artificial Sequence
  Description of Artificial Sequence: Synthetic coding sequence
atgacccacgccctggagtggcccagcctgacagcccagtggctgcctgatgtgaccaggcctgagggcaaggacttcagcatccaccggctggtgctgggcacccacaccagtgatgagcagaaccacctggtgattgcctctgtgcagctgcccaatgatgatgcccagtttgatgccagccactatgattctgagaagggggagtttggaggctttggatctgtgtctgggaagattgaaattgagatcaagatcaactag

SEQ ID NO: 16718 - DNA, 1173 bp, Artificial Sequence
  Description of Artificial Sequence: Synthetic coding sequence
atgacccacgccctggagtggcccagcctgacagcccagtggctgcctgatgtgaccaggcctgagggcaaggacttcagcatccaccggctggtgctgggcacccacaccagtgatgagcagaaccacctggtgattgcctctgtgcagctgcccaatgatgatgcccagtttgatgccagccactatgattctgagaagggggagtttggaggctttggatctgtgtctgggaagattgaaattgagatcaagatcaaccacgagggggaggtgaacagagcccgctacatgccccagaacccctgcatcatcgccaccaagacccccagcagtgatgtgctggtgtttgactacaccaagcaccccagcaagccagaccccagcggggagtgcaacccagacctgcggctgcggggccaccagaaggagggctacggcctgtcctggaaccccaacctgagcggccacctgctgagcgccagtgatgaccacaccatctgcctgtgggacatctctgctgtgcccaaggagggcaaggtggtggatgccaagaccatcttcaccggccacacagctgtggtggaggatgtgtcctggcacctgctgcacgagagcctgtttggatctgtggctgatgaccagaagctgatgatctgggacaccaggagcaacaacaccagcaagcccagccacagcgtggatgcccacacagctgaggtgaactgcctgtccttcaacccctacagcgagttcatcctggccaccggcagcgctgacaagacagtggccctgtgggacctgaggaacctgaagctgaagctgcacagctttgagagccacaaggatgagatcttccaggtgcagtggagcccccacaatgagaccatcctggccagcagcggcacagaccggcggctgaatgtgtgggacctgagcaagattggagaggagcagagcccagaagatgctgaagatggccccccagagctgctcttcatccatggaggccacacagccaagatcagtgacttctcctggaaccccaatgagccctgggtgatctgcagcgtgtctgaggacaacatcatgcaggtgtggcagatggccgagaacatctacaatgatgaagatcctgagggctctgtggaccctgagggccagggcagctag

SEQ ID NO: 16719 - DNA, 543 bp, Artificial Sequence
  Description of Artificial Sequence: Synthetic coding sequence
gtggctgatgaccagaagctgatgatctgggacaccaggagcaacaacaccagcaagcccagccacagcgtggatgcccacacagctgaggtgaactgcctgtccttcaacccctacagcgagttcatcctggccaccggcagcgctgacaagacagtggccctgtgggacctgaggaacctgaagctgaagctgcacagctttgagagccacaaggatgagatcttccaggtgcagtggagcccccacaatgagaccatcctggccagcagcggcacagaccggcggctgaatgtgtgggacctgagcaagattggagaggagcagagcccagaagatgctgaagatggccccccagagctgctcttcatccatggaggccacacagccaagatcagtgacttctcctggaaccccaatgagccctgggtgatctgcagcgtgtctgaggacaacatcatgcaggtgtggcagatggccgagaacatctacaatgatgaagatcctgagggctctgtggaccctgagggccagggcagctag

SEQ ID NO: 16720 - DNA, 207 bp, Artificial Sequence
  Description of Artificial Sequence: Synthetic coding sequence
atgacccacgccctggagtggcccagcctgacagcccagtggctgcctgatgtgaccaggcctgagggcaaggacttcagcatccaccggctggtgctgggcacccacaccagtgatgagcagaaccacctggtgattgcctctgtgcagctgcccaatgatgatgcccagtttgatgccagccactatgattctgagaagggctag

SEQ ID NO: 16721 - DNA, 522 bp, Artificial Sequence
  Description of Artificial Sequence: Synthetic coding sequence
atgatctgggacaccaggagcaacaacaccagcaagcccagccacagcgtggatgcccacacagctgaggtgaactgcctgtccttcaacccctacagcgagttcatcctggccactggatctgctgacaagacagtggccctgtgggacctgaggaacctgaagctgaagctgcacagctttgagagccacaaggatgagatcttccaggtgcagtggagcccccacaatgagaccatcctggccagcagcggcacagaccggcggctgaatgtgtgggacctgagcaagatcggggaggagcagagcccagaagatgctgaagatggccccccagagctgctcttcatccacggcggccacacagccaagatcagtgacttctcctggaaccccaatgagccctgggtgatctgcagcgtgtctgaggacaacatcatgcaggtgtggcagatggccgagaacatctacaatgatgaggaccctgagggctctgtggaccctgagggccagggcagctag

SEQ ID NO: 16722 - DNA, 588 bp, Artificial Sequence
  Description of Artificial Sequence: Synthetic coding sequence
atggctgctgaagatgtggtggccactggagctgaccccagcgacctggagagcggcggcctgctgcacgagatcttcaccagccccctgaacctgctgctgctgggcctgtgcatcttcctgctgtacaagatcgtgcggggggaccagcctgctgccagcggggacagtgatgatgatgagcccccacccctgccccggctgaagaggcgggacttcaccccagctgagctgcggagatttgatggagtgcaggacccccgcatcctgatggccatcaacgggaaggtgtttgatgtgaccaagggcaggaagttctacggccctgagggcccctatggagtgtttgctggaagagatgccagccggggcctggccaccttctgcctggacaaggaggccctgaaggatgaatatgatgacctgagtgacctgacagctgcccagcaggagaccctgagtgactgggagagccagttcaccttcaagtaccaccacgtgggcaagctgctgaaggagggggaggagcccaccgtgtacagtgatgaggaggagcccaaggatgagagcgccaggaagaatgactag

SEQ ID NO: 16723 - DNA, 867 bp, Artificial Sequence
  Description of Artificial Sequence: Synthetic coding sequence
atggagcccccagaccagtgcagccagtacatgaccagcctgctgagccctgctgtggatgatgagaaggagctgcaggacatgaatgccatggtgctgagcctgacagaggaggtgaaggaggaggaggaggatgcccagcctgagcctgagcagggcacagctgctggggagaagctgaagtctgctggggcccagggcggggaggagaaggatggcggcggggaggagaaggatggcggcggggccggcgtgcccggccacctgtgggagggggacctggagggcaccagcggcagtgatggaaatgtggaggacagcgaccagagcgagaaggagcccggccagcagtacagccggccccagggcgctgtgggcggcctggagcctggaaatgcccagcagcccaacgtgcacgccttcacccccctgcagctgcaggagctggagcgcatcttccagcgggagcagttccccagcgagttcctgcggcggcggctggcccgctccatgaatgtgacagagctggccgtgcagatctggtttgaaaatagaagagccaagtggaggaggcaccagagggccctgatggccaggaacatgctgcccttcatggctgtgggccagcctgtgatggtgacagctgctgaggccatcacagcccccctcttcatcagcggcatgagagatgactacttctgggaccacagccacagcagcagcctgtgcttccccatgccacccttccccccacccagcctgcccctgcccctgatgctgctgccccccatgcctcctgctggccaggccgagtttggccccttcccctttgtgattgtgcccagcttcaccttccccaacgtgtag

SEQ ID NO: 16724 - DNA, 867 bp, Artificial Sequence
  Description of Artificial Sequence: Synthetic coding sequence
atggagcccccagaccagtgcagccagtacatgaccagcctgctgagccctgctgtggatgatgagaaggagctgcaggacatgaatgccatggtgctgagcctgacagaggaggtgaaggaggaggaggaggatgcccagcctgagcctgagcagggcacagctgctggggagaagctgaagtctgctggggcccagggcggggaggagaaggatggcggcggggaggagaaggatggcggcggggccggcgtgcccggccacctgtgggagggcaacctggagggcaccagcggcagtgatggaaatgtggaggacagcgaccagagcgagaaggagcccggccagcagtacagccggccccagggcgctgtgggcggcctggagcctggaaatgcccagcagcccaacgtgcacgccttcacccccctgcagctgcaggagctggagtgcatcttccagcgggagcagttccccagcgagttcctgcggcggcggctggcccgctccatgaatgtgacagagctggccgtgcagatctggtttgaaaatagaagagccaagtggaggaggcaccagagggccctgatggccaggaacatgctgcccttcatggctgtgggccagcctgtgatggtgacagctgctgaggccatcacagcccccctcttcatcagcggcatgagagatgactacttctgggaccacagccacagcagcagcctgtgcttccccatgccacccttccccccacccagcctgcccctgcccctgatgctgctgccccccatgcctcctgctggccaggccgagtttggccccttcccctttgtgattgtgcccagcttcaccttccccaacgtgtag

SEQ ID NO: 16725 - DNA, 375 bp, Artificial Sequence
  Description of Artificial Sequence: Synthetic coding sequence
atgcctgccccagctgccacctatgaaagagtggtgtacaagaaccccagcgagtaccactacatgaaggtgtgcctggagttccaggactgtggggtgggcctgaatgctgcccagttcaagcagctgctgatctctgctgtgaaggacctgtttggagaggtggatgctgccctgcccctggacatcctgacctatgaggagaagaccctgagcgccatcctgcgcatctgcagcagcggcctggtgaagctgtggagcagcctgaccctgctgggcagctacaagggcaagaagtgtgccttccgggtcatccaggtgagccccttcctgctggccctgagcggcaacagccgggagctggtgctggactag

SEQ ID NO: 16726 - DNA, 375 bp, Artificial Sequence; identical to SEQ ID NO: 16725
  Description of Artificial Sequence: Synthetic coding sequence

SEQ ID NO: 16727 - DNA, 375 bp, Artificial Sequence; identical to SEQ ID NO: 16725
  Description of Artificial Sequence: Synthetic coding sequence

SEQ ID NO: 16728 - DNA, 600 bp, Artificial Sequence
  Description of Artificial Sequence: Synthetic coding sequence
atggagaacttcaggaaggtgcgctctgaggaggccccagctggctgtggggctgagggcggcggccctggcagcggcccctttgctgacctggcccctggagctgtgcacatgagggtgaaggagggcagcaagatccggaacctgatggcctttgccacagcctccatggcccagcctgccacccgggccatcgtgttcagcggctgcggccgggccaccaccaagacagtgacctgtgccgagatcctgaagaggcggctggccggcctgcaccaggtgacccggctgcgctacagatctgtgcgggaggtgtggcagagcctgcccccaggccccacccagggccagaccccaggagagcctgctgccagcctgtctgtgctgaagaatgtgcccggcctggccatcctgctgagcaaggatgccctggacccccggcagcccggctaccagccccccaacccccaccctggccccagcagccccccagctgccccagccagcaagaggagcctgggggagcctgctgctggggagggcagcgccaagaggagccagcctgagcccggggtggctgatgaggaccagacagcctag

SEQ ID NO: 16729 - DNA, 600 bp, Artificial Sequence; identical to SEQ ID NO: 16728
  Description of Artificial Sequence: Synthetic coding sequence

SEQ ID NO: 16730 - DNA, 1386 bp, Artificial Sequence
  Description of Artificial Sequence: Synthetic coding sequence
atggtgtcccgggtgcagctgcccccagagatccagctggcccagaggctggccggaaatgagcaggtgacccgggacagagctgtgaggaagctgaggaagtacatcgtggcccggacccagagagctgctgggggcttcacccatgatgagctgctgaaggtgtggaagggcctcttctactgcatgtggatgcaggacaagcccctgctgcaggaggagctgggccgcaccatcagccagctggtgcacgccttccagaccacagaggcccagcacctgttcctgcaggccttctggcagaccatgaaccgggagtggacaggcatcgaccggctgcggctggacaagttctacatgctgatgaggatggtgctgaatgaaagcctgaaggtgctgaagatgcagggctgggaggagcggcagatcgaggagctgctggagctgctgatgacagagatcctgcaccccagcagccaggccccaaatggagtgaagagccacttcatcgagatcttcctggaggagctgaccaaggtgggcgctgaggagctgacagctgaccagaacctgaagttcatcgaccccttctgcagaattgctgcccggaccaaggacagcctggtgctgaacaacatcacccggggcatctttgagaccatcgtggagcaggcccccctggccatcgaggacctgctgaatgagctggacacccaggatgaggaggtggccagtgacagtgatgagagcagcgagggcggggagagaggagatgccctgagccagaagaggtctgagaagcccccagctggcagcatctgcagagctgagcctgaggccggggaggagcaggccggagatgaccgggacagcggcggccctgtgctgcagtttgattatgaggccgtggccaacagactctttgagatggccagccggcagagcacccccagccagaacaggaagaggctgtacaaggtgatcaggaagctgctgccctggttcagcggcatcttcccagaagatgagatccctgagaaggcctgccggcggctgctggagggccggcggcagaagaagaccaagaagcagaagaggctgctgcggctgcagcaggagcggggcaagggggagaaggagccccccagccctggcatggagaggaagaggagcagaagaagaggagtgggcgctgaccctgaggcccgggcagaggccggggagcagcccggcacagctgagcgggccctgctgcgggaccagccccggggccggggccagagaggagcccggcagaggaggaggaccccccggcccctgaccagcgcccgggccaaggccgccaacgtgcaggagcctgagaagaagaagaagagaagagaatag

SEQ ID NO: 16731 - DNA, 1386 bp, Artificial Sequence
  Description of Artificial Sequence: Synthetic coding sequence
atggtgtcccgggtgcagctgcccccagagatccagctggcccagaggctggccggaaatgagcaggtgacccgggacagagctgtgaggaagctgaggaagtacatcgtggcccggacccagagagctgctgggggcttcacccatgatgagctgctgaaggtgtggaagggcctcttctactgcatgtggatgcaggacaagcccctgctgcaggaggagctgggccgcaccatcagccagctggtgcacgccttccagaccacagaggcccagcacctgttcctgcaggccttctggcagaccatgaaccgggagtggacaggcatcgaccggctgcggctggacaagttctacatgctgatgaggatggtgctgaatgaaagcctgaaggtgctgaagatgcagggctgggaggagcggcagatcgaggagctgctggagctgctgatgacagagatcctgcaccccagcagccaggccccaaatggagtgaagagccacttcatcgagatcttcctggaggagctgaccaaggtgggcgctgaggagctgacagctgaccagaacctgaagttcatcgaccccttctgcagaattgctgcccggaccaaggacagcctggtgctgaacaacatcacccggggcatctttgagaccatcgtggagcaggcccccctggccatcgaggacctgctgaatgagctggacacccaggatgaggaggtggccagtgacagtgatgagagcagcgagggcggggagagaggagatgccctgagccagaagaggtctgagaagcccccagctggcagcatctgcagagctgagcctgaggccggggaggagcaggccggagatgaccgggacagcggcggccctgtgctgcagtttgattatgaggccgtggccaacagactctttgagatggccagccggcagagcacccccagccagaacaggaagaggctgtacaaggtgatcaggaagctgcaggacctggccggcggcatcttcccagaagatgagatccctgagaaggcctgccggcggctgctggagggccggcggcagaagaagaccaagaagcagaagaggctgctgcggctgcagcaggagcggggcaagggggagaaggagccccccagccctggcatggagaggaagaggagcagaagaagaggagtgggcgctgaccctgaggcccgggcagaggccggggagcagcccggcacagctgagcgggccctgctgcgggaccagccccggggccggggccagagaggagcccggcagaggaggaggaccccccggcccctgaccagcgcccgggccaaggccgccaacgtgcaggagcctgagaagaagaagaagagaagagaatag

SEQ ID NO: 16732 - DNA, 1371 bp, Artificial Sequence
  Description of Artificial Sequence: Synthetic coding sequence
atgtttgaggagcctgagtgggccgaggccgcccctgtggccgccggcctgggccctgtgatcagccggcccccacctgctgccagcagccagaacaagggcagcaagaggcggcagctgctggccaccctgcgggccctggaggccgccagcctgagccagcacccccccagcctgtgcatcagtgacagcgaggaggaggaggaggagaggaagaagaagtgccccaagaaggccagctttgccagcgccagcgctgaggtgggcaagaagggcaagaagaagtgccagaagcagggccccccctgcagcgacagcgaggaggaggtggagaggaagaagaagtgccacaagcaggccctggtgggcagtgacagcgcagaagatgagaagaggaagaggaagtgccagaagcacgcccccatcaacagcgcccagcacctggacaacgtggaccagacaggccccaaggcctggaagggcagcaccaccaatgacccccccaagcagagccctggcagcaccagccccaagccaccccacaccctgagcaggaagcagtggaggaaccggcagaagaacaagaggcgctgcaagaacaagttccagcccccccaggtgcctgaccaggccccagctgaggcccccacagagaagacagaggtgtcccctgtgcccaggacagacagccatgaggcccgggccggggccctgcgggccaggatggcccagaggctggatggagcccgcttccgctacctgaatgagcagctgtacagcggccccagcagcgctgcccagaggctcttccaggaggaccctgaggccttcctgctgtaccaccggggcttccagagccaggtgaagaagtggcccctgcagcctgtggacagaattgcccgggacctgcggcagaggcctgccagcctggtggtggccgactttggctgtggggactgccgcctggccagcagcatcagaaatcctgtgcactgctttgacctggccagcctggacccccgggtgacagtgtgtgacatggcccaggtgcccctggaggatgagagcgtggatgtggccgtgttctgcctgagcctgatgggcaccaacatccgggacttcctggaggaggccaacagagtgctgaagccaggcggcctgctgaaggtggccgaggtgagcagcagatttgaagatgtgaggaccttcctgcgggctgtgaccaagctgggcttcaagatcgtgtccaaggacctgaccaacagccacttcttcctgtttgacttccagaagacaggcccccccctggtgggccccaaggcccagctgagcggcctgcagctgcagccctgcctgtacaagagaagatag

SEQ ID NO: 16733 - DNA, 1017 bp, Artificial Sequence
  Description of Artificial Sequence: Synthetic coding sequence
atggagctgtggggccgcatgctgtgggccctgctgagcggccctggaagaagaggcagcacccggggctgggccttcagctcctggcagccccagccccccctggccggcctgagcagcgccatcgagctggtgagccactggacaggagtgtttgagaagaggggcatccctgaggcccgggagagcagcgagtacatcgtggcccacgtgctgggcgccaagaccttccagagcctgcggcctgccctgtggacccagcccctgaccagccagcagctgcagtgcatccgggagctgagcagccggcggctgcagaggatgcctgtgcagtacatcctgggggagtgggacttccagggcctgagcctgaggatggtgccccctgtgttcatccccaggcctgagacagaggagctggtggagtgggtgctggaggaggtggcccagaggagccatgctgtgggcagccctggcagccccctcatcctggaggtgggctgcggcagcggggccatcagcctgagcctgctgagccagctgccccagagccgggtgattgctgtggacaagcgggaggccgccatcagcctgacccatgaaaatgcccagaggctgcggctgcaggaccgcatctggatcatccacctggacatgaccagcgagaggtcctggacccacctgccctggggccccatggacctgattgtgagcaaccccccctacgtgttccaccaggacatggagcagctggcccctgagatccgctcctatgaagatcctgctgccctggatggaggagaggagggcatggacatcatcacccacatcctggccctggccccccggctgctgaaggacagcggcagcatcttcctggaggtggaccccaggcaccctgagctggtgtcctcctggctgcagagcaggccagacctgtacctgaacctggtggccgtgagaagagacttctgtggccggccccgcttcctgcacatccgccgcagcggcccctag

SEQ ID NO: 16734 - DNA, 1050 bp, Artificial Sequence
  Description of Artificial Sequence: Synthetic coding sequence
atggccaaggccggggacaagagcagcagcagcggcaagaagagcctgaagaggaaggctgctgctgaggagctgcaggaggccgccggggctggagatggagccacagaaaatggagtgcagccccccaaggccgccgccttccccccaggcttcagcatcagcgagatcaagaacaagcagaggaggcacctgatgttcacccgctggaagcagcagcagaggaaggagaagctggccgccaagaagaagctgaagaaggagcgggaggccctgggggacaaggccccacccaagcctgtgcccaagaccatcgacaaccagagggtgtatgatgagaccaccgtggaccccaatgatgaggaggtggcctatgatgaggccacagatgaatttgccagctacttcaacaagcagaccagccccaagatcctgatcaccaccagtgaccggccccacggccgcacagtgcggctgtgtgagcagctgagcaccgtcatccccaacagccacgtgtactacagaagaggcctggccctgaagaagatcatcccccagtgcatcgcccgggacttcacagacctgattgtcatcaatgaagacaggaagacccccaacggcctcatcctgagccacctgcccaacggccccacagcccacttcaagatgagctctgtgcggctgaggaaggagatcaagaggcggggcaaggaccccacagagcacatccctgagatcatcctgaacaacttcaccacccggctgggccacagcattggaaggatgtttgccagcctcttcccccacaacccccagttcatcggccggcaggtggccaccttccacaaccagagggactacatcttcttccgcttccaccgctacatcttccgctctgagaagaaggtgggcatccaggagctgggcccccgcttcaccctgaagctgcggagcctgcagaagggcacctttgacagcaagtacggggagtatgagtgggtgcacaagccccgggagatggacaccagcaggaggaagttccacctgtag

SEQ ID NO: 16735 - DNA, 390 bp, Artificial Sequence
  Description of Artificial Sequence: Synthetic coding sequence
atggccaaggccggggacaagagcagcagcagcggcaagaagagcctgaagaggaaggctgctgctgaggagctgcaggaggccgccggggctggagatggagccacagaaaatggagtgcagccccccaaggccgccgccttccccccaggcttcagcatcagcgagatcaagaacaagcagaggaggcacctgatgttcacccgctggaagcagcagcagaggaaggagaagctggccgccaagaagaagctgaagaaggagcgggaggccctgggggacaaggccccacccaagcctgtgcccaagaccatcgacaaccagagggtgtatgatgagaccaccgtggaccccaatgatgaggaggtgatgctggaggtgctgaactag

SEQ ID NO: 16736 - DNA, 627 bp, Artificial Sequence
  Description of Artificial Sequence: Synthetic coding sequence
atgtgctttgtgctgaaggccatcaactttgtgctgcagtatgccctgaagaagccctacggcgtgctgtacaagaagaagaacatcacccggccctttgaggaccagaccagcctggagttcttcagcaagaagagtgactgcagcctcttcatgtttggcagccacaacaagaagaggcccaacaacctggtgattggccgcatgtatgactaccacgtgctggacatgattgagctgggcattgaaaattttgtgtccctgaaggacatcaagaacagcaaatgtcctgagggcaccaagcccatgctgatctttgctggagatgactttgatgtgacagaggactaccgccgcctgaagagcctgctgattgacttcttccggggccccaccgtgagcaacatccggctggccggcctggagtatgtgctgcacttcaccgccctgaatggcaagatctacttccgcagctacaagctgctgctgaagaagagcggctgcaggaccccaagaattgagctggaggagatgggccccagcctggacctggtgctgcggaggacccacctggccagtgatgacctgtacaagctgtccatgaagatgcccaaggccctgaagtag

SEQ ID NO: 16737 - DNA, 645 bp, Artificial Sequence
  Description of Artificial Sequence: Synthetic coding sequence
atgctgatcaagggcggcaatgccaatgccaccgtgaccaaggtgctgaaggatgtgtatgccctgaagaagccctacggcgtgctgtacaagaagaagaacatcacccggccctttgaggaccagaccagcctggagttcttcagcaagaagagtgactgcagcctcttcatgtttggcagccacaacaagaagaggcccaacaacctggtgattggccgcatgtatgactaccacgtgctggacatgattgagctgggcattgaaaattttgtgtccctgaaggacatcaagaacagcaaatgtcctgagggcaccaagcccatgctgatctttgctggagatgactttgatgtgacagaggactaccgccgcctgaagagcctgctgattgacttcttccggggccccaccgtgagcaacatccggctggccggcctggagtatgtgctgcacttcaccgccctgaatggcaagatctacttccgcagctacaagctgctgctgaagaagagcggctgcaggaccccaagaattgagctggaggagatgggccccagcctggacctggtgctgcggaggacccacctggccagtgatgacctgtacaagctgtccatgaagatgcccaaggccctgaagtag

SEQ ID NO: 16738 - DNA, 921 bp, Artificial Sequence
  Description of Artificial Sequence: Synthetic coding sequence
atggacaccctggacagagtggtgaagcccaagaccaagagggccaagcgcttcctggagaagcgggagcccaagctgaatgaaaacatcaagaatgccatgctgatcaagggcggcaatgccaatgccaccgtgaccaaggtgctgaaggatgtgtatgccctgaagaagccctatggagtgctgtacaagaagaagaacatcacccggccctttgaggaccagaccagcctggagttcttcagcaagaagagtgactgcagcctcttcatgtttggcagccacaacaagaagaggcccaacaacctggtgattggaaggatgtatgactaccacgtgctggacatgattgagctgggcatcgagaactttgtgtccctgaaggacatcaagaacagcaagtgcccagagggcaccaagcccatgctgatctttgctggagatgactttgatgtgacagaggactacagaaggctgaagagcctgctgattgacttcttccggggccccaccgtgagcaacatccggctggccggcctggagtatgtgctgcacttcaccgccctgaatggcaagatctacttccgcagctacaagctgctgctgaagaagagcggctgcaggaccccccgcatcgagctggaggagatgggccccagcctggacctggtgctgcggaggacccacctggccagtgatgacctgtacaagctgtccatgaagatgcccaaggccctgaagcccaagaagaagaagaacatcagccatgacaccttcggcaccacctacggccgcatccacatgcagaagcaggacctgagcaagctgcagaccaggaagatgaagggcctgaagaagaggcctgctgagcgcatcacagaggaccacgagaagaagagcaagaggatcaagaagaactag

SEQ ID NO: 16739 - DNA, 546 bp, Artificial Sequence
  Description of Artificial Sequence: Synthetic coding sequence
atgagcggcatcggcaacaagagagctgctggggagcccggcacctccatgcctcctgagaagaaggctgctgtggaggacagcggcaccaccgtggagaccatcaagctgggcggcgtgagcagcacagaggagctggacatccgcaccctgcagaccaagaacaggaagctggccgagatgctggaccagaggcaggccattgaagatgagctgcgggagcacatcgagaagctggagcggcggcaggccacagatgatgccagcctgctgattgtgaaccgctactggagccagtttgatgagaacatccgcatcatcctgaagagatatgacctggagcagggcctgggggacctgctgacagagaggaaggccctggtggtgcctgagcctgagccagacagcgacagcaaccaggagaggaaggatgaccgggagcggggggagggccaggagcccgccttctccttcctggccaccctggccagcagcagcagcgaggagatggagagccagctgcaggagcgggtggagagcagctag

SEQ ID NO: 16740 - DNA, 2928 bp, Artificial Sequence
  Description of Artificial Sequence: Synthetic coding sequence
atgagcggcatcggcaacaagagagctgctggggagcccggcacctccatgcctcctgagaagaaggctgctgtggaggacagcggcaccaccgtggagaccatcaagctgggcggcgtgagcagcacagaggagctggacatccgcaccctgcagaccaagaacaggaagctggccgagatgctggaccagaggcaggccattgaagatgagctgcgggagcacatcgagaagctggagcggcggcaggccacagatgatgccagcctgctgattgtgaaccgctactggagccagtttgatgagaacatccgcatcatcctgaagagatatgacctggagcagggcctgggggacctgctgacagagaggaaggccctggtggtgcctgagcctgagccagacagcgacagcaaccaggagaggaaggatgaccgggagcggggggagggccaggagcccgccttctccttcctggccaccctggccagcagcagcagcgaggagatggagagccagctgcaggagcgggtggagagcagccggcgggctgtgtcccagatcgtgacagtgtatgacaagctgcaggagaaggtggagctgctgagcaggaagctgaacagcggggacaacctgattgtggaggaggccgtgcaggagctgaacagcttcctggcccaggagaacatgaggctgcaggagctgacagacctgctgcaggagaagcacaggaccatgagccaggagttcagcaagctgcagagcaaggtggagacagctgagagccgggtgtctgtgctggagagcatgattgatgacctgcagtgggacatcgacaagatcaggaagcgggagcagaggctgaacagacacctggccgaggtgctggagcgggtgaacagcaagggctacaaggtgtatggagctggcagcagcctgtatggaggcaccatcaccatcaatgccaggaagtttgaggagatgaatgctgagctggaggagaacaaggagctggcccagaaccggctgtgtgagctggagaagctgcggcaggactttgaggaggtgaccacccagaatgagaagctgaaggtggagctgcggtctgctgtggagcaggtggtgaaggagaccccagagtaccgctgcatgcagagccagttctctgtgctgtacaatgaaagcctgcagctgaaggcccacctggatgaggcccggaccctgctgcacggcacccggggcacccaccagcaccaggtggagctgattgaaagagatgaggtgtccctgcacaagaagctgaggacagaggtgatccagctggaggacaccctggcccaggtgaggaaggagtatgagatgctgagaattgaatttgagcagaccctggccgccaatgagcaggccggccccatcaaccgggagatgaggcacctgatcagcagcctgcagaaccacaaccaccagctgaagggggaggtgctgcgctacaagaggaagctgcgggaggcccagagcgacctgaacaagacccggctgcggagcggcagcgccctgctgcagagccagagcagcacagaggaccccaaggatgagcctgctgagctgaagccagacagcgaggacctgagcagccagagcagcgccagcaaggccagccaggaggatgccaatgagatcaagagcaagagagatgaggaggagcgggagcgggagcggcgggagaaggagcgggagcgggagcgggagcgggagaaggagaaggagcgggagcgggagaagcagaagctgaaggagagcgagaaggagcgggacagcgccaaggacaaggagaagggcaagcatgatgatggcaggaagaaggaggccgagatcatcaagcagctgaagattgagctgaagaaggcccaggagagccagaaggagatgaagctgctgctggacatgtaccgcagcgcccccaaggagcagagggacaaggtgcagctgatggctgctgagaagaagagcaaggccgagctggaggacctgcggcagaggctgaaggacctggaggacaaggagaagaaggagaacaagaagatggctgatgaagatgccctgaggaagatccgggctgtggaggagcagatcgagtacctgcagaagaagctggccatggccaagcaggaggaggaggccctgctgtctgagatggatgtgacaggccaggcctttgaggacatgcaggagcagaacatccggctgatgcagcagctgcgggagaaggatgatgccaacttcaagctgatgtctgagcgcatcaagagcaaccagatccacaagctgctgaaggaggagaaggaggagctggccgaccaggtgctgaccctgaagacccaggtggatgcccagctgcaggtggtgaggaagctggaggagaaggagcacctgctgcagagcaacatcggcaccggggagaaggagctgggcctgcggacccaggccctggagatgaacaagaggaaggccatggaggccgcccagctggctgatgacctgaaggcccagctggagctggcccagaagaagctgcatgacttccaggatgaaattgtggagaacagcgtgaccaaggagaaggacatgttcaacttcaagagggcccaggaggacatcagccggctgcggaggaagctggagaccaccaagaagccagacaacgtgcccaagtgtgatgagatcctgatggaggagatcaaggactacaaggcccggctgacctgcccctgctgcaacatgaggaagaaggatgctgtgctgaccaagtgcttccacgtgttctgctttgaatgtgtgaagaccaggtatgacacccggcagaggaagtgccccaagtgcaatgctgccttcggggccaatgacttccaccgcatctacatcggctag

SEQ ID NO: 16741 - DNA, 438 bp, Artificial Sequence
  Description of Artificial Sequence: Synthetic coding sequence
atgagcggcatcggcaacaagagagctgctggggagcccggcacctccatgcctcctgagaagaaggctgctgtggaggacagcggcaccaccgtggagaccatcaagctgggcggcgtgagcagcacagaggagctggacatccgcaccctgcagaccaagaacaggaagctggccgagatgctggaccagaggcaggccattgaagatgagctgcgggagcacatcgagaagctggagcggcggcaggccacagatgatgccagcctgctgattgtgaaccgctactggagccagtttgatgagaacatccgcatcatcctgaagagatatgacctggagcagggcctgggggacctgctgacagagaggaaggccctggtggtgcctgagcctgagccagacagcgacagcaaccaggagaggaaggatgactag

SEQ ID NO: 16742 - DNA, 300 bp, Artificial Sequence
  Description of Artificial Sequence: Synthetic coding sequence
atgagcggcatcggcaacaagagagctgctggggagcccggcacctccatgcctcctgagaagaaggctgctgtggaggacagcggcaccaccgtggagaccatcaagctgggcggcgtgagcagcacagaggagctggacatccgcaccctgcagaccaagaacaggaagctggccgagatgctggaccagaggcaggccattgaagatgagctgcgggagcacatcgagaagctggagcggcggcaggccacagatgatgccagcctgctgattgtgaaccgctactggagccagtag

SEQ ID NO: 16743 - DNA, 1878 bp, Artificial Sequence
  Description of Artificial Sequence: Synthetic coding sequence
atgaatgtgaccagcatcgccctgcgggcagagacctggctgctggccgcctggcacgtgaaggtgccccccatgtggctggaggcctgcatcaactggatccaggaggagaacaacaacgtgaacctgagccaggcccagatgaacaagcaggtgtttgagcagtggctgctgacagacctgcgggacctggagcaccccctgctgcctgatggcatcctggagatccccaagggggagctgaatggcttctacgccctgcagatcaacagcctggtggatgtgtcccagcctgcctacagccagatccagaagctgcggggcaagaacaccaccaatgacctggtgacagctgaggcccaggtgacccccaagccctgggaggccaagcccagcaggatgctgatgctgcagctgacagatggcatcgtgcagatccagggcatggagtaccagcccatccccatcctgcacagcgacctgcccccaggcaccaagatcctgatctacggcaacatctccttccggctgggcgtgctgctgctgaagccagaaaatgtgaaggtgctgggcggggaggtggatgccctgctggaggagtatgcccaggagaaggtgctggcccggctgattggagagccagacctggtggtgtctgtcatccccaacaacagcaatgaaaacatcccccgggtgacagatgtgctggaccctgccctgggccccagtgatgaggagctgctggccagcctggatgaaaatgatgagctgacagccaacaatgacaccagcagcgagcgctgcttcaccaccggcagcagcagcaacaccatccccacccggcagagcagctttgagcctgagtttgtgatcagcccccggcccaaggaggagcccagcaacctgagcatccacgtgatggatggagagctggatgacttcagcctggaggaggccctgctgctggaggagaccgtgcagaaggagcagatggagaccaaggagctgcagcccctgaccttcaacagaaatgctgacaggagcattgagcgcttcagccacaaccccaacaccaccaacaacttcagcctgacctgcaagaatggaaacaacaactggagcgagaagaatgtgtctgagcagatgaccaatgaagacaagagctttggctgccccagcgtgcgggaccagaacagaagcatcttctctgtgcactgcaatgtgcccctggcccatgacttcaccaacaaggagaagaacctggagacagacaacaagatcaagcagaccagcagcagtgacagccacagcctgaacaacaagatcctgaaccgggaggtggtgaactacgtgcagaagaggaacagccagatcagcaatgaaaatgactgcaacctgcagagctgcagcctgcggagcagtgaaaattccatcaacctgagcatcgccatggacctgtacagccccccatttgtgtacctgtctgtgctgatggccagcaagcccaaggaggtgaccaccgtgaaggtgaaggccttcatcgtgaccctgaccggcaacctgagcagcagcggcggcatctggagcatcacagccaaggtgtctgatggaacagcctacctggatgtggactttgtggatgagatcctgaccagcctcatcggcttctctgtgcctgagatgaagcagagcaagaaggaccccctgcagtaccagaagttcctggagggcctgcagaagtgccagagggacctgattgacctgtgctgcctgatgaccatctccttcaaccccagcctgagcaaggccatggtgctggccctgcaggatgtgaacatggagcacctggagaacctgaagaagaggctgaacaagtag

SEQ ID NO: 16744 - DNA, 2196 bp, Artificial Sequence
  Description of Artificial Sequence: Synthetic coding sequence
atgcccagcatcccccccatccctgtgcccccacctgtgcccaccctgccccctgtgccccctgtgccccccatcccccctgtgcccagcgtgccccccatgacccccctgccccccatgagcggcatgccacccctgaaccccccacctgtggcccccctgcctgctggcatgaatggaagtggggcccccatgaacctgaacaacaacctgaaccccatgttcctgggccccctgaaccctgtgaaccccatccagatgaacagccagagctctgtgaagcccctgcccatcaacccagatgacctgtatgtgtctgtgcacggcatgcccttcagcgccatggagaatgatgtgcgggacttcttccacggcctgcgggtggatgctgtgcacctgctgaaggaccacgtgggcaggaacaatggaaatggcctggtgaagttcctgagcccccaggacacctttgaggccctgaagaggaacaggatgctgatgatccagcgctacgtggaggtgtccccagccacagagcggcagtgggtggccgccggcggccacatcaccttcaagcagaacatgggccccagcggccagacccaccccccaccccagaccctgcccaggagcaagagccccagcggccagaagaggagccgcagccgcagcccccatgaagctggcttctgtgtgtacctgaagggcctgccctttgaagctgagaacaagcacgtgattgacttcttcaagaagctggacatcgtggaggacagcatctacatcgcctacggccccaacgggaaggccaccggggagggctttgtggagttcagaaatgaagctgactacaaggccgccctgtgccgccacaagcagtacatgggcaaccgcttcatccaggtgcaccccatcaccaagaagggcatgctggagaagattgacatgatcaggaagaggctgcagaacttctcctatgaccagcgggagatgatcctgaacccagaaggagatgtgaacagcgccaaggtgtgtgcccacatcaccaacatccccttcagcatcaccaagatggatgtgctgcagttcctggagggcatccctgtggatgaaaatgctgtgcacgtgctggtggacaacaacggccagggcctgggccaggccctggtgcagttcaagaatgaagatgatgccaggaagtctgagcggctgcacaggaagaagctgaatggccgggaggcctttgtgcacgtggtgaccctggaggacatgagagaaattgagaagaaccccccagcccagggcaagaagggcctgaagatgcctgtgcccggcaacccagctgtgcccggcatgcccaatgccggcctgcccggggtgggcctgcccagcgctggcctgcctggagctggcctgcccagcacaggcctgcccggcagcgccatcaccagcgctggcctgcctggagctggcatgcccagcgctggcatccccagcgctggaggagaggagcacgccttcctgactgtgggcagcaaggaggccaacaacggcccccccttcaacttccctggcaactttggaggcagcaatgccttcggcccccccatccccccacctggcctgggcggcggggcctttggagatgcccggcccggcatgcccagcgtgggcaacagcggcctgcccggcctgggcctggatgtgcccggctttggaggcggccccaacaacctgagcggccccagcggctttggaggcggcccccagaactttggaaatggacctggcagcctgggcggccccccaggcttcggcagcggccccccaggcctgggcagcgcccctggccacctgggcggccccccagccttcggccctggccctggccctggccctggccctggccccatccacatcggcggccccccaggctttgccagcagcagcggcaagccaggccccaccgtcatcaaggtgcagaacatgcccttcaccgtgtccattgatgagatcctggacttcttctacggctaccaggtgattcctggctctgtgtgcctgaagtacaatgagaagggcatgcccaccggggaggccatggtggcctttgagagcagagatgaggccacagctgctgtgattgacctgaatgaccggcccatcggcagcaggaaggtgaagctggtgctgggctag

SEQ ID NO: 16745 - DNA, 2799 bp, Artificial Sequence
  Description of Artificial Sequence: Synthetic coding sequence
atggctgtggtgatccggctgcagggcctgcccatcgtggccggcaccatggacatccgccacttcttcagcggcctgaccatcccagatggcggcgtgcacatcgtgggcggggagctgggggaggccttcatcgtgtttgccacagatgaagatgcccggctgggcatgatgaggactggaggcaccatcaagggcagcaaggtgaccctgctgctgagcagcaagacagagatgcagaacatgattgagctgagcagaagaagatttgaaacagccaacctggacatccccccagccaatgccagccgcagcggccccccacccagcagcggcatgagcagccgggtgaacctgcccaccaccgtgagcaacttcaacaaccccagccccagcgtggtgacagccaccacctctgtgcatgagagcaacaagaacatccagaccttcagcacagcctctgtgggcacagccccacccaacatgggcgccagctttggcagccccaccttcagcagcacagtgcccagcacagccagccccatgaacacagtgcccccaccacccatcccccccatcccagccatgcccagcctgccccccatgcccagcatcccccccatccctgtgcccccacctgtgcccaccctgccccctgtgccccctgtgccccccatcccccctgtgcccagcgtgccccccatgacccccctgccccccatgagcggcatgccacccctgaaccccccacctgtggcccccctgcctgctggcatgaatggcagcggggcccccatgaacctgaacaacaacctgaaccccatgttcctgggccccctgaaccctgtgaaccccatccagatgaacagccagagctctgtgaagcccctgcccatcaacccagatgacctgtatgtgtctgtgcacggcatgcccttcagcgccatggagaatgatgtgcgggacttcttccacggcctgcgggtggatgctgtgcacctgctgaaggaccacgtgggcagaaataatggaaatggcctggtgaagttcctgagcccccaggacacctttgaggccctgaagaggaacaggatgctgatgatccagagatatgtggaggtgtccccagccacagagcggcagtgggtggccgccggcggccacatcaccttcaagcagaacatgggccccagcggccagacccaccccccaccccagaccctgcccaggagcaagagccccagcggccagaagaggagccgcagccgcagcccccatgaggccggcttctgtgtgtacctgaagggcctgccctttgaagctgagaacaagcacgtgattgacttcttcaagaagctggacatcgtggaggacagcatctacatcgcctacggccccaacgggaaggccactggagagggctttgtggagttcagaaatgaggccgactacaaggccgccctgtgccgccacaagcagtacatgggcaaccgcttcatccaggtgcaccccatcaccaagaagggcatgctggagaagattgacatgatcaggaagaggctgcagaacttctcctatgaccagcgggagatgatcctgaacccagaaggagatgtgaacagcgccaaggtgtgtgcccacatcaccaacatccccttcagcatcaccaagatggatgtgctgcagttcctggagggcatccctgtggatgaaaatgctgtgcacgtgctggtggacaacaacggccagggcctgggccaggccctggtgcagttcaagaatgaagatgatgccaggaagtctgagcggctgcacaggaagaagctgaatggccgggaggcctttgtgcacgtggtgaccctggaggacatgagagaaattgagaagaaccccccagcccagggcaagaagggcctgaagatgcctgtgcccggcaacccagctgtgcccggcatgcccaatgccggcctgcccggggtgggcctgcccagcgctggcctgcccggggccggcctgcccagcacaggcctgcccggcagcgccatcaccagcgctggcctgcccggggccggcatgcccagcgctggcatccccagcgctggaggagaggagcacgccttcctgactgtgggcagcaaggaggccaacaatggaccacccttcaacttccctggcaactttggaggcagcaatgcctttggaccacccatccccccacctggcctgggcggcggggcctttggagatgcccggcccggcatgcccagcgtgggcaacagcggcctgcccggcctgggcctggatgtgcccggctttggaggcggccccaacaacctgagcggccccagcggctttggaggcggcccccagaactttggaaatggacctggcagcctgggcggccccccaggctttggaagtggccccccaggcctgggcagcgcccctggccacctgggcggccccccagcctttggacctggccctggccctggccctggccctggccccatccacatcggcggccccccaggctttgccagcagcagcggcaagccaggccccaccgtcatcaaggtgcagaacatgcccttcaccgtgtccattgatgagatcctggacttcttctacggctaccaggtgattcctggctctgtgtgcctgaagtacaatgagaagggcatgcccactggagaggccatggtggcctttgagagcagagatgaggccacagctgctgtgattgacctgaatgaccggcccatcggcagcaggaaggtgaagctggtgctgggctag

SEQ ID NO: 16746 - DNA, 2799 bp, Artificial Sequence; identical to SEQ ID NO: 16745
  Description of Artificial Sequence: Synthetic coding sequence

SEQ ID NO: 16747 - DNA, 2799 bp, Artificial Sequence; identical to SEQ ID NO: 16745
  Description of Artificial Sequence: Synthetic coding sequence

SEQ ID NO: 16748 - DNA, 876 bp, Artificial Sequence
  Description of Artificial Sequence: Synthetic coding sequence
atggctgtggtgatccggctgcagggcctgcccatcgtggccggcaccatggacatccgccacttcttcagcggcctgaccatcccagatggcggcgtgcacatcgtgggcggggagctgggggaggccttcatcgtgtttgccacagatgaagatgcccggctgggcatgatgaggactggaggcaccatcaagggcagcaaggtgaccctgctgctgagcagcaagacagagatgcagaacatgattgagctgagcagaagaagatttgaaacagccaacctggacatccccccagccaatgccagccgcagcggccccccacccagcagcggcatgagcagccgggtgaacctgcccaccaccgtgagcaacttcaacaaccccagccccagcgtggtgacagccaccacctctgtgcatgagagcaacaagaacatccagaccttcagcacagcctctgtgggcacagccccacccaacatgggcgccagctttggcagccccaccttcagcagcacagtgcccagcacagccagccccatgaacacagtgcccccaccacccatcccccccatcccagccatgcccagcctgccccccatgcccagcatcccccccatccctgtgcccccacctgtgcccaccctgccccctgtgccccctgtgccccccatcccccctgtgcccagcgtgccccccatgacccccctgccccccatgagcggcatgccacccctgaaccccccacctgtggcccccctgcctgctggcatgaatggcagcggggcccccatgaacctgaacaacaacctgaaccccatgttcctgggccccctgaaccctgtgaaccccatccagatgaacagccagtag

SEQ ID NO: 16749 - DNA, 432 bp, Artificial Sequence
  Description of Artificial Sequence: Synthetic coding sequence
atggctgtggtgatccggctgcagggcctgcccatcgtggccggcaccatggacatccgccacttcttcagcggcctgaccatcccagatggcggcgtgcacatcgtgggcggggagctgggggaggccttcatcgtgtttgccacagatgaagatgcccggctgggcatgatgaggactggaggcaccatcaagggcagcaaggtgaccctgctgctgagcagcaagacagagatgcagaacatgattgagctgagcagaagaagatttgaaacagccaacctggacatccccccagccaatgccagccgcagcggccccccacccagcagcggcatgagcagccgggtgaacctgcccaccaccgtgagcaacttcaacaaccccagccccagcgtggtgacagccaccacctctgtgcatgagagctag

SEQ ID NO: 16750 - DNA, 405 bp, Artificial Sequence
  Description of Artificial Sequence: Synthetic coding sequence
atggctgtggtgatccggctgcagggcctgcccatcgtggccggcaccatggacatccgccacttcttcagcggcctgaccatcccagatggcggcgtgcacatcgtgggcggggagctgggggaggccttcatcgtgtttgccacagatgaagatgcccggctgggcatgatgaggactggaggcaccatcaagggcagcaaggtgaccctgctgctgagcagcaagacagagatgcagaacatgattgagctgagcagaagaagatttgaaacagccaacctggacatccccccagccaatgccagccgcagcggccccccacccagcagcggcatgagcagccgggtgaacctgcccaccaccgtgagcaacttcaacaaccccagccccagcgtggtgtag

SEQ ID NO: 16751 - DNA, 1251 bp, Artificial Sequence
  Description of Artificial Sequence: Synthetic coding sequence
atgagcaacaagggcaagaagctgaagaggatcatcctggccatccccccagctgccccagccaccgtggccatgaggcctgtggaggccgcccccagcggccggcaggccaggagaagaggagtgggcgccatcatcaaggccggcatcgagagcgctgtggtggtggagatcggcatcggcattgatggagagatcgtgggcgctgaggtgcaggtgggctctgtggtgcgcagccgctcctgggaccggcggcacggcagcgagagccgcagccgggaccaccggcgggaggacagagtgcactaccgcagcccccccctggccaccggctaccgctatggccacagcaagagcccccacttccgggagaagagccctgtgcgggagcctgtggacaacctgagccctgaggagagagatgccaggacagtgttctgcatgcagctggccgcccgcatccggccccgggacctggaggacttcttctctgctgtgggcaaggtgagagatgtgcgcatcatcagtgacaggaacagcagaagaagcaagggcatcgcctacgtggagttctgtgagatccagagcgtgcccctggccatcggcctgaccggccagaggctgctgggcgtgcccatcatcgtgcaggccagccaggccgagaagaaccggctggccgccatggccaacaacctgcagaagggaaatggaggccccatgaggctgtatgtgggcagcctgcacttcaacatcacagaggacatgctgcggggcatctttgagccctttgggaagattgacaacatcgtgctgatgaaggacagcgacaccggccgcagcaagggctacggcttcatcaccttcagtgacagtgaatgtgcccggcgggccctggagcagctgaatggatttgagctggccggccggcccatgagggtgggccacgtgacagagcggctggatggcggcacagacatcaccttcccagatggagaccaggagctggacctgggcagcgctgggggccgcttccagctgatggccaagctggccgagggcgccggcatccagctgcccagcacagctgctgctgctgctgctgctgctgcccaggccgccgccctgcagctgaatggagctgtgcccctgggcgccctgaacccagctgccctgacagccctgagccctgccctgaacctggccagccagtgcttccagctgagcagcctcttcaccccccagaccatgtag

SEQ ID NO: 16752 - DNA, 1218 bp, Artificial Sequence
  Description of Artificial Sequence: Synthetic coding sequence
atggccagtgatgactttgacatcgtcatcgaggccatgctggaggccccctacaagaaggaggaggatgagcagcagaggaaggaggtgaagaaggactaccccagcaacaccaccagcagcaccagcaacagcggaaatgagaccagcggcagcagcaccatcggggagaccagcaacagaagccgggaccgggaccgctacagaagaagaaacagccgcagccgcagccctggccggcagtgccgccacaggagccgctcctgggacagaagacatggcagcgagagccgcagccgggaccacagaagagaagatagagtgcactaccgcagcccccccctggccactggagagcctgtggacaacctgagccctgaggagagagatgccaggacagtgttctgcatgcagctggccgcccgcatccggccccgggacctggaggacttcttctctgctgtgggcaaggtgagagatgtgcgcatcatcagtgacaggaacagccgccgcagcaaaggaattgcctacgtggagttctgtgagatccagagcgtgcccctggccatcggcctgaccggccagaggctgctgggcgtgcccatcatcgtgcaggccagccaggccgagaagaaccggctggccgccatggccaacaacctgcagaagggaaatggaggccccatgaggctgtatgtgggcagcctgcacttcaacatcacagaggacatgctgcggggcatctttgagccctttgggaagattgacaacatcgtgctgatgaaggacagcgacaccggccgcagcaagggctacggcttcatcaccttcagtgacagtgaatgtgcccggcgggccctggagcagctgaatggatttgagctggccggccggcccatgagggtgggccacgtgacagagcggctggatggcggcacagacatcaccttcccagatggagaccaggagctggacctgggcagcgctgggggccgcttccagctgatggccaagctggccgagggcgccggcatccagctgcccagcacagctgctgctgctgctgctgctgctgcccaggccgccgccctgcagctgaatggagctgtgcccctgggcgccctgaacccagctgccctgacagccctgagccctgccctgaacctggccagccagtgcttccagctgagcagcctcttcaccccccagaccatgtag

SEQ ID NO: 16753 - DNA, 1320 bp, Artificial Sequence
  Description of Artificial Sequence: Synthetic coding sequence
atggccagtgatgactttgacatcgtcatcgaggccatgctggaggccccctacaagaaggaggaggatgagcagcagaggaaggaggtgaagaaggactaccccagcaacaccaccagcagcaccagcaacagcggaaatgagaccagcggcagcagcaccatcggggagaccagcaagaagaagaggagccgcagccacaacaagagccgggacaggaagaggagccgcagccgggaccgggaccgctacagaagaagaaacagccgcagccgcagccctggccggcagtgccgccacaggagccgctcctgggacagaagacatggcagcgagagccgcagccgggaccacagaagagaagatagagtgcactaccgcagcccccccctggccaccggctaccgctatggccacagcaagagcccccacttccgggagaagagccctgtgcgggagcctgtggacaacctgagccctgaggagagagatgccaggacagtgttctgcatgcagctggccgcccgcatccggccccgggacctggaggacttcttctctgctgtgggcaaggtgagagatgtgcgcatcatcagtgacaggaacagccgccgcagcaaaggaattgcctacgtggagttctgtgagatccagagcgtgcccctggccatcggcctgaccggccagaggctgctgggcgtgcccatcatcgtgcaggccagccaggccgagaagaaccggctggccgccatggccaacaacctgcagaagggaaatggaggccccatgaggctgtatgtgggcagcctgcacttcaacatcacagaggacatgctgcggggcatctttgagccctttgggaagattgacaacatcgtgctgatgaaggacagcgacaccggccgcagcaagggctacggcttcatcaccttcagtgacagtgaatgtgcccggcgggccctggagcagctgaatggatttgagctggccggccggcccatgagggtgggccacgtgacagagcggctggatggcggcacagacatcaccttcccagatggagaccaggagctggacctgggcagcgctgggggccgcttccagctgatggccaagctggccgagggcgccggcatccagctgcccagcacagctgctgctgctgctgctgctgctgcccaggccgccgccctgcagctgaatggagctgtgcccctgggcgccctgaacccagctgccctgacagccctgagccctgccctgaacctggccagccagtgcttccagctgagcagcctcttcaccccccagaccatgtag

SEQ ID NO: 16754 - DNA, 1272 bp, Artificial Sequence
  Description of Artificial Sequence: Synthetic coding sequence
atggccagtgatgactttgacatcgtcatcgaggccatgctggaggccccctacaagaaggaggaggatgagcagcagaggaaggaggtgaagaaggactaccccagcaacaccaccagcagcaccagcaacagcggaaatgagaccagcggcagcagcaccatcggggagaccagcaacagaagccgggaccgggaccgctacagaagaagaaacagccgcagccgcagccctggccggcagtgccgccacaggagccgctcctgggacagaagacatggcagcgagagccgcagccgggaccacagaagagaagatagagtgcactaccgcagcccccccctggccaccggctaccgctatggccacagcaagagcccccacttccgggagaagagccctgtgcgggagcctgtggacaacctgagccctgaggagagagatgccaggacagtgttctgcatgcagctggccgcccgcatccggccccgggacctggaggacttcttctctgctgtgggcaaggtgagagatgtgcgcatcatcagtgacaggaacagccgccgcagcaaaggaattgcctacgtggagttctgtgagatccagagcgtgcccctggccatcggcctgaccggccagaggctgctgggcgtgcccatcatcgtgcaggccagccaggccgagaagaaccggctggccgccatggccaacaacctgcagaagggaaatggaggccccatgaggctgtatgtgggcagcctgcacttcaacatcacagaggacatgctgcggggcatctttgagccctttgggaagattgacaacatcgtgctgatgaaggacagcgacaccggccgcagcaagggctacggcttcatcaccttcagtgacagtgaatgtgcccggcgggccctggagcagctgaatggatttgagctggccggccggcccatgagggtgggccacgtgacagagcggctggatggcggcacagacatcaccttcccagatggagaccaggagctggacctgggcagcgctgggggccgcttccagctgatggccaagctggccgagggcgccggcatccagctgcccagcacagctgctgctgctgctgctgctgctgcccaggccgccgccctgcagctgaatggagctgtgcccctgggcgccctgaacccagctgccctgacagccctgagccctgccctgaacctggccagccagtgcttccagctgagcagcctcttcaccccccagaccatgtag

SEQ ID NO: 16755 - DNA, 183 bp, Artificial Sequence
  Description of Artificial Sequence: Synthetic coding sequence
atggccagtgatgactttgacatcgtcatcgaggccatgctggaggccccctacaagaaggaggaggatgagcagcagaggaaggaggtgaagaaggactaccccagcaacaccaccagcagcaccagcaacagcggaaatgagaccagcggcagcagcaccatcggggagaccagcaagtag

SEQ ID NO: 16756 - DNA, 435 bp, Artificial Sequence
  Description of Artificial Sequence: Synthetic coding sequence
atggccagtgatgactttgacatcgtcatcgaggccatgctggaggccccctacaagaaggaggaggatgagcagcagaggaaggaggtgaagaaggactaccccagcaacaccaccagcagcaccagcaacagcggaaatgagaccagcggcagcagcaccatcggggagaccagcaagaagaagaggagccgcagccacaacaagagccgggacaggaagaggagccgcagccgggaccgggaccgctacagaagaagaaacagccgcagccgcagccctggccggcagtgccgccacaggagccgctcctgggacagaagacatggcagcgagagccgcagccgggaccacagaagagaagatagagtgcactaccgcagcccccccctggccactggagagcctgtggacaacctgagccctgaggagtag

SEQ ID NO: 16757 - DNA, 228 bp, Artificial Sequence
  Description of Artificial Sequence: Synthetic coding sequence
atggccagtgatgactttgacatcgtcatcgaggccatgctggaggccccctacaagaaggaggaggatgagcagcagaggaaggaggtgaagaaggactaccccagcaacaccaccagcagcaccagcaacagcggaaatgagaccagcggcagcagcaccatcggggagaccagcaagaagaagaggagccgcagccacaacaagagccgggacaggaagaggtag

SEQ ID NO: 16758 - DNA, 303 bp, Artificial Sequence
  Description of Artificial Sequence: Synthetic coding sequence
atggccagtgatgactttgacatcgtcatcgaggccatgctggaggccccctacaagaaggaggaggatgagcagcagaggaaggaggtgaagaaggactaccccagcaacaccaccagcagcaccagcaacagcggaaatgagaccagcggcagcagcaccatcggggagaccagcaacagaagccgggaccgggaccgctacagaagaagaaacagccgcagccgcagccctggccggcagtgccgccacaggagccgctcctgggacagaagacatggcagcgagagccgcagcaggtag

SEQ ID NO: 16759 - DNA, 174 bp, Artificial Sequence
  Description of Artificial Sequence: Synthetic coding sequence
atggccagtgatgactttgacatcgtcatcgaggccatgctggaggccccctacaagaaggaggaggatgagcagcagaggaaggaggtgaagaaggactaccccagcaacaccaccagcagcaccagcaacagcggaaatgagaccagcggcagcagcaccatcggggagtag

SEQ ID NO: 16760 - DNA, 279 bp, Artificial Sequence
  Description of Artificial Sequence: Synthetic coding sequence
atggccagtgatgactttgacatcgtcatcgaggccatgctggaggccccctacaagaaggaggaggatgagcagcagaggaaggaggtgaagaaggactaccccagcaacaccaccagcagcaccagcaacagcggaaatgagaccagcggcagcagcaccatcggggagaccagcaagaagaagaggagccgcagccacaacaagagccgggacaggaagaggagccgcagccgggaccgggaccgctacagaagaagaaacagccgcagcaggtag

SEQ ID NO: 16761 - DNA, 201 bp, Artificial Sequence
  Description of Artificial Sequence: Synthetic coding sequence
atggccagtgatgactttgacatcgtcatcgaggccatgctggaggccccctacaagaaggaggaggatgagcagcagaggaaggaggtgaagaaggactaccccagcaacaccaccagcagcaccagcaacagcggaaatgagaccagcggcagcagcaccatcggggagaccagcaacagaagccgggaccgggactag

SEQ ID NO: 16762 - DNA, 306 bp, Artificial Sequence
  Description of Artificial Sequence: Synthetic coding sequence
atggccagtgatgactttgacatcgtcatcgaggccatgctggaggccccctacaagaaggaggaggatgagcagcagaggaaggaggtgaagaaggactaccccagcaacaccaccagcagcaccagcaacagcggaaatgagaccagcggcagcagcaccatcggggagaccagcaacagaagccgggaccgggaccgctacagaagaagaaacagccgcagccgcagccctggccggcagtgccgccacaggagccgctcctgggacagaagacatggcagcgagagccgcagccgggactag

SEQ ID NO: 16763 - DNA, 276 bp, Artificial Sequence
  Description of Artificial Sequence: Synthetic coding sequence
atggccagtgatgactttgacatcgtcatcgaggccatgctggaggccccctacaagaaggaggaggatgagcagcagaggaaggaggtgaagaaggactaccccagcaacaccaccagcagcaccagcaacagcggaaatgagaccagcggcagcagcaccatcggggagaccagcaacagaagccgggaccgggaccgctacagaagaagaaacagccgcagccgcagccctggccggcagtgccgccacaggagccgctcctgggacagatag

SEQ ID NO: 16764 - DNA, 636 bp, Artificial Sequence
  Description of Artificial Sequence: Synthetic coding sequence
atggccctggagggcatgagcaagaggaagaggaagaggtctgtgcaggagggagaaaatccagatgatggagtgcggggcagccccccagaggactaccgcctgggccaggtggccagcagcctcttccggggggagcaccacagcagaggaggcaccggccgcctggccagcctcttcagcagcctggagccccagatccagcctgtgtatgtgcctgtgcccaagcagaccatcaagaagaccaagagaaatgaggaggaggagagcaccagccagatcgagcggcccctgagccaggagcccgccaagaaggtgaaggccaagaagaagcacaccaatgctgagaagaagctggccgacagcagccccttccggctgatgctgcggccctgcctgagcatcagcagcaacaccctgtactgcatctaccgcttcaccatctacttctgggagagcgccctggccagcgctgacctggaggaggagatccaccagaagcagggccagaagaggaagaacagccagcccggggtgaaggtggccgacaggaagatcctggatgacacagaagatactgtggtgtcccagaggaagaagatccagatcaaccaggaggaggagcggctgaagtag

SEQ ID NO: 16765 - DNA, 1293 bp, Artificial Sequence
  Description of Artificial Sequence: Synthetic coding sequence
atggccctggagggcatgagcaagaggaagaggaagaggtctgtgcaggagggagaaaatccagatgatggagtgcggggcagccccccagaggactaccgcctgggccaggtggccagcagcctcttccggggggagcaccacagcagaggaggcaccggccgcctggccagcctcttcagcagcctggagccccagatccagcctgtgtatgtgcctgtgcccaagcagaccatcaagaagaccaagagaaatgaggaggaggagagcaccagccagatcgagcggcccctgagccaggagcccgccaagaaggtgaaggccaagaagaagcacaccaatgctgagaagaagctggccgaccgggagagcgccctggccagcgctgacctggaggaggagatccaccagaagcagggccagaagaggaagaacagccagcccggggtgaaggtggccgacaggaagatcctggatgacacagaggacacagtggtgtcccagaggaagaagatccagatcaaccaggaggaggagcggctgaagaatgaaagaacagtgtttgtgggcaacctgcctgtgacctgcaacaagaagaagctgaagagcttcttcaaggagtatggccagattgaatctgtgcgcttccgcagcctcatcccagctgagggcaccctgagcaagaagctggccgccatcaagaggaagatccacccagaccagaagaacatcaatgcctacgtggtgttcaaggaggagagcgctgccacccaggccctgaagagaaatggagcccagattgctgatggcttccgcatccgggtggacctggccagcgagaccagcagccgggacaagaggtctgtgtttgtgggcaacctgccctacaaggtggaggagagcgccatcgagaagcacttcctggactgtggcagcatcatggctgtgcgcatcgtgcgggacaagatgacaggcatcggcaagggcttcggctacgtgctgtttgagaacacagacagcgtgcacctggccctgaagctgaacaacagcgagctgatgggcaggaagctgcgggtgatgaggtctgtgaacaaggagaagttcaagcagcagaacagcaacccccggctgaagaatgtgtccaagcccaagcagggcctgaacttcaccagcaagacagctgagggccaccccaagagcctcttcatcggggagaaggctgtgctgctgaagaccaagaagaagggccagaagaagagcggccggcccaagaagcagaggaagcagaagtag

SEQ ID NO: 16766 - DNA, 636 bp, Artificial Sequence; identical to SEQ ID NO: 16764
  Description of Artificial Sequence: Synthetic coding sequence

SEQ ID NO: 16767 - DNA, 1074 bp, Artificial Sequence
  Description of Artificial Sequence: Synthetic coding sequence
atggcctctgtgctgaatgtgaaggagagcaaggcccctgagaggacagtggtggtggccggcctgcctgtggacctcttcagtgaccagctgctggccgtgctggtgaagagccacttccaggacatcaagaatgaaggaggagatgtggaggatgtgatctaccccaccaggaccaagggcgtggcctacgtgatcttcaaggagaagaaggtggccgagaatgtcatccggcagaagaagcactggctggccaggaagaccaggcatgctgagctgactgtgtccctgcgggtgagccactttggagacaagatcttcagctctgtgaatgccatcctggacctgtctgtgtttgggaaggaggtgaccctggagaccctggtgaaggacctgaagaagaagatccccagcctgtccttcagccccctgaagcccaacggccgcatctctgtggagggcagcttcctggccgtgaagaggctgcgggagagcctgctggcccgggcctgcagcctgctggagaaggacaggaacttcaccagcgaggagaggaagtggaaccggcagaacccccagaggaacctgcagaggagcaacaacagcctggcctctgtgaggaccctggtgcctgagacagcccggagcggggagatgctggtgctggacacagatgtgttcctgtacctgaagcacaagtgtggcagctatgagagcaccctgaagaagttccacatcctgagccaggagaaggtggatggagagatcaccaccatctgcctgaagagcatccaggtgggcagccagcccaacaatgccaagcacgtgaaggagctgattgaggagtggagccacgccctgtacctgaagctgaggaaggagaccttcatcctggagggcaaggagaaccgggagaagaggatgatcaagagggcctgtgagcagctgagcagccgctacctggaggtgctgatcaacctgtaccgcacccacatcgacatcatcggcagcagcagtgacacctacctgttcaagaagggcgtgatgaagctgattggccagaaggtgtcctag

SEQ ID NO: 16768 - DNA, 1782 bp, Artificial Sequence
  Description of Artificial Sequence: Synthetic coding sequence
atgacagctgaggacagcacagctgccatgagcagtgacagcgctgctggcagcagcgccaaggtgcctgagggcgtggccggggccccaaatgaagctgccctgctggccctgatggagaggacaggctacagcatggtgcaggagaatggccagaggaaatatggaggccccccacctggctgggagggcccccacccccagaggggctgtgaggtgtttgtgggcaagatccccagagatgtgtatgaagatgagctggtgcctgtgtttgaagctgtgggccgcatctatgagctgcggctgatgatggactttgatggcaagaacagaggctacgcctttgtgatgtactgccacaagcatgaggccaagagagctgtgcgggagctgaacaactatgagatccggcccggccgcctgctgggcgtgtgctgcagcgtggacaactgccgcctcttcatcggcggcatccccaagatgaagaagcgggaggagatcctggaggagatcgccaaggtgacagaaggagtgctggatgtgattgtgtatgccagcgctgctgacaagatgaagaacagaggatttgcctttgtggagtatgagagccacagagctgctgccatggcccggaggaagctgatgcctggccgcatccagctgtggggccaccagattgctgtggactgggccgagcctgagattgatgtggatgaagatgtgatggagaccgtgaagatcctgtatgtgaggaacctgatgattgagaccacagaggacaccatcaagaagagctttggccagttcaaccctggctgtgtggagcgggtgaagaagatccgggactatgcctttgtgcacttcaccagccgggaggatgctgtgcacgccatgaacaacctgaatggaacagagctggagggcagctgcctggaggtgaccctggccaagcctgtggacaaggagcagtacagccgctaccagaaggccgcccggggcggcggcgctgctgaggccgcccagcagcccagctatgtgtacagctgtgacccctacaccctggcctactacggctacccctacaatgccctgattggccccaacagagactactttgtgaaggccggcagcatccggggccggggcagaggagctgctggcaacagagcccctggcccccggggcagctacctgggcggctacagcgctggccggggcatctacagccgctaccacgagggcaagggcaagcagcaggagaagggctatgagctggtgcccaacctggagatccccaccgtgaaccctgtggccatcaagccaggcaccgtggccatcccagccatcggggcccagtacagcatgtttcctgctgccccagcccccaagatgattgaagatggcaagatccacacagtggagcacatgatcagccccatcgctgtgcagcctgaccctgccagcgctgctgctgctgctgctgctgctgctgctgctgctgctgctgtgatccccaccgtgtccaccccaccacccttccagggccggcccatcacccctgtgtacacagtggccccaaatgtgcagaggatccccacagctggcatctatggagccagctatgtgccctttgctgccccagccacagccaccatcgccaccctgcagaagaatgctgctgctgctgctgccatgtatggaggctacgccggctacatcccccaggccttccctgctgctgccatccaggtgcccatcccagatgtgtaccagacctactag

SEQ ID NO: 16769 - DNA, 1575 bp, Artificial Sequence
  Description of Artificial Sequence: Synthetic coding sequence
atgacagctgaggacagcacagctgccatgagcagtgacagcgctgctggcagcagcgccaaggtgcctgagggcgtggccggggccccaaatgaagctgccctgctggccctgatggagaggacaggctacagcatggtgcaggagaatggccagaggaaatatggaggccccccacctggctgggagggcccccacccccagaggggctgtgaggtgtttgtgggcaagatccccagagatgtgtatgaagatgagctggtgcctgtgtttgaagctgtgggccgcatctatgagctgcggctgatgatggactttgatggcaagaacagaggctacgcctttgtgatgtactgccacaagcatgaggccaagagagctgtgcgggagctgaacaactatgagatccggcccggccgcctgctgggcgtgtgctgcagcgtggacaactgccgcctcttcatcggcggcatccccaagatgaagaagcgggaggagatcctggaggagatcgccaaggtgacagaaggagtgctggatgtgattgtgtatgccagcgctgctgacaagatgaagaacagaggatttgcctttgtggagtatgagagccacagagctgctgccatggcccggaggaagctgatgcctggccgcatccagctgtggggccaccagattgctgtggactgggccgagcctgagattgatgtggatgaagatgtgatggagaccgtgaagatcctgtatgtgaggaacctgatgattgagaccacagaggacaccatcaagaagagctttggccagttcaaccctggctgtgtggagcgggtgaagaagatccgggactatgcctttgtgcacttcaccagccgggaggatgctgtgcacgccatgaacaacctgaatggaacagagctggagggcagctgcctggaggtgaccctggccaagcctgtggacaaggagcagtacagccgctaccagaaggccgcccggggcggcggcgctgctgaggccgcccagcagcccagctatgtgtacagctgtgacccctacaccctggcctactacggctacccctacaatgccctgattggccccaacagagactactttgtgaaggtggccatcccagccatcggggcccagtacagcatgtttcctgctgccccagcccccaagatgattgaagatggcaagatccacacagtggagcacatgatcagccccatcgctgtgcagcctgaccctgccagcgctgctgctgctgctgctgctgctgctgctgctgctgctgctgtgatccccaccgtgtccaccccaccacccttccagggccggcccatcacccctgtgtacacagtggcccccaacgtgcagaggatccccacagctggcatctacggggccagctatgtgccctttgctgccccagccacagccaccatcgccaccctgcagaagaatgctgctgctgctgctgccatgtatggaggctacgccggctacatcccccaggccttccctgctgctgccatccaggtgcccatcccagatgtgtaccagacctactag

SEQ ID NO: 16770 - DNA, 1782 bp, Artificial Sequence; identical to SEQ ID NO: 16768
  Description of Artificial Sequence: Synthetic coding sequence

SEQ ID NO: 16771 - DNA, 1575 bp, Artificial Sequence; identical to SEQ ID NO: 16769
  Description of Artificial Sequence: Synthetic coding sequence

SEQ ID NO: 16772 - DNA, 180 bp, Artificial Sequence
  Description of Artificial Sequence: Synthetic coding sequence
atgacagctgaggacagcacagctgccatgagcagtgacagcgctgctggcagcagcgccaaggtgcctgagggcgtggccggggccccaaatgaagctgccctgctggccctgatggagaggacaggctacagcatggtgcaggagaatggccagaggaaatatggaggccccccatag

SEQ ID NO: 16773 - DNA, 480 bp, Artificial Sequence
  Description of Artificial Sequence: Synthetic coding sequence
atgacagctgaggacagcacagctgccatgagcagtgacagcgctgctggcagcagcgccaaggtgcctgagggcgtggccggggccccaaatgaagctgccctgctggccctgatggagaggacaggctacagcatggtgcaggagaatggccagaggaaatatggaggccccccacctggctgggagggcccccacccccagaggggctgtgaggtgtttgtgggcaagatccccagagatgtgtatgaagatgagctggtgcctgtgtttgaagctgtgggccgcatctatgagctgcggctgatgatggactttgatggcaagaacagaggctacgcctttgtgatgtactgccacaagcatgaggccaagagagctgtgcgggagctgaacaactatgagatccggcccggccgcctgctgggcgtgtgctgcagcgtggacaactgccgcctcttcatcggcggcatcccctag

SEQ ID NO: 16774 - DNA, 375 bp, Artificial Sequence
  Description of Artificial Sequence: Synthetic coding sequence
atgacagctgaggacagcacagctgccatgagcagtgacagcgctgctggcagcagcgccaaggtgcctgagggcgtggccggggccccaaatgaagctgccctgctggccctgatggagaggacaggctacagcatggtgcaggagaatggccagaggaaatatggaggccccccacctggctgggagggcccccacccccagaggggctgtgaggtgtttgtgggcaagatccccagagatgtgtatgaagatgagctggtgcctgtgtttgaagctgtgggccgcatctatgagctgcggctgatgatggactttgatggcaagaacagaggctacgcctttgtgatgtactgccacaagcatgaggcctag

SEQ ID NO: 16775 - DNA, 345 bp, Artificial Sequence
  Description of Artificial Sequence: Synthetic coding sequence
atgacagctgaggacagcacagctgccatgagcagtgacagcgctgctggcagcagcgccaaggtgcctgagggcgtggccggggccccaaatgaagctgccctgctggccctgatggagaggacaggctacagcatggtgcaggagaatggccagaggaaatatggaggccccccacctggctgggagggcccccacccccagaggggctgtgaggtgtttgtgggcaagatccccagagatgtgtatgaagatgagctggtgcctgtgtttgaagctgtgggccgcatctatgagctgcggctgatgatggactttgatggcaagaacagaggctacgcctag

SEQ ID NO: 16776 - DNA, 180 bp, Artificial Sequence; identical to SEQ ID NO: 16772
  Description of Artificial Sequence: Synthetic coding sequence

SEQ ID NO: 16777 - DNA, 582 bp, Artificial Sequence
  Description of Artificial Sequence: Synthetic coding sequence
atgacagctgaggacagcacagctgccatgagcagtgacagcgctgctggcagcagcgccaaggtgcctgagggcgtggccggggccccaaatgaagctgccctgctggccctgatggagaggacaggctacagcatggtgcaggagaatggccagaggaaatatggaggccccccacctggctgggagggcccccacccccagaggggctgtgaggtgtttgtgggcaagatccccagagatgtgtatgaagatgagctggtgcctgtgtttgaagctgtgggccgcatctatgagctgcggctgatgatggactttgatggcaagaacagaggctacgcctttgtgatgtactgccacaagcatgaggccaagagagctgtgcgggagctgaacaactatgagatccggcccggccgcctgctgggcgtgtgctgcagcgtggacaactgccgcctcttcatcggcggcatccccaagatgaagaagcgggaggagatcctggaggagatcgccaaggtgacagaaggagtgctggatgtgattgtgtatgccagcgctgctgacaagatgaagaactag

SEQ ID NO: 16778 - DNA, 414 bp, Artificial Sequence
  Description of Artificial Sequence: Synthetic coding sequence
atgacagctgaggacagcacagctgccatgagcagtgacagcgctgctggcagcagcgccaaggtgcctgagggcgtggccggggccccaaatgaagctgccctgctggccctgatggagaggacaggctacagcatggtgcaggagaatggccagaggaaatatggaggccccccacctggctgggagggcccccacccccagaggggctgtgaggtgtttgtgggcaagatccccagagatgtgtatgaagatgagctggtgcctgtgtttgaagctgtgggccgcatctatgagctgcggctgatgatggactttgatggcaagaacagaggctacgcctttgtgatgtactgccacaagcatgaggccaagagagctgtgcgggagctgaacaactatgagatcagatag

SEQ ID NO: 16779 - DNA, 654 bp, Artificial Sequence
  Description of Artificial Sequence: Synthetic coding sequence
atgacagctgaggacagcacagctgccatgagcagtgacagcgctgctggcagcagcgccaaggtgcctgagggcgtggccggggccccaaatgaagctgccctgctggccctgatggagaggacaggctacagcatggtgcaggagaatggccagaggaaatatggaggccccccacctggctgggagggcccccacccccagaggggctgtgaggtgtttgtgggcaagatccccagagatgtgtatgaagatgagctggtgcctgtgtttgaagctgtgggccgcatctatgagctgcggctgatgatggactttgatggcaagaacagaggctacgcctttgtgatgtactgccacaagcatgaggccaagagagctgtgcgggagctgaacaactatgagatccggcccggccgcctgctgggcgtgtgctgcagcgtggacaactgccgcctcttcatcggcggcatccccaagatgaagaagcgggaggagatcctggaggagatcgccaaggtgacagaaggagtgctggatgtgattgtgtatgccagcgctgctgacaagatgaagaacagaggatttgcctttgtggagtatgagagccacagagctgctgccatggcccggaggaagctgatgcctggatag

SEQ ID NO: 16780 - DNA, 1080 bp, Artificial Sequence
  Description of Artificial Sequence: Synthetic coding sequence
atggtgaagctgttcatcggcaacctgccccgggaggccacagagcaggagatccgcagcctgtttgagcagtatggcaaggtgctggagtgtgacatcatcaagaactacggctttgtgcacatcgaggacaagacagctgctgaagatgccatccggaacctgcaccactacaagctgcatggagtgaacatcaacgtggaggccagcaagaacaagagcaaggccagcaccaagctgcacgtgggcaacatcagccccacctgcaccaaccaggagctgcgggccaagtttgaggagtatggccctgtgattgaatgtgacatcgtgaaggactatgcctttgtgcacatggagcgggcagaagatgctgtggaggccatccggggcctggacaacacagagttccagggcaagaggatgcacgtgcagctgagcaccagccggctgaggacagcccctggcatgggagaccagagcggctgctaccgctgtgggaaggagggccactggagcaaggagtgccctgtggacagaacaggccgggtggccgacttcacagagcagtacaatgagcagtacggggctgtgaggaccccctacaccatgggctatggagagagcatgtactacaatgatgcctatggagccctggactactacaagcgctacagagtgcgctcctatgaagctgtggccgctgctgctgctgccagcgcctacaactatgcagagcagaccatgagccacctgccccaggtgcagagcaccaccgtgaccagccacctgaacagcacctctgtggacccctatgacagacacctgctgcccaacagcggggccgccgccaccagcgctgccatggctgctgctgctgccaccaccagcagctactacggccgggacaggagccccctgcggcgggccgccgccatgctgcccaccgtgggggagggctacggctacggccctgagagcgagctgagccaggccagcgctgccaccaggaacagcctgtatgacatggcccgctatgagcgggagcagtatgtggaccgggcccgctacagcgccttctag

SEQ ID NO: 16781 - DNA, 1080 bp, Artificial Sequence; identical to SEQ ID NO: 16780
  Description of Artificial Sequence: Synthetic coding sequence

SEQ ID NO: 16782 - DNA, 2448 bp, Artificial Sequence
  Description of Artificial Sequence: Synthetic coding sequence
atgggcagtgacaagagggtgtccaggacagagaggagcggccgctatggcagcatcatcgacagagatgacagagatgagcgggagagccgcagcagaagaagagacagcgactacaagaggagcagtgatgaccggcggggggacagatatgatgactacagagattatgacagccctgagcgggagcgggagaggaggaacagcgacagaagtgaagatggctaccacagtgatggagactatggagaacatgactacagacatgacatcagtgatgagcgggagagcaagaccatcatgctgcggggcctgcccatcaccatcacagaaagtgacatccgggagatgatggagagctttgagggcccccagcctgcagatgtgcggctgatgaagaggaagacaggagtgtcccggggctttgcctttgtggagttctaccacctgcaggatgccacctcctggatggaggccaaccagaagaagctggtgatccagggcaagcacatcgccatgcactacagcaacccccggcccaagtttgaggactggctgtgcaacaagtgctgcctgaacaacttcaggaagaggctgaagtgcttccgctgtggggctgacaagtttgattctgagcaggaggtgcccccaggcaccacagagagcgtgcagagcgtggactactactgtgacaccatcatcctgaggaacatcgccccccacacagtggtggacagcatcatgacagccctgagcccctatgccagcctggccgtgaacaacatccgcctcatcaaggacaagcagacccagcagaacagaggatttgcctttgtgcagctgagcagcgccatggatgccagccagctgctgcagatcctgcagagcctgcacccccccctgaagattgatggcaagaccatcggcgtggactttgccaagagcgccaggaaggacctggtgctgagtgatggcaacagagtgtctgccttctctgtggccagcacagccatcgccgccgcccagtggagcagcacccagagccagagcggggagggcggctctgtggactacagctacctgcagcccggccaggacggctacgcccagtatgcccagtacagccaggactaccagcagttctaccagcagcaggccggcggcctggagagtgatgccagcagcgccagcggcacagctgtgaccaccaccagcgctgctgtggtgtcccagagcccccagctgtacaaccagaccagcaaccccccaggcagccccacagaggaggcccagcccagcaccagcaccagcacccaggccccagctgccagccccaccggggtggtgcccggcaccaagtatgctgtgcctgacaccagcacctaccagtatgatgagagcagcggctactactatgaccccaccaccggcctgtactatgaccccaacagccagtactactacaacagcctgacccagcagtacctgtactgggatggagagaaggagacctacgtgcctgctgctgagagcagcagccaccagcagagcggcctgcccccagccaaggagggcaaggagaagaaggagaagcccaagagcaagacagcccagcagatcgccaaggacatggagcgctgggccaagagcctgaacaagcagaaggagaacttcaagaacagcttccagcctgtgaacagcctgcgggaggaggagcggcgggagagcgctgctgctgatgctggctttgccctgtttgagaagaagggggccctggccgagcggcagcagctgatccctgagctggtgagaaatggagatgaggagaaccccctgaagaggggcctggtggccgcctacagcggggacagcgacaatgaggaggagctggtggagcggctggagagcgaggaggagaagctggccgactggaagaagatggcctgcctgctgtgccggcggcagttccccaacaaggatgccctggtgcgccaccagcagctgagtgacctgcacaagcagaacatggacatctaccgccgcagccggctgtctgagcaggagctggaggccctggagctgcgggagcgggagatgaagtacagagacagagctgctgagcggcgggagaagtatggcatccctgagcccccagagcccaagaggaagaagcagtttgatgctggcaccgtgaactatgagcagcccaccaaggatggcatcgaccacagcaacatcggcaacaagatgctgcaggccatgggctggagggagggcagcggcctgggcaggaagtgccagggcatcacagcccccatcgaggcccaggtgcggctgaagggggccggcctgggcgccaagggcagcgcctacggcctgagcggggctgacagctacaaggatgctgtgaggaaggccatgtttgcccgcttcacagagatggagtag

SEQ ID NO: 16783 - DNA, 363 bp, Artificial Sequence
  Description of Artificial Sequence: Synthetic coding sequence
atgggcagtgacaagagggtgtccaggacagagaggagcggccgctatggcagcatcatcgacagagatgacagagatgagcgggagagccgcagcagaagaagagacagcgactacaagaggagcagtgatgaccggcggggggacagatatgatgactacagagattatgacagccctgagcgggagcgggagaggaggaacagcgacagaagtgaagatggctaccacagtgatggagactatggagaacatgactacagacatgacatcagtgatgagcgggagagcaagaccatcatgctgcggggcctgcccatcaccatcacagaaagtgacatccgggagatgatggagagctag

SEQ ID NO: 16784 - DNA, 318 bp, Artificial Sequence
  Description of Artificial Sequence: Synthetic coding sequence
atgggcagtgacaagagggtgtccaggacagagaggagcggccgctatggcagcatcatcgacagagatgacagagatgagcgggagagccgcagcagaagaagagacagcgactacaagaggagcagtgatgaccggcggggggacagatatgatgactacagagattatgacagccctgagcgggagcgggagaggaggaacagcgacagaagtgaagatggctaccacagtgatggagactatggagaacatgactacagacatgacatcagtgatgagcgggagagcaagaccatcatgctgcggggcctgtag

SEQ ID NO: 16785 - DNA, 414 bp, Artificial Sequence
  Description of Artificial Sequence: Synthetic coding sequence
atgggcagtgacaagagggtgtccaggacagagaggagcggccgctatggcagcatcatcgacagagatgacagagatgagcgggagagccgcagcagaagaagagacagcgactacaagaggagcagtgatgaccggcggggggacagatatgatgactacagagattatgacagccctgagcgggagcgggagaggaggaacagcgacagaagtgaagatggctaccacagtgatggagactatggagaacatgactacagacatgacatcagtgatgagcgggagagcaagaccatcatgctgcggggcctgcccatcaccatcacagaaagtgacatccgggagatgatggagagctttgagggcccccagcctgcagatgtgcggctgatgaagaggaagacaggatag

SEQ ID NO: 16786 - DNA, 432 bp, Artificial Sequence
  Description of Artificial Sequence: Synthetic coding sequence
atgggcagtgacaagagggtgtccaggacagagaggagcggccgctatggcagcatcatcgacagagatgacagagatgagcgggagagccgcagcagaagaagagacagcgactacaagaggagcagtgatgaccggcggggggacagatatgatgactacagagattatgacagccctgagcgggagcgggagaggaggaacagcgacagaagtgaagatggctaccacagtgatggagactatggagaacatgactacagacatgacatcagtgatgagcgggagagcaagaccatcatgctgcggggcctgcccatcaccatcacagaaagtgacatccgggagatgatggagagctttgagggcccccagcctgcagatgtgcggctgatgaagaggaagacaggagagagcctgctgagcagctag

SEQ ID NO: 16787 - DNA, 381 bp, Artificial Sequence
  Description of Artificial Sequence: Synthetic coding sequence
atgggcagtgacaagagggtgtccaggacagagaggagcggccgctatggcagcatcatcgacagagatgacagagatgagcgggagagccgcagcagaagaagagacagcgactacaagaggagcagtgatgaccggcggggggacagatatgatgactacagagattatgacagcccagaaaatgacaagtacagcagaaatgatggagtgctgcggcggcccagcgcctgtggctgtgaggctgatgaggaggagaaccgctgcaagccctggttccggctgcggggcgtgctgagcctggcccgctgctaccagctggatggcagccagagcgagaaggtgggggacagcaggaaggcccactgcaatgccctgtag

SEQ ID NO: 16788 - DNA, 450 bp, Artificial Sequence
  Description of Artificial Sequence: Synthetic coding sequence
ggcaccaagtgccgggtgtccaggacagagaggagcggccgctatggcagcatcatcgacagagatgacagagatgagcgggagagccgcagcagaagaagagacagcgactacaagaggagcagtgatgacagaagaggagacagatatgatgactacagagattatgacagccctgagcgggagcgggagaggaggaacagcgacagaagtgaagatggctaccacagtgatggagactatggagaacatgactacagacatgacatcagtgatgagcgggagagcaagaccatcatgctgcggggcctgcccatcaccatcacagaaagtgacatccgggagatgatggagagctttgagggcccccagcctgcagatgtgcggctgatgaagaggaagacagagaaggtgggggacagcaggaaggcccactgcaatgccctgtag

SEQ ID NO: 16789 - DNA, 2445 bp, Artificial Sequence
  Description of Artificial Sequence: Synthetic coding sequence
ggcaccaagtgccgggtgtccaggacagagaggagcggccgctatggcagcatcatcgacagagatgacagagatgagcgggagagccgcagcagaagaagagacagcgactacaagaggagcagtgatgacagaagaggagacagatatgatgactacagagattatgacagccctgagcgggagcgggagaggaggaacagcgacagaagtgaagatggctaccacagtgatggagactatggagaacatgactacagacatgacatcagtgatgagcgggagagcaagaccatcatgctgcggggcctgcccatcaccatcacagaaagtgacatccgggagatgatggagagctttgagggcccccagcctgcagatgtgcggctgatgaagaggaagacaggagtgtcccggggctttgcctttgtggagttctaccacctgcaggatgccacctcctggatggaggccaaccagaagaagctggtgatccagggcaagcacatcgccatgcactacagcaacccccggcccaagtttgaggactggctgtgcaacaagtgctgcctgaacaacttcaggaagaggctgaagtgcttccgctgtggggctgacaagtttgacagcgagcaggaggtgcccccaggcaccacagaatctgtgcagagcgtggactactactgtgacaccatcatcctgagaaatattgccccccacacagtggtggacagcatcatgacagccctgagcccctatgccagcctggccgtgaacaacatccgcctcatcaaggacaagcagacccagcagaacagaggatttgcctttgtgcagctgagcagcgccatggatgccagccagctgctgcagatcctgcagagcctgcacccccccctgaagattgatggcaagaccatcggcgtggactttgccaagagcgccaggaaggacctggtgctgagtgatggcaacagagtgtctgccttctctgtggccagcacagccatcgctgctgcccagtggagcagcacccagagccagagcggggagggcggctctgtggactacagctacctgcagcccggccaggacggctacgcccagtatgcccagtacagccaggactaccagcagttctaccagcagcaggccggcggcctggagagtgatgccagcagcgccagcggcacagctgtgaccaccaccagcgctgctgtggtgtcccagagcccccagctgtacaaccagaccagcaaccccccaggcagccccacagaggaggcccagcccagcaccagcaccagcacccaggccccagctgccagccccactggagtggtgcccggcaccaagtatgctgtgcctgacaccagcacctaccagtatgatgagagcagcggctactactatgaccccaccaccggcctgtactatgaccccaacagccagtactactacaacagcctgacccagcagtacctgtactgggatggagagaaggagacctacgtgcctgctgctgagagcagcagccaccagcagagcggcctgcccccagccaaggagggcaaggagaagaaggagaagcccaagagcaagacagcccagcagatcgccaaggacatggagcgctgggccaagagcctgaacaagcagaaggagaacttcaagaacagcttccagcctgtgaacagcctgcgggaggaggagcggcgggagagcgctgctgctgatgctggctttgccctgtttgagaagaagggggccctggccgagcggcagcagctgatccctgagctggtgagaaatggagatgaggagaaccccctgaagaggggcctggtggccgcctacagcggggacagcgacaatgaggaggagctggtggagcggctggagagcgaggaggagaagctggccgactggaagaagatggcctgcctgctgtgccggcggcagttccccaacaaggatgccctggtgcgccaccagcagctgagtgacctgcacaagcagaacatggacatctacagaagaagccggctgtctgagcaggagctggaggccctggagctgcgggagcgggagatgaagtacagagacagagctgctgagcggcgggagaagtatggcatccctgagcccccagagcccaagaggaagaagcagtttgatgctggcaccgtgaactatgagcagcccaccaaggatggcatcgaccacagcaacatcggcaacaagatgctgcaggccatgggctggagggagggcagcggcctgggcaggaagtgccagggcatcacagcccccatcgaggcccaggtgcggctgaagggagctggcctgggcgccaagggcagcgcctacggcctgtctggagctgacagctacaaggatgctgtgaggaaggccatgtttgcccgcttcacagagatggagtag

SEQ ID NO: 16790 - DNA, 1518 bp, Artificial Sequence
  Description of Artificial Sequence: Synthetic coding sequence
aatggcttccgctctggagagcgggacctggtgctgagtgatggcaacagagtgtctgccttctctgtggccagcacagccatcgccgccgcccagtggagcagcacccagagccagagcggggagggcggctctgtggactacagctacctgcagcccggccaggacggctacgcccagtatgcccagtacagccaggactaccagcagttctaccagcagcaggccggcggcctggagagtgatgccagcagcgccagcggcacagctgtgaccaccaccagcgctgctgtggtgtcccagagcccccagctgtacaaccagaccagcaaccccccaggcagccccacagaggaggcccagcccagcaccagcaccagcacccaggccccagctgccagccccaccggggtggtgcccggcaccaagtatgctgtgcctgacaccagcacctaccagtatgatgagagcagcggctactactatgaccccaccaccggcctgtactatgaccccaacagccagtactactacaacagcctgacccagcagtacctgtactgggatggagagaaggagacctacgtgcctgctgctgagagcagcagccaccagcagagcggcctgcccccagccaaggagggcaaggagaagaaggagaagcccaagagcaagacagcccagcagatcgccaaggacatggagcgctgggccaagagcctgaacaagcagaaggagaacttcaagaacagcttccagcctgtgaacagcctgcgggaggaggagcggcgggagagcgctgctgctgatgctggctttgccctgtttgagaagaagggggccctggccgagcggcagcagctgatccctgagctggtgagaaatggagatgaggagaaccccctgaagaggggcctggtggccgcctacagcggggacagcgacaatgaggaggagctggtggagcggctggagagcgaggaggagaagctggccgactggaagaagatggcctgcctgctgtgccggcggcagttccccaacaaggatgccctggtgcgccaccagcagctgagtgacctgcacaagcagaacatggacatctaccgccgcagccggctgtctgagcaggagctggaggccctggagctgcgggagcgggagatgaagtacagagacagagctgctgagcggcgggagaagtatggcatccctgagcccccagagcccaagaggaagaagcagtttgatgctggcaccgtgaactatgagcagcccaccaaggatggcatcgaccacagcaacatcggcaacaagatgctgcaggccatgggctggagggagggcagcggcctgggcaggaagtgccagggcatcacagcccccatcgaggcccaggtgcggctgaagggggccggcctgggcgccaagggcagcgcctacggcctgagcggggctgacagctacaaggatgctgtgaggaaggccatgtttgcccgcttcacagagatggagtag

SEQ ID NO: 16791 - DNA, 3372 bp, Artificial Sequence
  Description of Artificial Sequence: Synthetic coding sequence
atgtggggagacagcaggcctgccaacagaacaggccccttccggggcagccaggaggagagatttgcccctggctggaacagagactacccacctccacccctgaagagccacgcccaggagcggcacagcggcaacttccctggccgggacagcctgccctttgacttccagggccacagcggccccccatttgccaacgtggaggagcacagcttctcctatggagccagagatggcccccacggggactacagaggaggagagggccctggccatgacttccggggcggggacttcagcagcagtgacttccagagccgggacagcagccagctggacttccggggccgggacatccacagcggggacttccgggaccgggagggcccccccatggactacagaggaggagatggcacctccatggactaccggggccgggaggccccccacatgaactacagagacagagatgcccatgctgtggacttccggggcagagatgcccccccaagtgacttccggggccggggcacctatgacctggacttccggggcagagatggcagccatgctgacttccggggccgggacctgagtgacctggacttccgggcccgggagcagagcagaagtgacttcaggaacagagatgtgtctgacctggacttccgggacaaggatggcacccaggtggacttccggggccggggcagcggcaccacagacctggacttccgggaccgggacaccccccacagcgacttccggggccgccacaggagcaggacagaccaggacttccggggccgggagatgggcagctgcatggagttcaaggaccgggagatgcctcctgtggaccccaacatcctggactacatccagcccagcacccaggaccgggagcacagcggcatgaatgtgaacagaagagaggagagcacccatgaccacaccatcgagaggcctgccttcggcatccagaagggggagtttgagcacagcgagacccgggagggggagacccagggcgtggcctttgaacatgagagccctgctgacttccagaacagccagagccctgtgcaggaccaggacaagagccagctgagcggccgggaggagcagagcagtgatgctggcctcttcaaggaggagggcggcctggacttcctgggccggcaggacacagactaccgctccatggagtacagagatgtggaccaccggctgcccggcagccagatgtttggctacggccagagcaagagcttccctgagggcaagacagccagagatgcccagagggacctgcaggaccaggactacagaacaggccccagcgaggagaagcccagccgcctcatccggctgtctggagtgcctgaagatgccaccaaggaggagatcctgaatgccttccgcaccccagatggcatgcctgtgaagaacctgcagctgaaggagtacaacacaggctatgactatggctacgtgtgtgtggagttcagcctgctggaggatgccatcggctgcatggaggccaaccagggcaccctgatgatccaggacaaggaggtgaccctggagtatgtgagcagcctggacttctggtactgcaagcgctgcaaggccaacattggaggccacaggagcagctgcagcttctgcaagaacccccgggaggtgacagaggccaagcaggagctgatcacctacccccagccccagaagaccagcatcccagcccccctggagaagcagcccaaccagcccctgcggcctgctgacaaggagcctgagcccaggaagcgggaggagggccaggagagccggctgggccaccagaagcgggaggccgagcgctacctgccccccagccggcgggagggccccaccttcagaagagaccgggagcgggagagctggagcggggagacccggcaggatggagagagcaagaccatcatgctgaagaggatctaccgcagcaccccacctgaggtgattgtggaggtgctggagccctacgtgcggctgaccacagccaacgtgcgcatcatcaagaacagaacaggccccatgggccacacctacggcttcatcgacctggacagccacgccgaggccctgcgggtggtgaagatcctgcagaacctggacccccccttcagcattgatggcaagatggtggccgtgaacctggccaccgggaagagaagaaatgacagcggggaccacagcgaccacatgcactactaccagggcaagaagtacttccgggacagaagaggaggcggcaggaacagcgactggagcagtgacaccaaccggcagggccagcagagcagcagtgactgctacatctatgacagcgccaccggctactactatgaccccctggccggcacctactatgaccccaacacccagcaggaggtgtatgtgccccaggaccccggcctgcctgaggaggaggagatcaaggagaagaagcccaccagccagggcaagagcagcagcaagaaggagatgagcaagagagatggcaaggagaagaaggacagaggagtgacccgcttccaggagaatgccagcgagggcaaggccccagcagaagatgtgttcaagaagcccctgcccccaacagtgaagaaggaggagagccccccaccacccaaggtggtgaaccccctcatcggcctgctgggggagtatggaggagacagcgactatgaggaggaggaggaggaggagcagaccccaccaccccagcccaggacagcccagccccagaagcgggaggagcagaccaagaaggaaaatgaggaggacaagctgacagactggaacaagctggcctgcctgctgtgccggcggcagttccccaacaaggaggtgctgatcaagcaccagcagctgagtgacctgcacaagcagaacctggagatccacaggaagatcaagcagagcgagcaggagctggcctacctggagcggcgggagcgggagggcaagttcaagggcagaggaaatgaccggcgggagaagctgcagagctttgacagccctgagaggaagaggatcaagtacagccgggagacagacagcgacaggaagctggtggacaaggaggacatcgacaccagcagcaagggcggctgtgtgcagcaggccaccggctggaggaagggcaccggcctgggctacggccaccctggcctggccagcagcgaggaggccgagggccgcatgaggggccccagcgtgggcgccagcggccgcaccagcaagaggcagagcaatgagacctacagagatgctgtgcggcgggtgatgtttgcccgctacaaggagctggactag

SEQ ID NO: 16792 - DNA, 429 bp, Artificial Sequence
  Description of Artificial Sequence: Synthetic coding sequence
atgtggggagacagcaggcctgccaacagaacaggccccttccggggcagccaggaggagagatttgcccctggctggaacagagactacccacctccacccctgaagagccacgcccaggagcggcacagcggcaacttccctggccgggacagcctgccctttgacttccagggccacagcggccccccatttgccaacgtggaggagcacagcttctcctatggagccagagatggcccccacggggactacagaggaggagagggccctggccatgacttccggggcggggacttcagcagcagtgacttccagagccgggacagcagccagctggacttccggggccgggacatccacagcggggacttccgggaccgggagggcccccccatggactacagaggaggagatggcaccagctag

SEQ ID NO: 16793 - DNA, 1806 bp, Artificial Sequence
  Description of Artificial Sequence: Synthetic coding sequence
atgatccaggacaaggaggtgaccctggagtatgtgagcagcctggacttctggtactgcaagcgctgcaaggccaacattggaggccacaggagcagctgcagcttctgcaagaacccccgggaggtgacagaggccaagcaggagctgatcacctacccccagccccagaagaccagcatcccagcccccctggagaagcagcccaaccagcccctgcggcctgctgacaaggagcctgagcccaggaagcgggaggagggccaggagagccggctgggccaccagaagcgggaggccgagcgctacctgccccccagccggcgggagggccccaccttcagaagagaccgggagcgggagagctggagcggggagacccggcaggatggagagagcaagaccatcatgctgaagaggatctaccgcagcaccccacctgaggtgattgtggaggtgctggagccctacgtgcggctgaccacagccaacgtgcgcatcatcaagaacagaacaggccccatgggccacacctacggcttcatcgacctggacagccacgccgaggccctgcgggtggtgaagatcctgcagaacctggacccccccttcagcattgatggcaagatggtggccgtgaacctggccaccgggaagagaagaaatgacagcggggaccacagcgaccacatgcactactaccagggcaagaagtacttccgggacagaagaggaggcggcaggaacagcgactggagcagtgacaccaaccggcagggccagcagagcagcagtgactgctacatctatgacagcgccaccggctactactatgaccccctggccggcacctactatgaccccaacacccagcaggaggtgtatgtgccccaggaccccggcctgcctgaggaggaggagatcaaggagaagaagcccaccagccagggcaagagcagcagcaagaaggagatgagcaagagagatggcaaggagaagaaggacagaggagtgacccgcttccaggagaatgccagcgagggcaaggccccagcagaagatgtgttcaagaagcccctgcccccaacagtgaagaaggaggagagccccccaccacccaaggtggtgaaccccctcatcggcctgctgggggagtatggaggagacagcgactatgaggaggaggaggaggaggagcagaccccaccaccccagcccaggacagcccagccccagaagcgggaggagcagaccaagaaggaaaatgaggaggacaagctgacagactggaacaagctggcctgcctgctgtgccggcggcagttccccaacaaggaggtgctgatcaagcaccagcagctgagtgacctgcacaagcagaacctggagatccacaggaagatcaagcagagcgagcaggagctggcctacctggagcggcgggagcgggagggcaagttcaagggcagaggaaatgaccggcgggagaagctgcagagctttgacagccctgagaggaagaggatcaagtacagccgggagacagacagcgacaggaagctggtggacaaggaggacatcgacaccagcagcaagggcggctgtgtgcagcaggccaccggctggaggaagggcaccggcctgggctacggccaccctggcctggccagcagcgaggaggccgagggccgcatgaggggccccagcgtgggcgccagcggccgcaccagcaagaggcagagcaatgagacctacagagatgctgtgcggcgggtgatgtttgcccgctacaaggagctggactag

SEQ ID NO: 16794 - DNA, 1563 bp, Artificial Sequence
  Description of Artificial Sequence: Synthetic coding sequence
atgtggggagacagcaggcctgccaacagaacaggccccttccggggcagccaggaggagagatttgcccctggctggaacagagactacccacctccacccctgaagagccacgcccaggagcggcacagcggcaacttccctggccgggacagcctgccctttgacttccagggccacagcggccccccatttgccaacgtggaggagcacagcttctcctatggagccagagatggcccccacggggactacagaggaggagagggccctggccatgacttccggggcggggacttcagcagcagtgacttccagagccgggacagcagccagctggacttccggggccgggacatccacagcggggacttccgggaccgggagggcccccccatggactacagaggaggagatggcacctccatggactaccggggccgggaggccccccacatgaactacagagacagagatgcccatgctgtggacttccggggcagagatgcccccccaagtgacttccggggccggggcacctatgacctggacttccggggcagagatggcagccatgctgacttccggggccgggacctgagtgacctggacttccgggcccgggagcagagcagaagtgacttcaggaacagagatgtgtctgacctggacttccgggacaaggatggcacccaggtggacttccggggccggggcagcggcaccacagacctggacttccgggaccgggacaccccccacagcgacttccggggccgccacaggagcaggacagaccaggacttccggggccgggagatgggcagctgcatggagttcaaggaccgggagatgcctcctgtggaccccaacatcctggactacatccagcccagcacccaggaccgggagcacagcggcatgaatgtgaacagaagagaggagagcacccatgaccacaccatcgagaggcctgccttcggcatccagaagggggagtttgagcacagcgagacccgggagggggagacccagggcgtggcctttgaacatgagagccctgctgacttccagaacagccagagccctgtgcaggaccaggacaagagccagctgagcggccgggaggagcagagcagtgatgctggcctcttcaaggaggagggcggcctggacttcctgggccggcaggacacagactaccgctccatggagtacagagatgtggaccaccggctgcccggcagccagatgtttggctacggccagagcaagagcttccctgagggcaagacagccagagatgcccagagggacctgcaggaccaggactacagaacaggccccagcgaggagaagcccagccgcctcatccggctgtctggagtgcctgaagatgccaccaaggaggagatcctgaatgccttccgcaccccagatggcatgcctgtgaagaacctgcagctgaaggagtacaacacaggcaacagcaatgaccccggccagaggagctacccaggagtgtgcatcaagccaggcttcctggtgctgcagaccatgtag

SEQ ID NO: 16795 - DNA, 231 bp, Artificial Sequence
  Description of Artificial Sequence: Synthetic coding sequence
atgtggggagacagcaggcctgccaacagaacaggccccttccggggcagccaggaggagagatttgcccctggctggaacagagactacccacctccacccctgaagagccacgcccaggagcggcacagcggcaacttccctggccgggacagcctgccctttgacttccagggccacagcggccccccatttgccaacgtggaggagcacagcttctcctatggatag

SEQ ID NO: 16796 - DNA, 1806 bp, Artificial Sequence; identical to SEQ ID NO: 16793
  Description of Artificial Sequence: Synthetic coding sequence

SEQ ID NO: 16797 - DNA, 2976 bp, Artificial Sequence
  Description of Artificial Sequence: Synthetic coding sequence
atggactacagaggaggagatggcacctccatggactaccggggccgggaggccccccacatgaactacagagacagagatgcccatgctgtggacttccggggcagagatgcccccccaagtgacttccggggccggggcacctatgacctggacttccggggcagagatggcagccatgctgacttccggggccgggacctgagtgacctggacttccgggcccgggagcagagcagaagtgacttcaggaacagagatgtgtctgacctggacttccgggacaaggatggcacccaggtggacttccggggccggggcagcggcaccacagacctggacttccgggaccgggacaccccccacagcgacttccggggccgccacaggagcaggacagaccaggacttccggggccgggagatgggcagctgcatggagttcaaggaccgggagatgcctcctgtggaccccaacatcctggactacatccagcccagcacccaggaccgggagcacagcggcatgaatgtgaacagaagagaggagagcacccatgaccacaccatcgagaggcctgccttcggcatccagaagggggagtttgagcacagcgagacccgggagggggagacccagggcgtggcctttgaacatgagagccctgctgacttccagaacagccagagccctgtgcaggaccaggacaagagccagctgagcggccgggaggagcagagcagtgatgctggcctcttcaaggaggagggcggcctggacttcctgggccggcaggacacagactaccgctccatggagtacagagatgtggaccaccggctgcccggcagccagatgtttggctacggccagagcaagagcttccctgagggcaagacagccagagatgcccagagggacctgcaggaccaggactacagaacaggccccagcgaggagaagcccagccgcctcatccggctgtctggagtgcctgaagatgccaccaaggaggagatcctgaatgccttccgcaccccagatggcatgcctgtgaagaacctgcagctgaaggagtacaacacaggctatgactatggctacgtgtgtgtggagttcagcctgctggaggatgccatcggctgcatggaggccaaccagggcaccctgatgatccaggacaaggaggtgaccctggagtatgtgagcagcctggacttctggtactgcaagcgctgcaaggccaacattggaggccacaggagcagctgcagcttctgcaagaacccccgggaggtgacagaggccaagcaggagctgatcacctacccccagccccagaagaccagcatcccagcccccctggagaagcagcccaaccagcccctgcggcctgctgacaaggagcctgagcccaggaagcgggaggagggccaggagagccggctgggccaccagaagcgggaggccgagcgctacctgccccccagccggcgggagggccccaccttcagaagagaccgggagcgggagagctggagcggggagacccggcaggatggagagagcaagaccatcatgctgaagaggatctaccgcagcaccccacctgaggtgattgtggaggtgctggagccctacgtgcggctgaccacagccaacgtgcgcatcatcaagaacagaacaggccccatgggccacacctacggcttcatcgacctggacagccacgccgaggccctgcgggtggtgaagatcctgcagaacctggacccccccttcagcattgatggcaagatggtggccgtgaacctggccaccgggaagagaagaaatgacagcggggaccacagcgaccacatgcactactaccagggcaagaagtacttccgggacagaagaggaggcggcaggaacagcgactggagcagtgacaccaaccggcagggccagcagagcagcagtgactgctacatctatgacagcgccaccggctactactatgaccccctggccggcacctactatgaccccaacacccagcaggaggtgtatgtgccccaggaccccggcctgcctgaggaggaggagatcaaggagaagaagcccaccagccagggcaagagcagcagcaagaaggagatgagcaagagagatggcaaggagaagaaggacagaggagtgacccgcttccaggagaatgccagcgagggcaaggccccagcagaagatgtgttcaagaagcccctgcccccaacagtgaagaaggaggagagccccccaccacccaaggtggtgaaccccctcatcggcctgctgggggagtatggaggagacagcgactatgaggaggaggaggaggaggagcagaccccaccaccccagcccaggacagcccagccccagaagcgggaggagcagaccaagaaggaaaatgaggaggacaagctgacagactggaacaagctggcctgcctgctgtgccggcggcagttccccaacaaggaggtgctgatcaagcaccagcagctgagtgacctgcacaagcagaacctggagatccacaggaagatcaagcagagcgagcaggagctggcctacctggagcggcgggagcgggagggcaagttcaagggcagaggaaatgaccggcgggagaagctgcagagctttgacagccctgagaggaagaggatcaagtacagccgggagacagacagcgacaggaagctggtggacaaggaggacatcgacaccagcagcaagggcggctgtgtgcagcaggccaccggctggaggaagggcaccggcctgggctacggccaccctggcctggccagcagcgaggaggccgagggccgcatgaggggccccagcgtgggcgccagcggccgcaccagcaagaggcagagcaatgagacctacagagatgctgtgcggcgggtgatgtttgcccgctacaaggagctggactag

SEQ ID NO: 16798 - DNA, 1398 bp, Artificial Sequence
  Description of Artificial Sequence: Synthetic coding sequence
atgctgaagaggatctaccgcagcaccccacctgaggtgattgtggaggtgctggagccctacgtgcggctgaccacagccaacgtgcgcatcatcaagaacagaacaggccccatgggccacacctacggcttcatcgacctggacagccacgccgaggccctgcgggtggtgaagatcctgcagaacctggacccccccttcagcattgatggcaagatggtggccgtgaacctggccaccgggaagagaagaaatgacagcggggaccacagcgaccacatgcactactaccagggcaagaagtacttccgggacagaagaggaggcggcaggaacagcgactggagcagtgacaccaaccggcagggccagcagagcagcagtgactgctacatctatgacagcgccaccggctactactatgaccccctggccggcacctactatgaccccaacacccagcaggaggtgtatgtgccccaggaccccggcctgcctgaggaggaggagatcaaggagaagaagcccaccagccagggcaagagcagcagcaagaaggagatgagcaagagagatggcaaggagaagaaggacagaggagtgacccgcttccaggagaatgccagcgagggcaaggccccagcagaagatgtgttcaagaagcccctgcccccaacagtgaagaaggaggagagccccccaccacccaaggtggtgaaccccctcatcggcctgctgggggagtatggaggagacagcgactatgaggaggaggaggaggaggagcagaccccaccaccccagcccaggacagcccagccccagaagcgggaggagcagaccaagaaggaaaatgaggaggacaagctgacagactggaacaagctggcctgcctgctgtgccggcggcagttccccaacaaggaggtgctgatcaagcaccagcagctgagtgacctgcacaagcagaacctggagatccacaggaagatcaagcagagcgagcaggagctggcctacctggagcggcgggagcgggagggcaagttcaagggcagaggaaatgaccggcgggagaagctgcagagctttgacagccctgagaggaagaggatcaagtacagccgggagacagacagcgacaggaagctggtggacaaggaggacatcgacaccagcagcaagggcggctgtgtgcagcaggccaccggctggaggaagggcaccggcctgggctacggccaccctggcctggccagcagcgaggaggccgagggccgcatgaggggccccagcgtgggcgccagcggccgcaccagcaagaggcagagcaatgagacctacagagatgctgtgcggcgggtgatgtttgcccgctacaaggagctggactag

SEQ ID NO: 16799 - DNA, 1173 bp, Artificial Sequence
  Description of Artificial Sequence: Synthetic coding sequence
atggtggaggccgacaggcctgggaagctgttcatcggcggcctgaacacagagaccaatgagaaggccctggagaccgtgtttgggaagtatggccgcatcgtggaggtgctgctgatcaaggaccgggagaccaacaagagccggggctttgcctttgtgacctttgagagccctgcagatgccaaggatgctgcccgggacatgaatggcaagagcctggatggcaaggccatcaaggtggagcaggccaccaagcccagctttgagcggggccgccacggccccccacctccacccaggagccggggccccccccggggctttggagctggccggggcggcagcggcggcacccggggcccccccagccggggcggccacatggatgatggcggctacagcatgaacttcaacatgagcagcagccggggccccctgcctgtgaagaggggccccccacccaggtctgggggccccagccccaagaggtctgcccccagcggcctggtgcgcagcagcagcggcatgggcggccgggcccccctgagccggggccgggacagctatggaggccccccaagaagagagcccctgcccagcagaagagatgtgtacctgagccccagagatgatggctacagcaccaaggacagctacagcagccgggactaccccagcagccgggacacccgggactatgcccccccaccccgggactacacctacagagattatggccacagcagcagcagagatgactaccccagccggggctacggggacagagatggctacggccgggaccgggactacagcgaccaccccagcggcggcagctacagagacagctatgagagctatggcaacagccgcagcgcccccctgacccggggccccccacccagctatggaggcagcagccgctatgatgactacagcagcagcagagatggctacggcggcagccgggacagctacagcagcagcagaagtgacctgtacagcagctgtgacagagtgggccggcaggagcggggcctgcccccatctgtggagcggggctaccccagcagccgggacagctacagcagcagcagcagaggagcccccaggggggccggccctgggggcagcagaagtgaccggggcggcggccgcagccgctactag

SEQ ID NO: 16800 - DNA, 1173 bp, Artificial Sequence; identical to SEQ ID NO: 16799
  Description of Artificial Sequence: Synthetic coding sequence

SEQ ID NO: 16801 - DNA, 1491 bp, Artificial Sequence
  Description of Artificial Sequence: Synthetic coding sequence
atggtggaggccgaccaccctgggaagctgttcatcggcggcctgaaccgggagaccaatgagaagatgctgaaggctgtgtttgggaagcacggccccatcagcgaggtgctgctgatcaaggacaggaccagcaagagccggggctttgccttcatcacctttgagaacccagcagatgccaagaatgctgccaaggacatgaatggcaccagcctgcacggcaaggccatcaaggtggagcaggccaagaagcccagcttccagagcggcggcagaagaagacctccagccagcagcaggaacagaagccccagcggcagcctgcggagcgcccggggcagcagcggcggcacccggggctggctgcccagccatgagggccacctggatgatggcggctacaccccagacctgaagatgagctacagccggggcctcatccctgtgaagaggggccccagcagccgcagcggcggccccccacccaagaagagcgcccccagcgctgtggcccggagcaacagctggatgggcagccagggccccatgagccagaggagagaaaattatggagtgcccccccggcgggccaccatcagctcctggagaaatgacaggatgagcaccaggcatgatggctacgccaccaatgatggcaaccaccccagctgccaggagacccgggactatgccccacccagccggggctacgcctacagagacaatggccacagcaacagagatgagcacagcagccggggctacagaaaccacaggagcagccgggagacccgggactatgccccacccagccggggccacgcctacagagattatggccacagcagaagagatgagagctacagccggggctacagaaaccacaggagcagccgggagacccgggagtatgccccacccagccggggccacggctacagagattatggccacagcagaagacatgagagctacagccggggctacagaaaccaccccagcagccgggagacccgggactatgccccaccccaccgggactatgcctacagagattatggccacagctcctgggatgagcacagcagccggggctacagctaccatgatggctatggagaggccctgggccgggaccacagcgagcacctgagcggcagcagctacagagatgccctgcagagatatggcaccagccatggagcccccccagcccggggccccaggatgtcctatggaggcagcacctgccacgcctacagcaacacccgggacagatatggccgctcctgggagagctacagcagctgtggggacttccactactgtgaccgggagcacgtgtgcaggaaggaccagagaaatccacccagcctgggccgggtgctgcctgacccccgggaggcctacggcagcagcagctatgtggccagcatcgtggatggaggagagagccgctctgagaagggggacagcagccgctactag

SEQ ID NO: 16802 - DNA, 1380 bp, Artificial Sequence
  Description of Artificial Sequence: Synthetic coding sequence
atggtggaggccgaccaccctgggaagctgttcatcggcggcctgaaccgggagaccaatgagaagatgctgaaggctgtgtttgggaagcacggccccatcagcgaggtgctgctgatcaaggacaggaccagcaagagccggggctttgccttcatcacctttgagaacccagcagatgccaagaatgctgccaaggacatgaatggcaccagcctgcacggcaaggccatcaaggtggagcaggccaagaagcccagcttccagagcggcggcagaagaagacctccagccagcagcaggaacagaagccccagcggcagcctgcggagcgcccggggcagcagcggcggcacccggggctggctgcccagccatgagggccacctggatgatggcggctacaccccagacctgaagatgagctacagccggggcctcatccctgtgaagaggggccccagcagccgcagcggcggccccccacccaagaagagcgcccccagcgctgtggcccggagcaacagctggatgggcagccagggccccatgagccagaggagagaaaattatggagtgcccccccggcgggccaccatcagctcctggagaaatgacaggatgagcaccaggcatgatggctacgccaccaatgatggcaaccaccccagctgccaggagacccgggactatgccccacccagccggggctacgcctacagagacaatggccacagcaacagagatgagcacagcagccggggctacagaaaccacaggagcagccgggagacccgggactatgccccacccagccggggccacgcctacagagattatggccacagcagaagagatgagagctacagccggggctacagaaaccacaggagcagccgggagacccgggagtatgccccacccagccggggccacggctacagagattatggccacagcagaagacatgagagctacagccggggctacagctaccatgatggctacggggaggccctgggccgggaccacagcgagcacctgagcggcagcagctacagagatgccctgcagagatatggcaccagccacggggcccccccagcccggggccccaggatgtcctatggaggcagcacctgccacgcctacagcaacacccgggacagatatggccgctcctgggagagctacagcagctgtggggacttccactactgtgaccgggagcacgtgtgcaggaaggaccagaggaacccccccagcctgggccgggtgctgcctgacccccgggaggcctacggcagcagcagctatgtggccagcatcgtggatggaggagagagccgctctgagaagggggacagcagccgctactag

SEQ ID NO: 16803 - DNA, 1491 bp, Artificial Sequence; identical to SEQ ID NO: 16801
  Description of Artificial Sequence: Synthetic coding sequence

SEQ ID NO: 16804 - DNA, 1491 bp, Artificial Sequence; identical to SEQ ID NO: 16801
  Description of Artificial Sequence: Synthetic coding sequence

SEQ ID NO: 16805 - DNA, 1380 bp, Artificial Sequence; identical to SEQ ID NO: 16802
  Description of Artificial Sequence: Synthetic coding sequence

SEQ ID NO: 16806 - DNA, 1221 bp, Artificial Sequence
  Description of Artificial Sequence: Synthetic coding sequence
atgggcaaggtgtggaagcagcagatgtacccccagtatgccacctactactacccccagtacctgcaggccaagcagagcctggtgcctgcccaccccatggccccacccagccccagcaccaccagcagcaacaacaacagcagcagcagcagcaacagcggctgggaccagctgagcaagaccaacctgtacatccggggcctgcccccccacaccacagaccaggacctggtgaagctgtgccagccctacggcaagatcgtgtccaccaaggccatcctggacaagaccaccaacaagtgcaagggctacggctttgtggactttgacagccctgctgctgcccagaaggctgtgtctgccctgaaggccagcggcgtgcaggcccagatggccaagcagcaggagcaggaccccaccaacctgtacatcagcaacctgcccctgtccatggatgagcaggagctggagaacatgctgaagcccttcggccaggtgatcagcacccgcatcctgcgggacagcagcggcaccagccggggcgtgggctttgccaggatggagagcacagagaagtgtgaggccgtcatcggccacttcaacgggaagttcatcaagaccccacctggggtgtctgcccccacagagcccctgctgtgcaagtttgctgatggcggccagaagaagaggcagaaccccaacaagtacatccccaacggccggccctggcaccgggagggggaggtgcggctggccggcatgaccctgacctatgaccccaccacagctgccatccagaatggcttctaccccagcccctacagcatcgccaccaacaggatgatcacccagaccagcatcaccccctacatcgccagccctgtgtctgcctaccaggtgcagagccccagctggatgcagccccagccctacatcctgcagcaccctggagctgtgctgacccccagcatggagcacaccatgagcctgcagcctgcctccatgatcagccccctggcccagcagatgagccacctgagcctgggcagcacaggcacctacatgcctgccaccagcgccatgcagggcgcctacctgccccagtatgcccacatgcagaccacagctgtgcctgtggaggaggccagcggccagcagcaggtggccgtggagaccagcaatgaccacagcccctacaccttccagcccaacaagtag

SEQ ID NO: 16807 - DNA, 1260 bp, Artificial Sequence
  Description of Artificial Sequence: Synthetic coding sequence
atgggcaaggtgtggaagcagcagatgtacccccagtatgccacctactactacccccagtacctgcaggccaagcagagcctggtgcctgcccaccccatggccccacccagccccagcaccaccagcagcaacaacaacagcagcagcagcagcaacagcggctgggaccagctgagcaagaccaacctgtacatccggggcctgcccccccacaccacagaccaggacctggtgaagctgtgccagccctacggcaagatcgtgtccaccaaggccatcctggacaagaccaccaacaagtgcaagggctacggctttgtggactttgacagccctgctgctgcccagaaggctgtgtctgccctgaaggccagcggcgtgcaggcccagatggccaagcagcaggagcaggaccccaccaacctgtacatcagcaacctgcccctgtccatggatgagcaggagctggagaacatgctgaagcccttcggccaggtgatcagcacccgcatcctgcgggacagcagcggcaccagccggggcgtgggctttgccaggatggagagcacagagaagtgtgaggccgtcatcggccacttcaacgggaagttcatcaagaccccacctggggtgtctgcccccacagagcccctgctgtgcaagtttgctgatggcggccagaagaagaggcagaaccccaacaagtacatccccaacggccggccctggcaccgggagggggaggccggcatgaccctgacctatgaccccaccacagctgccatccagaatggcttctaccccagcccctacagcatcgccaccaacaggatgatcacccagaccagcatcaccccctacatcgccagccctgtgtctgcctaccaggtggccaaggagacccgggagaacaagtaccggggcagcgccatcaaggtgcagagccccagctggatgcagccccagccctacatcctgcagcaccctggagctgtgctgacccccagcatggagcacaccatgagcctgcagcctgcctccatgatcagccccctggcccagcagatgagccacctgagcctgggcagcacaggcacctacatgcctgccaccagcgccatgcagggcgcctacctgccccagtatgcccacatgcagaccacagctgtgcctgtggaggaggccagcggccagcagcaggtggccgtggagaccagcaatgaccacagcccctacaccttccagcccaacaagtag

SEQ ID NO: 16808 - DNA, 1113 bp, Artificial Sequence
  Description of Artificial Sequence: Synthetic coding sequence
atggccccacccagccccagcaccaccagcagcaacaacaacagcagcagcagcagcaacagcggctgggaccagctgagcaagaccaacctgtacatccggggcctgcccccccacaccacagaccaggacctggtgaagctgtgccagccctacggcaagatcgtgtccaccaaggccatcctggacaagaccaccaacaagtgcaagggctacggctttgtggactttgacagccctgctgctgcccagaaggctgtgtctgccctgaaggccagcggcgtgcaggcccagatggccaagcagcaggagcaggaccccaccaacctgtacatcagcaacctgcccctgtccatggatgagcaggagctggagaacatgctgaagcccttcggccaggtgatcagcacccgcatcctgcgggacagcagcggcaccagcagaggagtgggctttgccaggatggagagcacagagaagtgtgaggccgtgattggccacttcaacgggaagttcatcaagaccccacctggggtgtctgcccccacagagcccctgctgtgcaagtttgctgatggcggccagaagaagaggcagaaccccaacaagtacatccccaacggccggccctggcaccgggagggggaggccggcatgaccctgacctatgaccccaccacagctgccatccagaatggcttctaccccagcccctacagcatcgccaccaacaggatgatcacccagaccagcatcaccccctacatcgccagccctgtgtctgcctaccaggtgcagagccccagctggatgcagccccagccctacatcctgcagcaccctggagctgtgctgacccccagcatggagcacaccatgagcctgcagcctgcctccatgatcagccccctggcccagcagatgagccacctgagcctgggcagcacaggcacctacatgcctgccaccagcgccatgcagggcgcctacctgccccagtatgcccacatgcagaccacagctgtgcctgtggaggaggccagcggccagcagcaggtggccgtggagaccagcaatgaccacagcccctacaccttccagcccaacaagtag

SEQ ID NO: 16809 - DNA, 1113 bp, Artificial Sequence; identical to SEQ ID NO: 16808
  Description of Artificial Sequence: Synthetic coding sequence

SEQ ID NO: 16810 - DNA, 1113 bp, Artificial Sequence; identical to SEQ ID NO: 16808
  Description of Artificial Sequence: Synthetic coding sequence

SEQ ID NO: 16811 - DNA, 387 bp, Artificial Sequence
  Description of Artificial Sequence: Synthetic coding sequence
atggccccacccagccccagcaccaccagcagcaacaacaacagcagcagcagcagcaacagcggctgggaccagctgagcaagaccaacctgtacatccggggcctgcccccccacaccacagaccaggacctggtgaagctgtgccagccctacggcaagatcgtgtccaccaaggccatcctggacaagaccaccaacaagtgcaagggctacggctttgtggactttgacagccctgctgctgcccagaaggctgtgtctgccctgaaggccagcggcgtgcaggcccagatggccaagcagcaggagcaggaccccaccaacctgtacatcagcaacctgcccctgtccatggatgagcaggagctggagaacatgctgtag

SEQ ID NO: 16812 - DNA, 1224 bp, Artificial Sequence
  Description of Artificial Sequence: Synthetic coding sequence
atgctgctgtctgtgaccagcaggcctggcatcagcaccttcggctacaacagaaacaacaagaagccctacgtgtccctggcccagcagatggccccacccagccccagcaacagcacccccaacagcagcagcggcagcaatggaaatgaccagctgagcaagaccaacctgtacatccggggcctgcagcccggcaccacagaccaggacctggtgaagctgtgccagccctacggcaagatcgtgtccaccaaggccatcctggacaagaccaccaacaagtgcaagggctacggctttgtggactttgacagccccagcgctgcccagaaggctgtgacagccctgaaggccagcggcgtgcaggcccagatggccaagcagcaggagcaggaccccaccaacctgtacatcagcaacctgcccctgtccatggatgagcaggagctggagggcatgctgaagcccttcggccaggtgatcagcacccgcatcctgcgggacaccagcggcaccagccggggcgtgggctttgccaggatggagagcacagagaagtgtgaggccatcatcacccacttcaacgggaagtacatcaagaccccacctggggtgcctgcccccagcgaccccctgctgtgcaagtttgctgatggcggccccaagaagaggcagaaccagggcaagtttgtgcagaatggccgggcctggcccagaaatgctgacatgggcgtgatggccctgacctatgaccccaccacagccctgcagaatggcttctacccagccccctacaacatcacccccaacaggatgctggcccagagcgccctgagcccctacctgagcagccctgtgtcctcctaccagagggtgacccagaccagccccctgcaggtgcccaaccccagctggatgcaccaccacagctacctgatgcagcccagcggctctgtgctgaccccaggcatggaccaccccatcagcctgcagcctgcctccatgatgggccccctgacccagcagctgggccacctgagcctgagcagcacaggcacctacatgcccacagctgctgccatgcagggcgcctacatcagccagtacacccctgtgcccagcagctctgtgtctgtggaggagagcagcggccagcagaaccaggtggccgtggatgcccccagcgagcacggcgtgtacagcttccagttcaacaagtag

SEQ ID NO: 16813 - DNA, 921 bp, Artificial Sequence
  Description of Artificial Sequence: Synthetic coding sequence
atgagcctgaagctgcaggccagcaatgtgaccaacaagaatgaccccaagagcatcaacagcagggtcttcatcggcaacctgaacacagccctggtgaagaagagtgatgtggagaccatcttcagcaaatatggccgggtggccggctgcagcgtgcacaagggctacgcctttgtgcagtacagcaatgaaagacatgcccgggctgctgtgctgggagaaaatggccgggtgctggccggccagaccctggacatcaacatggccggggagcccaagccagaccggcccaagggcctgaagagagctgccagcgccatctacagcggctacatctttgattatgactactacagagatgacttctatgaccggctgtttgactaccggggccgcctgagccctgtgcctgtgcccagggctgtgcctgtgaagaggccccgggtgacagtgcccctggtgcggcgggtgaagaccaacgtgcctgtgaagctgtttgcccggagcacagctgtgaccaccagcagcgccaagatcaagctgaagagcagcgagctgcaggccatcaagacagagctgacccagatcaagagcaacattgatgccctgctgagccggctggagcagattgctgctgagcagaaggccaacccagatggcaagaagaagggagatggcggcggggccggcggcggcggcggcggcggcggcagcggcggcggcggcagcggcggcggcggcggcggcggcagcagccggcccccagccccccaggagaacaccaccagcgaggccggcctgccccagggcgaggcccggaccagagatgatggagatgaggagggcctgctgacccacagcgaggaggagctggagcacagccaggacacagatgctgatgatggagccctgcagtag

SEQ ID NO: 16814 - DNA, 873 bp, Artificial Sequence
  Description of Artificial Sequence: Synthetic coding sequence
atgagcctgaagctgcaggccagcaatgtgaccaacaagaatgaccccaagagcatcaacagcagggtcttcatcggcaacctgaacacagccctggtgaagaagagtgatgtggagaccatcttcagcaaatatggccgggtggccggctgcagcgtgcacaagggctacgcctttgtgcagtacagcaatgaaagacatgcccgggctgctgtgctgggagaaaatggccgggtgctggccggccagaccctggacatcaacatggccggggagcccaagccagaccggcccaagggcctgaagagagctgccagcgccatctaccgcctgtttgactaccggggccgcctgagccctgtgcctgtgcccagggctgtgcctgtgaagaggccccgggtgacagtgcccctggtgcggcgggtgaagaccaacgtgcctgtgaagctgtttgcccggagcacagctgtgaccaccagcagcgccaagatcaagctgaagagcagcgagctgcaggccatcaagacagagctgacccagatcaagagcaacattgatgccctgctgagccggctggagcagattgctgctgagcagaaggccaacccagatggcaagaagaagggagatggcggcggggccggcggcggcggcggcggcggcggcagcggcggcggcggcagcggcggcggcggcggcggcggcagcagccggcccccagccccccaggagaacaccaccagcgaggccggcctgccccagggcgaggcccggaccagagatgatggagatgaggagggcctgctgacccacagcgaggaggagctggagcacagccaggacacagatgctgatgatggagccctgcagtag

SEQ ID NO: 16815 - DNA, 270 bp, Artificial Sequence
  Description of Artificial Sequence: Synthetic coding sequence
atgagcctgaagctgcaggccagcaatgtgaccaacaagaatgaccccaagagcatcaacagcagggtcttcatcggcaacctgaacacagccctggtgaagaagagtgatgtggagaccatcttcagcaaatatggccgggtggccggctgcagcgtgcacaagggctacgcctttgtgcagtacagcaatgaaagacatgcccgggctgctgtgctgggagaaaatggccgggtgctggccggccagaccctggacatcaacatgtag

SEQ ID NO: 16816 - DNA, 714 bp, Artificial Sequence
  Description of Artificial Sequence: Synthetic coding sequence
atgagcctgaagctgcaggccagcaatgtgaccaacaagaatgaccccaagagcatcaacagcagggtcttcatcggcaacctgaacacagccctggtgaagaagagtgatgtggagaccatcttcagcaaatatggccgggtggccggctgcagcgtgcacaagggctacgcctttgtgcagtacagcaatgaaagacatgcccgggctgctgtgctgggagaaaatggccgggtgctggccggccagaccctggacatcaacatggccggggagcccaagccagaccggcccaagggcctgaagagagctgccagcgccatctaccgcctgtttgactaccggggccgcctgagccctgtgcctgtgcccagggctgtgcctgtgaagaggccccgggtgacagtgcccctggtgcggcgggtgaagaccaacgtgcctgtgaagctgtttgcccggagcacagctgtgaccaccagcagcgccaagatcaagctgaagagcagcgagctgcaggccatcaagacagagctgacccagatcaagagcaacattgatgccctgctgagccggctggagcagattgctgctgagcagaaggccaacccagatggcaagaagaagggagatggcggcggggccggcggcggcggcggcggcggcggcagcggcggcggcggcagcggcggcggcggcggcggcggcagcagctag

SEQ ID NO: 16817 - DNA, 546 bp, Artificial Sequence
  Description of Artificial Sequence: Synthetic coding sequence
atgagcctgaagctgcaggccagcaatgtgaccaacaagaatgaccccaagagcatcaacagcagggtcttcatcggcaacctgaacacagccctggtgaagaagagtgatgtggagaccatcttcagcaaatatggccgggtggccggctgcagcgtgcacaagggctacgcctttgtgcagtacagcaatgaaagacatgcccgggctgctgtgctgggagaaaatggccgggtgctggccggccagaccctggacatcaacatggccggggagcccaagccagaccggcccaagggcctgaagagagctgccagcgccatctacagcggctacatctttgattatgactactacagagatgacttctatgaccggctgtttgactaccggggccgcctgagccctgtgcctgtgcccagggctgtgcctgtgaagaggccccgggtgacagtgcccctggtgcggcgggtgaagaccaacgtgcctgtgaagctgtttgcccggagcacagctgtgaccaccagcagcgccaagatcaagtag

SEQ ID NO: 16818 - DNA, 564 bp, Artificial Sequence
  Description of Artificial Sequence: Synthetic coding sequence
atgaccagcctgaccccaggctgccgctacagcgtgcgggtgagcccccagatggccaaccgcatcgtggacagcgcccggagcatcctgaacaagttcatcccagacatctacatctacacagaccacatgaagggcgtgaacagcggcaagagccctggcttcggcctgagcctggtggccgagaccaccagcggcaccttcctgtctgctgagctggccagcaacccccagggccagggcgctgctgtgctgcctgaggacctgggcaggaactgtgcccggctgctgctggaggagatctaccggggcggctgtgtggacagcaccaaccagagcctggccctgctgctgatgaccctgggccagcaggatgtgtccaaggtgctgctgggccccctgagcccctacaccatcgagttcctgcggcacctgaagagcttcttccagatcatgttcaagattgagaccaagccctgtggggaggagctgaagggcggggacaaggtgctgatgacctgtgtgggcatcggcttcagcaacctgagcaagaccctgaagtag

SEQ ID NO: 16819 - DNA, 564 bp, Artificial Sequence; identical to SEQ ID NO: 16818
  Description of Artificial Sequence: Synthetic coding sequence

SEQ ID NO: 16820 - DNA, 528 bp, Artificial Sequence
  Description of Artificial Sequence: Synthetic coding sequence
atggccacccaggcccacagcctgtcctatgccggctgcaacttcctgcggcagaggctggtgctgagcaccctgagcggccggcctgtgaagatcaggaagatccgggccagagatgacaaccctggcctgcgggactttgaggccagcttcatccggctgctggacaagatcaccaacggcagccgcatcgagatcaaccagacaggcaccaccctgtactaccagcccggcctgctgtatggaggctctgtggagcatgactgcagcgtgctgcggggcatcggctactacctggagagcctgctgtgcctggcccccttcatgaagcaccccctgaagatcgtgctgcggggcgtgaccaatgaccaggtggaccccagcgtgtccattgagaacaagccctggtgtggcttctgctttgtgtcctgccacaaccccacctgtgagaagaaggtgccctacaaggcccagttctactacaagtgcatcctgctgctgctcttcaccctgcgcttccggggctag

SEQ ID NO: 16821 - DNA, 1122 bp, Artificial Sequence
  Description of Artificial Sequence: Synthetic coding sequence
atggccacccaggcccacagcctgtcctatgccggctgcaacttcctgcggcagaggctggtgctgagcaccctgagcggccggcctgtgaagatcaggaagatccgggccagagatgacaaccctggcctgcgggactttgaggccagcttcatccggctgctggacaagatcaccaacggcagccgcatcgagatcaaccagacaggcaccaccctgtactaccagcccggcctgctgtatggaggctctgtggagcatgactgcagcgtgctgcggggcatcggctactacctggagagcctgctgtgcctggcccccttcatgaagcaccccctgaagatcgtgctgcggggcgtgaccaatgaccaggtggaccccagcgtggatgtgctgaaggccacagccctgcccctgctgaagcagtttggaattgatggagagagctttgagctgaagatcgtgcggcggggcatgcctcctgggggcggcggggaggtggtgttcagctgccctgtgaggaaggtgctgaagcccatccagctgacagatcctgggaagatcaagaggatccggggcatggcctacagcgtgcgggtgagcccccagatggccaaccgcatcgtggacagcgcccggagcatcctgaacaagttcatcccagacatctacatctacacagaccacatgaagggcgtgaacagcggcaagagccctggcttcggcctgagcctggtggccgagaccaccagcggcaccttcctgtctgctgagctggccagcaacccccagggccagggcgctgctgtgctgcctgaggacctgggcaggaactgtgcccggctgctgctggaggagatctaccggggcggctgtgtggacagcaccaaccagagcctggccctgctgctgatgaccctgggccagcaggatgtgtccaaggtgctgctgggccccctgagcccctacaccatcgagttcctgcggcacctgaagagcttcttccagatcatgttcaagattgagaccaagccctgtggggaggagctgaagggcggggacaaggtgctgatgacctgtgtgggcatcggcttcagcaacctgagcaagaccctgaagtag

SEQ ID NO: 16822 - DNA, 417 bp, Artificial Sequence
  Description of Artificial Sequence: Synthetic coding sequence
atgaccagcctgaccccaggctgccgctacagcgtgcgggtgagcccccagatggccaaccgcatcgtggacagcgcccggagcatcctgaacaagttcatcccagacatctacatctacacagaccacatgaagggcgtgaacagcggcaagagccctggcttcggcctgagcctggtggccgagaccaccagcggcaccttcctgtctgctgagctggccagcaacccccagggccagggcgctgctgtgctgcctgaggacctgggcaggaactgtgcccggctgctgctggaggagatctaccggggcggctgtgtggacagcaccaaccagagcctggccctgctgctgatgaccctgggccagcaggatgtgtccaaggtgctgctgggccccctgagcccctacacctag

SEQ ID NO: 16823 - DNA, 549 bp, Artificial Sequence
  Description of Artificial Sequence: Synthetic coding sequence
atgcctcctgggggcggcggggaggtggtgttcagctgccctgtgaggaaggtgctgaagcccatccagctgacagatcctgggaagatcaagaggatccggggcatggcctacagcgtgcgggtgagcccccagatggccaaccgcatcgtggacagcgcccggagcatcctgaacaagttcatcccagacatctacatctacacagaccacatgaagggcgtgaacagcggcaagagccctggcttcggcctgagcctggtggccgagaccaccagcggcaccttcctgtctgctgagctggccagcaacccccagggccagggcgctgctgtgctgcctgaggacctgggcaggaactgtgcccggctgctgctggaggagatctaccggggcggctgtgtggacagcaccaaccagagcctggccctgctgctgatgaccctgggccagcaggatgtgtccaaggtgctgctgggccccctgagcccctacaccatcgagttcctgcggcacctgaagagcttcttccagatcatgttcaagtag

SEQ ID NO: 16824 - DNA, 564 bp, Artificial Sequence; identical to SEQ ID NO: 16818
  Description of Artificial Sequence: Synthetic coding sequence

SEQ ID NO: 16825 - DNA, 1554 bp, Artificial Sequence
  Description of Artificial Sequence: Synthetic coding sequence
atggccgcccctgagcagcccctggccatcagccggggctgcaccagcagcagcagcctgagcccccccaggggggacaggaccctgctggtgcgccacctgcctgctgagctgacagctgaggagaaggaggacctgctgaagtactttggagcccagagcgtgcgggtgctgagtgacaagggccgcctgaagcacacagcctttgccaccttccccaatgagaaggccgccatcaaggccctgacccggctgcaccagctgaagctgctgggccacaccctggtggtggagtttgccaaggagcaggacagagtgcacagcccctgccccaccagcggcagcgagaagaagaagagaagtgatgatcctgtggaggatgacaaggagaagaaggagctgggctacctgactgtggagaatggaattgcccccaaccacggcctgaccttccccctgaacagctgcctgaagtacatgtaccccccacccagcagcaccatcctggccaacatcgtgaatgccctggcctctgtgcccaagttctacgtgcaggtgctgcacctgatgaacaagatgaacctgcccaccccatttggccccatcacagcccggccccccatgtatgaggactacatgcccctgcacgcccccctgccccccaccagcccccagcccccagaggagccccccctgcctgatgaagatgaggagctgagcagcgaggagagtgaatatgagagcacagatgatgaggaccggcagaggatgaacaagctgatggagctggccaacctgcagcccaagaggcccaagaccatcaagcagagacatgtgaggaagaagaggaagatcaaggacatgctgaacacccccctgtgccccagccacagcagcctgcaccctgtgctgctgcccagtgatgtgtttgaccagccccagcctgtgggcaacaagagaattgagttccacatcagcacagacatgcctgctgccttcaagaaggacctggagaaggagcagaactgtgaggagaagaaccacgacctgcctgccacagaggtggatgccagcaacatcggctttgggaagatcttccccaagcccaacctggacatcacagaggagatcaaggaggacagtgatgagatgcccagcgagtgcatcagcagaagagagctggagaagggccgcatcagccgggaggagatggagaccctgagcgtcttccgctcctatgagcctggagagcccaactgccgcatctacgtgaagaacctggccaagcacgtgcaggagaaggacctgaagtacatcttcggccgctacgtggacttcagcagcgagacccagaggatcatgtttgacatccggctgatgaaggagggccgcatgaagggccaggccttcatcggcctgcccaatgagaaggctgctgccaaggccctgaaggaggccaacggctacgtgctgtttgggaagcccatggtggtgcagtttgcccggagcgcccggcccaagcaggaccccaaggagggcaagaggaagtgctag

SEQ ID NO: 16826 - DNA, 387 bp, Artificial Sequence
  Description of Artificial Sequence: Synthetic coding sequence
tgaagaagagagctggagaagggccgcatcagccgggaggagatggagaccctgtctgtgttccgctcctatgagcccggggagcccaactgccgcatctacgtgaagaacctggccaagcacgtgcaggagaaggacctgaagtacatcttcggccgctacgtggacttcagcagcgagacccagaggatcatgtttgacatccggctgatgaaggagggccgcatgaagggccaggccttcatcggcctgcccaatgagaaggccgccgccaaggccctgaaggaggccaacggctacgtgctgtttgggaagcccatggtggtgcagtttgcccggagcgcccggcccaagcaggaccccaaggagggcaagaggaaatgttag

SEQ ID NO: 16827 - DNA, 558 bp, Artificial Sequence
  Description of Artificial Sequence: Synthetic coding sequence
atggccgcccctgagcagcccctggccatcagccggggctgcaccagcagcagcagcctgagcccccccaggggggacaggaccctgctggtgcgccacctgcctgctgagctgacagctgaggagaaggaggacctgctgaagtactttggagcccagagcgtgcgggtgctgagtgacaagggccgcctgaagcacacagcctttgccaccttccccaatgagaaggccgccatcaaggccctgacccggctgcaccagctgaagctgctgggccacaccctggtggtggagtttgccaaggagcaggacagagtgcacagcccctgccccaccagcggcagcgagaagaagaagagaagtgatgatcctgtggaggatgacaaggagaagaaggagctgggctacctgactgtggagaatggaattgcccccaaccacggcctgaccttccccctgaacagctgcctgaagtacatgtaccccccacccagcagcaccatcctggccaacatcgtgaatgccctggcctctgtgcccaagttctacgtgcagtag

SEQ ID NO: 16828 - DNA, 1554 bp, Artificial Sequence; identical to SEQ ID NO: 16825
  Description of Artificial Sequence: Synthetic coding sequence

SEQ ID NO: 16829 - DNA, 2409 bp, Artificial Sequence
  Description of Artificial Sequence: Synthetic coding sequence
atgttcatcagcggccgcaggacagctgacaagtggagggctgaggagcggctgcagtgcccagctggcagcgcccgggccgccctggcccgctgtgctgatggcggcgctgtgggccccttcaagtgtgtgtttgtgggggagatggccgcccaggtgggcgctgtgcgggtggtgcgggctgtggccgcccaggaggagccagacaaggagggcaaggagaagccccacgccggcgtgagcccccggggcgtgaagaggcagaggaggagcagcagcggcggcagccaggagaagaggggccggcccagccaggagccccccctggccccaccccacagaagaagaagaagccggcagcaccctggccccctgccccccaccaatgctgcccccaccgtgcccggccctgtggagcccctgctgctgcccccacctcctccacccagcctggccccagctggccctgctgtggccgcccccctgcctgcccccagcaccagcgccctcttcaccttcagccccctgactgtgtctgctgctggccccaagcacaagggccacaaggagcggcacaagcaccaccaccaccggggcccagatggagaccccagcagctgtggcacagacctgaagcacaaggacaagcaggagaatggagagaggactggaggagtgcccctcatcaaggcccccaagcgggagaccccagatgaaaatggcaagacccagagagcagatgactttgtgctgaagaagatcaagaagaagaagaagaagaagcaccgggaggacatgagaggaagaaggctgaagatgtacaacaaggaggtgcagacagtgtgtgccggcctgacccgcatcagcaaggagatcctgacccagggccagatcaacagcaccagcggcctgaacaaggagagcttccgctacctgaaggatgagcagctgtgccgcctgaacctgggcatgcaggagtacagagtgccccagggcgtgcagacccccttcatgacccaccaggagcacagcatcagaagaaacttcctgaagacaggcaccaagttcagcaacttcatccacgaggagcaccagagcaatggaggagccctggtgctgcacgcctacatggatgagctgtccttcctgagccccatggagatggagcgcttcagcgaggagttcctggccctgaccttctctgaaaatgagaagaatgctgcctactatgccctggccatcgtgcacggggctgctgcctacctgcctgacttcctggactactttgccttcaacttccccaacacccctgtgaagatggagatcctgggcaagaaggacatcgagaccaccaccatcagcaacttccacacccaggtgaacagaacctactgctgcggcacctacagagctggccccatgaggcagatcagcctggtgggcgctgtggatgaggaggtgggggactacttccctgagttcctggacatgctggaggagagccccttcctgaagatgaccctgccctggggcaccctgagcagcctgcggctgcagtgccgcagccagagtgatgatggccccatcatgtgggtgcggcctggagagcagatgatccccacagctgacatgcccaagagccccttcaagagaagaagatccatgaatgagatcaagaacctgcagtacctgcccaggaccagcgagccccgggaggtgctgtttgaggacaggacccgggcccatgctgaccacgtgggccagggctttgactggcagagcacagctgctgtgggcgtgctgaaggctgtgcagtttggagagtggagcgaccagccccgcatcaccaaggatgtgatctgcttccacgccgaggacttcacagatgtggtgcagaggctgcagctggacctgcacgagccccctgtgtcccagtgtgtgcagtgggtggatgaggccaagctgaaccagatgagaagagagggcatccgctatgcccgcatccagctgtgtgacaatgacatctacttcatccccagaaatgtcatccaccagttcaagacagtgtctgctgtgtgcagcctggcctggcacatccggctgaagcagtaccaccctgtggtggaggccacccagaacacagagagcaacagcaacatggactgtggcctgaccgggaagcgggagctggaggtggacagccagtgtgtgcgcatcaagacagaaagtgaggaggcctgcacagagatccagctgctgaccacagccagcagcagcttccccccagccagcgagctgaacctgcagcaggaccagaagacccagcccatccctgtgctgaaggtggagagccggctggacagcgaccagcagcacaacctgcaggagcacagcaccacctctgtgtag

SEQ ID NO: 16830 - DNA, 2541 bp, Artificial Sequence
  Description of Artificial Sequence: Synthetic coding sequence
atggccgagccccccagccctgtgcactgtgtggccgccgccgcccccacagccaccgtgtctgagaaggagccctttgggaagctgcagctgagcagccgggaccccccaggcagcctgagcgccaagaaggtgaggacagaggagaagaaggccccccggcgggtgaatggagagggcggcagcggcggcaacagccggcagctgcagcccccagctgcccccagcccccagagctatggcagccctgcctcctggagctttgcccccctgtctgctgcccccagccccagcagcagccgcagcagcttctccttctctgctggaacagctgtgcccagcagcgccagcgccagcctgagccagcctgtgcccaggaagctgctggtgccccccaccctgctgcacgcccagccccaccacctgctgctgcctgctgctgctgctgctgccagcgccaatgccaagagccggcggcccaaggagaagcgggagaaggagaggagaagacatggcctgggcggggcccgggaggccggcggggccagccgggaggagaatggagaggtgaagcccctgccccgggacaagatcaaggacaagatcaaggagcgggacaaggagaaggagcgggagaagaagaagcacaaggtgatgaatgagatcaagaaggaaaatggagaggtgaagatcctgctgaagagcggcaaggagaagcccaagaccaacatcgaggacctgcagatcaagaaggtgaagaagaagaagaagaagaagcacaaggaaaatgagaagaggaagaggcccaagatgtacagcaagagcatccagaccatctgcagcggcctgctgacagatgtggaggaccaggccgccaagggcatcctgaatgacaacatcaaggactatgtgggcaagaacctggacaccaagaactatgacagcaagatcccagaaaattctgagttcccctttgtgtccctgaaggagccccgggtgcagaacaacctgaagaggctggacaccctggagttcaagcagctgatccacatcgagcaccagcccaacggcggggccagcgtcatccacgcctacagcaatgagctgagccacctgagccccatggagatggagagatttgctgaggagtttgtgggcctggtgttttctgaaaatgaaaattctgctgccttctacgtgatgggcatcgtgcatggagctgccacctacctgcctgacttcctggactacttctccttcaacttccccaacagccctgtgaagatggagatcctgggcaagaaggacatcgagaccaccaccatgagcaacttccacgcccaggtgaagaggacctacagccacggcacctaccgggccggccccatgaggcagatcagcctggtgggcgctgtggatgaggaggtgggggactacttccctgagttcctggacatgctggaggagagccccttcctgaagtgcaccctgccctggggcaccctgagcagcctgaagctgcagagcaggaaggacagtgatgatggccccatcatgtgggtgcggcctggagagcagatgatccctgtggccgacatgcccaagagccccttcaagaggaagaggaccaccaatgagatcaagaacctgcagtacctgcccaggaccagcgagccccgggagatgctgtttgaggacaggacccgggcccacgccgaccacatcggccagggctttgagcggcagaccacagctgctgtgggcgtgctgaaggctgtgcactgtggggagtggccagaccagccccgcatcaccaaggatgtgatctgcttccacgccgaggacttcctggaggtggtgcagaggatgcagctggacctgcacgagccccccctgagccagtgtgtgcagtgggtggatgatgccaagctgaaccagctgcggcgggagggcatccgctatgcccgcatccagctgtatgacaatgacatctacttcatccccagaaatgtggtgcaccagttcaagacagtgtctgctgtgtgcagcctggcctggcacatccggctgaagctgtaccacagcgaggaggacaccagccagaacacagccacccatgagaccggcaccagcagtgacagcaccagctctgtgctgggcccccacacagacaacatgatctgtgctgtgtccaaggccagcctggacagcgtcttcagtgacaagctgcacagcaaatatgagctgcagcagatcaagcatgagcccatcgcctctgtgcgcatcaaggaggagcctgtgaatgtgaacatccctgagaagaccacagccctgaacaacatggatggcaagaatgtgaaggccaagctggaccacgtgcagtttgctgagttcaagattgacatggacagcaagtttgagaacagcaacaaggacctgaaggaggagctgtgccccggcaacctgagcctggtggacacccggcagcacagcagcgcccacagcaaccaggacaagaaggatgatgacatcctgtgctag

SEQ ID NO: 16831 - DNA, 1731 bp, Artificial Sequence
  Description of Artificial Sequence: Synthetic coding sequence
atgtacagcaagagcatccagaccatctgcagcggcctgctgacagatgtggaggaccaggccgccaagggcatcctgaatgacaacatcaaggactatgtgggcaagaacctggacaccaagaactatgacagcaagatcccagaaaattctgagttcccctttgtgtccctgaaggagccccgggtgcagaacaacctgaagaggctggacaccctggagttcaagcagctgatccacatcgagcaccagcccaacggcggggccagcgtcatccacgcctacagcaatgagctgagccacctgagccccatggagatggagagatttgctgaggagtttgtgggcctggtgttttctgaaaatgaaaattctgctgccttctacgtgatgggcatcgtgcatggagctgccacctacctgcctgacttcctggactacttctccttcaacttccccaacagccctgtgaagatggagatcctgggcaagaaggacatcgagaccaccaccatgagcaacttccacgcccaggtgaagaggacctacagccacggcacctaccgggccggccccatgaggcagatcagcctggtgggcgctgtggatgaggaggtgggggactacttccctgagttcctggacatgctggaggagagccccttcctgaagtgcaccctgccctggggcaccctgagcagcctgaagctgcagagcaggaaggacagtgatgatggccccatcatgtgggtgcggcctggagagcagatgatccctgtggccgacatgcccaagagccccttcaagaggaagaggaccaccaatgagatcaagaacctgcagtacctgcccaggaccagcgagccccgggagatgctgtttgaggacaggacccgggcccacgccgaccacatcggccagggctttgagcggcagaccacagctgctgtgggcgtgctgaaggctgtgcactgtggggagtggccagaccagccccgcatcaccaaggatgtgatctgcttccacgccgaggacttcctggaggtggtgcagaggatgcagctggacctgcacgagccccccctgagccagtgtgtgcagtgggtggatgatgccaagctgaaccagctgcggcgggagggcatccgctatgcccgcatccagctgtatgacaatgacatctacttcatccccagaaatgtggtgcaccagttcaagacagtgtctgctgtgtgcagcctggcctggcacatccggctgaagctgtaccacagcgaggaggacaccagccagaacacagccacccatgagaccggcaccagcagtgacagcaccagctctgtgctgggcccccacacagacaacatgatctgtgctgtgtccaaggccagcctggacagcgtcttcagtgacaagctgcacagcaaatatgagctgcagcagatcaagcatgagcccatcgcctctgtgcgcatcaaggaggagcctgtgaatgtgaacatccctgagaagaccacagccctgaacaacatggatggcaagaatgtgaaggccaagctggaccacgtgcagtttgctgagttcaagattgacatggacagcaagtttgagaacagcaacaaggacctgaaggaggagctgtgccccggcaacctgagcctggtggacacccggcagcacagcagcgcccacagcaaccaggacaagaaggatgatgacatcctgtgctag

SEQ ID NO: 16832 - DNA, 1815 bp, Artificial Sequence
  Description of Artificial Sequence: Synthetic coding sequence
atgatctctgtgaagaggaacacctggagggccctgagcctggtgattggagactgcaggaagaagggcaactttgagtactgccaggacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagccccccaaatggcttcagcaatggccccagcagcagcagcagcagcagcctggccaaccagcagctgcccccagcctgtggggcccggcagctgagcaagctgaagcgcttcctgaccaccctgcagcagtttggaaatgacatcagccctgagatcggggagcgggtgaggaccctggtgctgggcctggtgaacagcaccctgaccatcgaggagttccacagcaagctgcaggaggccaccaacttccccctgcggcccttcgtcatccccttcctgaaggccaacctgcccctgctgcagcgggagctgctgcactgtgcccggctggccaagcagaacccagcccagtacctggcccagcacgagcagctgctgctggatgccagcaccaccagccctgtggacagcagcgagctgctgctggatgtgaatgaaaatggcaagaggaggaccccagacaggaccaaggaaaatggatttgaccgggagcccctgcacagcgagcaccccagcaagaggccctgcaccatcagccctggccagcgctacagccccaacaacggcctgagctaccagcccaacggcctgccccaccccaccccacctccaccccagcactaccgcctggatgacatggccatcgcccaccactacagagacagctaccgccaccccagccaccgggacctgcgggacaggaaccggcccatgggcctgcacggcacccggcaggaggagatgattgaccaccggctgacagaccgggagtgggccgaggagtggaagcacctggaccacctgctgaactgcatcatggacatggtggagaagacccggcgcagcctgactgtgctgcggcgctgccaggaggccgaccgggaggagctgaactactggatccgccgctacagtgatgctgaggacctgaagaagggcggcggcagcagcagcagccacagccggcagcagagccctgtgaacccagaccctgtggccctggatgcccaccgggagttcctgcacaggcctgccagcggctacgtgcctgaggagatctggaagaaggccgaggaggccgtgaatgaggtgaagaggcaggccatgacagagctgcagaaggctgtgtctgaggccgagaggaaggcccatgacatgatcaccacagagcgggccaagatggagaggacagtggccgaggccaagaggcaggccgcagaagatgccctggccgtcatcaaccagcaggaggacagcagcgagagctgctggaactgtggcaggaaggccagcgagacctgcagcggctgcaacacagcccgctactgcggcagcttctgccagcacaaggactgggagaagcaccaccacatctgtggccagaccctgcaggcccagcagcagggcgacaccccagctgtgagcagctctgtgacccccaacagcggggccggcagccccatggacaccccacctgctgccacccccaggagcaccaccccaggcacccccagcaccatcgagaccacccccaggtag

SEQ ID NO: 16833 - DNA, 1704 bp, Artificial Sequence
  Description of Artificial Sequence: Synthetic coding sequence
atgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagcccccccaacggcttcagcaatggccccagcagcagcagcagcagcagcctggccaaccagcagctgcccccagcctgtggggcccggcagctgagcaagctgaagcgcttcctgaccaccctgcagcagtttggaaatgacatcagccctgagattggagagcgggtgaggaccctggtgctgggcctggtgaacagcaccctgaccatcgaggagttccacagcaagctgcaggaggccaccaacttccccctgcggccctttgtgatccccttcctgaaggccaacctgcccctgctgcagcgggagctgctgcactgtgcccggctggccaagcagaacccagcccagtacctggcccagcacgagcagctgctgctggatgccagcaccaccagccctgtggacagcagcgagctgctgctggatgtgaatgaaaatggcaagaggaggaccccagacaggaccaaggaaaatggatttgaccgggagcccctgcacagcgagcaccccagcaagaggccctgcaccatcagccctggccagcgctacagccccaacaacggcctgagctaccagcccaacggcctgccccaccccaccccacctccaccccagcactaccgcctggatgacatggccatcgcccaccactacagagacagctaccgccaccccagccaccgggacctgcgggacaggaaccggcccatgggcctgcacggcacccggcaggaggagatgattgaccaccggctgacagaccgggagtgggccgaggagtggaagcacctggaccacctgctgaactgcatcatggacatggtggagaagaccaggaggagcctgactgtgctgcggcgctgccaggaggccgaccgggaggagctgaactactggatccgccgctacagtgatgctgaggacctgaagaagggcggcggcagcagcagcagccacagccggcagcagagccctgtgaacccagaccctgtggccctggatgcccaccgggagttcctgcacaggcctgccagcggctacgtgcctgaggagatctggaagaaggccgaggaggccgtgaatgaggtgaagaggcaggccatgacagagctgcagaaggctgtgtctgaggccgagaggaaggcccatgacatgatcaccacagagcgggccaagatggagaggacagtggccgaggccaagaggcaggccgcagaagatgccctggccgtcatcaaccagcaggaggacagcagcgagagctgctggaactgtggcaggaaggccagcgagacctgcagcggctgcaacacagcccgctactgcggcagcttctgccagcacaaggactgggagaagcaccaccacatctgtggccagaccctgcaggcccagcagcagggcgacaccccagctgtgagcagctctgtgacccccaacagcggggccggcagccccatggacaccccacctgctgccacccccaggagcaccaccccaggcacccccagcaccatcgagaccaccccaagatag

SEQ ID NO: 16834 - DNA, 1734 bp, Artificial Sequence
  Description of Artificial Sequence: Synthetic coding sequence
atgccagacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagcccccccaacggcttcagcaatggccccagcagcagcagcagcagcagcctggccaaccagcagctgcccccagcctgtggggcccggcagctgagcaagctgaagcgcttcctgaccaccctgcagcagtttggaaatgacatcagccctgagattggagagcgggtgaggaccctggtgctgggcctggtgaacagcaccctgaccatcgaggagttccacagcaagctgcaggaggccaccaacttccccctgcggccctttgtgatccccttcctgaaggccaacctgcccctgctgcagcgggagctgctgcactgtgcccggctggccaagcagaacccagcccagtacctggcccagcacgagcagctgctgctggatgccagcaccaccagccctgtggacagcagcgagctgctgctggatgtgaatgaaaatggcaagaggaggaccccagacaggaccaaggaaaatggatttgaccgggagcccctgcacagcgagcaccccagcaagaggccctgcaccatcagccctggccagcgctacagccccaacaacggcctgagctaccagcccaacggcctgccccaccccaccccacctccaccccagcactaccgcctggatgacatggccatcgcccaccactacagagacagctaccgccaccccagccaccgggacctgcgggacaggaaccggcccatgggcctgcacggcacccggcaggaggagatgattgaccaccggctgacagaccgggagtgggccgaggagtggaagcacctggaccacctgctgaactgcatcatggacatggtggagaagaccaggaggagcctgactgtgctgcggcgctgccaggaggccgaccgggaggagctgaactactggatccgccgctacagtgatgctgaggacctgaagaagggcggcggcagcagcagcagccacagccggcagcagagccctgtgaacccagaccctgtggccctggatgcccaccgggagttcctgcacaggcctgccagcggctacgtgcctgaggagatctggaagaaggccgaggaggccgtgaatgaggtgaagaggcaggccatgacagagctgcagaaggctgtgtctgaggccgagaggaaggcccatgacatgatcaccacagagcgggccaagatggagaggacagtggccgaggccaagaggcaggccgcagaagatgccctggccgtcatcaaccagcaggaggacagcagcgagagctgctggaactgtggcaggaaggccagcgagacctgcagcggctgcaacacagcccgctactgcggcagcttctgccagcacaaggactgggagaagcaccaccacatctgtggccagaccctgcaggcccagcagcagggcgacaccccagctgtgagcagctctgtgacccccaacagcggggccggcagccccatggacaccccacctgctgccacccccaggagcaccaccccaggcacccccagcaccatcgagaccaccccaagatag

SEQ ID NO: 16835 - DNA, 1704 bp, Artificial Sequence; identical to SEQ ID NO: 16833
  Description of Artificial Sequence: Synthetic coding sequence

SEQ ID NO: 16836 - DNA, 1848 bp, Artificial Sequence
  Description of Artificial Sequence: Synthetic coding sequence
atgtgccacccagacaaggccttcaccagtgacaagctgcagtgtgtgttcaatgagtacaaggctgctgtgtgggtgcccccccggccccggcccctgagccgggcccccctgcctgaggacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagcccccccaacggcttcagcaatggccccagcagcagcagcagcagcagcctggccaaccagcagctgcccccagcctgtggggcccggcagctgagcaagctgaagcgcttcctgaccaccctgcagcagtttggaaatgacatcagccctgagattggagagcgggtgaggaccctggtgctgggcctggtgaacagcaccctgaccatcgaggagttccacagcaagctgcaggaggccaccaacttccccctgcggccctttgtgatccccttcctgaaggccaacctgcccctgctgcagcgggagctgctgcactgtgcccggctggccaagcagaacccagcccagtacctggcccagcacgagcagctgctgctggatgccagcaccaccagccctgtggacagcagcgagctgctgctggatgtgaatgaaaatggcaagaggaggaccccagacaggaccaaggaaaatggatttgaccgggagcccctgcacagcgagcaccccagcaagaggccctgcaccatcagccctggccagcgctacagccccaacaacggcctgagctaccagcccaacggcctgccccaccccaccccacctccaccccagcactaccgcctggatgacatggccatcgcccaccactacagagacagctaccgccaccccagccaccgggacctgcgggacaggaaccggcccatgggcctgcacggcacccggcaggaggagatgattgaccaccggctgacagaccgggagtgggccgaggagtggaagcacctggaccacctgctgaactgcatcatggacatggtggagaagaccaggaggagcctgactgtgctgcggcgctgccaggaggccgaccgggaggagctgaactactggatccgccgctacagtgatgctgaggacctgaagaagggcggcggcagcagcagcagccacagccggcagcagagccctgtgaacccagaccctgtggccctggatgcccaccgggagttcctgcacaggcctgccagcggctacgtgcctgaggagatctggaagaaggccgaggaggccgtgaatgaggtgaagaggcaggccatgacagagctgcagaaggctgtgtctgaggccgagaggaaggcccatgacatgatcaccacagagcgggccaagatggagaggacagtggccgaggccaagaggcaggccgcagaagatgccctggccgtcatcaaccagcaggaggacagcagcgagagctgctggaactgtggcaggaaggccagcgagacctgcagcggctgcaacacagcccgctactgcggcagcttctgccagcacaaggactgggagaagcaccaccacatctgtggccagaccctgcaggcccagcagcagggcgacaccccagctgtgagcagctctgtgacccccaacagcggggccggcagccccatggacaccccacctgctgccacccccaggagcaccaccccaggcacccccagcaccatcgagaccaccccaagatag

SEQ ID NO: 16837 - DNA, 363 bp, Artificial Sequence
  Description of Artificial Sequence: Synthetic coding sequence
atgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagcccccccaacggcttcagcaatggccccagcagcagcagcagcagcagcctggccaaccagcagctgcccccagcctgtggggcccggcagctgagcaagctgaagcgcttcctgaccaccctgcagcagtttggaaatgacatcagccctgagattggagagcgggtgaggaccctggtgctgggcctggtgaactag

SEQ ID NO: 16838 - DNA, 408 bp, Artificial Sequence
  Description of Artificial Sequence: Synthetic coding sequence
atgatctctgtgaagaggaacacctggagggccctgagcctggtgattggagactgcaggaagaagggcaactttgagtactgccaggacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagccccccaaatggcttcagcaatggccccagcagcagcagcagcagcagcctggccaaccagcagctgcccccagcctgtggggcccggcagctgagcaagctgaagcgcttcctgaccaccctgcagcagtag

SEQ ID NO: 16839 - DNA, 210 bp, Artificial Sequence
  Description of Artificial Sequence: Synthetic coding sequence
atgccagacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagcccccccaacggctag

SEQ ID NO: 16840 - DNA, 177 bp, Artificial Sequence
  Description of Artificial Sequence: Synthetic coding sequence
atgatctctgtgaagaggaacacctggagggccctgagcctggtgattggagactgcaggaagaagggcaactttgagtactgccagggcgcccgggcccagcacccagccagcggagatgctgccccagcccccctgatggccctgctgtctgctgccacccacagcaggacatag

SEQ ID NO: 16841 - DNA, 240 bp, Artificial Sequence
  Description of Artificial Sequence: Synthetic coding sequence
atgccagacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagcccccccaacggcttcagcaatggccccagcagcagcagcagctag

SEQ ID NO: 16842 - DNA, 141 bp, Artificial Sequence
  Description of Artificial Sequence: Synthetic coding sequence
atgccagacagccctgtggatgtgaagacccagagccggctgaccccacccaccatgcctcctccacccaccacccagggcgcccccaggaccagcagcttcacccccaccaccctgaccaacggcaccagccacagctag

SEQ ID NO: 16843 - DNA, 1734 bp, Artificial Sequence; identical to SEQ ID NO: 16834
  Description of Artificial Sequence: Synthetic coding sequence

SEQ ID NO: 16844 - DNA, 165 bp, Artificial Sequence
  Description of Artificial Sequence: Synthetic coding sequence
atgatctctgtgaagaggaacacctggagggccctgagcctggtgattggagactgcaggaagaagggcaactttgagtactgccaggacagaacagagaagcacagcaccatgccagacagccctgtggatgtgaagacccagagccggctgaccccaccctag

SEQ ID NO: 16845 - DNA, 690 bp, Artificial Sequence
  Description of Artificial Sequence: Synthetic coding sequence
atgatctctgtgaagaggaacacctggagggccctgagcctggtgattggagactgcaggaagaagggcaactttgagtactgccaggacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagccccccaaatggcttcagcaatggccccagcagcagcagcagcagcagcctggccaaccagcagctgcccccagcctgtggggcccggcagctgagcaagctgaagcgcttcctgaccaccctgcagcagtttggaaatgacatcagccctgagatcggggagcgggtgaggaccctggtgctgggcctggtgaacagcaccctgaccatcgaggagttccacagcaagctgcaggaggccaccaacttccccctgcggcccttcgtcatccccttcctgaaggccaacctgcccctgctgcagcgggagctgctgcactgtgcccggctggccaagcagaacccagcccagtacctggcccagcacgagcagctgctgctggatgccagcaccaccagccctgtggacagctag

SEQ ID NO: 16846 - DNA, 81 bp, Artificial Sequence
  Description of Artificial Sequence: Synthetic coding sequence
atgccagacagaacagagaagcacagcaccatgccagacagccctgtggatgtgaagacccagagccggctgaccccctag

SEQ ID NO: 16847 - DNA, 510 bp, Artificial Sequence
  Description of Artificial Sequence: Synthetic coding sequence
atgatctctgtgaagaggaacacctggagggccctgagcctggtgattggagactgcaggaagaagggcaactttgagtactgccaggacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagccccccaaatggcttcagcaatggccccagcagcagcagcagcagcagcctggccaaccagcagctgcccccagcctgtggggcccggcagctgagcaagctgaagcgcttcctgaccaccctgcagcagtttggaaatgacatcagccctgagatcggggagcgggtgaggaccctggtgctgggcctggtgaacagcaccctgaccatcgaggagttccacagcaagctgtag

SEQ ID NO: 16848 - DNA, 147 bp, Artificial Sequence
  Description of Artificial Sequence: Synthetic coding sequence
atgatctctgtgaagaggaacacctggagggccctgagcctggtgattggagactgcaggaagaagggcaactttgagtactgccaggacagaacagagaagcacagcaccatgccagacagccctgtggatgtgaagacccagtag

SEQ ID NO: 16849 - DNA, 276 bp, Artificial Sequence
  Description of Artificial Sequence: Synthetic coding sequence
atgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagcccccccaacggcttcagcaatggccccagcagcagcagcagcagcagcctggccaaccagcagctgcccccagcctgtggggcccggcagctgagcaagctgaagaggtag

SEQ ID NO: 16850 - DNA, 363 bp, Artificial Sequence
  Description of Artificial Sequence: Synthetic coding sequence
atgatctctgtgaagaggaacacctggagggccctgagcctggtgattggagactgcaggaagaagggcaactttgagtactgccaggacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagccccccaaatggcttcagcaatggccccagcagcagcagcagcagcagcctggccaaccagcagctgcccccagcctgtggggcctag

SEQ ID NO: 16851 - DNA, 1704 bp, Artificial Sequence; identical to SEQ ID NO: 16833
  Description of Artificial Sequence: Synthetic coding sequence

SEQ ID NO: 16852 - DNA, 258 bp, Artificial Sequence
  Description of Artificial Sequence: Synthetic coding sequence
atgatctctgtgaagaggaacacctggagggccctgagcctggtgattggagactgcaggaagaagggcaactttgagtactgccaggacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacctag

SEQ ID NO: 16853 - DNA, 516 bp, Artificial Sequence
  Description of Artificial Sequence: Synthetic coding sequence
atgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagcccccccaacggcttcagcaatggccccagcagcagcagcagcagcagcctggccaaccagcagctgcccccagcctgtggggcccggcagctgagcaagctgaagcgcttcctgaccaccctgcagcagtttggaaatgacatcagccctgagattggagagcgggtgaggaccctggtgctgggcctggtgaacagcaccctgaccatcgaggagttccacagcaagctgcaggaggccaccaacttccccctgcggccctttgtgatccccttcctgaaggccaacctgcccctgctgcagcgggagctgctgcactgtgcccggctggccaagcagaacccagcctag

SEQ ID NO: 16854 - DNA, 270 bp, Artificial Sequence
  Description of Artificial Sequence: Synthetic coding sequence
atgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagcccccccaacggcttcagcaatggccccagcagcagcagcagcagcagcctggccaaccagcagctgcccccagcctgtggggcccggcagctgagcaagctgtag

SEQ ID NO: 16855 - DNA, 285 bp, Artificial Sequence
  Description of Artificial Sequence: Synthetic coding sequence
atgatctctgtgaagaggaacacctggagggccctgagcctggtgattggagactgcaggaagaagggcaactttgagtactgccaggacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagccccccatag

SEQ ID NO: 16856 - DNA, 306 bp, Artificial Sequence
  Description of Artificial Sequence: Synthetic coding sequence
atgccagacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagcccccccaacggcttcagcaatggccccagcagcagcagcagcagcagcctggccaaccagcagctgcccccagcctgtggggcccggcagctgagcaagctgaagaggtag

SEQ ID NO: 16857 - DNA, 471 bp, Artificial Sequence
  Description of Artificial Sequence: Synthetic coding sequence
atgatctctgtgaagaggaacacctggagggccctgagcctggtgattggagactgcaggaagaagggcaactttgagtactgccaggacagaacagagaagcacagcaccatgccagacagccctgtggatgtgaagacccagagccggctgaccccacccaccatgcctcctccacccaccacccagggcgcccccaggaccagcagcttcacccccaccaccctgaccaacggcaccagccacagccccacagccctgaatggagcccccagccccccaaatggcttcagcaatggccccagcagcagcagcagcagcagcctggccaaccagcagctgcccccagcctgtggggcccggcagctgagcaagctgaagcgcttcctgaccaccctgcagcagtttggaaatgacatcagccctgagatcggggagcgggtgaggaccctggtgctgggcctggtgtag

SEQ ID NO: 16858 - DNA, 363 bp, Artificial Sequence; identical to SEQ ID NO: 16850
  Description of Artificial Sequence: Synthetic coding sequence

SEQ ID NO: 16859 - DNA, 1815 bp, Artificial Sequence; identical to SEQ ID NO: 16832
  Description of Artificial Sequence: Synthetic coding sequence

SEQ ID NO: 16860 - DNA, 3105 bp, Artificial Sequence
  Description of Artificial Sequence: Synthetic coding sequence
atggctgctgccactggagctgtggccgccagcgctgccagcggccaggccgagggcaagaagatcacagacctgcgggtcatcgacctgaagtctgagctgaagagaagaaacctggacatcaccggggtgaagacagtgctgatcagccggctgaagcaggccatcgaggaggagggcggggaccctgacaacatcgagctgactgtgtccacagacacccccaacaagaagcccaccaagggcaagggcaagaagcatgaagcagatgagctgtctggagatgcctctgtggaggatgatgccttcatcaaggactgtgagctggagaaccaggaggcccacgagcaggatggaaatgatgagctgaaggacagcgaggagtttggagaaaatgaggaggagaatgtgcacagcaaggagctgctgtctgctgaggagaacaagagggcccacgagctgattgaagctgagggcattgaagatattgagaaggaggacatcgagagccaggagattgaggcccaggagggagaagatgacaccttcctgacagcccaggatggagaggaggaggagaatgagaaggacattgctggcagcggagatggcacccaggaggtgtccaagcccctgcccagcgagggcagcctggccgaggccgaccacacagcccacgaggagatggaggcccacaccaccgtgaaggaggctgaagatgacaacatctctgtgaccatccaggccgaggatgccatcaccctggactttgatggagatgacctgctggagaccgggaagaatgtgaagatcacagacagcgaggccagcaagcccaaggatggccaggatgccatcgcccagagccctgagaaggagagcaaggactatgagatgaatgccaaccacaaggatggcaagaaggaggactgtgtgaagggggaccctgtggagaaggaggcccgggagagcagcaagaaggccgagagcggggacaaggagaaggacaccctgaagaagggccccagcagcactggagccagcggccaggccaagagcagcagcaaggagagcaaggacagcaagaccagcagcaaggatgacaagggcagcaccagcagcaccagcggcagcagcggcagcagcaccaagaacatctgggtgtctggcctgagcagcaacaccaaggctgctgacctgaagaacctgtttgggaagtatggcaaggtgctgagcgccaaggtggtgaccaatgcccggagccctggggccaagtgctatggaattgtgaccatgagcagcagcacagaggtgagccgctgcatcgcccacctgcacaggacagagctgcacggccagctgatctctgtggagaaggtgaagggggaccccagcaagaaggagatgaagaaggaaaatgatgagaagagcagcagccgcagcagcggggacaagaagaacaccagtgacaggagcagcaagacccaggcctctgtgaagaaggaggagaagaggagcagcgagaagtctgagaagaaggagagcaaggacaccaagaagattgagggcaaggatgagaagaatgacaacggggccagcggccagaccagcgagagcatcaagaagtctgaggagaagaagaggatcagcagcaagagccctggccacatggtgatcctggaccagaccaagggggaccactgccggcccagccggcggggccgctatgagaagatccacggccgcagcaaggagaaggagcgggccagcctggacaagaagagggacaaggactacagaaggaaggagatcctgccctttgagaagatgaaggagcagaggctgcgggagcacctggtgcgctttgagcggctgcggcgggccatggagctgcggcggcggcgggagattgctgagcgggagcggcgggagcgggagcgcatccgcatcatccgggagcgggaggagcgggagcggctgcagcgggagcgggagcggctggagattgagcggcagaagctggagcgggagaggatggagcgggagcggctggagcgggagcgcatcagaattgagcaggagaggaggaaggaggccgagcgcatcgcccgggagcgggaggagctgcggcggcagcagcagcagctgcgctatgagcaggagaagaggaacagcctgaagaggcccagagatgtggaccacagaagagatgacccctactggagcgagaacaagaagctgagcctggacacagatgccaggtttggacatggcagtgactacagccggcagcagaaccgcttcaatgactttgaccaccgggagcggggccgcttccctgagagcagcgctgtgcagagcagcagctttgagcggcgggacagatttgtgggccagagcgagggcaagaaggcccggcccacagcccggcgggaggaccccagctttgagcgctaccccaagaacttcagtgacagcagaagaaatgaacctcctcctccaagaaatgagctgcgggagagtgacagaagagaggtgcggggggagagagatgaaagaagaactgtcatcatccatgacagaccagacatcacccaccccaggcacccccgggaggccggccccaaccccagccggcccacctcctggaagtctgagggctccatgagcacagacaagcgggagaccagggtggagaggcctgagaggagcggccgggaggtgtctggccacagcgtgcggggggcccctcctggcaacagaagcagcgccagcggctacggcagccgggagggggacagaggagtcatcacagacagaggaggcggcagccagcactacccagaggagcggcacgtggtggagagacatggccgggacaccagcggccccaggaaggagtggcacggcccccccagccagggccccagctaccatgacaccaggaggatgggagatggccgggccggggccggcatgatcacccagcacagcagcaatgccagccccatcaacagaattgtgcagatcagcggcaacagcatgccccggggcagcggcagcggcttcaagcccttcaagggcggccccccccggcgcttctag

SEQ ID NO: 16861 - DNA, 1812 bp, Artificial Sequence
  Description of Artificial Sequence: Synthetic coding sequence
atgagcagcagcacagaggtgagccgctgcatcgcccacctgcacaggacagagctgcacggccagctgatctctgtggagaaggtgaagggggaccccagcaagaaggagatgaagaaggaaaatgatgagaagagcagcagccgcagcagcggggacaagaagaacaccagtgacaggagcagcaagacccaggcctctgtgaagaaggaggagaagaggagcagcgagaagtctgagaagaaggagagcaaggacaccaagaagattgagggcaaggatgagaagaatgacaatggagccagcggccagaccagcgagagcatcaagaagtctgaggagaagaagaggatcagcagcaagagccctggccacatggtgatcctggaccagaccaagggggaccactgccggcccagcagaagaggccgctatgagaagatccacggccgcagcaaggagaaggagcgggccagcctggacaagaagagggacaaggactacagaaggaaggagatcctgccctttgagaagatgaaggagcagaggctgcgggagcacctggtgcgctttgagcggctgcggcgggccatggagctgcggaggagaagagaaattgctgagcgggagcggcgggagcgggagcgcatccgcatcatccgggagcgggaggagcgggagcggctgcagcgggagcgggagcggctggagattgaaaggcagaagctggagcgggagaggatggagcgggagcggctggagcgggagcgcatccgcatcgagcaggagaggaggaaggaggccgagagaattgcccgggagcgggaggagctgcggcggcagcagcagcagctgcgctatgagcaggagaagaggaacagcctgaagaggcccagagatgtggaccacagaagagatgacccctactggagcgagaacaagaagctgagcctggacacagatgcccgcttcggccacggcagtgactacagccggcagcagaaccgcttcaatgactttgaccaccgggagcggggccgcttccctgagagcagcgctgtgcagagcagcagctttgaaagaagagacagatttgtgggccagagcgagggcaagaaggcccggcccacagcccggcgggaggaccccagctttgagcgctaccccaagaacttcagtgacagcagaagaaatgagcccccacctccaagaaatgagctgcgggagagtgaccggcgggaggtgcggggggagagagatgagaggagaactgtcatcatccatgacagaccagacatcacccaccccaggcacccccgggaggccggccccaaccccagccggcccacctcctggaagtctgagggctccatgagcacagacaagcgggagaccagggtggagaggcctgagaggagcggccgggaggtgtctggccacagcgtgcggggggcccctcctggcaacagaagcagcgccagcggctacggcagccgggagggggaccggggcgtcatcacagaccggggcggcggcagccagcactacccagaggagagacatgtggtggagcggcacggccgggacaccagcggccccaggaaggagtggcacggcccccccagccagggccccagctaccatgacaccaggaggatgggagatggccgggccggggccggcatgatcacccagcacagcagcaatgccagccccatcaaccgcatcgtgcagatcagcggcaacagcatgccccggggcagcggcagcggcttcaagcccttcaagggcggccccccccggcgcttctag

SEQ ID NO: 16862 - DNA, 303 bp, Artificial Sequence
  Description of Artificial Sequence: Synthetic coding sequence
ggtgtcatcacagacagaggaggcggcagccagcactacccagaggagcggcacgtggtggagagacatggccgggacaccagcggccccaggaaggagtggcacggcccccccagccagggccccagctaccatgacaccaggaggatgggagatggccgggccggggccggcatgatcacccagcacagcagcaatgccagccccatcaacagaattgtgcagatcagcggcaacagcatgccccggggcagcggcagcggcttcaagcccttcaagggcggccccccccggcgcttctag

SEQ ID NO: 16863 - DNA, 552 bp, Artificial Sequence
  Description of Artificial Sequence: Synthetic coding sequence
atgaatggcttcagcacagaggaggacagccgggagggccccccagctgccccagctgctgctgcccctggctacggccagagctgctgcctgattgaagatggagagcgctgtgtgcggcctgctggaaatgccagcttcagcaagagggtgcagaagagcatcagccagaagaagctgaagctggacatcgacaagtctgtgcgccacctgtacatctgtgacttccacaagaacttcatccagagcgtgaggaacaagaggaagaggaagaccagtgatgatggaggagacagccctgagcatgacacagacatccctgaggtggacctcttccagctgcaggtgaacaccctgcggcgctacaagaggcactacaagctgcagacccggcccggcttcaacaaggcccagctggccgagaccgtgagccgccacttcaggaacatccctgtgaatgagaaggagaccctggcctacttcatctacatggtgaagagcaacaagagccggctggaccagaagtctgagggcggcaagcagctggagtag

SEQ ID NO: 16864 - DNA, 414 bp, Artificial Sequence
  Description of Artificial Sequence: Synthetic coding sequence
atgaatggcttcagcacagaggaggacagccgggagggccccccagctgccccagctgctgctgcccctggctacggccagagctgctgcctgattgaagatggagagcgctgtgtgcggcctgctggaaatgccagcttcagcaagagggtgcagaagagcatcagccagaagaagctgaagctggacatcgacaagagcctgcaggtgaacaccctgcggcgctacaagaggcactacaagctgcagacccggcccggcttcaacaaggcccagctggccgagaccgtgagccgccacttcaggaacatccctgtgaatgagaaggagaccctggcctacttcatctacatggtgaagagcaacaagagccggctggaccagaagtctgagggcggcaagcagctggagtag

SEQ ID NO: 16865 - DNA, 429 bp, Artificial Sequence
  Description of Artificial Sequence: Synthetic coding sequence
atgaatggcttcagcacagaggaggacagccgggagggccccccagctgccccagctgctgctgcccctggctacggccagagctgctgcctgattgaagatggagagcgctgtgtgcggcctgctggaaatgccagcttcagcaagagggtgcagaagagcatcagccagaagaagctgaagctggacatcgacaagtctgtggacctcttccagctgcaggtgaacaccctgcggcgctacaagaggcactacaagctgcagaccaggcctggcttcaacaaggcccagctggccgagaccgtgagccgccacttcaggaacatccctgtgaatgagaaggagaccctggcctacttcatctacatggtgaagagcaacaagagccggctggaccagaagtctgagggcggcaagcagctggagtag

SEQ ID NO: 16866 - DNA, 540 bp, Artificial Sequence
  Description of Artificial Sequence: Synthetic coding sequence
atggccgccacagagcccatcctggccgccaccggcagccctgctgctgtgcccccagagaagctggagggcgccggcagcagcagcgcccctgagaggaactgtgtgggcagcagcctgcctgaggccagccccccagcccctgagcccagcagccccaatgctgctgtgcctgaggccatccccacccccagggctgctgccagcgctgccctggagctgcccctgggccctgcccctgtgtctgtggccccccaggccgaggccgaggcccggagcaccccaggccctgctggcagccggctgggccctgagaccttccggcagcgcttccggcagttccgctaccaggatgctgctggcccccgggaggccttccggcagctgcgggagctgagccggcagtggctgcggccagacatccgcaccaaggagcagatcgtggagatgctggtgcaggagcagctgctggccatcctgcctgaggccgcccgggcccggcgcatcagaagaagaacagatgtgcgcatcaccggctag

SEQ ID NO: 16867 - DNA, 540 bp, Artificial Sequence; identical to SEQ ID NO: 16866
  Description of Artificial Sequence: Synthetic coding sequence

SEQ ID NO: 16868 - DNA, 3978 bp, Artificial Sequence
  Description of Artificial Sequence: Synthetic coding sequence
atggaggccgtgtccagggtcttccctgccctggccggccaggcccctgaggagcagggcgagatcatcaaggtgaaggtgaaggaggaggaccacacctgggaccaggagagcgccctgcggaggaacctgagctacacccgggagctgagccggcagcgcttccggcagttctgctaccaggagaccccaggcccccgggaggccctgagccagctgcgggagctgtgccggcagtggctgaaccctgagatccacaccaaggagcagatcctggagctgctggtgctggagcagttcctgaccatcctgcctgaggagctgcagagctgggtgcgggagcacaaccctgagagcggggaggaggtggtgaccctgctggaggacctggagcgggagctggatgagccccggcagcaggtgtcccagggcacctacggccaggaggtgtccatggaggagatgatccccctggacagcgccaaggagagcctgggcacccagctgcagagcatggaggacaggatggagtgtgagagccctgagccccaccccctgcaggacaatggcagcttcctgtggttctccatgatgagccagagcatgggcggggacaacctgagcagcctggacaccaatgaagctgagattgagcctgagaacatgagggagaagttcttccgcagcctggcccggctgctggagaacaagagcaacaacaccaagatcttcagcaaggccaagtactgccagctgatcaaggaggtgaaggaggccaaggccaaggccaagaaggagagcgtggactacagaaggctggccaggtttgatgtgatcctggtgcagggcaatgagaagctgattgaggccgtgaatggagaaacagacaagatccgctactacctgcacagcgaggacctgtttgacatcctgcacaacacccacctgagcatcggccacggcggccgcaccaggatggagaaggagctgcaggccaagtacaagaacatcaccaaggaggtgatcatgctgtacctgaccctgtgcaagccctgccagcagaagaacagcaagctgaagaaggtgctgaccagcaagagcatcaaggaggtgagcagccgctgccaggtggacctgattgacatgcagctgaacccagatggagagtaccgcttcatcctgcactaccaggacctgtgcaccaagctgaccttcctgcggagcctgaagagcaagaggcccacagaggtggcccacgccctgctggacatcttcaccatcatcggggcccccagcgtgctgcagagcgacaatggccgggagttcagcagccaggtggtgtctgagctgagcaacatctggccagagctgaagatcgtgcacggcaagagccagacctgccagagccagagcagcgctgagcagacagaggacatcaggaagaggatcttctcctggatgcagaccaacaacagcagccactggacagagttcctgtggttcatccagatgagccagaaccagccctaccaccgctccatgcagcagaccccctgtgagagcgccttcagcagcgaggccaagctgggcctgagccacagccagctgacagaggagctggtggccagcctgcacacagaaaatgagctggaccaggccgacaaggagctggagaacaccctgcgggcccagtatgaagaaaatattgaaacaggaacagacagcagtgacatcgaggagaacctgtctgtgacccccaaggtggccgagaagagccccccagagagccggctgcgcttcctgagctgtgtggtgtgtgagaaggaatgtactggagtgaacagctgcatcagctgtgatggcaacatccacgccatctgtggggtgcccagccagcacggcacagagggctgcggccggcagatcacctgcagcctgtgctatgagaccagcaccatgaagaggaagcatgatgagatccagaggagcctgcctgtgaagcccagcaagatgctgaagcccagcggcacccccttctccccagacaaggtgggggactggatggccaagcaggccagcctggacttctttgtgaagaagagacatgccttcagcgagcacagcagcagcaacaagagaaatgtgaacaacagaagctacccagaggagggcaagaccaagagggtgcacgccagcttcaccaggaaatatgaccccagctacatcgagtttggatttgtggccgtgattgatggagaggtgctgaagccccagtgcatcatctgtggagatgtgctggccaatgaggccatgaagcccagcaagctgaagaggcacctgtacagcaagcacaaggagatcagcagccagcccaaggagttctttgagaggaagagcagcgagctgaagagccagcccaagcaggtgttcaacgtgagccacatcaacatcagcgccctgcgggccagctacaaggtggccctgcctgtggccaagagcaagaccccctacaccatcgccgagaccctggtgaaggactgcatcaaggaggtgtgcctggagatgctgggggagagcgctgccaagaaggtggcccaggtgcccctgagcaatgacaccatcgcccggcgcatccaggagctggccaatgacatggaggaccagctgattgagcagatcaagctggccaagtacttcagcctgcagctggatgaatgtcgggacatcgccaacatgatcatcctgctggtgtatgtgcgctttgaacatgatgatgacatcaaggaggagttcttcttcagcgccagcctgcccaccaacaccaccagcagcgagctgtatgaagctgtgaagaactacatcgtgaacaagtgtggcctggagttcaagttctgtgtgggcgtgtgcagtgatggagctgcctccatgaccgggaagcacagcgaggtggtgacccagatcaaggagctggcccctgagtgcaagaccacccactgcttcatccaccgggagagcctggccatgaagaagatctctgctgagctgaacagcgtgctgaatgacatcgtgaagatcgtgaactacatcaagagcaacagcctgaacagccgcctcttcagcctgctgtgtgacaacatggaggccgaccacaagcagctgctgctgcatgctgagatccgctggctgagccggggcaaggtgctgagcaggatgtttgagatcagaaatgagctgctggtgttcctgcagggcaagaagcccatgtggagccagctgttcaaggatgtgaactggacagcccggctggcctacctgagtgacatcttcagcatcttcaatgacctgaatgcctccatgcagggcaagaatgccacctacttctccatggctgacaaggtggagggccagaagcagaagctggaggcctggaagaaccgcatcagcacagactgctatgacatgttccacaacctgaccaccatcatcaatgaggtgggcaatgacctggacatcgcccacctgaggaaggtgatcagcgagcacctgaccaacctgctggagtgctttgagttctacttccccagcaaagaagaccccagaattggcaacctgtggatccagaaccccttcctgagcagcaaggacaacctgaacctgactgtgaccctgcaggacaagctgctgaagctggccacagatgagggcctgaagatcagctttgaaaatacagccagcctgcccagcttctggatcaaggccaagaatgactacccagagctggccgagatcgccctgaagctgctgctgctcttccccagcacctacctgtgtgaaacaggcttcagcaccctgagcgtcatcaagaccaagcacaggaacagcctgaacatccactaccccctgcgggtggccctgagcagcatccagccccggctggacaagctgaccagcaagaagcaggcccacctgagccactag

SEQ ID NO: 16869 - DNA, 2706 bp, Artificial Sequence
  Description of Artificial Sequence: Synthetic coding sequence
atggaggccaaccagtgccccctggtggtggagcccagctacccagacctggtgatcaacgtgggggaggtgaccctgggggaggagaacaggaagaagctgcagaagatccagagggaccaggagaaggagcgggtgatgagagctgcctgtgccctgctgaacagcggcggcggcgtcatccgcatggccaagaaggtggagcaccctgtggagatgggcctggacctggagcagagcctgcgggagctgatccagagcagtgacctgcaggccttctttgagaccaagcagcagggccgctgcttctacatctttgtgaagtcctggagcagcggccccttcccagaagatagatctgtgaagccccggctgtgcagcctgagcagcagcctgtaccgccgctctgagacctctgtgcgctccatggacagccgggaggccttctgcttcctgaagaccaagaggaagcccaagatcctggaggagggccccttccacaagatccacaagggcgtgtaccaggagctgcccaacagcgaccctgctgaccccaacagcgaccctgctgacctgatcttccagaaggactacctggagtatggagagatcctgcccttccctgagagccagctggtggagttcaagcagttcagcaccaagcacttccaggagtatgtgaagaggaccatcccagaatatgtgcctgcctttgccaacacaggaggcggctacctgttcatcggcgtggatgacaagagccgggaggtgctgggctgtgccaaggaaaatgtggaccctgacagcctgcggaggaagattgagcaggccatctacaagctgccctgtgtgcacttctgccagccccagaggcccatcaccttcaccctgaagatcgtgaatgtgctgaagagaggagagctgtatggctacgcctgcatgatccgggtgaaccccttctgctgtgctgtgttcagcgaggcccccaacagctggatcgtggaggacaagtatgtgtgcagcctgaccacagagaagtgggtgggcatgatgacagacacagatcctgacctgctgcagctgtctgaagattttgagtgccagctgagcctgagcagcggcccccccctgagcaggcctgtgtacagcaagaagggcctggagcacaagaaggagctgcagcagctgctcttctctgtgcccccaggctacctgcgctacaccccagagagcctgtggagggacctgatcagcgagcaccggggcctggaggagctgatcaacaagcagatgcagcccttcttccggggcatcctgatcttcagccgctcctgggccgtggacctgaacctgcaggagaagccaggagtcatctgtgatgccctgctgattgcccagaacagcacccccatcctgtacaccatcctgcgggagcaggatgctgagggccaggactactgcaccaggacagccttcaccctgaagcagaagctggtgaacatgggcggctacacaggcaaggtgtgtgtgcgggccaaggtgctgtgcctgagccctgagagcagcgctgaggccctggaggccgctgtgagccccatggactacccagccagctacagcctggccggcacccagcacatggaggccctgctgcagagcctggtgattgtgctgctgggcttccgcagcctgctgagtgaccagctgggctgtgaggtgctgaacctgctgacagcccagcagtatgagatcttcagccgcagcctgaggaagaaccgggagctgtttgtgcacggcctgcccggcagcggcaagaccatcatggccatgaagatcatggagaagatcagaaatgtgttccactgtgaggcccaccgcatcctgtatgtgtgtgagaaccagcccctgaggaacttcatcagtgacaggaacatctgcagagctgagaccaggaagaccttcctgagagaaaattttgagcacatccagcacatcgtgattgatgaggcccagaacttcagaacagaagatggagactggtacggcaaggccaagagcatcacccggcgggccaagggcggccctggcatcctgtggatcttcctggactacttccagaccagccacctggactgcagcggcctgccccccctgagtgaccagtacccccgggaggagctgacccgcatcgtgagaaatgctgaccccatcgccaagtacctgcagaaggagatgcaggtgatccgcagcaaccccagcttcaacatccccaccggctgcctggaggtgtttcctgaggccgagtggagccagggcgtgcagggcaccctgcgcatcaagaagtacctgactgtggagcagatcatgacctgtgtggccgacacctgccgccgcttctttgaccggggctacagccccaaggatgtggccgtgctggtgtccacagccaaggaggtggagcactacaagtatgagctgctgaaggccatgaggaagaagagggtggtgcagctgagtgatgcctgtgacatgctgggggaccacatcgtgctggacagcgtgcggcgcttcagcggcctggagaggagcatcgtgtttggcatccaccccaggacagctgaccctgccatcctgcccaacgtgctgatctgcctggccagccgggccaagcagcacctgtacatcttcccctggggcggccactag

SEQ ID NO: 16870 - DNA, 2706 bp, Artificial Sequence; identical to SEQ ID NO: 16869
  Description of Artificial Sequence: Synthetic coding sequence

SEQ ID NO: 16871 - DNA, 273 bp, Artificial Sequence
  Description of Artificial Sequence: Synthetic coding sequence
atggaggccaaccagtgccccctggtggtggagcccagctacccagacctggtgatcaacgtgggggaggtgaccctgggggaggagaacaggaagaagctgcagaagatccagagggaccaggagaaggagcgggtgatgagagctgcctgtgccctgctgaacagcggcggcggcgtcatccgcatggccaagaaggtggagcaccctgtggagatgggcctggacctggagcagagcctgcgggagctgatccagagcagtgacctgtag

SEQ ID NO: 16872 - DNA, 273 bp, Artificial Sequence; identical to SEQ ID NO: 16871
  Description of Artificial Sequence: Synthetic coding sequence

SEQ ID NO: 16873 - DNA, 273 bp, Artificial Sequence; identical to SEQ ID NO: 16871
  Description of Artificial Sequence: Synthetic coding sequence

SEQ ID NO: 16874 - DNA, 606 bp, Artificial Sequence
  Description of Artificial Sequence: Synthetic coding sequence
atgagctttgccaccctgcggcctgcccctcctggccgctacctgtacccagaggtgagccccctgtctgaagatgaggaccggggcagtgacagcagcggcagtgatgagaagccctgccgggtgcacgccgcccgctgtggcctgcagggcgcccggcggcgggccggcggcagaagagctgggggcggcggccctgggggccggcccggccgggagccccggcagaggcacacagccaatgcccgggagcgggacaggaccaacagcgtgaacacagccttcaccgccctgcggaccctcatccccacagagcctgctgacaggaagctgagcaagattgagaccctgcggctggccagcagctacatcagccacctgggcaatgtgctgctggccggggaggcctgtggagatggccagccctgccacagcggccctgccttcttccacgccgcccgggccggcagccccccacctcctcctcctcctcctccagccagagatggagagaacacccagcccaagcagatctgcaccttctgcctgagcaaccagaggaagctgagcaaggaccgggacaggaagacagccatccgctcctag

SEQ ID NO: 16875 - DNA, 2472 bp, Artificial Sequence
  Description of Artificial Sequence: Synthetic coding sequence
atgaatggagagcagcagctggatgctgatgctggcagcggcatggaggaggtggagctgtcctgggaggactacctggaggagaccggcagcacagctgtgccctacggcagcttcaagcacgtggacacccggctgcagaatggatttgcccctggcatgaagctggaggtggccgtgaggacagatcctgagacctactgggtggccaccgtcatcaccacctgtgagcagctgctgctgctgcgctatgatggctatggagaagatagaagagctgacttctggtgtgacatcaggaaggctgacctgtaccccatcggctggtgtgagcagaacaagaagaccctggaggcccctgagggcatccgggacaaggtgtctgactgggatgagttcctgcggcagaccctgattggagcctgcagcccccctgtgcccctgctggagggcctgagaaatggaagaaaccccctggacctgattgcccctggcagccggctggagtgccaggccttccaggacagcctgagcacctggatcgtgacagtggtggagaacatcggcggccgcctgaagctgcgctatgagggcctggagagcagtgacaactatgagcactggctgtactacctggaccccttcctgcaccacgtgggctgggccgcccagcagggctatgagctgcagcccccatctgccatccgccacctgaagaatgaggccgagtggcaggagatcctggccaaggtgaaggaggaggaggaggagcccctgcccagctacctgttcaaggacaagcaggtgattggcatccacaccttctctgtgaacatgaagctggaggccgtggacccctggagccccttcggcatcagccctgccaccgtggtgaaggtgtttgatgagaagtacttcctggtggagatggatgacctgcggcctgagaaccacgcccggcgcagctttgtgtgccacgccgacagccctggcatcttccctgtgcagtggagcctgaagaatggcctgcacatcagccccccacctggctaccccagccaggactttgactgggccgactacctgaagcagtgtggggctgaggccgccccccagcgctgcttccccccactcatcagcgagcacgagttcaaggagaacatgaagctggaggccgtgaaccccatcctgcctgaggaggtgtgtgtggccaccatcacagctgtgcggggcagctacctgtggctgcagctggagggcagcaagaagcccatcccagaatgtattgtgtctgtggagagcatggacatcttccccctgggctggtgtgagaccaacggccaccccctgagcaccccccggcgggcccgggtgtacaagcagaggaagattgctgtggtgcagcctgagaagcaggtgcccagcagcaggacagtgcatgagggcctgaggaaccaggagctgaacagcacagaatctgtgatgatcaatggcaagtactgctgccccaagatctacttcaaccaccgctgcttcagcggcccctacctgaacaagggcagaattgctgagctgccccagtgtgtgggccctggcaactgtgtgctggtgctgcgggaggtgctgaccctgctgatcaatgctgcctacaagcccagccgggtgctgcgggagctgcagctggacaaggacagcgtgtggcacggctgtggggaggtgctgaaggccaagtacaagggcaagagctaccgggccaccgtggagatcgtgaagacagctgacagagtgacagagttctgccggcagacctgcatcaagctggagtgctgccccaacctgtttggccccaggatggtgctggacaagtgcagcgagaactgcagcgtgctgaccaagaccaagtacacccactactacggcaagaagaagaacaagagaattggccggcccccaggcggccacagcaacctggcctgtgccctgaagaaggccagcaagaggaggaagaggaggaagaatgtgtttgtgcacaagaagaagaggagcagcgcctctgtggacaacaccccagctggcagcccccagggcagcggcggggaggatgaagatgatcctgatgaaggagatgatgacagcctgtctgagggcagcaccagcgagcagcaggatgagctgcaggaggagagcgagatgtctgagaagaagagctgcagcagcagccccacccagagcgagatcagcaccagcctgcccccagaccggcagaggaggaagcgggagctgcggaccttctccttcagtgatgatgagaacaagccacccagccccaaggagattgatggccaggccctgctgctgctgaccctgcccaccgtgcaggagtgcatggacctgaagctgggccctgccatcaagctgtgccaccacatcgagcgcatcaagtttgccttctatgagcagtttgccaactag

SEQ ID NO: 16876 - DNA, 2601 bp, Artificial Sequence
  Description of Artificial Sequence: Synthetic coding sequence
atgaatggagagcagcagctggatgctgatgctggcagcggcatggaggaggtggagctgtcctgggaggactacctggaggagaccggcagcacagctgtgccctacggcagcttcaagcacgtggacacccggctgcagaatggatttgcccctggcatgaagctggaggtggccgtgaggacagatcctgagacctactgggtggccaccgtcatcaccacctgtgagcagctgctgctgctgcgctatgatggctatggagaagatagaagagctgacttctggtgtgacatcaggaaggctgacctgtaccccatcggctggtgtgagcagaacaagaagaccctggaggcccctgagggcatccgggacaaggtgtctgactgggatgagttcctgcggcagaccctgattggagcctgcagcccccctgtgcccctgctggagggcctgagaaatggaagaaaccccctggacctgattgcccctggcagccggctggagtgccaggccttccaggacagcctgagcacctggatcgtgacagtggtggagaacatcggcggccgcctgaagctgcgctatgagggcctggagagcagtgacaactatgagcactggctgtactacctggaccccttcctgcaccacgtgggctgggccgcccagcagggctatgagctgcagcccccatctgccatccgccacctgaagaatgaggccgagtggcaggagatcctggccaaggtgaaggaggaggaggaggagcccctgcccagctacctgttcaaggacaagcaggtgattggcatccacaccttctctgtgaacatgaagctggaggccgtggacccctggagccccttcggcatcagccctgccaccgtggtgaaggtgtttgatgagaagtacttcctggtggagatggatgacctgcggcctgagaaccacgcccggcgcagctttgtgtgccacgccgacagccctggcatcttccctgtgcagtggagcctgaagaatggcctgcacatcagccccccacctggctaccccagccaggactttgactgggccgactacctgaagcagtgtggggctgaggccgccccccagcgctgcttccccccactcatcagcgagcacgagttcaaggagaacatgaagctggaggccgtgaaccccatcctgcctgaggaggtgtgtgtggccaccatcacagctgtgcggggcagctacctgtggctgcagctggagggcagcaagaagcccatcccagaatgtattgtgtctgtggagagcatggacatcttccccctgggctggtgtgagaccaacggccaccccctgagcaccccccggcgggcccgggtgtacaagcagaggaagattgctgtggtgcagcctgagaagcaggtgcccagcagcaggacagtgcatgagggcctgaggaaccaggagctgaacagcacagaatctgtgatgatcaatggcaagtactgctgccccaagatctacttcaaccaccgctgcttcagcggcccctacctgaacaagggcagaattgctgagctgccccagtgtgtgggccctggcaactgtgtgctggtgctgcgggaggtgctgaccctgctgatcaatgctgcctacaagcccagccgggtgctgcgggagctgcagctggacaaggacagcgtgtggcacggctgtggggaggtgctgaaggccaagtacaagggcaagagctaccgggccaccgtggagatcgtgaagacagctgacagagtgacagagttctgccggcagacctgcatcaagctggagtgctgccccaacctgtttggccccaggatggtgctggacaagtgcagcgagaactgcagcgtgctgaccaagaccaagtacacccactactacggcaagaagaagaacaagagaattggccggcccccaggcggccacagcaacctggcctgtgccctgaagaaggccagcaagaggaggaagaggaggaagaatgtgtttgtgcacaagaagaagaggagcagcgcctctgtggacaacaccccagctggcagcccccagggcagcggcggggaggatgaagatgatcctgatgaaggagatgatgacagcctgtctgagggcagcaccagcgagcagcaggatgagctgcaggaggagagcgagatgtctgagaagaagagctgcagcagcagccccacccagagcgagatcagcaccagcctgcccccagaccggcagaggaggaagcgggagctgcggaccttctccttcagtgatgatgagaacaagccacccagccccaaggagatcagaattgaggtggccgagcggctgcacctggacagcaaccccctgaagtggagcgtggctgatgtggtgcgcttcatccgcagcacagactgtgcccccctggcccgcatcttcctggaccaggagattgatggccaggccctgctgctgctgaccctgcccaccgtgcaggagtgcatggacctgaagctgggccctgccatcaagctgtgccaccacatcgagcgcatcaagtttgccttctatgagcagtttgccaactag

SEQ ID NO: 16877 - DNA, 2601 bp, Artificial Sequence; identical to SEQ ID NO: 16876
  Description of Artificial Sequence: Synthetic coding sequence

SEQ ID NO: 16878 - DNA, 2601 bp, Artificial Sequence; identical to SEQ ID NO: 16876
  Description of Artificial Sequence: Synthetic coding sequence

SEQ ID NO: 16879 - DNA, 366 bp, Artificial Sequence
  Description of Artificial Sequence: Synthetic coding sequence
atgaatggagagcagcagctggatgctgatgctggcagcggcatggaggaggtggagctgtcctgggaggactacctggaggagaccggcagcacagctgtgccctacggcagcttcaagcacgtggacacccggctgcagaatggatttgcccctggcatgaagctggaggtggccgtgaggacagatcctgagacctactgggtggccaccgtcatcaccacctgtgagcagctgctgctgctgcgctatgatggctatggagaagatagaagagctgacttctggtgtgacatcaggaaggctgacctgtaccccatcggctggtgtgagcagaacaagaagaccctggaggcccctgagtag

SEQ ID NO: 16880 - DNA, 285 bp, Artificial Sequence
  Description of Artificial Sequence: Synthetic coding sequence
atgaatggagagcagcagctggatgctgatgctggcagcggcatggaggaggtggagctgtcctgggaggactacctggaggagaccggcagcacagctgtgccctacggcagcttcaagcacgtggacacccggctgcagaatggatttgcccctggcatgaagctggaggtggccgtgaggacagatcctgagacctactgggtggccaccgtcatcaccacctgtgagcagctgctgctgctgcgctatgatggctatggagaagatagaagagctgactag

SEQ ID NO: 16881 - DNA, 153 bp, Artificial Sequence
  Description of Artificial Sequence: Synthetic coding sequence
atgaatggagagcagcagctggatgctgatgctggcagcggcatggaggaggtggagctgtcctgggaggactacctggaggagaccggcagcacagctgtgccctacggcagcttcaagcacgtggacacccggctgcagaatggcttctag

SEQ ID NO: 16882 - DNA, 2685 bp, Artificial Sequence
  Description of Artificial Sequence: Synthetic coding sequence
atggagagcaccctgagcgccagcaacatgcaggaccccagcagcagccccctggagaagtgcctgggcagcgccaatggaaatggagacctggacagcgaggagggcagcagcctggaggagaccggcttcaactggggcgagtacctggaggagactggagccagcgctgccccccacaccagcttcaagcacgtggagatcagcatccagagcaacttccagcccggcatgaagctggaggtggccaacaagaacaacccagacacctactgggtggccaccatcatcaccacctgtggccagctgctgctgctgcgctactgcggctatggagaagatagaagagctgacttctggtgtgatgtggtgattgctgacctgcaccctgtgggctggtgcacccagaacaacaaggtgctgatgcccccagatgccatcaaggagaagtacacagactggacagagttcctgatccgggacctgaccggcagcaggacagccccagccaacctgctggagggccccctgcggggcaagggccccatcgacctgatcaccgtgggcagcctcatcgagctgcaggacagccagaaccccttccagtactggatcgtgtctgtgattgaaaatgtgggcggccgcctgcggctgcgctacgtgggcctggaggacacagagagctatgaccagtggctgttctacctggactaccgcctgcggcctgtgggctggtgccaggagaacaagtacaggatggaccccccatctgagatctaccccctgaagatggccagcgagtggaagtgcaccctggagaagagcctgattgatgctgccaagttccccctgcccatggaggtgttcaaggaccatgctgacctgcggagccacttcttcaccgtgggcatgaagctggagaccgtgaacatgtgtgagcccttctacatcagccctgcctctgtgaccaaggtgttcaacaaccacttcttccaggtgaccattgatgacctgcggcctgagcccagcaagctgtccatgctgtgccacgccgacagcctgggcatcctgcctgtgcagtggtgcctgaagaatggagtgtccctgaccccacccaagggctacagcggccaggactttgactgggccgactaccacaagcagcacggggcccaggaggccccacccttctgcttcaggaacaccagcttcagccggggcttcaccaagaacatgaagctggaggccgtgaaccccaggaaccctggagagctgtgtgtggcctctgtggtgtctgtgaagggccgcctgatgtggctgcacctggagggcctgcagacccctgtgcctgaggtgattgtggatgtggagagcatggacatcttccctgtgggctggtgtgaggccaacagctaccccctgacagccccccacaagacagtgtcccagaagaagaggaagattgctgtggtgcagcctgagaagcagctgccccccaccgtgcctgtgaagaagatcccccatgacctgtgcctcttcccccacctggacaccactggaacagtgaatggcaagtactgctgcccccagctgttcatcaaccaccgctgcttcagcggcccctacctgaacaagggcagaattgctgagctgccccagagcgtgggccctggaaaatgtgtgctggtgctgaaggaggtgctgtccatgatcatcaatgctgcctacaagccaggccgggtgctgcgggagctgcagctggtggaggacccccactggaacttccaggaggagaccctgaaggccaagtaccggggcaagacctacagagctgtggtgaagatcgtgaggaccagtgaccaggtggccaacttctgcagaagagtgtgtgccaagctggagtgctgccccaacctcttcagccctgtgctgatcagcgagaactgcccagagaactgcagcatccacaccaagaccaagtacacctactactacggcaagaggaagaagatcagcaagccacccatcggggagagcaacccagattctggccaccccaagccagcccggcggaggaagaggaggaagagcatctttgtgcagaagaagaggaggagcagcgctgtggacttcaccgctggcagcggggaggagagcgaggaggaggatgctgatgccatggatgatgacacagccagcgaggagaccggcagcgagctgagagatgaccagacagacaccagcagcgctgaggtgcccagcgcccggccccggcgggctgtgaccctgcggagcggcagcgagcctgtgagaagacctcctcctgagaggacccggcggggccgcggggccccagctgccagcagcgctgaggagggggagaagtgcccccccaccaagccagagggcacagaggacaccaagcaggaggaggaggagcggctggtgctggagagcaaccccctggagtggacagtgacagatgtggtgcgcttcatcaagctgacagactgtgcccccctggccaagatcttccaggagcaggacattgatggccaggccctgctgctgctgaccctgcccaccgtgcaggagtgcatggagctgaagctgggccctgccatcaagctgtgccaccagatcgagcgggtgaaggtggccttctacgcccagtatgccaactag

SEQ ID NO: 16883 - DNA, 483 bp, Artificial Sequence
  Description of Artificial Sequence: Synthetic coding sequence
atggagagcaccctgagcgccagcaacatgcaggaccccagcagcagccccctggagaagtgcctgggcagcgccaatggaaatggagacctggacagcgaggagggcagcagcctggaggagaccggcttcaactggggcgagtacctggaggagactggagccagcgctgccccccacaccagcttcaagcacgtggagatcagcatccagagcaacttccagcccggcatgaagctggaggtggccaacaagaacaacccagacacctactgggtggccaccatcatcaccacctgtggccagctgctgctgctgcgctactgcggctatggagaagatagaagagctgacttctggtgtgatgtggtgattgctgacctgcaccctgtgggctggtgcacccagaacaacaaggtgctgatgcccccagatgtggagagtgatgtgaagcccagcgcctctgtgcagcacatctcctag

SEQ ID NO: 16884 - DNA, 561 bp, Artificial Sequence
  Description of Artificial Sequence: Synthetic coding sequence
atggagagcaccctgagcgccagcaacatgcaggaccccagcagcagccccctggagaagtgcctgggcagcgccaatggaaatggagacctggacagcgaggagggcagcagcctggaggagaccggcttcaactggggcgagtacctggaggagactggagccagcgctgccccccacaccagcttcaagcacgtggagatcagcatccagagcaacttccagcccggcatgaagctggaggtggccaacaagaacaacccagacacctactgggtggccaccatcatcaccacctgtggccagctgctgctgctgcgctactgcggctatggagaagatagaagagctgacttctggtgtgatgtggtgattgctgacctgcaccctgtgggctggtgcacccagaacaacaaggtgctgatgcccccagatgccatcaaggagaagtacacagactggacagagttcctgatccgggacctgaccggcagcaggacagccccagccaacctgctggagggcgtgtgcatcgtggtgatccacctgatgtacctgtag

SEQ ID NO: 16885 - DNA, 483 bp, Artificial Sequence; identical to SEQ ID NO: 16883
  Description of Artificial Sequence: Synthetic coding sequence

SEQ ID NO: 16886 - DNA, 2685 bp, Artificial Sequence; identical to SEQ ID NO: 16882
  Description of Artificial Sequence: Synthetic coding sequence

SEQ ID NO: 16887 - DNA, 924 bp, Artificial Sequence
  Description of Artificial Sequence: Synthetic coding sequence
atgcccaggagcttcctggtgaagaagatcaagggagatggcttccagtgcagcggcgtgcctgcccccacctaccaccccctggagacagcctacgtgctgcccggggcccggggccccccaggggacaatggctacgccccccaccggctgccccccagcagctatgatgctgaccagaagccaggcctggagctggccccagctgagcccgcctaccccccagctgcccctgaggagtacagcgaccctgagagcccccagagcagcctgagcgcccgctacttccggggggaggccgctgtgacagacagctacagcatggatgccttcttcatcagtgatggccgcagcagaagaagaagaggaggcggcggcggagatgctgggggcagcggagatgctggaggagctgggggccgggccggccgggccggggcccaggccggcggcggccacagacatgcctgtgctgaatgtgggaagacctacgccaccagcagcaacctgagccgccacaagcagacccacaggagcctggacagccagctggccaggaaatgtcccacctgtgggaaggcctacgtgtccatgcctgccctggccatgcacctgctgacccacaacctgcggcacaagtgtggggtgtgtgggaaggccttcagccggccctggctgctgcagggccacatgaggagccacactggagagaagcccttcggctgtgcccactgcggcaaggcctttgctgacaggagcaacctgcgggcccacatgcagacccacagcgccttcaagcactaccgctgccggcagtgtgacaagagctttgccctgaagagctacctgcacaagcactgtgaggccgcctgtgccaaggctgctgagcccccaccacccaccccagctggccctgccagctag

SEQ ID NO: 16888 - DNA, 2064 bp, Artificial Sequence
  Description of Artificial Sequence: Synthetic coding sequence
atgagcaacagaaacaacaacaagctgcccagcaacctgccccagctgcagaacctgatcaagagggaccccccagcctacatcgaggagttcctgcagcagtacaaccactacaagagcaatgtggagatcttcaagctgcagcccaacaagcccagcaaggagctggccgagctggtgatgttcatggcccagatcagccactgctacccagagtacctgagcaacttcccccaggaggtgaaggacctgctgagctgcaaccacacagtgctggaccctgacctgaggatgaccttctgcaaggccctgatcctgctgaggaacaagaacctgatcaaccccagcagcctgctggagctgttctttgagctgttccgctgccacgacaagctgctgaggaagaccctgtacacccacatcgtgacagacatcaagaacatcaatgccaagcacaagaacaacaaggtgaatgtggtgctgcagaacttcatgtacaccatgctgcgggacagcaatgccacagctgccaagatgagcctggatgtgatgattgagctgtacagaagaaacatctggaatgatgccaagacagtgaatgtcatcaccacagcctgcttcagcaaggtgaccaagatcctggtggccgccctgaccttcttcctgggcaaggatgaagatgagaagcaggacagcgacagcgagagtgaagatgatggccccacagcccgggacctgctggtgcagtatgccaccgggaagaagagcagcaagaacaagaagaagctggagaaggccatgaaggtgctgaagaagcagaagaagaagaagaagccagaggtgttcaacttcagcgccatccacctgattcatgacccccaggactttgctgagaagctgctgaagcagctggagtgctgcaaggagagatttgaggtgaagatgatgctgatgaacctgatcagccggctggtgggcatccacgagctgttcctgttcaacttctaccccttcctgcagcgcttcctgcagccccaccagcgggaggtgaccaagatcctgctgtttgctgcccaggccagccaccacctggtgcccccagagatcatccagagcctgctgatgacagtggccaacaactttgtgacagacaagaacagcggggaggtgatgacagtgggcatcaatgccatcaaggagatcacagcccgctgccccctggccatgacagaggagctgctgcaggacctggcccagtacaagacccacaaggacaagaatgtgatgatgtctgcccggaccctcatccacctgttccgcaccctgaacccccagatgctgcagaagaagttccggggcaagcccacagaggccagcattgaggcccgggtgcaggagtatggagagctggatgccaaggactacatccctggagctgaggtgctggaggtggagaaggaggagaatgcagaaaatgatgaagatggctgggagagcaccagcctgtctgaggaggaggatgctgatggagagtggattgatgtgcagcacagcagtgatgaggagcagcaggagatcagcaagaagctgaacagcatgcccatggaggagaggaaggccaaggctgctgccatcagcaccagccgggtgctgacccaggaggacttccagaagatccgcatggcccagatgaggaaggagctggatgctgcccctgggaagagccagaagaggaagtacattgaaattgacagtgatgaggagcccagaggagagctgctgagcctgcgggacatcgagcggctgcacaagaagcccaagagtgacaaggagacccggctggccacagccatggccggcaagacagacaggaaggagtttgtgaggaagaagaccaagaccaaccccttcagcagcagcaccaacaaggagaagaagaagcagaagaacttcatgatgatgagatacagccagaatgtgcgcagcaagaacaagaggagcttccgggagaagcagctggccctgagagatgccctgctgaagaagaggaagaggatgaagtag

SEQ ID NO: 16889 - DNA, 786 bp, Artificial Sequence
  Description of Artificial Sequence: Synthetic coding sequence
atgagccgctacaccaggcctcccaacaccagcctcttcatcagaaatgtggctgatgccaccaggcctgaggacctgcggcgggagtttggccgctatggccccatcgtggatgtgtacatccccctggacttctacacccggcggccccggggctttgcctacgtgcagtttgaagatgtgagagatgctgaagatgccctgtacaacctgaacaggaagtgggtgtgtggccggcagatcgagatccagtttgcccagggcgacaggaagaccccaggccagatgaagagcaaggagcggcacccctgcagccccagcgaccaccggcgcagccgcagccccagccagaggaggaccaggagccgcagcagctcctggggcaggaacagaagaagaagtgacagcctgaaggagagccgccaccggcgcttctcctacagccagagcaagagccgcagcaagagcctgcccaggaggagcaccagcgcccggcagagcaggaccccaagaagaaactttggcagccggggccgcagccgcagcaagagcctgcagaagaggagcaagagcatcggcaagagccagagcagcagcccccagaagcagaccagcagcggcaccaagagccgcagccacggccgccacagcgacagcatcgcccggagcccctgcaagagccccaagggctacaccaacagcgagaccaaggtgcagacagccaagcacagccacttccgcagccacagccgcagccgcagctaccgccacaagaacagctggtag

SEQ ID NO: 16890 - DNA, 1245 bp, Artificial Sequence
  Description of Artificial Sequence: Synthetic coding sequence
atgatccccctggagaagccaggcagcggcggcagcagccctggggccaccagcggcagcggccgggccggccggggcctgagcggcccctgcaggcctcctcctccaccccaggcccggggcctgctgacagagatccgggctgtggtgaggacagagcccttccaggacggctacagcctgtgccccggccgggagctgggccggggcaagtttgctgtggtgaggaagtgcatcaagaaggacagcggcaaggagtttgctgccaagttcatgaggaagaggaggaagggccaggactgcaggatggagatcatccatgaaattgctgtgctggagctggcccaggacaacccctgggtgatcaacctgcacgaggtgtatgaaacagccagcgagatgatcctggtgctggagtatgctgctggaggagagatctttgaccagtgtgtggccgaccgggaggaggccttcaaggagaaggatgtgcagaggctgatgaggcagatcctggagggcgtgcacttcctgcacaccagagatgtggtgcacctggacctgaagccccagaacatcctgctgaccagcgagagccccctgggggacatcaagatcgtggactttggcctgagccgcatcctgaagaacagcgaggagctgcgggagatcatgggcaccccagaatatgtggcccctgagatcctgtcctatgaccccatctccatggccacagacatgtggagcattggagtgctgacctacgtgatgctgaccggcatcagccccttcctgggcaatgacaagcaggagaccttcctgaacatcagccagatgaacctgagctacagcgaggaggagtttgatgtgctgtctgagagcgctgtggacttcatccgcaccctgctggtgaagaagccagaagatcgggccacagctgaggagtgcctgaagcacccctggctgacccagagcagcatccaggagcccagcttcaggatggagaaggccctggaggaggccaatgccctgcaggagggccacagcgtgcctgagatcaacagcgacacagacaagtctgagaccaaggagagcatcgtgacagaggagctgattgtggtgaccagctacaccctgggccagtgccggcagagcgagaaggagaagatggagcagaaggccatcagcaagcgcttcaagtttgaggagcccctgctgcaggagatccctggagagttcatctactag

SEQ ID NO: 16891 - DNA, 1062 bp, Artificial Sequence
  Description of Artificial Sequence: Synthetic coding sequence
atgagcctgcacacccagtacctggagagcttcctgcggagccagttctacatgctgaggatggatggccccctgcccctgccctaccgccactacatcgccatcatgaagctggtgaagacaggagagaacaactggagcctgcctgagctggtgcatgctgtggtgctgctggcccactaccacgccctggccagctttgtgtttggaagtggcatcaaccctgagcgggaccctgagatcagcaatggcttccgcctcatctctgtgaacaacttctgtgtgtgtgacctggccaatgacaacaacattgaaaatgccagcctgagcggcagcaactttggcatcgtggacagcctgtctgagctggaggccctgatggagaggatgaagaggctgcaggaggagcgggaggatgaggaggccagccaggaggagatgagcaccaggtttgagaaggagaagaaggagagcctgtttgtggtgtctggggacaccttccacagcttcccccacagcgactttgaagatgacatgatcatcaccagtgatgtgagccgctacatcgaggaccccggcttcggctatgaagattttgccaggagaggagaggagcacctgcccaccttccgggcccaggactacacctgggagaaccacggcttcagcctggtgaaccggctgtacagcgacatcggccacctgctggatgagaagttcaggatggtgtacaacctgacctacaacaccatggccacccatgaagatgtggacaccaccatgctgcggcgggccctcttcaactacgtgcactgcatgtttggcatccgctatgatgattatgactatggagaggtgaaccagctgctggagaggagcctgaaggtgtacatcaagacagtgacctgctacccagagaggaccaccaagaggatgtatgacagctactggaggcagttcaagcacagcgagaaggtgcacgtgaacctgctgctgatggaggccaggatgcaggccgagctgctgtatgccctgcgggccatcaccaggcacctgacctag

SEQ ID NO: 16892 - DNA, 954 bp, Artificial Sequence
  Description of Artificial Sequence: Synthetic coding sequence
atgaacagaggaggcggcagccccagcgctgctgccaactacctgctgtgcaccaactgcaggaaggtgctgaggaaggacaagaggatccgggtgtcccagcccctgacccggggccccagcgccttcatccctgagaaggaggtggtgcaggccaacacagtggatgagaggaccaacttcctggtggaggagtacagcaccagcggccgcctggacaacatcacccaggtgatgagcctgcacacccagtacctggagagcttcctgcggagccagttctacatgctgaggatggatggccccctgcccctgccctaccgccactacatcgccatcatggccgccgcccggcaccagtgcagctacctgatcaacatgcacgtggatgagttcctgaagacaggaggcattgctgagtggctgaatggcctggagtatgtgccccagaggctgaagaacctgaatgagatcaacaagctgctggcccaccggccctggctgatcaccaaggagcacatccagaagctggtgaagacaggagagaacaactggagcctgcctgagctggtgcatgctgtggtgctgctggcccactaccacgccctggccagctttgtgtttggcagcggcatcaaccctgagcgggaccctgagatcagcaatggcttccgcctcatctctgtgaacaacttctgtgtgtgtgacctggccaatgacaacaacattgaaaatgccagcctgagcggcagcaactttggaattgtggacagcctgtctgagctggaggccctgatggagaggatgaagaggctgcaggaggagagagaagatgaggaggccagccaggaggagatgagcaccaggtttgagaaggagaagaaggagagcctgtttgtggtgtctggggacaccttccacagcttcccccacagcggcctgctgaagtactag

SEQ ID NO: 16893 - DNA, 966 bp, Artificial Sequence
  Description of Artificial Sequence: Synthetic coding sequence
atgaacagaggaggcggcagccccagcgctgctgccaactacctgctgtgcaccaactgcaggaaggtgctgaggaaggacaagaggatccgggtgtcccagcccctgacccggggccccagcgccttcatccctgagaaggaggtggtgcaggccaacacagtggatgagaggaccaacttcctggtggaggagtacagcaccagcggccgcctggacaacatcacccaggtgatgagcctgcacacccagtacctggagagcttcctgcggagccagttctacatgctgaggatggatggccccctgcccctgccctaccgccactacatcgccatcatggccgccgcccggcaccagtgcagctacctgatcaacatgcacgtggatgagttcctgaagacaggaggcattgctgagtggctgaatggcctggagtatgtgccccagaggctgaagaacctgaatgagatcaacaagctgctggcccaccggccctggctgatcaccaaggagcacatccagaagctggtgaagacaggagagaacaactggagcctgcctgagctggtgcatgctgtggtgctgctggcccactaccacgccctggccagctttgtgtttggcagcggcatcaaccctgagcgggaccctgagatcagcaatggcttccgcctcatctctgtgaacaacttctgtgtgtgtgacctggccaatgacaacaacattgaaaatgccagcctgagcggcagcaactttggaattgtggacagcctgtctgagctggaggccctgatggagaggatgaagaggctgcaggaggagagagaagatgaggaggccagccaggaggagatgagcaccaggtttgagaaggagaagaaggagagcctgtttgtggtgtctggggacaccttccacagcttcccccacagcggggccttcctgcacttctttgccttctag

SEQ ID NO: 16894 - DNA, 1479 bp, Artificial Sequence
  Description of Artificial Sequence: Synthetic coding sequence
atgaacagaggaggcggcagccccagcgctgctgccaactacctgctgtgcaccaactgcaggaaggtgctgaggaaggacaagaggatccgggtgtcccagcccctgacccggggccccagcgccttcatccctgagaaggaggtggtgcaggccaacacagtggatgagaggaccaacttcctggtggaggagtacagcaccagcggccgcctggacaacatcacccaggtgatgagcctgcacacccagtacctggagagcttcctgcggagccagttctacatgctgaggatggatggccccctgcccctgccctaccgccactacatcgccatcatggccgccgcccggcaccagtgcagctacctgatcaacatgcacgtggatgagttcctgaagacaggaggcattgctgagtggctgaatggcctggagtatgtgccccagaggctgaagaacctgaatgagatcaacaagctgctggcccaccggccctggctgatcaccaaggagcacatccagaagctggtgaagacaggagagaacaactggagcctgcctgagctggtgcatgctgtggtgctgctggcccactaccacgccctggccagctttgtgtttggcagcggcatcaaccctgagcgggaccctgagatcagcaatggcttccgcctcatctctgtgaacaacttctgtgtgtgtgacctggccaatgacaacaacattgaaaatgccagcctgagcggcagcaactttggaattgtggacagcctgtctgagctggaggccctgatggagaggatgaagaggctgcaggaggagagagaagatgaggaggccagccaggaggagatgagcaccaggtttgagaaggagaagaaggagagcctgtttgtggtgtctggggacaccttccacagcttcccccacagcgactttgaagatgacatgatcatcaccagtgatgtgagccgctacattgaagatcctggcttcggctatgaggactttgcccggcggggggaggagcacctgcccaccttccgggcccaggactacacctgggagaaccacggcttcagcctggtgaacagactctacagcgacatcggccacctgctggatgagaagttcaggatggtgtacaacctgacctacaacaccatggccacccatgaagatgtggacaccaccatgctgcggcgggccctcttcaactacgtgcactgcatgtttggcatccgctatgatgattatgactatggagaggtgaaccagctgctggagaggagcctgaaggtgtacatcaagacagtgacctgctacccagagaggaccaccaagaggatgtatgacagctactggaggcagttcaagcacagcgagaaggtgcacgtgaacctgctgctgatggaggccaggatgcaggccgagctgctgtatgccctgcgggccatcaccaggcacctgacctag

SEQ ID NO: 16895 - DNA, 891 bp, Artificial Sequence
  Description of Artificial Sequence: Synthetic coding sequence
atgggcaagaagagccgggtgaagacccagaagagcggcaccggggccacagccaccgtgagccccaaggagatcctgaacctgaccagcgagctgctgcagaagtgcagcagccctgcccctggccctgggaaggagtgggaggagtatgtgcagatccgcaccctggtggagaagatcaggaagaagcagaagggcctgtctgtgacctttgatggcaagcgggaggactacttcccagacctgatgaagtgggcctctgaaaatggagcctctgtggagggctttgagatggtgaacttcaaggaggagggcttcggcctgcgggccacccgggacatcaaggccgaggagctgttcctgtgggtgcccaggaagctgctgatgacagtggagagcgccaagaacagcgtgctgggccccctgtacagccaggaccgcatcctgcaggccatgggcaacatcgccctggccttccacctgctgtgtgagcgggccagccccaacagcttctggcagccctacatccagaccctgcccagtgaatatgacacccccctgtactttgaagaagatgaggtgcgctacctgcagagcacccaggccatccatgatgtgttcagccagtacaagaacacagcccggcagtatgcctacttctacaaggtgatccagacccacccccacgccaacaagctgcccctgaaggacagcttcacctatgaggactaccgctgggccgtgtcctctgtgatgacccggcagaaccagatccccacagaagatggcagccgggtgaccctggccctgatccccctgtgggacatgtgcaaccacaccaacggcctgaccccagaggacagctttgccctggccgtggccagcgcctag

SEQ ID NO: 16896 - DNA, 1785 bp, Artificial Sequence
  Description of Artificial Sequence: Synthetic coding sequence
atgggcaagaagagccgggtgaagacccagaagagcggcaccggggccacagccaccgtgagccccaaggagatcctgaacctgaccagcgagctgctgcagaagtgcagcagccctgcccctggccctgggaaggagtgggaggagtatgtgcagatccgcaccctggtggagaagatcaggaagaagcagaagggcctgtctgtgacctttgatggcaagcgggaggactacttcccagacctgatgaagtgggcctctgaaaatggagcctctgtggagggctttgagatggtgaacttcaaggaggagggcttcggcctgcgggccacccgggacatcaaggccgaggagctgttcctgtgggtgcccaggaagctgctgatgacagtggagagcgccaagaacagcgtgctgggccccctgtacagccaggaccgcatcctgcaggccatgggcaacatcgccctggccttccacctgctgtgtgagcgggccagccccaacagcttctggcagccctacatccagaccctgcccagtgaatatgacacccccctgtactttgaagaagatgaggtgcgctacctgcagagcacccaggccatccatgatgtgttcagccagtacaagaacacagcccggcagtatgcctacttctacaaggtgatccagacccacccccacgccaacaagctgcccctgaaggacagcttcacctatgaggactaccgctgggccgtgtcctctgtgatgacccggcagaaccagatccccacagaagatggcagccgggtgaccctggccctgatccccctgtgggacatgtgcaaccacaccaacggcctcatcaccaccggctacaacctggaggatgacagatgtgaatgtgtggccctgcaggacttccgggccggggagcagatctacatcttctacggcaccaggagcaatgctgagtttgtgatccacagcggcttcttctttgacaacaacagccatgacagagtgaagatcaagctgggcgtgtccaagagtgaccggctgtatgccatgaaggccgaggtgctggcccgggccggcatccccaccagctctgtgtttgccctgcacttcacagagccccccatcagcgcccagctgctggccttcctgcgggtcttctgcatgacagaggaggagctgaaggagcacctgctgggggacagcgccatcgaccgcatcttcaccctgggcaacagcgagttccctgtgtcctgggacaatgaggtgaagctgtggaccttcctggaggaccgggccagcctgctgctgaagacctacaagaccaccatcgaggaggacaagtctgtgctgaagaaccacgacctgtctgtgcgggccaagatggccatcaagctgcggctgggggagaaggagatcctggagaaggctgtgaagtctgctgctgtgaaccgggagtactaccggcagcagatggaggagaaggcccccctgcccaagtatgaggagagcaacctgggcctgctggagagctctgtgggggacagccggctgcccctggtgctgaggaacctggaggaggaggccggcgtgcaggatgccctgaacatccgggaggccatcagcaaggccaaggccacagaaaatggcctggtgaatggagagaacagcatccccaacggcaccaggagtgaaaatgaaagcctgaaccaggagagcaagagagctgtggaggatgccaagggcagcagcagtgacagcacagctggggtgaaggagtag

SEQ ID NO: 16897 - DNA, 975 bp, Artificial Sequence
  Description of Artificial Sequence: Synthetic coding sequence
atgcctgagctggccgtgcagaaggtggtggtgcaccccctggtgctgctgtctgtggtggaccacttcaaccgcatcggcaaggtgggcaaccagaagagggtggtgggcgtgctgctgggctcctggcagaagaaggtgctggatgtgagcaacagctttgctgtgccctttgatgaagatgacaaggatgacagcgtgtggttcctggaccatgactacctggagaacatgtatggcatgttcaagaaggtgaatgcccgggagagaattgtgggctggtaccacacaggccccaagctgcacaagaatgacatcgccatcaatgagctgatgaagcgctactgccccaacagcgtgctggtgatcattgatgtgaagcccaaggacctgggcctgcccacagaggcctacatctctgtggaggaggtgcatgatgatggcacccccaccagcaagacctttgaacatgtgaccagcgagatcggggctgaggaggccgaggaggtgggcgtggagcacctgctgcgggacatcaaggacaccaccgtgggcaccctgagccagaggatcaccaaccaggtgcacggcctgaagggcctgaacagcaagctgctggacatccgcagctacctggagaaggtggccaccgggaagctgcccatcaaccaccagatcatctaccagctgcaggatgtgttcaacctgctgcctgatgtgtccctgcaggagtttgtgaaggccttctacctgaagaccaatgaccagatggtggtggtgtacctggccagcctcatccgctctgtggtggccctgcacaacctgatcaacaacaagatcgccaacagagatgctgagaagaaggagggccaggagaaggaggagagcaagaaggacaggaaggaggacaaggagaaggacaaggacaaggagaagagtgatgtgaagaaggaggagaagaaggagaagaagtag

SEQ ID NO: 16898 - DNA, 1350 bp, Artificial Sequence
  Description of Artificial Sequence: Synthetic coding sequence
atggccacccaggccaagaggccccgggtggccggccctgtggatggaggagacctggaccctgtggcctgcttcctgtcctggtgccggcgggtgggcctggagctgagccccaaggtggccgtgtcccggcagggcaccgtggccggctacggcatggtggcccgggagagcgtgcaggccggggagctgctgtttgtggtgcccagggctgccctgctgagccagcacacctgcagcattggaggcctgctggagcgggagcgggtggccctgcagagccagagcggctgggtgcccctgctgctggccctgctgcacgagctgcaggccccagccagccgctggaggccctactttgccctgtggccagagctgggccgcctggagcaccccatgttctggccagaggaggagcggcgctgcctgctgcagggcactggagtgcctgaggccgtggagaaggacctggccaacatccgctctgagtaccagagcatcgtgctgcccttcatggaggcccacccagacctcttcagcctgcgggtgcgcagcctggagctgtaccaccagctggtggccctggtgatggcctacagcttccaggagcccctggaggaggaggaggatgagaaggagcccaacagccctgtgatggtgcctgctgctgacatcctgaaccacctggccaaccacaatgccaacctggagtacagcgccaactgcctgaggatggtggccacccagcccatccccaagggccacgagatcttcaacacctacggccagatggccaactggcagctgatccacatgtatggctttgtggagccctacccagacaacacagatgacacagctgacatccagatggtgacagtgcgggaggccgccctgcagggcaccaagacagaggccgagcggcacctggtgtatgagcgctgggacttcctgtgcaagctggagatggtgggggaggagggcgccttcgtcatcggccgggaggaggtgctgacagaggaggagctgaccaccaccctgaaggtgctgtgcatgcctgctgaggagttccgggagctgaaggaccaggacggcggcggagatgacaagcgggaggagggcagcctgaccatcaccaacatccccaagctgaaggcctcctggaggcagctgctgcagaacagcgtgctgctgaccctgcagacctacgccacagacctgaagacagaccagggcctgctgagcaacaaggaggtgtatgccaagctgtcctggagggagcagcaggccctgcaggtgcgctatggccagaagatgatcctgcaccagctgctggagctgaccagctag

SEQ ID NO: 16899 - DNA, 372 bp, Artificial Sequence
  Description of Artificial Sequence: Synthetic coding sequence
atggccacccaggccaagaggccccgggtggccggccctgtggatggaggagacctggaccctgtggcctgcttcctgtcctggtgccggcgggtgggcctggagctgagccccaaggtgtctgaaagagctgctggccgggcccctgtggccgcccacctgctgcacagaagacctgctggggcccgggccagctgtgccgctgagcctgtgggcctgggcgccacagctgctggggccgcccccagggctgctggccctggcctgaccctggaggccctgctgtgtgccctggcccgggccggccccctgggcgccccagatgtgctggtgcgggccctgggcggcgtgggggagcggctgcacaggtag

SEQ ID NO: 16900 - DNA, 810 bp, Artificial Sequence
  Description of Artificial Sequence: Synthetic coding sequence
atgctgttcttcacccagtgcttcggggctgtgctggacctgatccacctgcgcttccagcactacaaggccaagagggtcttctctgctgctggccagctggtgtgtgtggtgaaccccacccacaacctgaagtatgtgagcagccggcgggctgtgacccagagcgcccctgagcagggcagcttccacccccaccacctgagccaccaccactgccaccaccgccaccaccaccacctgcggcaccacgcccacccccaccacctgcaccaccaggaggccggcctgcacgccaaccctgtgaccccctgcctgtgcatgtgccccctcttcagctgccagtgggagggccgcctggaggtggtggtgccccacctgcggcagatccaccgggtggacatcctgcagggcgctgagatcgtgttcctggccacagacatgcacctgcctgccccagctgactggatcatcatgcacagctgcctgggccaccacttcctgctggtgctgaggaagcaggagagacatgagggccacccccagttctttgccaccatgatgctgattggcacccccacccaggccgactgcttcacctaccgcctggagctgaacagaaaccaccggcggctgaagtgggaggccacccccaggtctgtgctggagtgtgtggacagcgtcatcacagatggagactgcctggtgctgaacaccagcctggcccagctgttcagtgacaatggcagcctggccatcggcatcgccatcacagccacagaggtgctgcccagcgaggccgagatgtag

SEQ ID NO: 16901 - DNA, 1983 bp, Artificial Sequence
  Description of Artificial Sequence: Synthetic coding sequence
atgctggtgtgctacagcgtgctggcctgtgagatcctgtgggacctgccctgcagcatcatgggcagccccctgggccacttcacctgggacaagtacctgaaggagacctgcagcgtgcctgcccctgtgcactgcttcaagcagagctacaccccacccagcaatgagttcaagatctccatgaagctggaggcccaggaccccaggaacaccaccagcacctgcatcgccaccgtggtgggcctgaccggggcccggctgcggctgcggctggatggcagtgacaacaagaatgacttctggaggctggtggacagcgctgagatccagcccatcggcaactgtgagaagaatggaggcatgctgcagccccccctgggcttccggctgaatgccagctcctggcccatgttcctgctgaagaccctgaatggagctgagatggcccccatccgcatcttccacaaggagccccccagccccagccacaacttcttcaagatgggcatgaagctggaggccgtggacaggaagaacccccacttcatctgcccagccaccatcggggaggtgcggggcagcgaggtgctggtgacctttgatggctggaggggggcctttgactactggtgccgctttgacagccgggacatcttccctgtgggctggtgcagcctgaccggggacaacctgcagcccccaggcaccaaggtggtgatccccaagaacccctacccagccagtgatgtgaacacagagaagcccagcatccacagcagcaccaagacagtgctggagcaccagcccggccagaggggcaggaagccaggcaagaagaggggccgcacccccaagaccctcatcagccaccccatcagcgcccccagcaagacagctgagcccctgaagttccccaagaagaggggccccaagccaggcagcaagaggaagcccaggaccctgctgaaccccccaccagccagccccaccaccagcaccccagagccagacaccagcacagtgccccaggatgctgccaccatccccagcagcgccatgcaggcccccaccgtgtgcatctacctgaacaagaatggcagcacaggcccccacctggacaagaagaaggtgcagcagctgcctgaccactttggacctgcccgggcctctgtggtgctgcagcaggccgtgcaggcctgcatcgactgtgcctaccaccagaagacagtgttctccttcctgaagcagggccatggaggagaggtgatctctgctgtgtttgaccgggagcagcacaccctgaacctgcctgctgtgaacagcatcacctacgtgctgcgcttcctggagaagctgtgccacaacctgcggagtgacaacctgtttggaaaccagcccttcacccagacccacctgagcctgacagccatcgagtacagccacagccatgaccgctacctgcctggagagacctttgtgctgggcaacagcctggcccggagcctggagccccacagcgacagcatggacagcgccagcaaccccaccaacctggtgtccaccagccagaggcaccggcccctgctgagcagctgtggcctgccccccagcacagccagcgctgtgcggcggctgtgcagccggggcgtgctgaagggcagcaatgaaagaagagacatggagagcttctggaagctgaacagaagccctggcagtgaccgctacctggagagcagagatgccagccggctgagcggccgggaccccagctcctggacagtggaggatgtgatgcagtttgtgcgggaggccgacccccagctgggcccccatgctgacctcttcaggaagcatgaaattgatggcaaggccctgctgctgctgcggagtgacatgatgatgaagtacatgggcctgaagctgggccctgccctgaagctgagctaccacatcgaccggctgaagcagggcaagttctag

SEQ ID NO: 16902 - DNA, 1947 bp, Artificial Sequence
  Description of Artificial Sequence: Synthetic coding sequence
atgcagcccaacgtcatcgactggagcgatgtgaggaagcacaagtatggccacctgtctgagagcgccagccagtaccaggaggccgctgacatcctggacctgggccacttcacctgggacaagtacctgaaggagacctgcagcgtgcctgcccctgtgcactgcttcaagcagagctacaccccacccagcaatgagttcaagatctccatgaagctggaggcccaggaccccaggaacaccaccagcacctgcatcgccaccgtggtgggcctgaccggggcccggctgcggctgcggctggatggcagtgacaacaagaatgacttctggaggctggtggacagcgctgagatccagcccatcggcaactgtgagaagaatggaggcatgctgcagccccccctgggcttccggctgaatgccagctcctggcccatgttcctgctgaagaccctgaatggagctgagatggcccccatccgcatcttccacaaggagccccccagccccagccacaacttcttcaagatgggcatgaagctggaggccgtggacaggaagaacccccacttcatctgcccagccaccatcggggaggtgcggggcagcgaggtgctggtgacctttgatggctggaggggggcctttgactactggtgccgctttgacagccgggacatcttccctgtgggctggtgcagcctgaccggggacaacctgcagcccccaggcaccaaggtggtgatccccaagaacccctacccagccagtgatgtgaacacagagaagcccagcatccacagcagcaccaagacagtgctggagcaccagcccggccagaggggcaggaagccaggcaagaagaggggccgcacccccaagaccctcatcagccaccccatcagcgcccccagcaagacagctgagcccctgaagttccccaagaagaggggccccaagccaggcagcaagaggaagcccaggaccctgctgaaccccccaccagccagccccaccaccagcaccccagagccagacaccagcacagtgccccaggatgctgccaccatccccagcagcgccatgcaggcccccaccgtgtgcatctacctgaacaagaatggcagcacaggcccccacctggacaagaagaaggtgcagcagctgcctgaccactttggacctgcccgggcctctgtggtgctgcagcaggccgtgcaggcctgcatcgactgtgcctaccaccagaagacagtgttctccttcctgaagcagggccatggaggagaggtgatctctgctgtgtttgaccgggagcagcacaccctgaacctgcctgctgtgaacagcatcacctacgtgctgcgcttcctggagaagctgtgccacaacctgcggagtgacaacctgtttggaaaccagcccttcacccagacccacctgagcctgacagccatcgagtacagccacagccatgaccgctacctgcctggagagacctttgtgctgggcaacagcctggcccggagcctggagccccacagcgacagcatggacagcgccagcaaccccaccaacctggtgtccaccagccagaggcaccggcccctgctgagcagctgtggcctgccccccagcacagccagcgctgtgcggcggctgtgcagccggggcagtgaccgctacctggagagcagagatgccagccggctgagcggccgggaccccagctcctggacagtggaggatgtgatgcagtttgtgcgggaggccgacccccagctgggcccccatgctgacctcttcaggaagcatgaaattgatggcaaggccctgctgctgctgcggagtgacatgatgatgaagtacatgggcctgaagctgggccctgccctgaagctgagctaccacatcgaccggctgaagcagggcaagttctag

SEQ ID NO: 16903 - DNA, 1734 bp, Artificial Sequence
  Description of Artificial Sequence: Synthetic coding sequence
atgaagctggaggcccaggaccccaggaacaccaccagcacctgcatcgccaccgtggtgggcctgactggagcccggctgcggctgcggctggatggcagtgacaacaagaatgacttctggaggctggtggacagcgctgagatccagcccatcggcaactgtgagaagaatggaggcatgctgcagccccccctgggcttccggctgaatgccagctcctggcccatgttcctgctgaagaccctgaatggagctgagatggcccccatccgcatcttccacaaggagccccccagccccagccacaacttcttcaagatgggcatgaagctggaggccgtggacaggaagaacccccacttcatctgcccagccaccatcggggaggtgcggggcagcgaggtgctggtgacctttgatggctggaggggggcctttgactactggtgccgctttgacagccgggacatcttccctgtgggctggtgcagcctgactggagacaacctgcagcccccaggcaccaaggtggtgatccccaagaacccctacccagccagtgatgtgaacacagagaagcccagcatccacagcagcaccaagacagtgctggagcaccagcccggccagaggggcaggaagccaggcaagaagaggggccgcacccccaagaccctcatcagccaccccatcagcgcccccagcaagacagctgagcccctgaagttccccaagaagaggggccccaagccaggcagcaagaggaagcccaggaccctgctgaaccccccaccagccagccccaccaccagcaccccagagccagacaccagcacagtgccccaggatgctgccaccatccccagcagcgccatgcaggcccccaccgtgtgcatctacctgaacaagaatggcagcacaggcccccacctggacaagaagaaggtgcagcagctgcctgaccacttcggccctgcccgggcctctgtggtgctgcagcaggccgtgcaggcctgcatcgactgtgcctaccaccagaagacagtgttctccttcctgaagcagggccacggcggggaggtgatctctgctgtgtttgaccgggagcagcacaccctgaacctgcctgctgtgaacagcatcacctacgtgctgcgcttcctggagaagctgtgccacaacctgcggagtgacaacctgtttggaaaccagcccttcacccagacccacctgagcctgacagccatcgagtacagccacagccatgaccgctacctgcccggggagacctttgtgctgggcaacagcctggcccggagcctggagccccacagcgacagcatggattctgccagcaaccccaccaacctggtgtccaccagccagaggcaccggcccctgctgagcagctgtggcctgccccccagcacagccagcgctgtgcggcggctgtgcagccggggcagtgaccgctacctggagagcagagatgccagccggctgagcggccgggaccccagctcctggacagtggaggatgtgatgcagtttgtgcgggaggccgacccccagctgggcccccacgccgacctcttcaggaagcatgaaattgatggcaaggccctgctgctgctgcggagtgacatgatgatgaagtacatgggcctgaagctgggccctgccctgaagctgagctaccacatcgaccggctgaagcagggcaagttctag

SEQ ID NO: 16904 - DNA, 1776 bp, Artificial Sequence
  Description of Artificial Sequence: Synthetic coding sequence
atgcagagctacaccccacccagcaatgagttcaagatctccatgaagctggaggcccaggaccccaggaacaccaccagcacctgcatcgccaccgtggtgggcctgactggagcccggctgcggctgcggctggatggcagtgacaacaagaatgacttctggaggctggtggacagcgctgagatccagcccatcggcaactgtgagaagaatggaggcatgctgcagccccccctgggcttccggctgaatgccagctcctggcccatgttcctgctgaagaccctgaatggagctgagatggcccccatccgcatcttccacaaggagccccccagccccagccacaacttcttcaagatgggcatgaagctggaggccgtggacaggaagaacccccacttcatctgcccagccaccatcggggaggtgcggggcagcgaggtgctggtgacctttgatggctggaggggggcctttgactactggtgccgctttgacagccgggacatcttccctgtgggctggtgcagcctgactggagacaacctgcagcccccaggcaccaaggtggtgatccccaagaacccctacccagccagtgatgtgaacacagagaagcccagcatccacagcagcaccaagacagtgctggagcaccagcccggccagaggggcaggaagccaggcaagaagaggggccgcacccccaagaccctcatcagccaccccatcagcgcccccagcaagacagctgagcccctgaagttccccaagaagaggggccccaagccaggcagcaagaggaagcccaggaccctgctgaaccccccaccagccagccccaccaccagcaccccagagccagacaccagcacagtgccccaggatgctgccaccatccccagcagcgccatgcaggcccccaccgtgtgcatctacctgaacaagaatggcagcacaggcccccacctggacaagaagaaggtgcagcagctgcctgaccacttcggccctgcccgggcctctgtggtgctgcagcaggccgtgcaggcctgcatcgactgtgcctaccaccagaagacagtgttctccttcctgaagcagggccacggcggggaggtgatctctgctgtgtttgaccgggagcagcacaccctgaacctgcctgctgtgaacagcatcacctacgtgctgcgcttcctggagaagctgtgccacaacctgcggagtgacaacctgtttggaaaccagcccttcacccagacccacctgagcctgacagccatcgagtacagccacagccatgaccgctacctgcccggggagacctttgtgctgggcaacagcctggcccggagcctggagccccacagcgacagcatggattctgccagcaaccccaccaacctggtgtccaccagccagaggcaccggcccctgctgagcagctgtggcctgccccccagcacagccagcgctgtgcggcggctgtgcagccggggcagtgaccgctacctggagagcagagatgccagccggctgagcggccgggaccccagctcctggacagtggaggatgtgatgcagtttgtgcgggaggccgacccccagctgggcccccacgccgacctcttcaggaagcatgaaattgatggcaaggccctgctgctgctgcggagtgacatgatgatgaagtacatgggcctgaagctgggccctgccctgaagctgagctaccacatcgaccggctgaagcagggcaagttctag

SEQ ID NO: 16905 - DNA, 1800 bp, Artificial Sequence
  Description of Artificial Sequence: Synthetic coding sequence
atgaagctggaggcccaggaccccaggaacaccaccagcacctgcatcgccaccgtggtgggcctgactggagcccggctgcggctgcggctggatggcagtgacaacaagaatgacttctggaggctggtggacagcgctgagatccagcccatcggcaactgtgagaagaatggaggcatgctgcagccccccctgggcttccggctgaatgccagctcctggcccatgttcctgctgaagaccctgaatggagctgagatggcccccatccgcatcttccacaaggagccccccagccccagccacaacttcttcaagatgggcatgaagctggaggccgtggacaggaagaacccccacttcatctgcccagccaccatcggggaggtgcggggcagcgaggtgctggtgacctttgatggctggaggggggcctttgactactggtgccgctttgacagccgggacatcttccctgtgggctggtgcagcctgactggagacaacctgcagcccccaggcaccaaggtggtgatccccaagaacccctacccagccagtgatgtgaacacagagaagcccagcatccacagcagcaccaagacagtgctggagcaccagcccggccagaggggcaggaagccaggcaagaagaggggccgcacccccaagaccctcatcagccaccccatcagcgcccccagcaagacagctgagcccctgaagttccccaagaagaggggccccaagccaggcagcaagaggaagcccaggaccctgctgaaccccccaccagccagccccaccaccagcaccccagagccagacaccagcacagtgccccaggatgctgccaccatccccagcagcgccatgcaggcccccaccgtgtgcatctacctgaacaagaatggcagcacaggcccccacctggacaagaagaaggtgcagcagctgcctgaccacttcggccctgcccgggcctctgtggtgctgcagcaggccgtgcaggcctgcatcgactgtgcctaccaccagaagacagtgttctccttcctgaagcagggccacggcggggaggtgatctctgctgtgtttgaccgggagcagcacaccctgaacctgcctgctgtgaacagcatcacctacgtgctgcgcttcctggagaagctgtgccacaacctgcggagtgacaacctgtttggaaaccagcccttcacccagacccacctgagcctgacagccatcgagtacagccacagccatgaccgctacctgcccggggagacctttgtgctgggcaacagcctggcccggagcctggagccccacagcgacagcatggattctgccagcaaccccaccaacctggtgtccaccagccagaggcaccggcccctgctgagcagctgtggcctgccccccagcacagccagcgctgtgcggcggctgtgcagcagaggagtgctgaagggcagcaatgaaagaagagacatggagagcttctggaagctgaacagaagccctggcagtgaccgctacctggagagcagagatgccagccggctgagcggccgggaccccagctcctggacagtggaggatgtgatgcagtttgtgcgggaggccgacccccagctgggcccccacgccgacctcttcaggaagcatgaaattgatggcaaggccctgctgctgctgcggagtgacatgatgatgaagtacatgggcctgaagctgggccctgccctgaagctgagctaccacatcgaccggctgaagcagggcaagttctag

SEQ ID NO: 16906 - DNA, 1734 bp, Artificial Sequence; identical to SEQ ID NO: 16903
  Description of Artificial Sequence: Synthetic coding sequence

SEQ ID NO: 16907 - DNA, 1776 bp, Artificial Sequence; identical to SEQ ID NO: 16904
  Description of Artificial Sequence: Synthetic coding sequence

SEQ ID NO: 16908 - DNA, 1734 bp, Artificial Sequence; identical to SEQ ID NO: 16903
  Description of Artificial Sequence: Synthetic coding sequence

SEQ ID NO: 16909 - DNA, 1857 bp, Artificial Sequence
  Description of Artificial Sequence: Synthetic coding sequence
atgggcagccccctgggccacttcacctgggacaagtacctgaaggagacctgcagcgtgcctgcccctgtgcactgcttcaagcagagctacaccccacccagcaatgagttcaagatctccatgaagctggaggcccaggaccccaggaacaccaccagcacctgcatcgccaccgtggtgggcctgaccggggcccggctgcggctgcggctggatggcagtgacaacaagaatgacttctggaggctggtggacagcgctgagatccagcccatcggcaactgtgagaagaatggaggcatgctgcagccccccctgggcttccggctgaatgccagctcctggcccatgttcctgctgaagaccctgaatggagctgagatggcccccatccgcatcttccacaaggagccccccagccccagccacaacttcttcaagatgggcatgaagctggaggccgtggacaggaagaacccccacttcatctgcccagccaccatcggggaggtgcggggcagcgaggtgctggtgacctttgatggctggaggggggcctttgactactggtgccgctttgacagccgggacatcttccctgtgggctggtgcagcctgaccggggacaacctgcagcccccaggcaccaaggtggtgatccccaagaacccctacccagccagtgatgtgaacacagagaagcccagcatccacagcagcaccaagacagtgctggagcaccagcccggccagaggggcaggaagccaggcaagaagaggggccgcacccccaagaccctcatcagccaccccatcagcgcccccagcaagacagctgagcccctgaagttccccaagaagaggggccccaagccaggcagcaagaggaagcccaggaccctgctgaaccccccaccagccagccccaccaccagcaccccagagccagacaccagcacagtgccccaggatgctgccaccatccccagcagcgccatgcaggcccccaccgtgtgcatctacctgaacaagaatggcagcacaggcccccacctggacaagaagaaggtgcagcagctgcctgaccactttggacctgcccgggcctctgtggtgctgcagcaggccgtgcaggcctgcatcgactgtgcctaccaccagaagacagtgttctccttcctgaagcagggccatggaggagaggtgatctctgctgtgtttgaccgggagcagcacaccctgaacctgcctgctgtgaacagcatcacctacgtgctgcgcttcctggagaagctgtgccacaacctgcggagtgacaacctgtttggaaaccagcccttcacccagacccacctgagcctgacagccatcgagtacagccacagccatgaccgctacctgcctggagagacctttgtgctgggcaacagcctggcccggagcctggagccccacagcgacagcatggacagcgccagcaaccccaccaacctggtgtccaccagccagaggcaccggcccctgctgagcagctgtggcctgccccccagcacagccagcgctgtgcggcggctgtgcagccggggcagtgaccgctacctggagagcagagatgccagccggctgagcggccgggaccccagctcctggacagtggaggatgtgatgcagtttgtgcgggaggccgacccccagctgggcccccatgctgacctcttcaggaagcatgaaattgatggcaaggccctgctgctgctgcggagtgacatgatgatgaagtacatgggcctgaagctgggccctgccctgaagctgagctaccacatcgaccggctgaagcagggcaagttctag

SEQ ID NO: 16910 - DNA, 1983 bp, Artificial Sequence; identical to SEQ ID NO: 16901
  Description of Artificial Sequence: Synthetic coding sequence

SEQ ID NO: 16911 - DNA, 1443 bp, Artificial Sequence
  Description of Artificial Sequence: Synthetic coding sequence
atgcagagctacaccccacccagcaatgagttcaagatctccatgaagctggaggcccaggaccccaggaacaccaccagcacctgcatcgccaccgtggtgggcctgactggagcccggctgcggctgcggctggatggcagtgacaacaagaatgacttctggaggctggtggacagcgctgagatccagcccatcggcaactgtgagaagaatggaggcatgctgcagccccccctggtggtgatccccaagaacccctacccagccagtgatgtgaacacagagaagcccagcatccacagcagcaccaagacagtgctggagcaccagcccggccagaggggcaggaagccaggcaagaagaggggccgcacccccaagaccctcatcagccaccccatcagcgcccccagcaagacagctgagcccctgaagttccccaagaagaggggccccaagccaggcagcaagaggaagcccaggaccctgctgaaccccccaccagccagccccaccaccagcaccccagagccagacaccagcacagtgccccaggatgctgccaccatccccagcagcgccatgcaggcccccaccgtgtgcatctacctgaacaagaatggcagcacaggcccccacctggacaagaagaaggtgcagcagctgcctgaccactttggacctgcccgggcctctgtggtgctgcagcaggccgtgcaggcctgcatcgactgtgcctaccaccagaagacagtgttctccttcctgaagcagggccatggaggagaggtgatctctgctgtgtttgaccgggagcagcacaccctgaacctgcctgctgtgaacagcatcacctacgtgctgcgcttcctggagaagctgtgccacaacctgcggagtgacaacctgtttggaaaccagcccttcacccagacccacctgagcctgacagccatcgagtacagccacagccatgaccgctacctgcctggagagacctttgtgctgggcaacagcctggcccggagcctggagccccacagcgacagcatggacagcgccagcaaccccaccaacctggtgtccaccagccagaggcaccggcccctgctgagcagctgtggcctgccccccagcacagccagcgctgtgcggcggctgtgcagccggggcagtgaccgctacctggagagcagagatgccagccggctgagcggccgggaccccagctcctggacagtggaggatgtgatgcagtttgtgcgggaggccgacccccagctgggcccccatgctgacctcttcaggaagcatgaaattgatggcaaggccctgctgctgctgcggagtgacatgatgatgaagtacatgggcctgaagctgggccctgccctgaagctgagctaccacatcgaccggctgaagcagggcaagttctag

SEQ ID NO: 16912 - DNA, 1245 bp, Artificial Sequence
  Description of Artificial Sequence: Synthetic coding sequence
atgcagagccagagaattcctggcaggaagaggggccggcccagcctgcacagcacccccatgaagatggctgtgcacaacctgtacagcgccagcgctggcagcctgcctgctgtgaagatccccaagaagaggggcaggaagccaggctacaagatcaagagccgggtgctgatgacccccctggccctgagcccccccaggagcaccccagagccagacctgagcagcatcccccaggatgctgccaccgtgcccagcctggccgccccccaggccctgactgtgtgcctgtacatcaacaagcaggccaatgccggcccctacctggagaggaagaaggtgcagcagctgcctgagcacttcggccctgagcggcccagcgctgtgctgcagcaggccgtgcaggcctgcatcgactgtgcccaccagcagaagctggtgttcagcctggtgaagcagggctacggcggggagatggtgtctgtgtctgccagctttgatggcaagcagcacctgcggagcctgcctgtggtgaacagcatcggctacgtgctgcgcttcctggccaagctgtgccgcagcctgctgtgtgatgacctcttcagccaccagcccttcccccggggctgcagcgccagcgagaaggtgcaggagaaggaggagggccgcatggagagcgtgaagacagtgaccacagaggagtacctggtgaaccctgtgggcatgaaccgctacagcgtggacaccagcgccagcaccttcaaccaccggggcagcctgcaccccagcagcagcctgtactgcaagaggcagaacagcggggacagccacctgggcggcggccctgctgccacagctgggggccccaggaccagccccatgagcagcggcggccccagcgcccctggcctgcggcccccagccagcagccccaagaggaacaccaccagcctggagggcaacagatgtgccagcagccccagccaggatgcccaggatgcccggcggcccaggagcaggaaccccagcgcctggacagtggaggatgtggtgtggtttgtgaaggatgctgacccccaggccctgggcccccacgtggagctgttcaggaagcatgaaattgatggaaatgccctgctgctgctgaagagtgacatggtgatgaagtacctgggcctgaagctgggccctgccctgaagctgtgctaccacatcgacaagctgaagcaggccaagttctag

SEQ ID NO: 16913 - DNA, 918 bp, Artificial Sequence
  Description of Artificial Sequence: Synthetic coding sequence
atgccctgccagaggacagcctggattggctgtgaccggcagaggaccccacccttccactggagggagatcaagagccgggtgctgatgacccccctggccctgagccccccaagaagcaccccagagccagacctgagcagcatcccccaggatgctgccaccgtgcccagcctggccgccccccaggccctgactgtgtgcctgtacatcaacaagcaggccaatgccggcccctacctggagaggaagaaggtgcagcagctgcctgagcactttggacctgagcggcccagcgctgtgctgcagcaggccgtgcaggcctgcatcgactgtgcccaccagcagaagctggtgttcagcctggtgaagcagggctatggaggagagatggtgtctgtgtctgccagctttgatggcaagcagcacctgcggagcctgcctgtggtgaacagcatcggctacgtgctgcgcttcctggccaagctgtgccgcagcctgctgtgtgatgacctcttcagccaccagcccttcccccggggctgcagcgccagcgagaaggtgcaggagaaggaggagggccgcatggagagcgtgaagacagtgaccacagaggagtacctggtgaaccctgtgggcatgaaccgctacagcgtggacaccagcgccagcaccttcaaccaccggggcagcctgcaccccagcagcagcctgtactgcaagaggcagaacagcggggacagccacctgggcggcggccctgctgccacagctgggggccccaggaccagccccatgagcagcggcggccccagcgcccctggcctgcggcccccagccagcagccccaagaggaacaccaccagcctggagggcaacagatgtggaaatgtgatgcacgccagcgccagccactag

SEQ ID NO: 16914 - DNA, 324 bp, Artificial Sequence
  Description of Artificial Sequence: Synthetic coding sequence
atggtgatccgggtcttcatcgccagcagcagcggctttgtggccatcaagaagaagcagcaggatgtggtgcgcttcctggaggccaacaagattgaatttgaggaggtggacatcaccatgtctgaggagcagaggcagtggatgtacaagaatgtgcccccagagaagaagcccacccagggcaaccccctgcccccccagatcttcaatggagaccgctactgtggggactatgacagcttctttgagagcaaggagagcaacacagtgttctccttcctgggcctgaagccccggctggccagcaaggccgagccctag

SEQ ID NO: 16915 - DNA, 960 bp, Artificial Sequence
  Description of Artificial Sequence: Synthetic coding sequence
atggaggagctgacagcctttgtgtccaagagctttgaccagaaggtgaaggagaagaaggaggccatcacctaccgggaggtgctggagagcggccccctgcggggggccaaggagcccaccggctgcacagaggccggcagagatgacaggagcagccctgctgtgcgggctgctgggggcggcggcggcggcggcggcggcggcggcggcggcggcggcggcggcggcgtgggcggcggcggggccggcggcggggccggcggcggccgcagccctgtgcgggagctggacatgggcgctgctgagaggagccgggagcccggcagcccccggctgacagaggtgtccccagagctgaaggacagaaaagaagatgccaagggcatggaggatgagggccagaccaagatcaagcagaggaggagcaggaccaacttcaccctggagcagctgaatgagctggagcggctgtttgatgagacccactacccagatgccttcatgagggaggagctgagccagaggctgggcctgtctgaggcccgggtgcaggtgtggttccagaacagaagagccaagtgcaggaagcaggagaaccagctgcacaagggcgtgctgattggagctgccagccagtttgaggcctgccgggtggccccctacgtgaatgtgggcgccctgaggatgcccttccagcaggtgcaggcccagctgcagctggacagcgctgtggcccacgcccaccaccacctgcacccccacctggccgcccacgccccctacatgatgtttcctgccccacccttcggcctgcccctggccaccctggccgctgacagcgccagcgctgcctctgtggtggccgctgctgctgctgccaagaccaccagcaagaacagcagcattgctgacctgcggctgaaggccaagaagcacgccgccgccctgggcctgtag

SEQ ID NO: 16916 - DNA, 663 bp, Artificial Sequence
  Description of Artificial Sequence: Synthetic coding sequence
atgaatggcttcaccccagatgagatgagcagaggaggagatgctgctgctgctgtggccgctgtggtggccgctgctgctgctgctgccagcgctggaaatggcaccggggccggcaccggggctgaggtgcctggagctggagctgtgtctgctgctggccccccaggagctgctggccctggccctggccagctgtgctgcctgagagaagatggagagcgctgtggccgggctgctggaaatgccagcttcagcaagaggatccagaagagcatcagccagaagaaggtgaagattgagctggacaagagcgcccggcacctgtacatctgtgactaccacaagaacctgatccagagcgtgaggaacagaaggaagaggaaaggaagtgatgatgatggaggagacagccctgtgcaggacatcgacaccccagaggtggacctgtaccagctgcaggtgaacaccctgcggcgctacaagaggcacttcaagctgcccaccaggcctggcctgaacaaggcccagctggtggagatcgtgggctgccacttccgcagcatccctgtgaatgagaaggacaccctgacctacttcatctacagcgtgaagaatgacaagaacaagagtgacctgaaggtggacagcggcgtgcactag

SEQ ID NO: 16917 - DNA, 828 bp, Artificial Sequence
  Description of Artificial Sequence: Synthetic coding sequence
atgggccctgctggggtggccgcccggcccggccgcttcttcggcgtgtacctgctgtactgcctgaacccccgctaccggggccgggtgtatgtgggcttcaccgtgaacacagcccggcgggtgcagcagcacaacggcggcaggaagaagggcggggcctggaggaccagcggccggggcccctgggagatggtgctggtggtgcacggcttccccagctctgtggccgccctgcgctttgagtgggcctggcagcacccccacgccagccggcggctggcccacgtgggcccccggctgcggggggagacagcctttgccttccacctgcgggtgctggcccacatgctgcgggccccaccctgggcccggctgcccctgaccctgcgctgggtgcggccagacctgcggcaggacctgtgcctgcccccaccaccccacgtgcccctggcctttggacctcctccaccccaggccccagcccccaggagaagagctggcccctttgatgatgctgagcctgagccagaccagggcgaccccggggcctgctgcagcctgtgtgcccagaccatccaggatgaggagggccccctgtgctgcccccaccctggctgcctgctgcgggcccacgtgatctgcctggccgaggagttcctgcaggaggagcccggccagctgctgcccctggagggccagtgcccctgctgtgagaagagcctgctgtggggagacctgatctggctgtgccagatggacacagagaaggaggtggaggacagcgagctggaggaggcccactggacagacctgctggagacctag

SEQ ID NO: 16918 - DNA, 486 bp, Artificial Sequence
  Description of Artificial Sequence: Synthetic coding sequence
atgggccctgctggggtggccgcccggcccggccgcttcttcggcgtgtacctgctgtactgcctgaacccccgctaccggggccgggtgtatgtgggcttcaccgtgaacacagcccggcgggtgcagcagcacaacggcggcaggaagaagggcggggcctggaggaccagcggccggggcccctgggagatggtgctggtggtgcacggcttccccagctctgtggccgccctgagagatgaggagggccccctgtgctgcccccaccctggctgcctgctgcgggcccacgtgatctgcctggccgaggagttcctgcaggaggagcccggccagctgctgcccctggagggccagtgcccctgctgtgagaagagcctgctgtggggagacctgatctggctgtgccagatggacacagagaaggaggtggaggacagcgagctggaggaggcccactggacagacctgctggagacctag

SEQ ID NO: 16919 - DNA, 765 bp, Artificial Sequence
  Description of Artificial Sequence: Synthetic coding sequence
atgggccctgctggggtggccgcccggcccggccgcttcttcggcgtgtacctgctgtactgcctgaacccccgctaccggggccgggtgtatgtgggcttcaccgtgaacacagcccggcgggtgcagcagcacaacggcggcaggaagaagggcggggcctggaggaccagcggccggggcccctgggagatggtgctggtggtgcacggcttccccagctctgtggccgccctgcgctttgagtgggcctggcagcacccccacgccagccggcggctggcccacgtgggcccccggctgcggggggagacagcctttgccttccacctgcgggtgctggcccacatgctgcgggccccaccctgggcccggctgcccctgaccctgcgctgggtgcggccagacctgcggcaggacctgtgcctgcccccaccaccccacgtgcccctggcctttggacctcctccaccccaggccccagcccccaggagaagagctggcccctttgatgatgctgagcctgagccagaccagggcgaccccggggcctgctgcagcctgtgtgcccagaccatccaggatgaggagggccccctgtgctgcccccaccctggctgcctgctgcgggcccacgtgatctgcctggccgaggagttcctgcaggaggagcccggccagctgctgcccctggagggccagtgcccctgctgtgagaagagcgccctgggccgcccagacctggccgtgcctgatggccactag

SEQ ID NO: 16920 - DNA, 828 bp, Artificial Sequence; identical to SEQ ID NO: 16917
  Description of Artificial Sequence: Synthetic coding sequence

SEQ ID NO: 16921 - DNA, 486 bp, Artificial Sequence; identical to SEQ ID NO: 16918
  Description of Artificial Sequence: Synthetic coding sequence

SEQ ID NO: 16922 - DNA, 765 bp, Artificial Sequence; identical to SEQ ID NO: 16919
  Description of Artificial Sequence: Synthetic coding sequence

SEQ ID NO: 16923 - DNA, 372 bp, Artificial Sequence
  Description of Artificial Sequence: Synthetic coding sequence
atggtggtgcaggaccccctgctgtgtgacctgcccatccaggtgaccctggaggaggtgaacagccagatcgccctggagtatggccaggccatgacagtgcgggtgtgcaagatggatggagaggtgatgcctgtggtggtggtgcagagcgccaccgtgctggacctgaagaaggccatccagcgctacgtgcagctgaagcaggagcgggagggcggcatccagcacatctcctggagctatgtgtggaggacctaccacctgaccagcgctggggagaagctgacagaggacaggaagaagctgcgggactatggcatccggaacagagatgaggtgtccttcatcaagaagctgcggcagaagtag

SEQ ID NO: 16924 - DNA, 399 bp, Artificial Sequence
  Description of Artificial Sequence: Synthetic coding sequence
atggatgtgttccaggagggcctggccatggtggtgcaggaccccctgctgtgtgacctgcccatccaggtgaccctggaggaggtgaacagccagatcgccctggagtatggccaggccatgacagtgcgggtgtgcaagatggatggagaggtgatgcctgtggtggtggtgcagagcgccaccgtgctggacctgaagaaggccatccagagatatgtgcagctgaagcaggagcgggagggcggcatccagcacatctcctggagctatgtgtggaggacctaccacctgaccagcgctggggagaagctgacagaggacaggaagaagctgcgggactatggcatccggaacagagatgaggtgtccttcatcaagaagctgcggcagaagtag

SEQ ID NO: 16925 - DNA, 468 bp, Artificial Sequence
  Description of Artificial Sequence: Synthetic coding sequence
atgggccgcagccgcagccgcagcccccggcgggagcggcggcgcagccgcagcaccagccgggagcgggagaggagaagaagagagaggagccgcagccgggagcgggacagaagaagaagccgcagccgcagcccccacagaagaagaagccgcagccccaggaggcacaggagcaccagccccagccccagccggctgaaggagaggagagatgaggagaagaaggagaccaaggagaccaagagcaaggagcggcagatcacagaggaggacctggagggcaagacagaggaggagattgagatgatgaagctgatgggctttgccagctttgacagcaccaagggcaagaaggtggatggctctgtgaatgcctatgccatcaacgtgtcccagaagaggaagtaccggcagtacatgaacaggaagggcggcttcaaccggcccctggacttcatcgcctag

SEQ ID NO: 16926 - DNA, 468 bp, Artificial Sequence; identical to SEQ ID NO: 16925
  Description of Artificial Sequence: Synthetic coding sequence

SEQ ID NO: 16927 - DNA, 741 bp, Artificial Sequence
  Description of Artificial Sequence: Synthetic coding sequence
atgaatgactggatgcccatcgccaaggagtatgaccccctgaaggccggcagcattgatggaacagatgaggacccccatgacagagctgtgtggagggccatgctggcccgctacgtgcccaacaagggcgtcatcggggaccccctgctgaccctgtttgtggcccggctgaacctgcagaccaaggaggacaagctgaaggaggtgttcagccgctacggggacatccggcggctgcggctggtgcgggacctggtgacaggcttcagcaagggctacgccttcatcgagtacaaggaggagcgggccgtcatcaaggcctacagagatgctgatggcctggtgattgaccagcacgagatctttgtggactatgagctggagaggaccctgaagggctggatcccccggcggctgggcggcggcctgggcggcaagaaggagagcggccagctgcgctttggaggccgggaccggcccttcaggaagcccatcaacctgcctgtggtgaagaatgacctgtaccgggagggcaagcgggagcggcgggagaggagccgcagccgggagcggcactgggacagcaggacccgggaccgggaccatgaccggggccgggagaagcgctggcaggagcgggagcccaccagggtgtggccagacaatgactgggagcgggagcgggacttcagagatgaccgcatcaagggccgggagaagaaggagcggggcaagtag

SEQ ID NO: 16928 - DNA, 756 bp, Artificial Sequence
  Description of Artificial Sequence: Synthetic coding sequence
atgaagccagccaacatgaatgactggatgcccatcgccaaggagtatgaccccctgaaggccggcagcattgatggaacagatgaggacccccatgacagagctgtgtggagggccatgctggcccgctacgtgcccaacaagggcgtgattggagaccccctgctgaccctgtttgtggcccggctgaacctgcagaccaaggaggacaagctgaaggaggtgttcagccgctatggagacatccggcggctgcggctggtgcgggacctggtgacaggcttcagcaagggctacgccttcatcgagtacaaggaggagagagctgtgatcaaggcctacagagatgctgatggcctggtgattgaccagcacgagatctttgtggactatgagctggagaggaccctgaagggctggatcccccggcggctgggcggcggcctgggcggcaagaaggagagcggccagctgcgctttggaggccgggaccggcccttcaggaagcccatcaacctgcctgtggtgaagaatgacctgtaccgggagggcaagcgggagcggcgggagaggagccgcagccgggagcggcactgggacagcaggacccgggaccgggaccatgaccggggccgggagaagcgctggcaggagcgggagcccaccagggtgtggccagacaatgactgggagcgggagcgggacttcagagatgaccgcatcaagggccgggagaagaaggagcggggcaagtag

SEQ ID NO: 16929 - DNA, 741 bp, Artificial Sequence; identical to SEQ ID NO: 16927
  Description of Artificial Sequence: Synthetic coding sequence

SEQ ID NO: 16930 - DNA, 1371 bp, Artificial Sequence
  Description of Artificial Sequence: Synthetic coding sequence
atggagccccgctgccccccaccctgtggctgctgtgagcggctggtgctgaatgtggccggcctgcgctttgagacccgggcccggaccctgggccgcttcccagacaccctgctgggggaccctgcccggcggggccgcttctatgatgatgcccggcgggagtacttctttgacagacaccggcccagctttgatgctgtgctgtactactaccagagcggcggccgcctgcggcggcctgcccacgtgcccctggatgtgttcctggaggaggtggccttctacggcctgggcgctgctgccctggcccggctgcgggaggatgagggctgccctgtgcccccagagcggcccctgccccggcgggcctttgcccggcagctgtggctgctgtttgagttccctgagagcagccaggccgcccgggtgctggccgtggtgtctgtgctggtgatcctggtgtccatcgtggtgttctgcctggagaccctgcctgacttcagagatgacagagatggcaccggcctggccgctgctgctgctgctggccccttccctgcccccctgaatggcagcagccagatgcctggcaaccccccccggctgcccttcaatgaccccttctttgtggtggagaccctgtgcatctgctggttctcctttgagctgctggtgcggctgctggtgtgccccagcaaggccatcttcttcaagaatgtgatgaacctgattgactttgtggccatcctgccctactttgtggccctgggcacagagctggcccggcagaggggcgtgggccagcaggccatgagcctggccatcctgcgggtcatccggctggtgcgggtcttccgcatcttcaagctgagccgccacagcaagggcctgcagatcctgggccagaccctgcgggcctccatgagggagctgggcctgctgatcttcttcctgttcatcggcgtggtgctcttcagcagcgctgtgtactttgctgaggtggacagagtggacagccacttcaccagcatccctgagagcttctggtgggccgtggtgaccatgaccaccgtgggctatggagacatggcccctgtgacagtgggcggcaagatcgtgggcagcctgtgtgccatcgccggcgtgctgaccatcagcctgcctgtgcctgtgattgtgagcaacttctcctacttctaccaccgggagacagaaggagaggaggccggcatgttcagccacgtggacatgcagccctgtggccccctggagggcaaggccaatggaggcctggtggatggagaggtgcctgagctgcccccacccctgtgggcccctcctgggaagcacctggtgacagaggtgtag

SEQ ID NO: 16931 - DNA, 501 bp, Artificial Sequence
  Description of Artificial Sequence: Synthetic coding sequence
atgacccagttcctgccccccaacctgctggccctgtttgccccccgggaccccatcccctacctgccccccctggagaagctgccccatgagaagcaccacaaccagccctactgcggcatcgccccctacatccgggagtttgaggaccccagagatgcccccccacccaccagggctgagacccgggaggagaggatggagaggaagagaagagagaagattgaaagacggcagcaggaggtggagacagagctgaagatgtgggacccccacaatgaccccaatgcccagggagatgccttcaagaccctgtttgtggcccgggtgaactatgacaccacagagagcaagctgcggcgggagtttgaggtgtatggccccatcaagaggatccacatggtgtacagcaagaggtctgggaagccccggggctacgccttcattgaatatgaacatgagcgggacatgcacagcaccacccagctggcctgcagctag

SEQ ID NO: 16932 - DNA, 114 bp, Artificial Sequence
  Description of Artificial Sequence: Synthetic coding sequence
gctgctgctgctgctgccagcctgaggacagatgcccgggccaggagatatgccacctggcaggatgatcctgtgcctgctgcccagcccagcggccccctgtgccccccatag

SEQ ID NO: 16933 - DNA, 1026 bp, Artificial Sequence
  Description of Artificial Sequence: Synthetic coding sequence
atggagcaggccctgcaccgcttcggccggggcctggtgtggctgtctgtggcctggctgtctgtgggccgggtgcgggtgagagatgatggagacaccggccggggcttctgccgggccggccctgtgctgacccggggccccagcggggacagcagccccctgcccctgcccacctctgtgacagctgcctacaagcatgctgatggcaagaagattgatggccggcgggtgctggtggatgtggagcggggccgcacagtgaagggctggaggccccggcggctgggcggcggcctgggcggcacccggcggggcggcgcagatgtgaacatccgccacagcggcagagatgacaccagccgctatgatgagaggcctggccccagccccctgccccaccgggaccgggaccgggaccgggagcgggagcggcgggagaggagccgggagcgggacaaggagcgggagaggagaagaagccgcagccgggacagaagaagaagaagccgcagccgggacaaggaggagaggagaagaagccgggagaggagcaaggacaaggaccgggacaggaagaggaggagcagccgcagccgggagcgggcccggcgggagcgggagaggaaggaggagctgcggggcggcggcggggacatggccgagcccagcgaggccggagatgcccccccagatgatggccccccaggagagctgggcccagatggcccagatggccctgaggagaagggccgggaccgggaccgggagaggagaagaagccacaggtctgagcgggagaggagaagagaccgggaccgggaccgggaccgggaccgggagcacaagagaggagagcggggcagcgagcggggcagagatgaggcccggggcggcggcggcggccaggacaatggcctggagggcctgggcaatgacagccgggacatgtacatggagagcgagggcggagatggctacctggccccagaaaatggctacctgatggaggccgcccctgagtag

SEQ ID NO: 16934 - DNA, 1314 bp, Artificial Sequence
  Description of Artificial Sequence: Synthetic coding sequence
atgacccagttcctgccccccaacctgctggccctgtttgccccccgggaccccatcccctacctgccccccctggagaagctgccccatgagaagcaccacaaccagccctactgcggcatcgccccctacatccgggagtttgaggaccccagagatgcccccccacccaccagggctgagacccgggaggagaggatggagaggaagagaagagagaagattgaaagacggcagcaggaggtggagacagagctgaagatgtgggacccccacaatgaccccaatgcccagggagatgccttcaagaccctgtttgtggcccgggtgaactatgacaccacagagagcaagctgcggcgggagtttgaggtgtatggccccatcaagaggatccacatggtgtacagcaagaggtctgggaagccccggggctacgccttcattgaatatgaacatgagcgggacatgcacagcgcctacaagcatgctgatggcaagaagattgatggccggcgggtgctggtggatgtggagcggggccgcacagtgaagggctggaggccccggcggctgggcggcggcctgggcggcacccggcggggcggcgcagatgtgaacatccgccacagcggcagagatgacaccagccgctatgatgagaggcctggccccagccccctgccccaccgggaccgggaccgggaccgggagcgggagcggcgggagaggagccgggagcgggacaaggagcgggagaggagaagaagccgcagccgggacagaagaagaagaagccgcagccgggacaaggaggagaggagaagaagccgggagaggagcaaggacaaggaccgggacaggaagaggaggagcagccgcagccgggagcgggcccggcgggagcgggagaggaaggaggagctgcggggcggcggcggggacatggccgagcccagcgaggccggagatgcccccccagatgatggccccccaggagagctgggcccagatggcccagatggccctgaggagaagggccgggaccgggaccgggagaggagaagaagccacaggtctgagcgggagaggagaagagaccgggaccgggaccgggaccgggaccgggagcacaagagaggagagcggggcagcgagcggggcagagatgaggcccggggcggcggcggcggccaggacaatggcctggagggcctgggcaatgacagccgggacatgtacatggagagcgagggcggagatggctacctggccccagaaaatggctacctgatggaggccgcccctgagtag

SEQ ID NO: 16935 - DNA, 678 bp, Artificial Sequence
  Description of Artificial Sequence: Synthetic coding sequence
atggacatccggcccaaccacaccatctacatcaacaacatgaatgacaagatcaagaaggaggagctgaagaggagcctgtatgccctcttcagccagtttggccacgtggtggacatcgtggccctgaagaccatgaagatgaggggccaggcctttgtgatcttcaaggagctgggcagcagcaccaatgccctgcggcagctgcagggcttccccttctacggcaagcccatgaggatccagtatgccaagacagacagcgacatcatcagcaagatgaggggcacctttgctgacaaggagaagaagaaggagaagaagaaggccaagacagtggagcagacagccaccaccaccaacaagaagccaggccagggcacccccaacagcgccaacacccagggcaacagcacccccaacccccaggtgcctgactacccacccaactacatcctcttcctgaacaacctgcctgaggagaccaatgagatgatgctgtccatgctgttcaaccagtttcctggcttcaaggaggtgcggctggtgcccggcagacatgacatcgcctttgtggagtttgaaaatgatggccaggccggggccgccagagatgccctgcagggcttcaagatcacccccagccacgccatgaagatcacctacgccaagaagtag

SEQ ID NO: 16936 - DNA, 678 bp, Artificial Sequence; identical to SEQ ID NO: 16935
  Description of Artificial Sequence: Synthetic coding sequence

SEQ ID NO: 16937 - DNA, 2142 bp, Artificial Sequence
  Description of Artificial Sequence: Synthetic coding sequence
atgagcaccaggacccccctgcccaccgtgaatgaaagagacacagagaaccacaccagccatggagatggccggcaggaggtgaccagcaggaccagccgcagcggggcccgctgcaggaacagcatcgccagctgtgctgatgagcagccccacatcggcaactaccgcctgctgaagaccatcggcaagggcaactttgccaaggtgaagctggcccggcacatcctgaccggccgggaggtggccatcaagatcatcgacaagacccagctgaaccccaccagcctgcagaagctgttccgggaggtgcgcatcatgaagatcctgaaccaccccaacatcgtgaagctgtttgaagtcatcgagacagagaagaccctgtacctgatcatggagtatgccagcggcggggaggtgtttgactacctggtggcccacggccgcatgaaggagaaggaggcccggagcaagttccggcagatcgtgtctgctgtgcagtactgccaccagaagagaattgtgcaccgggacctgaaggccgagaacctgctgctggatgctgacatgaacatcaagattgctgactttggcttcagcaatgagttcaccgtgggcggcaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagcgcttcctggtgctgaaccccatcaagaggggcaccctggagcagatcatgaaggaccgctggatcaatgccggccatgaagaagatgagctgaagccctttgtggagcctgagctggacatcagtgaccagaagagaattgacatcatggtgggcatgggctacagccaggaggagatccaggagagcctgagcaagatgaagtatgatgagatcacagccacctacctgctgctgggcaggaagagcagcgaggtgcggcccagcagtgacctgaacaacagcacaggccagagcccccaccacaaggtgcagaggagcgtcttcagcagccagaagcagaggcgctacagcgaccacgccggccctgccatccccagcgtggtggcctaccccaagaggagccagaccagcacagctgacagcgacctgaaggaggatggcatcagcagcaggaagagcagcggcagcgctgtgggcggcaaaggaattgccccagccagccccatgctgggcaatgccagcaaccccaacaaggctgacatccctgagaggaagaagagcagcacagtgcccagcagcaacacagccagcggcggcatgaccaggaggaacacctacgtgtgcagcgagaggaccacagctgacagacacagcgtcatccagaatggcaaggagaacagcaccatcccagaccagaggacccctgtggccagcacccacagcatcagcagcgctgccaccccagaccgcatccgcttcccccggggcacagccagccgcagcaccttccacggccagccccgggagaggagaacagccacctacaacggccccccagccagccccagcctgagccatgaggccacccccctgagccagaccaggagccggggcagcaccaacctcttcagcaagctgaccagcaagctgaccaggagcagaaatgtgtctgctgagcagaaggatgagaacaaggaggccaagcccaggagcctgcgcttcacctggagcatgaagaccaccagctccatggaccccggggacatgatgagggagatcaggaaggtgctggatgccaacaactgtgactatgagcagcgggagcgcttcctgctcttctgtgtgcatggagatggccatgctgagaacctggtgcagtgggagatggaggtgtgcaagctgccccggctgagcctgaatggagtgcgcttcaagaggatcagcggcaccagcatcgccttcaagaacatcgccagcaagatcgccaatgagctgaagctgtag

SEQ ID NO: 16938 - DNA, 1059 bp, Artificial Sequence
  Description of Artificial Sequence: Synthetic coding sequence
atggcccccaagctgatcaccgtgctgtgcctgggcttctgcctgaaccagaagatctgcccccatgctggggcccaggacaagttcagcctgagcgcctggcccagccctgtggtgcccctgggcggccgggtgaccctgagctgccacagccacctgcgctttgtgatctggaccatcttccagaccaccggcaccaggagccatgagctgcacacaggcctgagcaacaacatcaccatcagccctgtgaccccagagcacgccggcacctaccgctgtgtgggcatctacaagcacgccagcaagtggagcgctgagagcaacagcctgaagatcatcgtgacaggcctcttcaccaagcccagcatcagcgcccaccccagcagcctggtgcacgccggggcccgggtgtccctgcgctgccacagcgagctggcctttgatgagttcatcctgtacaaggagggccacatccagcacagccagcagctggaccagggcatggaggccggcatccactacgtggaggccgtgttctccatgggccctgtgaccccagcccacgccggggcctaccgctgctgcggctgcttcagccacagccgctatgagtggagcgcccccagcgaccccctggacatcgtcatcaccgggaagtacaagaagcccagcctgagcacccaggtggaccccatgatgaggctgggggagaagctgaccctcttctgcagcagcgagatcagctttgaccagtaccacctgttcagacatggagtggcccacggccagtggctgagcggcggccagaggcaccgggaggccttccaggccaacttctctgtgggccgggccacccctgtgcctgggggcacctaccgctgctacggcagcttcaatgacagcccctacaagccccctgtgacccgctgcaacttcaccccccaggagaccctgcgggtgctgctgtgccacagccagaacccccccctgaacctgacccacctggccctgaaggacagccctgccacctgcatctgcagcctggacagccagtag

SEQ ID NO: 16939 - DNA, 75 bp, Artificial Sequence
  Description of Artificial Sequence: Synthetic coding sequence
ctggccagctcctgggacctgagccctgagcctgtgcctgagagcctgggcccccctgtgggccctggcctgtag

SEQ ID NO: 16940 - DNA, 375 bp, Artificial Sequence
  Description of Artificial Sequence: Synthetic coding sequence
atgctggtgctgggcagccagaagctgacccagctgcgggacagcatccgctgtgtgtctgacctgcagatcggcggggagttcagcaacaccccagaccaggcccctgagcacatcagcaaggacctgtacaagagcgccttcttctactttgagggcaccttctacaatgacaagcgctacccagaatgtcgggacctgagcaggaccatcatcgagtggagcgagagccatgaccggggctacggcaagttccagacagccaggatggaggacttcaccttcaatgacctgtgcatcaagctgggcttcccctacctgtactgccaccagggcgactgtgagcacgtgattgtcatcacagacatcagatag

SEQ ID NO: 16941 - DNA, 732 bp, Artificial Sequence
  Description of Artificial Sequence: Synthetic coding sequence
atggccgagggcagcagaggaggccccacctgcagcggcgtgggcggccggcaggaccctgtgtctggcagcggcggctgcaacttcccagaatatgagctgcctgagctgaacacccgggccttccacgtgggcgcctttggagagctgtggaggggccgcctgcggggggccggggacctgagcctgcgggagcccccagccagcgccctgcccggcagccaggccgctgacagcgaccgggaggatgctgctgtggcccgggacctggactgcagcctggaggccgctgctgagctgcgggctgtgtgtggcctggacaagctgaagtgcctggaggatggagaggaccctgaggtgatcccagaaaatacagacctggtgaccctgggcgtgaggaagcgcttcctggagcaccgggaggagaccatcaccatcgaccgggcctgccggcaggagacctttgtgtatgagatggagagccacgccatcggcaagaagccagaaaattctgctgacatgattgaggagggggagctgatcctgtctgtgaacatcctgtaccctgtgatcttccacaaggacctgtacaagagcgccttcttctactttgagggcaccttctacaatgacaagcgctacccagagtgccgggacctgagcaggaccatcatcgagtggagcgagagccatgaccggggctacggcaagttccagacagccaggatgtag

SEQ ID NO: 16942 - DNA, 1236 bp, Artificial Sequence
  Description of Artificial Sequence: Synthetic coding sequence
atggccgagggcagcagaggaggccccacctgcagcggcgtgggcggccggcaggaccctgtgtctggcagcggcggctgcaacttcccagaatatgagctgcctgagctgaacacccgggccttccacgtgggcgcctttggagagctgtggaggggccgcctgcggggggccggggacctgagcctgcgggagcccccagccagcgccctgcccggcagccaggccgctgacagcgaccgggaggatgctgctgtggcccgggacctggactgcagcctggaggccgctgctgagctgcgggctgtgtgtggcctggacaagctgaagtgcctggaggatggagaggaccctgaggtgatcccagaaaatacagacctggtgaccctgggcgtgaggaagcgcttcctggagcaccgggaggagaccatcaccatcgaccgggcctgccggcaggagacctttgtgtatgagatggagagccacgccatcggcaagaagccagaaaattctgctgacatgattgaggagggggagctgatcctgtctgtgaacatcctgtaccctgtgatcttccacaagcacaaggagcacaagccctaccagaccatgctggtgctgggcagccagaagctgacccagctgcgggacagcatccgctgtgtgtctgacctgcagattggaggagagttcagcaacaccccagaccaggcccctgagcacatcagcaaggacctgtacaagagcgccttcttctactttgagggcaccttctacaatgacaagcgctacccagagtgccgggacctgagcaggaccatcatcgagtggagcgagagccatgaccggggctacggcaagttccagacagccaggatggaggacttcaccttcaatgacctgtgcatcaagctgggcttcccctacctgtactgccaccagggcgactgtgaacatgtgattgtcatcacagacatccggctggtgcaccatgatgactgcctggacaggaccctgtaccccctgctgatcaagaagcactggctgtggaccaggaaatgttttgtgtgcaagatgtacacagcccgctgggtgaccaacaatgacagctttgcccctgaggacccctgcttcttctgtgatgtgtgcttcaggatgctgcactatgattctgagggcaacaagctgggggagttcctggcctacccctacgtggaccccggcaccttcaactag

SEQ ID NO: 16943 - DNA, 732 bp, Artificial Sequence; identical to SEQ ID NO: 16941
  Description of Artificial Sequence: Synthetic coding sequence

SEQ ID NO: 16944 - DNA, 657 bp, Artificial Sequence
  Description of Artificial Sequence: Synthetic coding sequence
atggccgagggcagcagaggaggccccacctgcagcggcgtgggcggccggcaggaccctgtgtctggcagcggcggctgcaacttcccagaatatgagctgcctgagctgaacacccgggccttccacgtgggcgcctttggagagctgtggaggggccgcctgcggggggcccgggacctggactgcagcctggaggccgctgctgagctgcgggctgtgtgtggcctggacaagctgaagtgcctggaggatggagaagatcctgaggtgattcctgagaacacagacctggtgaccctgggcgtgaggaagcgcttcctggagcaccgggaggagaccatcaccatcgaccgggcctgccggcaggagacctttgtgtatgagatggagagccacgccatcggcaagaagccagagaacagcgctgacatgattgaggagggggagctgatcctgtctgtgaacatcctgtaccctgtgatcttccacaagcacaaggagcacaagccctaccagaccatgctggtgctgggcagccagaagctgacccagctgcgggacagcatccgctgtgtgtctgacctgcagatcggcggggagttcagcaacaccccagaccaggcccctgagcacatcagcaagaactaccactag

SEQ ID NO: 16945 - DNA, 1236 bp, Artificial Sequence; identical to SEQ ID NO: 16942
  Description of Artificial Sequence: Synthetic coding sequence

SEQ ID NO: 16946 - DNA, 1236 bp, Artificial Sequence; identical to SEQ ID NO: 16942
  Description of Artificial Sequence: Synthetic coding sequence

SEQ ID NO: 16947 - DNA, 4410 bp, Artificial Sequence
  Description of Artificial Sequence: Synthetic coding sequence
atggatgtggatgctgagcgggagaagatcacccaggagatcaaggagctggagcgcatcctggaccccggcagcagcggcagccacgtggagatcagcgagagcagcctggagagtgacagcgaggccgacagcctgcccagcgaggacctggaccctgctgacccccccatcagcgaggaggagcgctggggcgaggccagcaatgatgaagatgaccccaaggacaagaccctgcctgaagatcctgagacctgcctgcagctgaacatggtgtaccaggaggtgatccaggagaagctggccgaggccaacctgctgctggcccagaaccgggagcagcaggaggagctgatgagggacctggccggcagcaagggcaccaaggtgaaggatggcaagagcctgccccccagcacctacatgggccacttcatgaagccctacttcaaggacaaggtgactggagtgggccccccagccaatgaagacacccgggagaaggccgcccagggcatcaaggcctttgaggagctgctggtgaccaagtggaagaactgggagaaggccctgctgaggaagtctgtggtgtctgaccggctgcagaggctgctgcagcccaagctgctgaagctggagtacctgcaccagaagcagagcaaggtgagcagcgagctggagcggcaggccctggagaagcagggccgggaggccgagaaggagatccaggacatcaaccagctgcctgaggaggccctgctgggcaaccggctggacagccatgactgggagaagatcagcaacatcaactttgagggcagccgctctgctgaggagatcaggaagttctggcagaacagcgagcaccccagcatcaacaagcaggagtggagccgggaggaggaggagcggctgcaggccatcgccgccgcccacggccacctggagtggcagaagattgctgaggagctgggcaccagccgcagcgccttccagtgcctgcagaagttccagcagcacaacaaggccctgaagaggaaggagtggacagaggaggaggacaggatgctgacccagctggtgcaggagatgagggtgggcagccacatcccctacagaagaattgtgtactacatggagggccgggacagcatgcagctgatctaccgctggaccaagagcctggaccccggcctgaagaagggctactgggcccctgaggaggatgccaagctgctgcaggccgtggccaagtatggagagcaggactggttcaagatccgggaggaggtgcccggccgcagtgatgcccagtgccgggaccgctacctgcggcggctgcacttcagcctgaagaagggccgctggaacctgaaggaggaggagcagctgattgagctgattgagaagtatggagtgggccactgggccaagatcgccagcgagctgccccacaggagcggcagccagtgcctgagcaagtggaagatcatgatgggcaagaagcagggcctgcggaggagaagaagaagagcccggcacagcgtgcgctggagcagcaccagcagcagcggcagcagcagcggcagcagcggcggcagcagcagcagcagcagcagcagcagcgaggaggatgagcctgagcaggcccaggccggggagggggaccgggccctgctgagcccccagtacatggtgcctgacatggacctgtgggtgcctgcccggcagagcaccagccagccctggaggggcggggccggggcctggctgggcggccctgctgccagcctgagcccccccaagggcagcagcgccagccagggcggcagcaaggaggccagcaccacagctgctgcccctggagaggagaccagccctgtgcaggtgcctgcccgggcccacggccctgtgcccaggtctgcccaggccagccacagcgctgacaccaggcctgctggagctgagaagcaggccctggagggcggccggcggctgctgactgtgcctgtggagaccgtgctgcgggtgctgcgggccaacacagctgcccggagctgcacccagaaggagcagctgcggcagccccccctgcccaccagcagccctggggtgtcctctggggacagcgtggcccggagccacgtgcagtggctgcggcaccgggccacccagagcggccagaggcgctggaggcatgccctgcaccggcggctgctgaacagaaggctgctgctggccgtgaccccctgggtgggagatgtggtggtgccctgcacccaggccagccagaggcctgctgtggtgcagacccaggctgatggcctgcgggagcagctgcagcaggcccggctggccagcacccctgtgttcaccctcttcacccagctgttccacatcgacacagctggctgcctggaggtggtgcgggagaggaaggccctgcccccccggctgccccaggccggggcccgggacccccctgtgcacctgctgcaggccagcagcagcgcccagagcaccccaggccacctgttccccaacgtgcctgcccaggaggccagcaagagcgccagccacaagggcagccggcggctggccagcagccgggtggagaggaccctgccccaggccagcctgctggccagcacaggcccccggcccaagcccaagacagtgtctgagctgctgcaggagaagaggctgcaggaggcccgggcccgggaggccacccggggccctgtggtgctgcccagccagctgctggtgagcagcagcgtcatcctgcagccccccctgccccacaccccccacggccgcccagcccctggccccaccgtgctgaatgtgcccctgagcggccctggggccccagctgctgccaagccaggcaccagcggctcctggcaggaggccggcaccagcgccaaggacaagaggctgagcaccatgcaggccctgcccctggcccctgtgttcagcgaggccgagggcacagccccagctgccagccaggccccagccctgggccctggccagatctctgtgtcctgcccagagagcggcctgggccagagccaggccccagctgccagcaggaagcagggcctgcctgaggccccacccttcctgcctgctgcccccagccccacccccctgcctgtgcagcccctgagcctgacccacatcggcggcccccacgtggccacctctgtgcccctgcctgtgacctgggtgctgacagcccagggcctgctgcctgtgcctgtgcctgctgtggtgtccctgcccaggcctgctggcaccccaggccctgctggcctgctggccaccctgctgccccccctgacagagaccagggctgcccagggcccccgggccccagccctgagcagctcctggcagcccccagccaacatgaaccgggagcctgagcccagctgcaggacagacaccccagccccacccacccacgccctgagccagagccctgctgaggctgatggctctgtggcctttgtgcctggagaggcccaggtggcccgggagatccctgagcccaggaccagcagccatgctgaccccccagaggccgagcccccctggagcggccgcctgcctgcctttggaggagtcatcccagccacagagccccggggcaccccaggcagccccagcggcacccaggagccccggggccccctgggcctggagaagctgcccctgcggcagcccggccctgagaagggggccctggacctggagaagccacccctgccccagcccggccctgagaagggggccctggacctgggcctgctgagccaggagggggaggccgccacccagcagtggctgggcggccagaggggcgtgcgggtgcccctgctgggcagccggctgccctaccagcccccagccctgtgcagcctgcgggccctgagcggcctgctgctgcacaagaaggccctggagcacaaggccaccagcctggtggtgggcggggaggccgagaggcctgctggggccctgcaggccagcctgggcctggtgcggggccagctgcaggacaacccagcctacctgctgctgcgggcccgcttcctggccgccttcaccctgcctgccctgctggccaccctggccccccagggcgtgaggaccaccctgtctgtgcccagccgggtgggcagcgagagtgaagatgaggacctgctgtctgagctggagctggccgacagagatggccagcccggctgcaccacagccacctgccccatccagggcgccccagattctggaaaatgttctgccagcagctgcctggacaccagcaatgaccctgatgacctggatgtgctgcggaccaggcatgcccggcacaccaggaagagaagaaggctggtgtag

SEQ ID NO: 16948 - DNA, 207 bp, Artificial Sequence
  Description of Artificial Sequence: Synthetic coding sequence
atgctgagccggctgcaggagctgaggaaggaggaggagaccctgctgcggctgaaggccgccctgcatgaccagctgaaccggctgaagatgctggtgcacgtggacaatgaggccagcatcaaccagaccaccctggagctgagcaccaagagccacgtgacagaggaggaggaggaggaggaggaggaggagagtgacagctag

SEQ ID NO: 16949 - DNA, 297 bp, Artificial Sequence
  Description of Artificial Sequence: Synthetic coding sequence
atgctgagccggctgcaggagctgaggaaggaggaggagaccctgctgcggctgaaggccgccctgcatgaccagctgaaccggctgaaggtggaggagctggccctgcagagcatgatcagcagcagaagaggagatgagatgctgagcagccacacagtgcctgagcagagccatgacatgctggtgcacgtggacaatgaggccagcatcaaccagaccaccctggagctgagcaccaagagccacgtgacagaggaggaggaggaggaggaggaggaggagagtgacagctag

SEQ ID NO: 16950 - DNA, 297 bp, Artificial Sequence; identical to SEQ ID NO: 16949
  Description of Artificial Sequence: Synthetic coding sequence

SEQ ID NO: 16951 - DNA, 5052 bp, Artificial Sequence
  Description of Artificial Sequence: Synthetic coding sequence
atgagcagcaggaggaagagggcccctcctgtgcgggtggatgaggagaagaggcagcagctgcactggaacatgcatgaagatagaagaaatgagcccatcatcatcagtgatgatgatgagcagccctgccccggcagtgacaccagcagcgcccactacatcatcctgagtgacagcctgaaggaggaggtggcccaccgggacaagaagcgctgcagcaaggtggtgtccttcagcaagcccatcgagaaggaggagaccgtgggcatcttcagccccctgtctgtgaagctgaacatcgtcatcagcccctaccactttgacaacagctggaaggccttcctgggggagctgaccctgcagctgctgcctgcccagagcctgattgagaacttcagcgagaggagcatcaccctgatgagcagcgagagcagcaaccagttcctgatctacgtgcacagcaagggggaggatgtggagaagcagaagaaggagcccatgagcatctgtgacaagggcatcctggtggagagcagcttcagcggggagatgctggaggacctgggctggctgcagaagaagaggcgcatcaagctgtaccagaagccagagggcaaccacatcatcaaggtgggcatctacctgctggaggccggcctggccaagctggacttcctgagtgatgccaacagcaggatgaagaagttcaaccagctgatgaagaaggtgatggagaagctgcacaacagcatcatcccagatgtgctggaggaggatgaagatgatcctgagagcgagcctgagggccaggacattgatgagctgtaccactttgtgaagcagacccaccagcaggagacccagagcatccaggtggatgtgcagcacccagccctgatccctgtgctgcggccctaccagcgggaggccgtgaactggatgctgcagcaggagtgcttccgcagcagccctgccacagaaagtgccctgcacttcctgtggagggagatcgtgaccagcgagggcctgaagctgtactacaacccctacacaggctgcatcatccgggagtaccccaacagcggcccccagctgctgggcggcatcctggctgatgagatgggcctgggcaagacagtggaggtgctggccctgatcctgacccacacccggcaggatgtgaagcaggatgccctgaccctgcctgagggcaaggtggtgaactacttcatccccagccactactttggaggcaagctgaagaagacagagatccagaacattgaatttgagcccaaggagaaggtgcagtgcccccccaccagggtgatgatcctgacagctgtgaaggagatgaatggcaagaagggcgtgtccatcctgagcatctacaagtatgtgagcagcatctaccgctatgatgtgcagaggaacagaagcctgctgaagaggatgctgaagtgcctgatctttgagggcctggtgaagcagatcaagggccacggcttcagcggcaccttcaccctgggcaagaactacaaggaggaggacatctgtgacaagaccaagaagcaggccgtgggcagccccaggaagatccagaaggagaccaggaagagcggcaacaaggacacagacagcgagtacctgcccagcgacaccagtgatgatgatgatgacccctactactactactacaagagcagaagaaacagaagcaagctgaggaagaagctggtgcccagcaccaagaagggcaagagccagcccttcatcaacccagacagccagggccactgcccagccaccagtgacagcggcatcacagatgtggccatgagcaagagcacctgcatcagcgagttcaaccaggagcatgaaacagaggactgtgccgagagcctgaaccacgccgacagtgatgtgccccccagcaacaccatgagccccttcaacaccagtgactacagatttgagtgcatctgtggggagctggaccagattgacaggaagccccgggtgcagtgcctgaagtgccacctgtggcagcacgccaagtgtgtgaactatgatgagaagaacctgaagatcaagcccttctactgcccccactgcctggtggccatggagcctgtgtccacccgggccaccctcatcatcagccccagcagcatctgccaccagtgggtggatgagatcaacagacatgtgcgcagcagcagcctgcgggtgctggtgtaccagggcgtgaagaaggatggcttcctgcagccccacttcctggccgagcaggacatcgtcatcatcacctatgatgtgctgcggtctgagctgaactacgtggacatcccccacagcaacagtgaagatggaagaaggctgaggaaccagaagcgctacatggccatccccagccccctggtggccgtggagtggtggaggatctgcctggatgaggcccagatggtggagtgccccaccgtgaaggctgctgagatggcccagaggctgagcggcatcaaccgctggtgcatcagcggcacccctgtgcagaggggcctggaggacctgtttggcctggtggtgttcctgggcatcgagccctactgtgtgaagcactggtgggtgcggctgctgtaccggccctactgcaagaagaacccccagcacctgtacagcttcatcgccaagatcctgtggaggtctgccaagaaggatgtgattgaccagatccagatccccccccagacagaggagatccactggctgcacttcagccctgtggagcggcacttctaccaccggcagcacgaggtgtgctgccaggatgtggtggtgaagctgaggaagatcagtgactgggccctgaagctgagcagcctggacagaagaacagtgaccagcatcctgtaccccctgctgcggctgcggcaggcctgctgccacccccaggccgtgcggggggagttcctgcccctgcagaagagcaccatgaccatggaggagctgctgaccagcctgcagaagaagtgtggcacagaatgtgaggaggcccaccggcagctggtgtgtgccctgaatggcctggccggcatccacatcatcaagggggagtatgccctggccgctgagctgtaccgggaggtgctgcggagcagcgaggagcacaagggcaagctgaagacagacagcctgcagaggctgcacgccacccacaacctgatggagctgctgattgcccggcaccctggcatcccccccaccctgagagatggccgcctggaggaggaggccaagcagctgcgggagcactacatgagcaagtgcaacacagaggtggccgaggcccagcaggccctgtaccctgtgcagcagaccatccacgagctgcagaggaagatccacagcaacagcccctggtggctgaatgtcatccaccgggccatcgagttcaccattgatgaggagctggtgcagagggtgagaaatgagatcaccagcaactacaagcagcagacaggcaagctgtccatgtctgagaagttccgggactgccggggcctgcagttcctgctgaccacccagatggaggagctgaacaagtgccagaagctggtgcgggaggccgtgaagaacctggagggcccccccagcagaaatgtgattgaaagtgccaccgtgtgccacctgcggcctgcccggctgcccctgaactgctgcgtgttctgcaaggcagatgagctgttcacagaatatgagagcaagctgttcagcaacacagtgaagggccagacagccatctttgaggagatgattgaagatgaggagggcctggtggatgaccgggcccccaccaccacccggggcctgtgggccatcagcgagacagagaggtccatgaaggccatcctgagctttgccaagagccacagatttgatgtggagtttgtggatgagggcagcacctccatggacctgtttgaggcctggaagaaggagtacaagctgctgcacgagtactggatggccctgaggaacagagtgtctgctgtggatgagctggccatggccacagagcggctgcgggtgcgggacccccgggagcccaagcccaacccccctgtgctgcacatcatcgagccccatgaggtggagcagaaccgcatcaagctgctgaatgacaaggctgtggccaccagccagctgcagaagaagctgggccagctgctgtacctgaccaacctggagaagagccaggacaagaccagcggcggcgtgaaccctgagccctgccccatctgtgcccggcagctgggcaagcagtgggccgtgctgacctgtggccactgcttctgcaatgaatgcatcagcatcatcatcgagcagtacagcgtgggcagccacaggagcagcatcaagtgtgccatctgccggcagaccaccagccacaaggagatctcctatgtgttcaccagcgagaaggccaaccaggaggaggacatccctgtgaagggcagccacagcaccaaggtggaggccgtggtgaggaccctgatgaagatccagctgcgggaccccggggccaaggccctggtgttcagcacctggcaggatgtgctggacatcatcagcaaggccctgacagacaacaacatggagtttgcccagatcagccgggtgaagaccttccaggagaacctgagcgccttcaagagggacccccagatcaacatcctgctgctgcccctgcacacaggcagcaatggcctgaccatcatcgaggccacccacgtgctgctggtggagcccatcctgaacccagcccacgagctgcaggccatcggccgggtgcacagaattggccagaccaagcccaccatcgtgcaccgcttcctgatcaaggccaccatcgaggagaggatgcaggccatgctgaagacagctgagaggagccacaccaacagcagcgccaagcacagcgaggcctctgtgctgactgtggccgacctggccgacctcttcaccaaggagacagaggagctggagtag

SEQ ID NO: 16952 - DNA, 5064 bp, Artificial Sequence
  Description of Artificial Sequence: Synthetic coding sequence
atgagcagcaggaggaagagggcccctcctgtgcgggtggatgaggagaagaggcagcagctgcactggaacatgcatgaagatagaagaaatgagcccatcatcatcagtgatgatgatgagcagccctgccccggcagtgacaccagcagcgcccactacatcatcctgagtgacagcctgaaggaggaggtggcccaccgggacaagaagcgctgcagcaaggtggtgtccttcagcaagcccatcgagaaggaggagaccgtgggcatcttcagccccctgtctgtgaagctgaacatcgtcatcagcccctaccactttgacaacagctggaaggccttcctgggggagctgaccctgcagctgctgcctgcccagagcctgattgagaacttcagcgagaggagcatcaccctgatgagcagcgagagcagcaaccagttcctgatctacgtgcacagcaagggggaggatgtggagaagcagaagaaggagcccatgagcatctgtgacaagggcatcctggtggagagcagcttcagcggggagatgctggaggacctgggctggctgcagaagaagaggcgcatcaagctgtaccagaagccagagggcaaccacatcatcaaggtgggcatctacctgctggaggccggcctggccaagctggacttcctgagtgatgccaacagcaggatgaagaagttcaaccagctgatgaagaaggtgatggagaagctgcacaacagcatcatcccagatgtgctggaggaggatgaagatgatcctgagagcgagcctgagggccaggacattgatgagctgtaccactttgtgaagcagacccaccagcaggagacccagagcatccaggtggatgtgcagcacccagccctgatccctgtgctgcggccctaccagcgggaggccgtgaactggatgctgcagcaggagtgcttccgcagcagccctgccacagaaagtgccctgcacttcctgtggagggagatcgtgaccagcgagggcctgaagctgtactacaacccctacacaggctgcatcatccgggagtaccccaacagcggcccccagctgctgggcggcatcctggctgatgagatgggcctgggcaagacagtggaggtgctggccctgatcctgacccacacccggcaggatgtgaagcaggatgccctgaccctgcctgagggcaaggtggtgaactacttcatccccagccactactttggaggcaagctgaagaagacagagatccagaacattgaatttgagcccaaggagaaggtgcagtgcccccccaccagggtgatgatcctgacagctgtgaaggagatgaatggcaagaagggcgtgtccatcctgagcatctacaagtatgtgagcagcatctaccgctatgatgtgcagaggaacagaagcctgctgaagaggatgctgaagtgcctgatctttgagggcctggtgaagcagatcaagggccacggcttcagcggcaccttcaccctgggcaagaactacaaggaggaggacatctgtgacaagaccaagaagcaggccgtgggcagccccaggaagatccagaaggagaccaggaagagcggcaacaaggacacagacagcgagtacctgcccagcgacaccagtgatgatgatgatgacccctactactactactacaagagcagaagaaacagaagcaagctgaggaagaagctggtgcccagcaccaagaagggcaagagccagcccttcatcaacccagacagccagggccactgcccagccaccagtgacagcggcatcacagatgtggccatgagcaagagcacctgcatcagcgagttcaaccaggagcatgaaacagaggactgtgccgagagcctgaaccacgccgacagtgatgtgccccccagcaacaccatgagccccttcaacaccagtgactacagatttgagtgcatctgtggggagctggaccagattgacaggaagccccgggtgcagtgcctgaagtgccacctgtggcagcacgccaagtgtgtgaactatgatgagaagaacctgaagatcaagcccttctactgcccccactgcctggtggccatggagcctgtgtccacccgggccaccctcatcatcagccccagcagcatctgccaccagtgggtggatgagatcaacagacatgtgcgcagcagcagcctgcgggtgctggtgtaccagggcgtgaagaaggatggcttcctgcagccccacttcctggccgagcaggacatcgtcatcatcacctatgatgtgctgcggtctgagctgaactacgtggacatcccccacagcaacagtgaagatggaagaaggctgaggaaccagaagcgctacatggccatccccagccccctggtggccgtggagtggtggaggatctgcctggatgaggcccagatggtggagtgccccaccgtgaaggctgctgagatggcccagaggctgagcggcatcaaccgctggtgcatcagcggcacccctgtgcagaggggcctggaggacctgtttggcctggtggtgttcctgggcatcgagccctactgtgtgaagcactggtgggtgcggctgctgtaccggccctactgcaagaagaacccccagcacctgtacagcttcatcgccaagatcctgtggaggtctgccaagaaggatgtgattgaccagatccagatccccccccagacagaggagatccactggctgcacttcagccctgtggagcggcacttctaccaccggcagcacgaggtgtgctgccaggatgtggtggtgaagctgaggaagatcagtgactgggccctgaagctgagcagcctggacagaagaacagtgaccagcatcctgtaccccctgctgcggctgcggcaggcctgctgccacccccaggccgtgcggggggagttcctgcccctgcagaagagctttgagcagagcaccttctccttcagcaccatgaccatggaggagctgctgaccagcctgcagaagaagtgtggcacagaatgtgaggaggcccaccggcagctggtgtgtgccctgaatggcctggccggcatccacatcatcaagggggagtatgccctggccgctgagctgtaccgggaggtgctgcggagcagcgaggagcacaagggcaagctgaagacagacagcctgcagaggctgcacgccacccacaacctgatggagctgctgattgcccggcaccctggcatcccccccaccctgagagatggccgcctggaggaggaggccaagcagctgcgggagcactacatgagcaagtgcaacacagaggtggccgaggcccagcaggccctgtaccctgtgcagcagaccatccacgagctgcagaggaagatccacagcaacagcccctggtggctgaatgtcatccaccgggccatcgagttcaccattgatgaggagctggtgcagagggtgagaaatgagatcaccagcaactacaagcagcagacaggcaagctgtccatgtctgagaagggcctgcagttcctgctgaccacccagatggaggagctgaacaagtgccagaagctggtgcgggaggccgtgaagaacctggagggcccccccagcagaaatgtgattgaaagtgccaccgtgtgccacctgcggcctgcccggctgcccctgaactgctgcgtgttctgcaaggcagatgagctgttcacagaatatgagagcaagctgttcagcaacacagtgaagggccagacagccatctttgaggagatgattgaagatgaggagggcctggtggatgaccgggcccccaccaccacccggggcctgtgggccatcagcgagacagagaggtccatgaaggccatcctgagctttgccaagagccacagatttgatgtggagtttgtggatgagggcagcacctccatggacctgtttgaggcctggaagaaggagtacaagctgctgcacgagtactggatggccctgaggaacagagtgtctgctgtggatgagctggccatggccacagagcggctgcgggtgcgggacccccgggagcccaagcccaacccccctgtgctgcacatcatcgagccccatgaggtggagcagaaccgcatcaagctgctgaatgacaaggctgtggccaccagccagctgcagaagaagctgggccagctgctgtacctgaccaacctggagaagagccaggacaagaccagcggcggcgtgaaccctgagccctgccccatctgtgcccggcagctgggcaagcagtgggccgtgctgacctgtggccactgcttctgcaatgaatgcatcagcatcatcatcgagcagtacagcgtgggcagccacaggagcagcatcaagtgtgccatctgccggcagaccaccagccacaaggagatctcctatgtgttcaccagcgagaaggccaaccaggaggaggacatccctgtgaagggcagccacagcaccaaggtggaggccgtggtgaggaccctgatgaagatccagctgcgggaccccggggccaaggccctggtgttcagcacctggcaggatgtgctggacatcatcagcaaggccctgacagacaacaacatggagtttgcccagatcagccgggtgaagaccttccaggagaacctgagcgccttcaagagggacccccagatcaacatcctgctgctgcccctgcacacaggcagcaatggcctgaccatcatcgaggccacccacgtgctgctggtggagcccatcctgaacccagcccacgagctgcaggccatcggccgggtgcacagaattggccagaccaagcccaccatcgtgcaccgcttcctgatcaaggccaccatcgaggagaggatgcaggccatgctgaagacagctgagaggagccacaccaacagcagcgccaagcacagcgaggcctctgtgctgactgtggccgacctggccgacctcttcaccaaggagacagaggagctggagtag

SEQ ID NO: 16953 - DNA, 5052 bp, Artificial Sequence; identical to SEQ ID NO: 16951
  Description of Artificial Sequence: Synthetic coding sequence

SEQ ID NO: 16954 - DNA, 468 bp, Artificial Sequence
  Description of Artificial Sequence: Synthetic coding sequence
atggagtttgcccagatcagccgggtgaagaccttccaggagaacctgagcgccttcaagagggacccccagatcaacatcctgctgctgcccctgcacacaggcagcaatggcctgaccatcatcgaggccacccacgtgctgctggtggagcccatcctgaacccagcccacgagctgcaggccatcggccgggtgcacagaattggccagaccaagcccaccatcgtgcaccgcttcctgatcaaggccaccatcgaggagaggatgcaggccatgctgaagacagctgagcggcgcttctttgaggagcaggccctcttctgcttccatgacatcacccccttcagccacccctggagcctgaccacagccatcctgcagctgcgggacctggtgatctgtgagctgttcttcatctacttcaagaacttcctgatctgcttcctgagcagcttcagcatctag

SEQ ID NO: 16955 - DNA, 4980 bp, Artificial Sequence
  Description of Artificial Sequence: Synthetic coding sequence
atgagcagcaggaggaagagggcccctcctgtgcgggtggatgaggagaagaggcagcagctgcactggaacatgcatgaagatagaagaaatgagcccatcatcatcagtgatgatgatgagcagccctgccccggcagtgacaccagcagcgcccactacatcatcctgagtgacagcctgaaggaggaggtggcccaccgggacaagaagcgctgcagcaaggtggtgtccttcagcaagcccatcgagaaggaggagaccgtgggcatcttcagccccctgtctgtgaagctgaacatcgtcatcagcccctaccactttgacaacagctggaaggccttcctgggggagctgaccctgcagctgctgcctgcccagagcctgattgagaacttcagcgagaggagcatcaccctgatgagcagcgagagcagcaaccagttcctgatctacgtgcacagcaagggggaggatgtggagaagcagaagaaggagcccatgagcatctgtgacaagggcatcctggtggagagcagcttcagcggggagatgctggaggacctgggctggctgcagaagaagaggcgcatcaagctgtaccagaagccagagggcaaccacatcatcaaggtgggcatctacctgctggaggccggcctggccaagctggacttcctgagtgatgccaacagcaggatgaagaagttcaaccagctgatgaagaaggtgatggagaagctgcacaacagcatcatcccagatgtgctggaggaggatgaagatgatcctgagagcgagcctgagggccaggacattgatgagctgtaccactttgtgaagcagacccaccagcaggagacccagagcatccaggtggatgtgcagcacccagccctgatccctgtgctgcggccctaccagcgggaggccgtgaactggatgctgcagcaggagtgcttccgcagcagccctgccacagaaagtgccctgcacttcctgtggagggagatcgtgaccagcgagggcctgaagctgtactacaacccctacacaggctgcatcatccgggagtaccccaacagcggcccccagctgctgggcggcatcctggctgatgagatgggcctgggcaagacagtggaggtgctggccctgatcctgacccacacccggcaggatgtgaagcaggatgccctgaccctgcctgagggcaaggtggtgaactacttcatccccagccactactttggaggcaagctgaagaagacagagatccagaacattgaatttgagcccaaggagaaggtgcagtgcccccccaccagggtgatgatcctgacagctgtgaaggagatgaatggcaagaagggcgtgtccatcctgagcatctacaagtatgtgagcagcatctaccgctatgatgtgcagaggaacagaagcctgctgaagaggatgctgaagtgcctgatctttgagggcctggtgaagcagatcaagggccacggcttcagcggcaccttcaccctgggcaagaactacaaggaggaggacatctgtgacaagaccaagaagcaggccgtgggcagccccaggaagatccagaaggagaccaggaagagcggcaacaaggacacagacagcgagtacctgcccagcgacaccagtgatgatgatgatgacccctactactactactacaagagcagaagaaacagaagcaagctgaggaagaagctggtgcccagcaccaagaagggcaagagccagcccttcatcaacccagacagccagggccactgcccagccaccagtgacagcggcatcacagatgtggccatgagcaagagcacctgcatcagcgagttcaaccaggagcatgaaacagaggactgtgccgagagcctgaaccacgccgacagtgatgtgccccccagcaacaccatgagccccttcaacaccagtgactacagatttgagtgcatctgtggggagctggaccagattgacaggaagccccgggtgcagtgcctgaagtgccacctgtggcagcacgccaagtgtgtgaactatgatgagaagaacctgaagatcaagcccttctactgcccccactgcctggtggccatggagcctgtgtccacccgggccaccctcatcatcagccccagcagcatctgccaccagtgggtggatgagatcaacagacatgtgcgcagcagcagcctgcgggtgctggtgtaccagggcgtgaagaaggatggcttcctgcagccccacttcctggccgagcaggacatcgtcatcatcacctatgatgtgctgcggtctgagctgaactacgtggacatcccccacagcaacagtgaagatggaagaaggctgaggaaccagaagcgctacatggccatccccagccccctggtggccgtggagtggtggaggatctgcctggatgaggcccagatggtggagtgccccaccgtgaaggctgctgagatggcccagaggctgagcggcatcaaccgctggtgcatcagcggcacccctgtgcagaggggcctggaggacctgtttggcctggtggtgttcctgggcatcgagccctactgtgtgaagcactggtgggtgcggctgctgtaccggccctactgcaagaagaacccccagcacctgtacagcttcatcgccaagatcctgtggaggtctgccaagaaggatgtgattgaccagatccagatccccccccagacagaggagatccactggctgcacttcagccctgtggagcggcacttctaccaccggcagcacgaggtgtgctgccaggatgtggtggtgaagctgaggaagatcagtgactgggccctgaagctgagcagcctggacagaagaacagtgaccagcatcctgtaccccctgctgcggctgcggcaggcctgctgccacccccaggccgtgcggggggagttcctgcccctgcagaagagctttgagcagagcaccttctccttcagcaccatgaccatggaggagctgctgaccagcctgcagaagaagtgtggcacagaatgtgaggaggcccaccggcagctggtgtgtgccctgaatggcctggccggcatccacatcatcaagggggagtatgccctggccgctgagctgtaccgggaggtgctgcggagcagcgaggagcacaagggcaagctgaagacagacagcctgcagaggctgcacgccacccacaacctgatggagctgctgattgcccggcaccctggcatcccccccaccctgagagatggccgcctggaggaggaggccaagcagctgcgggagcactacatgagcaagtgcaacacagaggtggccgaggcccagcaggccctgtaccctgtgcagcagaccatccacgagctgcagaggaagatccacagcaacagcccctggtggctgaatgtcatccaccgggccatcgagttcaccattgatgaggagctggtgcagagggtgagaaatgagatcaccagcaactacaagcagcagacaggcaagctgtccatgtctgagaagggcctgcagttcctgctgaccacccagatggaggagctgaacaagtgccagaagctggtgcgggaggccgtgaagaacctggagggcccccccagcagaaatgtgattgaaagtgccaccgtgtgccacctgcggcctgcccggctgcccctgaactgctgcgtgttctgcaaggcagatgagctgttcacagaatatgagagcaagctgttcagcaacacagtgaagggccagacagccatctttgaggagatgattgaagatgaggagggcctggtggatgaccgggcccccaccaccacccggggcctgtgggccatcagcgagacagagaggtccatgaaggccatcctgagctttgccaagagccacagatttgatgtggagtttgtggatgagggcagcacctccatggacctgtttgaggcctggaagaaggagtacaagctgctgcacgagtactggatggccctgaggaacagagtgtctgctgtggatgagctggccatggccacagagcggctgcgggtgcgggacccccgggagcccaagcccaacccccctgtgctgcacatcatcgagccccatgaggtggagcagaaccgcatcaagctgctgaatgacaaggctgtggccaccagccagctgcagaagaagctgggccagctgctgtacctgaccaacctggagaagagccaggacaagaccagcggcggcgtgaaccctgagccctgccccatctgtgcccggcagctgggcaagcagtgggccgtgctgacctgtggccactgcttctgcaatgaatgcatcagcatcatcatcgagcagtacagcgtgggcagccacaggagcagcatcaagtgtgccatctgccggcagaccaccagccacaaggagatctcctatgtgttcaccagcgagaaggccaaccaggaggaggacatccctgtgaagggcagccacagcaccaaggtggaggccgtggtgaggaccctgatgaagatccagctgcgggaccccggggccaaggccctggtgttcagcacctggcaggatgtgctggacatcatcagcaaggccctgacagacaacaacatggagtttgcccagatcagccgggtgaagaccttccaggagaacctgagcgccttcaagagggacccccagatcaacatcctgctgctgcccctgcacacaggcagcaatggcctgaccatcatcgaggccacccacgtgctgctggtggagcccatcctgaacccagcccacgagctgcaggccatcggccgggtgcacagaattggccagaccaagcccaccatcgtgcaccgcttcctgatcaaggccaccatcgaggagaggatgcaggccatgctgaagacagctgagaggagcatctacatctag

SEQ ID NO: 16956 - DNA, 1983 bp, Artificial Sequence
  Description of Artificial Sequence: Synthetic coding sequence
atgagcagcaggaggaagagggcccctcctgtgcgggtggatgaggagaagaggcagcagctgcactggaacatgcatgaagatagaagaaatgagcccatcatcatcagtgatgatgatgagcagccctgccctggagaagatgtggagaagcagaagaaggagcccatgagcatctgtgacaagggcatcctggtggagagcagcttctctggagagatgctggaggacctgggctggctgcagaagaagaggcgcatcaagctgtaccagaagccagagggcaaccacatcatcaaggtgggcatctacctgctggaggccggcctggccaagctggacttcctgagtgatgccaacagcaggatgaagaagttcaaccagctgatgaagaaggtgatggagaagctgcacaacagcatcatcccagatgtgctggaggaggatgaagatgatcctgagagcgagcctgagggccaggacattgatgagctgtaccactttgtgaagcagacccaccagcaggagacccagagcatccaggtggatgtgcagcacccagccctgatccctgtgctgcggccctaccagcgggaggccgtgaactggatgctgcagcaggagtgcttccgcagcagccctgccacagagagcgccctgcacttcctgtggagagaaattgtgaccagcgagggcctgaagctgtactacaacccctacacaggctgcatcatccgggagtaccccaacagcggcccccagctgctgggcggcatcctggctgatgagatgggcctgggcaagacagtggaggtgctggccctgatcctgacccacacccggcaggatgtgaagcaggatgccctgaccctgcctgagggcaaggtggtgaactacttcatccccagccactactttggaggcaagctgaagaagacagagatccagaacatcgagtttgagcccaaggagaaggtgcagtgcccccccaccagggtgatgatcctgacagctgtgaaggagatgaatggcaagaagggcgtgtccatcctgagcatctacaagtatgtgagcagcatctaccgctatgatgtgcagaggaacagaagcctgctgaagaggatgctgaagtgcctgatctttgagggcctggtgaagcagatcaagggccacggcttcagcggcaccttcaccctgggcaagaactacaaggaggaggacatctgtgacaagaccaagaagcaggccgtgggcagccccaggaagatccagaaggagaccaggaagagcggcaacaaggacacagattctgagtacctgcccagcgacaccagtgatgatgatgatgacccctactactactactacaagagcagaagaaacagaagcaagctgaggaagaagctggtgcccagcaccaagaagggcaagagccagcccttcatcaacccagacagccagggccactgcccagccaccagtgacagcggcatcacagatgtggccatgagcaagagcacctgcatcagcgagttcaaccaggagcacgagacagaggactgtgccgagagcctgaaccacgccgacagtgatgtgccccccagcaacaccatgagccccttcaacaccagtgactacagatttgagtgcatctgtggggagctggaccagattgacaggaagccccgggtgcagtgcctgaagtgccacctgtggcagcacgccaagtgtgtgaactatgatgagaagaacctgaagatcaagcccttctactgcccccactgcctggtggccatggagcctgtgtccacccgggccaccctcatcatcagccccagcagcatctgccaccagtgggtggatgagatcaacagacatgtgcgcagcagcagcctgcgggtgctggtgtaccagggcgtgaagaaggatggcttcctgcagccccacttcggccgcacaggctacagctaccactacctgtag

SEQ ID NO: 16957 - DNA, 216 bp, Artificial Sequence
  Description of Artificial Sequence: Synthetic coding sequence
atggagcgggcccgggaccggctgcacctgcggaggaccacagagcagcacgtgcctgaggtggaggtgcaggtgaagagaagaagaacagccagcctgagcaaccaggagtgccagctgtaccccaggaggagccagcagcagcaggtgcctgtggtggacttccaggccgagctgcggcaggccttcctggccgagaccccccggggcggctag

SEQ ID NO: 16958 - DNA, 216 bp, Artificial Sequence; identical to SEQ ID NO: 16957
  Description of Artificial Sequence: Synthetic coding sequence

SEQ ID NO: 16959 - DNA, 375 bp, Artificial Sequence
  Description of Artificial Sequence: Synthetic coding sequence
atgaccccccagggccggggcaccgtggccgctgctgctgtggccgccacagccagcattgctggggcccccacccagtacccacctggccggggcaccccacctcctcctgtgggccgggccaccccacctcctggcatcatggcccctcctcctggcatgaggcctcccatgggcccccccatcggcctgcccccagcccggggcacccccatcggcatgcctcctcctggcatgaggcctcctcctcctggcatccggggggaggccttcctgctggccctggtgtgctggtacggctggcccctggactttggcatgtctgactatgctgcctacctgaagaagacctgcttccaggacctcttcaactag

SEQ ID NO: 16960 - DNA, 216 bp, Artificial Sequence; identical to SEQ ID NO: 16957
  Description of Artificial Sequence: Synthetic coding sequence

SEQ ID NO: 16961 - DNA, 1611 bp, Artificial Sequence
  Description of Artificial Sequence: Synthetic coding sequence
atggccctgaccagcttcctgcctgcccccacccagctgagccaggaccagctggaggccgaggagaaggcccggagccagaggagccggcagaccagcctggtgagcagccggcgggagcccccaccctacggctacaggaagggctggatcccccggctgctggaggactttggagatggaggagccttccctgagatccacgtggcccagtaccccctggacatgggcaggaagaagaagatgagcaatgccctggccatccaggtggacagcgagggcaagatcaagtatgatgccatcgcccggcagggccagagcaaggacaaggtgatctacagcaagtacacagacctggtgcccaaggaggtgatgaatgctgatgatcctgacctgcagaggccagatgaggaggccatcaaggagatcacagagaagaccagggtggccctggagaagtctgtgtcccagaaggtggccgccgccatgcctgtgcgggctgctgacaagctggccccagcccagtacatccgctacacccccagccagcagggcgtggccttcaacagcggggccaagcagagggtcatccgcatggtggagatgcagaaggaccccatggagcccccacgcttcaagatcaacaagaagatcccccggggcccccccagccccccagcccctgtgatgcacagccccagcaggaagatgacagtgaaggagcagcaggagtggaagatccccccctgcatcagcaactggaagaatgccaagggctacaccatccccctggacaagaggctggccgcagatggccggggcctgcagacagtgcacatcaatgaaaattttgccaagctggccgaggccctgtacatcgctgacaggaaggcccgggaggccgtggagatgagggcccaggtggagaggaagatggcccagaaggagaaggagaagcatgaggagaagctgcgggagatggcccagaaggcccgggagcggcgggccggcatcaagacccacgtggagaaggaggatggagaggcccgggagagagatgagatcagacatgacaggaggaaggagcggcagcacgacaggaacctgagccgggccgccccagacaagaggagcaagctgcagagaaatgaaaatagagacatcagcgaggtgattgccctgggcgtgcccaaccccaggaccagcaatgaggtgcagtatgaccagaggctcttcaaccagagcaagggcatggacagcggctttgctggaggagaagatgagatctacaacgtgtatgaccaggcctggaggggcggcaaggacatggcccagagcatctaccggcccagcaagaacctggacaaggacatgtatggagatgacctggaggcccgcatcaagaccaacagatttgtgcctgacaaggagttcagcggcagtgaccggcggcagaggggccgggagggccctgtgcagtttgaggaggaccccttcggcctggacaagttcctggaggaggccaagcagcacggcggcagcaagaggcccagcgacagcagccggcccaaggagcacgagcacgagggcaagaagaggaggaaggagtag

SEQ ID NO: 16962 - DNA, 867 bp, Artificial Sequence
  Description of Artificial Sequence: Synthetic coding sequence
atggccctgaccagcttcctgcctgcccccacccagctgagccaggaccagctggaggccgaggagaaggcccggagccagaggagccggcagaccagcctggtgagcagccggcgggagcccccaccctacggctacaggaagggctggatcccccggctgctggaggactttggagatggaggagccttccctgagatccacgtggcccagtaccccctggacatgggcaggaagaagaagatgagcaatgccctggccatccaggtggacagcgagggcaagatcaagtatgatgccatcgcccggcagggccagagcaaggacaaggtgatctacagcaagtacacagacctggtgcccaaggaggtgatgaatgctgatgatcctgacctgcagaggccagatgaggaggccatcaaggagatcacagagaagaccagggtggccctggagaagtctgtgtcccagaaggtggccgccgccatgcctgtgcgggctgctgacaagctggccccagcccagtacatccgctacacccccagccagcagggcgtggccttcaacagcggggccaagcagagggtcatccgcatggtggagatgcagaaggaccccatggagcccccacgcttcaagatcaacaagaagatcccccggggcccccccagccccccagcccctgtgatgcacagccccagcaggaagatgacagtgaaggagcagcaggagtggaagatccccccctgcatcagcaactggaagaatgccaagggctacaccatccccctggacaagaggctggccgcagatggccggggcctgcagacagtgcacaagaagaagaagaagaagaagaggaagtag

SEQ ID NO: 16963 - DNA, 558 bp, Artificial Sequence
  Description of Artificial Sequence: Synthetic coding sequence
atggccctgaccagcttcctgcctgcccccacccagctgagccaggaccagctggaggccgaggagaaggcccggagccagaggagccggcagaccagcctggtgagcagccggcgggagcccccaccctacggctacaggaagggctggatcccccggctgctggaggactttggagatggaggagccttccctgagatccacgtggcccagtaccccctggacatgggcaggaagaagaagatgagcaatgccctggccatccaggtggacagcgagggcaagatcaagtatgatgccatcgcccggcagggccagagcaaggacaaggtgatctacagcaagtacacagacctggtgcccaaggaggtgatgaatgctgatgatcctgacctgcagaggccagatgaggaggccatcaaggagatgacagtgaaggagcagcaggagtggaagatccccccctgcatcagcaactggaagaatgccaagggctacaccatccccctggacaagaggctggccgcagatggccggggcctgcagacagtgcactag

SEQ ID NO: 16964 - DNA, 2211 bp, Artificial Sequence
  Description of Artificial Sequence: Synthetic coding sequence
atggtggccgagatccagaatgtggagggccagaacctgcaggagcaggtgtgcccagagcccatcttccgcttcttccgggagaacaaggtggagatcgccagcgccatcacccggcccttccccttcctgatgggcctgcgggaccgctccttcatcagcgagcagatgtatgagcacttccaggaggccttcaggaacctggtgcctgtgaccagggtgatgtactgtgtgctgtctgagctggagaagaccttcggctggagccacctggaggccctcttcagccgcatcaacctgatggcctacccagacctgaatgagatctaccgctccttccagaatgtgtgctatgagcacagccccctgcagatgaacaacgtgaatgacctggaggaccggccccggctgctgccctacggcaagcaggagaacagcaatgcctgccacgagatggatgacattgctgtgccccaggaggccctgagcagcagcccccgctgtgagcccggcttcagcagcgagagctgtgagcagctggccctgcccaaggccggcggcggagatgctgaagatgcccccagcctgctgcccggcggcggcgtgtcctgcaagctggccatccagattgatgaaggagagagcgaggagatgcccaagctgctgccctatgacacagaggagacctttgacctgaagaccccccaggtgaccaatgaaggagagcctgagaagggcctgtgcctgctgcctggagagggggaggagggcagtgatgactgcagcgagatgtgtgatggagaggagcggcaggaggccagcagcagcctggcccggcggggctctgtgtcctctgagctggagaaccaccccatgaatgaggagggggagagcgaggagctggccagcagcctgctgtatgacaacgtgcctggagctgagcagagcgcctatgaaaatgagaagtgcagctgtgtgatgtgcttcagcgaggaggtgcccggcagccctgaggccaggacagaaagtgaccaggcctgtggcaccatggacacagtggacatcgccaacaacagcaccctgggcaagcccaagaggaagaggaggaagaagaggggccacggctggagcaggatgaggatgaggcggcaggagaacagccagcagaatgacaacagcaaggcagatggccaggtggtgagcagcgagaagaaggccaacgtgaacctgaaggacctgagcaagatccggggcaggaagaggggcaagccaggcacccgcttcacccagagcgaccgggccgcccagaagagggtgcgcagccgggccagcaggaagcacaaggatgaaacagtggacttcaaggcccccctgctgcctgtgacctgtggcggcgtgaagggcatcctgcacaagaagaagctgcagcagggcatcctggtgaagtgcatccagacagaagatggcaagtggttcacccccacagaatttgagatcaagggcggccacgcccggagcaagaactggaggctgtctgtgcgctgtggcggctggcccctgcgctggctgatggagaatggcttcctgcctgaccccccacgcatccgctacaggaagaagaagaggatcctgaagagccagaacaacagctctgtggacccctgcatgaggaacctggatgaatgtgaggtgtgcagagatggaggagagctgttctgctgtgacacctgcagcagggtcttccacgaggactgccacatcccccctgtggaggccgagaggaccccctggaactgcatcttctgcaggatgaaggagagccctggcagccagcagtgctgccaggagagcgaggtgctggagcggcagatgtgcccagaggagcagctgaagtgtgagttcctgctgctgaaggtgtactgctgcagcgagagcagcttctttgccaagatcccctactactactacatccgggaggcctgccagggcctgaaggagcccatgtggctggacaagatcaagaagaggctgaatgagcacggctacccccaggtggagggctttgtgcaggacatgaggctcatcttccagaaccaccgggccagctacaagtacaaggactttggccagatgggcttccggctggaggccgagtttgagaagaacttcaaggaggtgtttgccatccaggagaccaatggaaacaactag

SEQ ID NO: 16965 - DNA, 519 bp, Artificial Sequence
  Description of Artificial Sequence: Synthetic coding sequence
atggcccagcagggccagcagggccagatggccagcggggacagcaacctgaacttcaggatggtggccgagatccagaatgtggagggccagaacctgcaggagcaggtgtgcccagagcccatcttccgcttcttccgggagaacaaggtggagatcgccagcgccatcacccggcccttccccttcctgatgggcctgcgggaccgctccttcatcagcgagcagatgtatgagcacttccaggaggccttcaggaacctggtgcctgtgaccagggtgatgtactgtgtgctgtctgagctggagaagaccttcggctggagccacctggaggccctcttcagccgcatcaacctgatggcctacccagacctgaatgagatctaccgctccttccagaatgaaaacctgagcagcagcgctgtgctgtgccagctggtgagccccaacaaggactggaggagccatgaggagagcctggcccacacaggcaccctgcggcgcagctgcatgtag

SEQ ID NO: 16966 - DNA, 1218 bp, Artificial Sequence
  Description of Artificial Sequence: Synthetic coding sequence
atggcccagcagggccagcagggccagatggccagcggggacagcaacctgaacttcaggatggtggccgagatccagaatgtggagggccagaacctgcaggagcaggtgtgcccagagcccatcttccgcttcttccgggagaacaaggtggagatcgccagcgccatcacccggcccttccccttcctgatgggcctgcgggaccgctccttcatcagcgagcagatgtatgagcacttccaggaggccttcaggaacctggtgcctgtgaccagggtgatgtactgtgtgctgtctgagctggagaagaccttcggctggagccacctggaggccctcttcagccgcatcaacctgatggcctacccagacctgaatgagatctaccgctccttccagaatgtgtgctatgagcacagccccctgcagatgaacaacgtgaatgacctggaggaccggccccggctgctgccctacggcaagcaggagaacagcaatgcctgccacgagatggatgacattgctgtgccccaggaggccctgagcagcagcccccgctgtgagcccggcttcagcagcgagagctgtgagcagctggccctgcccaaggccggcggcggagatgctgaagatgcccccagcctgctgcccggcggcggcgtgtcctgcaagctggccatccagattgatgaaggagagagcgaggagatgcccaagctgctgccctatgacacagaggtgctggagagcaatggcatgattgatgctgcccggacctacagcacagcccctggagagaagcagggcgaggaggagggcaggaacagccccaggaagaggaaccaggacaaggagaagtaccaggagagccctgagggccgggacaaggagacctttgacctgaagaccccccaggtgaccaatgaaggagagcctgagaagggcctgtgcctgctgcctggagagggggaggagggcagtgatgactgcagcgagatgtgtgatggagaggagccccaggaggccagcagcagcctggcccgctgtggcagcgagggcagtgatgactgcagcgagatgtgtgatggagaggagcggcaggaggcccagaagcagggcaggaaggtgatcaagagggtggcccagtggatcctgtggatcctgcagaccacccccctgtgggagaacccccggggcaaggaggacaagaggtag

SEQ ID NO: 16967 - DNA, 2604 bp, Artificial Sequence
  Description of Artificial Sequence: Synthetic coding sequence
atggcccagcagggccagcagggccagatggccagcggggacagcaacctgaacttcaggatggtggccgagatccagaatgtggagggccagaacctgcaggagcaggtgtgcccagagcccatcttccgcttcttccgggagaacaaggtggagatcgccagcgccatcacccggcccttccccttcctgatgggcctgcgggaccgctccttcatcagcgagcagatgtatgagcacttccaggaggccttcaggaacctggtgcctgtgaccagggtgatgtactgtgtgctgtctgagctggagaagaccttcggctggagccacctggaggccctcttcagccgcatcaacctgatggcctacccagacctgaatgagatctaccgctccttccagaatgtgtgctatgagcacagccccctgcagatgaacaacgtgaatgacctggaggaccggccccggctgctgccctacggcaagcaggagaacagcaatgcctgccacgagatggatgacattgctgtgccccaggaggccctgagcagcagcccccgctgtgagcccggcttcagcagcgagagctgtgagcagctggccctgcccaaggccggcggcggagatgctgaagatgcccccagcctgctgcccggcggcggcgtgtcctgcaagctggccatccagattgatgaaggagagagcgaggagatgcccaagctgctgccctatgacacagaggtgctggagagcaatggcatgattgatgctgcccggacctacagcacagcccctggagagaagcagggcgaggaggagggcaggaacagccccaggaagaggaaccaggacaaggagaagtaccaggagagccctgagggccgggacaaggagacctttgacctgaagaccccccaggtgaccaatgaaggagagcctgagaagggcctgtgcctgctgcctggagagggggaggagggcagtgatgactgcagcgagatgtgtgatggagaggagccccaggaggccagcagcagcctggcccgctgtggctctgtgtcctgcctgtctgctgagacctttgacctgaagaccccccaggtgaccaatgaaggagagcctgagaaggagctgagcctgctgcccggggagggggaggagggcagtgatgactgcagcgagatgtgtgatggagaggagcggcaggaggccagcagcagcctggcccggcggggctctgtgagcagcgagctggagaaccaccccatgaatgaggagggggagagcgaggagctggccagcagcctgctgtatgacaacgtgcctggagctgagcagagcgcctatgaaaatgagaagtgcagctgtgtgatgtgcttcagcgaggaggtgcccggcagccctgaggccaggacagaaagtgaccaggcctgtggcaccatggacacagtggacatcgccaacaacagcaccctgggcaagcccaagaggaagaggaggaagaagaggggccacggctggagcaggatgaggatgaggcggcaggagaacagccagcagaatgacaacagcaaggcagatggccaggtggtgtcctctgagaagaaggccaacgtgaacctgaaggacctgagcaagatccggggcaggaagaggggcaagccaggcacccgcttcacccagagcgacagagctgcccagaagagggtgcgcagccgggccagcaggaagcacaaggatgagaccgtggacttcaaggcccccctgctgcctgtgacctgtggcggcgtgaagggcatcctgcacaagaagaagctgcagcagggcatcctggtgaagtgcatccagacagaagatggcaagtggttcacccccacagaatttgagatcaagggcggccacgcccggagcaagaactggaggctgtctgtgcgctgtggcggctggcccctgcgctggctgatggagaatggcttcctgcctgaccccccacgcatccgctacaggaagaagaagaggatcctgaagagccagaacaacagctctgtggacccctgcatgaggaacctggatgaatgtgaggtgtgcagagatggaggagagctgttctgctgtgacacctgcagcagggtcttccacgaggactgccacatcccccctgtggaggccgagaggaccccctggaactgcatcttctgcaggatgaaggagagccctggcagccagcagtgctgccaggagagcgaggtgctggagcggcagatgtgcccagaggagcagctgaagtgtgagttcctgctgctgaaggtgtactgctgcagcgagagcagcttctttgccaagatcccctactactactacatccgggaggcctgccagggcctgaaggagcccatgtggctggacaagatcaagaagaggctgaatgaacatggctacccccaggtggagggctttgtgcaggacatgaggctcatcttccagaaccaccgggccagctacaagtacaaggactttggccagatgggcttccggctggaggccgagtttgagaagaacttcaaggaggtgtttgccatccaggagaccaacggcaacaactag

SEQ ID NO: 16968 - DNA, 2523 bp, Artificial Sequence
  Description of Artificial Sequence: Synthetic coding sequence
atggcccagcagggccagcagggccagatggccagcggggacagcaacctgaacttcaggatggtggccgagatccagaatgtggagggccagaacctgcaggagcaggtgtgcccagagcccatcttccgcttcttccgggagaacaaggtggagatcgccagcgccatcacccggcccttccccttcctgatgggcctgcgggaccgctccttcatcagcgagcagatgtatgagcacttccaggaggccttcaggaacctggtgcctgtgaccagggtgatgtactgtgtgctgtctgagctggagaagaccttcggctggagccacctggaggccctcttcagccgcatcaacctgatggcctacccagacctgaatgagatctaccgctccttccagaatgtgtgctatgagcacagccccctgcagatgaacaacgtgaatgacctggaggaccggccccggctgctgccctacggcaagcaggagaacagcaatgcctgccacgagatggatgacattgctgtgccccaggaggccctgagcagcagcccccgctgtgagcccggcttcagcagcgagagctgtgagcagctggccctgcccaaggccggcggcggagatgctgaagatgcccccagcctgctgcccggcggcggcgtgtcctgcaagctggccatccagattgatgaaggagagagcgaggagatgcccaagctgctgccctatgacacagaggtgctggagagcaatggcatgattgatgctgcccggacctacagcacagcccctggagagaagcagggcgaggaggagggcaggaacagccccaggaagaggaaccaggacaaggagaagtaccaggagagccctgagggccgggacaaggagacctttgacctgaagaccccccaggtgaccaatgaaggagagcctgagaagggcctgtgcctgctgcctggagagggggaggagggcagtgatgactgcagcgagatgtgtgatggagaggagccccaggaggccagcagcagcctggcccgctgtggctctgtgtcctgcctgtctgctgagacctttgacctgaagaccccccaggtgaccaatgaaggagagcctgagaaggagctgagcctgctgcccggggagggggaggtgtcctctgagctggagaaccaccccatgaatgaggagggggagagcgaggagctggccagcagcctgctgtatgacaacgtgcctggagctgagcagagcgcctatgaaaatgagaagtgcagctgtgtgatgtgcttcagcgaggaggtgcccggcagccctgaggccaggacagaaagtgaccaggcctgtggcaccatggacacagtggacatcgccaacaacagcaccctgggcaagcccaagaggaagaggaggaagaagaggggccacggctggagcaggatgaggatgaggcggcaggagaacagccagcagaatgacaacagcaaggcagatggccaggtggtgagcagcgagaagaaggccaacgtgaacctgaaggacctgagcaagatccggggcaggaagaggggcaagccaggcacccgcttcacccagagcgaccgggccgcccagaagagggtgcgcagccgggccagcaggaagcacaaggatgaaacagtggacttcaaggcccccctgctgcctgtgacctgtggcggcgtgaagggcatcctgcacaagaagaagctgcagcagggcatcctggtgaagtgcatccagacagaagatggcaagtggttcacccccacagaatttgagatcaagggcggccacgcccggagcaagaactggaggctgtctgtgcgctgtggcggctggcccctgcgctggctgatggagaatggcttcctgcctgaccccccacgcatccgctacaggaagaagaagaggatcctgaagagccagaacaacagctctgtggacccctgcatgaggaacctggatgaatgtgaggtgtgcagagatggaggagagctgttctgctgtgacacctgcagcagggtcttccacgaggactgccacatcccccctgtggaggccgagaggaccccctggaactgcatcttctgcaggatgaaggagagccctggcagccagcagtgctgccaggagagcgaggtgctggagcggcagatgtgcccagaggagcagctgaagtgtgagttcctgctgctgaaggtgtactgctgcagcgagagcagcttctttgccaagatcccctactactactacatccgggaggcctgccagggcctgaaggagcccatgtggctggacaagatcaagaagaggctgaatgagcacggctacccccaggtggagggctttgtgcaggacatgaggctcatcttccagaaccaccgggccagctacaagtacaaggactttggccagatgggcttccggctggaggccgagtttgagaagaacttcaaggaggtgtttgccatccaggagaccaatggaaacaactag

SEQ ID NO: 16969 - DNA, 2307 bp, Artificial Sequence
  Description of Artificial Sequence: Synthetic coding sequence
atggcccagcagggccagcagggccagatggccagcggggacagcaacctgaacttcaggatggtggccgagatccagaatgtggagggccagaacctgcaggagcaggtgtgcccagagcccatcttccgcttcttccgggagaacaaggtggagatcgccagcgccatcacccggcccttccccttcctgatgggcctgcgggaccgctccttcatcagcgagcagatgtatgagcacttccaggaggccttcaggaacctggtgcctgtgaccagggtgatgtactgtgtgctgtctgagctggagaagaccttcggctggagccacctggaggccctcttcagccgcatcaacctgatggcctacccagacctgaatgagatctaccgctccttccagaatgtgtgctatgagcacagccccctgcagatgaacaacgtgaatgacctggaggaccggccccggctgctgccctacggcaagcaggagaacagcaatgcctgccacgagatggatgacattgctgtgccccaggaggccctgagcagcagcccccgctgtgagcccggcttcagcagcgagagctgtgagcagctggccctgcccaaggccggcggcggagatgctgaagatgcccccagcctgctgcccggcggcggggagacctttgacctgaagaccccccaggtgaccaatgaaggagagcctgagaagggcctgtgcctgctgcctggagagggggaggagggcagtgatgactgcagcgagatgtgtgatggagaggagccccaggaggccagcagcagcctggcccgctgtggctctgtgtcctgcctgtctgctgagacctttgacctgaagaccccccaggtgaccaatgaaggagagcctgagaaggagctgagcctgctgcccggggagggggaggagggcagtgatgactgcagcgagatgtgtgatggagaggagcggcaggaggccagcagcagcctggcccggcggggctctgtgagcagcgagctggagaaccaccccatgaatgaggagggggagagcgaggagctggccagcagcctgctgtatgacaacgtgcctggagctgagcagagcgcctatgaaaatgagaagtgcagctgtgtgatgtgcttcagcgaggaggtgcccggcagccctgaggccaggacagaaagtgaccaggcctgtggcaccatggacacagtggacatcgccaacaacagcaccctgggcaagcccaagaggaagaggaggaagaagaggggccacggctggagcaggatgaggatgaggcggcaggagaacagccagcagaatgacaacagcaaggcagatggccaggtggtgtcctctgagaagaaggccaacgtgaacctgaaggacctgagcaagatccggggcaggaagaggggcaagccaggcacccgcttcacccagagcgacagagctgcccagaagagggtgcgcagccgggccagcaggaagcacaaggatgagaccgtggacttcaaggcccccctgctgcctgtgacctgtggcggcgtgaagggcatcctgcacaagaagaagctgcagcagggcatcctggtgaagtgcatccagacagaagatggcaagtggttcacccccacagaatttgagatcaagggcggccacgcccggagcaagaactggaggctgtctgtgcgctgtggcggctggcccctgcgctggctgatggagaatggcttcctgcctgaccccccacgcatccgctacaggaagaagaagaggatcctgaagagccagaacaacagctctgtggacccctgcatgaggaacctggatgaatgtgaggtgtgcagagatggaggagagctgttctgctgtgacacctgcagcagggtcttccacgaggactgccacatcccccctgtggaggccgagaggaccccctggaactgcatcttctgcaggatgaaggagagccctggcagccagcagtgctgccaggagagcgaggtgctggagcggcagatgtgcccagaggagcagctgaagtgtgagttcctgctgctgaaggtgtactgctgcagcgagagcagcttctttgccaagatcccctactactactacatccgggaggcctgccagggcctgaaggagcccatgtggctggacaagatcaagaagaggctgaatgaacatggctacccccaggtggagggctttgtgcaggacatgaggctcatcttccagaaccaccgggccagctacaaggctgtgcacggccggcccggctgcaggtag

SEQ ID NO: 16970 - DNA, 570 bp, Artificial Sequence
  Description of Artificial Sequence: Synthetic coding sequence
atggcccagcagggccagcagggccagatggccagcggggacagcaacctgaacttcaggatggtggccgagatccagaatgtggagggccagaacctgcaggagcaggtgtgcccagagcccatcttccgcttcttccgggagaacaaggtggagatcgccagcgccatcacccggcccttccccttcctgatgggcctgcgggaccgctccttcatcagcgagcagatgtatgagcacttccaggaggccttcaggaacctggtgcctgtgaccagggtgatgtactgtgtgctgtctgagctggagaagaccttcggctggagccacctggaggccctcttcagccgcatcaacctgatggcctacccagacctgaatgagatctaccgctccttccagaatgtgtgctatgagcacagccccctgcagatgaacaacgtgaatgacctggaggaccggccccggctgctgccctacggcaagcaggagaacagcaatgcctgccacgagatggacttctgcctgatcctgcaggagtatgtgacaggcaagaagcgggagtactag

SEQ ID NO: 16971 - DNA, 1317 bp, Artificial Sequence
  Description of Artificial Sequence: Synthetic coding sequence
atggccggcggcggcagtgacctgagcacccggggcctgaatggaggagtgtcccaggtggccaatgagatgaaccacctgcctgcccacagccagagcctgcagaggctcttcacagaggaccaggatgtggatgagggcctggtgtatgacaccgtcttcaagcacttcaagaggcacaagctggagatcagcaatgccatcaagaagaccttccccttcctggagggcctgcgggaccgggagctgatcaccaacaagatgtttgaggacagcgaggacagctgcaggaacctggtgcctgtgcagagggtggtgtacaacgtgctgtctgagctggagaagaccttcaacctgtctgtgctggaggccctcttcagcgaggtgaacatgcaggagtacccagacctgatccacatctacaagagcttcaagaatgccatccaggacaagctgtccttccaggagagtgacaggaaggagcgggaggagaggccagacatcaagctgagcctgaagcagggcgaggtgcctgagagccctgaggccaggaaggagagtgaccaggcctgtgggaagatggacacagtggacatcgccaacaacagcaccctgggcaagcccaagaggaagaggaggaagaagaagggccacggctggagcaggatgggcaccaggacccagaagaacaaccagcagaatgacaacagcaaggcagatggccagctggtgagcagcgagaagaaggccaacatgaacctgaaggacctgagcaagatccggggcaggaagaggggcaagccaggcacccacttcacccagagcgaccgggccccccagaagagggtgcgcagccgggccagcaggaagcacaaggatgaaacagtggacttccaggcccccctgctgcctgtgacctgtggcggcgtgaagggcatcctgcacaaggagaagctggagcagggcaccctggccaagtgcatccagacagaagatggcaagtggttcacccccatggagtttgagatcaagggcggctacgcccggagcaagaactggaggctgtctgtgcgctgtggcggctggcccctgcggcggctgatggaggagggcagcctgcccaaccccccacgcatctactacagaaacaagaagaggatcctgaagagccagaacaacagctctgtggacccctgcatgaggaacctggatgaatgtgaggtgtgcagagatggaggagagctgttctgctgtgacacctgcagcagggtcttccacgaggactgccacatcccccctgtggagagcgagaagtag

SEQ ID NO: 16972 - DNA, 1212 bp, Artificial Sequence
  Description of Artificial Sequence: Synthetic coding sequence
atggccggcggcggcagtgacctgagcacccggggcctgaatggaggagtgtcccaggtggccaatgagatgaaccacctgcctgcccacagccagagcctgcagaggctcttcacagaggaccaggatgtggatgagggcctggtgtatgacaccgtcttcaagcacttcaagaggcacaagctggagatcagcaatgccatcaagaagaccttccccttcctggagggcctgcgggaccgggagctgatcaccaacaagatgtttgaggacagcgaggacagctgcaggaacctggtgcctgtgcagagggtggtgtacaacgtgctgtctgagctggagaagaccttcaacctgtctgtgctggaggccctcttcagcgaggtgaacatgcaggagtacccagacctgatccacatctacaagagcttcaagaatgccatccaggacaagctgtccttccaggagagtgacaggaaggagcgggaggagaggccagacatcaagctgagcctgaagcagggcgaggtgcctgagagccctgaggccaggaaggagagtgaccaggcctgtgggaagatggacacagtggacatcgccaacaacagcaccctgggcaagcccaagaggaagaggaggaagaagaagggccacggctggagcaggatgggcaccaggacccagaagaacaaccagcagaatgacaacagcaaggcagatggccagctggtgagcagcgagaagaaggccaacatgaacctgaaggacctgagcaagatccggggcaggaagaggggcaagccaggcacccacttcacccagagcgaccgggccccccagaagagggtgcgcagccggggcaccctggccaagtgcatccagacagaagatggcaagtggttcacccccatggagtttgagatcaagggcggctacgcccggagcaagaactggaggctgtctgtgcgctgtggcggctggcccctgcggcggctgatggaggagggcagcctgcccaaccccccacgcatctactacagaaacaagaagaggatcctgaagagccagaacaacagctctgtggacccctgcatgaggaacctggatgaatgtgaggtgtgcagagatggaggagagctgttctgctgtgacacctgcagcagggtcttccacgaggactgccacatcccccctgtggagagcgagaagtag

SEQ ID NO: 16973 - DNA, 1743 bp, Artificial Sequence
  Description of Artificial Sequence: Synthetic coding sequence
atggccggcggcggcagtgacctgagcacccggggcctgaatggaggagtgtcccaggtggccaatgagatgaaccacctgcctgcccacagccagagcctgcagaggctcttcacagaggaccaggatgtggatgagggcctggtgtatgacaccgtcttcaagcacttcaagaggcacaagctggagatcagcaatgccatcaagaagaccttccccttcctggagggcctgcgggaccgggagctgatcaccaacaagatgtttgaggacagcgaggacagctgcaggaacctggtgcctgtgcagagggtggtgtacaacgtgctgtctgagctggagaagaccttcaacctgtctgtgctggaggccctcttcagcgaggtgaacatgcaggagtacccagacctgatccacatctacaagagcttcaagaatgccatccaggacaagctgtccttccaggagagtgacaggaaggagcgggaggagaggccagacatcaagctgagcctgaagcagggcgaggtgcctgagagccctgaggccaggaaggagagtgaccaggcctgtgggaagatggacacagtggacatcgccaacaacagcaccctgggcaagcccaagaggaagaggaggaagaagaagggccacggctggagcaggatgggcaccaggacccagaagaacaaccagcagaatgacaacagcaaggcagatggccagctggtgagcagcgagaagaaggccaacatgaacctgaaggacctgagcaagatccggggcaggaagaggggcaagccaggcacccacttcacccagagcgaccgggccccccagaagagggtgcgcagccgggccagcaggaagcacaaggatgaaacagtggacttccaggcccccctgctgcctgtgacctgtggcggcgtgaagggcatcctgcacaaggagaagctggagcagggcaccctggccaagtgcatccagacagaagatggcaagtggttcacccccatggagtttgagatcaagggcggctacgcccggagcaagaactggaggctgtctgtgcgctgtggcggctggcccctgcggcggctgatggaggagggcagcctgcccaaccccccacgcatctactacagaaacaagaagaggatcctgaagagccagaacaacagctctgtggacccctgcatgaggaacctggatgaatgtgaggtgtgcagagatggaggagagctgttctgctgtgacacctgcagcagggtcttccacgaggactgccacatcccccctgtggagagcgagaagaccccctggaactgcatcttctgcaggatgaaggagagccctggcagccagcagtgctgccaggagagcgaggtgctggagcggcagatgtgcccagaggagcagctgaagtgtgagttcctgctgctgaaggtgtactgctgcagcgagagcagcttctttgccaagatcccctactactactacatccgggaggcctgccagggcctgaaggagcccatgtggctggacaagatcaagaagaggctgaatgagcacggctacccccaggtggagggctttgtgcaggacatgaggctcatcttccagaaccaccgggccagctacaagtacaaggactttggccagatgggcctgcggctggaggccgagtttgagaaggacttcaaggaggtgtttgccatccaggagaccaatggaaacagctag

SEQ ID NO: 16974 - DNA, 1317 bp, Artificial Sequence; identical to SEQ ID NO: 16971
  Description of Artificial Sequence: Synthetic coding sequence

SEQ ID NO: 16975 - DNA, 390 bp, Artificial Sequence
  Description of Artificial Sequence: Synthetic coding sequence
atgtttgaagattctgaggacagctgcaggaacctggtgcctgtgcagagggtggtgtacaacgtgctgtctgagctggagaagaccttcaacctgtctgtgctggaggccctcttcagcgaggtgaacatgcaggagtacccagacctgatccacatctacaagagcttcaagaatgccatccaggacaagctgtccttccaggagagtgacaggaaggagcgggaggagaggccagacatcaagctgagcctgaagcagggcgaggtgcctgagagccctgaggccaggaaggagagtgaccaggcctgtgggaagatggacacagtggacatcgccaacaacagcaccctgggcaagcccaagaggaagaggagcaagaacaagtag

SEQ ID NO: 16976 - DNA, 750 bp, Artificial Sequence
  Description of Artificial Sequence: Synthetic coding sequence
atggccgccacagctgctgtgagccccagcgactacctgcagcctgctgccagcaccacccaggacagccagcccagccccctggccctgctggccgccacctgcagcaagattggccccccagctgtggaggccgctgtgaccccaccagccccaccccagcccacccccaggaagctggtgcccatcaagccagcccccctgcccctgagccctgggaagaacagctttggcatcctgagcagcaaaggaaacatcctgcagatccagggcagccagctgagcgccagctacccaggcggccagctggtgtttgccatccagaaccccaccatgatcaacaagggcaccaggagcaatgccaacatccagtaccaggccgtgccccagatccaggccagcaacagccagaccatccaggtgcagcccaacctgaccaaccagatccagatcatccctggcaccaaccaggccatcatcacccccagccccagcagccacaagcctgtgcccatcaagccagcccccatccagaagagcagcaccaccaccacccctgtgcagagcggggccaacgtggtgaagctgactggaggcggcggcaatgtgaccctgaccctgcctgtgaacaacctggtgaatgccagtgacaccggggcccccacccagctgctgacagccagctgccagacaggcatgctgaacagcaccaggatgttcctgttcctggccttcatcaacgtgctgtag

SEQ ID NO: 16977 - DNA, 1842 bp, Artificial Sequence
  Description of Artificial Sequence: Synthetic coding sequence
atgtctgacccccagacctccatggccgccacagctgctgtgagccccagcgactacctgcagcctgctgccagcaccacccaggacagccagcccagccccctggccctgctggccgccacctgcagcaagattggccccccagctgtggaggccgctgtgaccccaccagccccaccccagcccacccccaggaagctggtgcccatcaagccagcccccctgcccctgagccctgggaagaacagctttggcatcctgagcagcaagggcaacatcctgcagatccagggcagccagctgagcgccagctacccaggcggccagctggtgtttgccatccagaaccccaccatgatcaacaagggcaccaggagcaatgccaacatccagtaccaggccgtgccccagatccaggccagcaacagccagaccatccaggtgcagcccaacctgaccaaccagatccagatcatccctggcaccaaccaggccatcatcacccccagccccagcagccacaagcctgtgcccatcaagccagcccccatccagaagagcagcaccaccaccacccctgtgcagagcggggccaacgtggtgaagctgaccggcggcggcggcaatgtgaccctgaccctgcctgtgaacaacctggtgaatgccagtgacacaggagcccccacccagctgctgacagagagcccccccacccccctgagcaagaccaacaagaaggccaggaagaagagcctgcctgccagccagccccctgtggccgtggccgagcaggtggagaccgtgctgattgagaccacagctgacaacatcatccaggccggcaacaacctgctgattgtgcagagccctgggggcggccagcctgctgtggtgcagcaggtgcaggtggtgccccccaaggccgagcagcagcaggtggtgcagatcccccagcaggccctgcgggtggtgcaggccgccagcgccaccctgcccaccgtgccccagaagcccagccagaacttccagatccaggccgctgagcccacccccacccaggtgtacatccgcacccccagcggggaggtgcagacagtgctggtgcaggacagccccccagccacagctgctgccaccagcaacaccacctgcagcagccctgccagccgggccccccacctgagcggcaccagcaagaagcacagcgctgccatcctgaggaaggagcggcccctgcccaagatcgccccagctggcagcatcatcagcctgaatgctgcccagctggccgccgccgcccaggccatgcagaccatcaacatcaacggggtgcaggtgcagggcgtgcctgtgaccatcaccaacacaggaggccagcagcagctgactgtgcagaatgtgtctggcaacaacctgaccatcagcggcctgagccccacccagatccagctgcagatggagcaggccctggccggggagacccagcccggggagaagagaagaaggatggcctgcacctgccccaactgcaaggatggagagaagaggtctggagagcagggcaagaagaagcacgtgtgccacatcccagactgtgggaagaccttcaggaagaccagcctgctgcgggcccacgtgcggctgcacactggagagcggccctttgtgtgcaactggttcttctgtgggaagcgcttcaccaggagtgatgagctgcagagacatgcccggacccacactggagacaagagatttgaatgtgcccagtgccagaagcgcttcatgagaagtgaccacctgaccaagcactacaagacccacctggtgaccaagaacctgtag

SEQ ID NO: 16978 - DNA, 1197 bp, Artificial Sequence
  Description of Artificial Sequence: Synthetic coding sequence
atggctgctgtggccgtgctgagaaatgacagcctgcaggccttcctgcaggacaggacccccagcgccagcccagacctgggcaagcacagccccctggccctgctggccgccacctgcagcagaattggccagcccggggctgctgcccccccagacttcctgcaggtgccctatgaccctgccctgggcagccccagccgcctcttccacccctggacagctgacatgcctgcccacagccctggggccctgcccccaccccaccccagcctgggcctgaccccccagaagacccacctgcagcccagctttggagctgcccacgagctgcccctgaccccacctgctgaccccagctacccctatgagttcagccctgtgaagatgctgcccagctccatggccgccctgcctgccagctgtgccccagcctacgtgccctatgctgcccaggccgccctgcccccaggctacagcaacctgctgcccccacctcctcctcctcctcctccacccacctgccggcagctgagccccaacccagccccagatgacctgccctggtggagcatcccccaggccggggccggccctggggccagcggcgtgcccggcagcggcctgagcggggcctgtgccggggccccccacgccccccgcttccctgccagcgctgctgctgctgctgctgctgctgctgccctgcagaggggcctggtgctgggccccagcgactttgcccagtaccagagccagattgctgccctgctgcagaccaaggcccccctggccgccacagcccggcgctgccgccgctgccgctgccccaactgccaggccgccggcggggcccctgaggccgagcccgggaagaagaagcagcacgtgtgccacgtgcccggctgcggcaaggtgtatggcaagaccagccacctgaaggcccacctgcgctggcacactggagagcggccctttgtgtgcaactggctgttctgtgggaagagcttcaccaggagtgatgagctgcagaggcacctgcggacccacactggagagaagagatttgcctgcccagaatgtgggaagcgcttcatgagaagtgaccacctggccaagcacgtgaagacccaccagaacaagaagctgaaggtggccgaggccggcgtgaagagagaagatgcccgggacctgtag

SEQ ID NO: 16979 - DNA, 1131 bp, Artificial Sequence
  Description of Artificial Sequence: Synthetic coding sequence
atgctgacagctgtgtgtggcagcctgggcagccagcacacagaggccccccacgccagccccccccggctggacctgcagcccctgcagacctaccagggccacaccagccctgaggccggggactaccccagccccctgcagcctggagagctgcagagcctgcccctgggccctgaggtggacttcagccagggctatgagctgcccggggccagcagccgggtgacctgtgaggacctggagagtgacagccccctggcccctggccccttcagcaagctgctgcagcctgacatgagccaccactatgagagctggttccggcccacccaccctggagcagaagatggctcctggtgggacctgcaccctggcacctcctggatggacctgccccacacccagggcgccctgaccagccctggccaccctggggccctgcaggccggcctgggcggctacgtgggggaccaccagctgtgtgcccccccaccccacccccacgcccaccacctgctgcctgctgctgggggccagcacctgctgggccccccagatggagccaaggccctggaggtggccgcccctgagagccagggcctggacagcagcctggatggagctgcccggcccaagggcagccgccgctctgtgcccaggagcagcggccagacagtgtgccgctgccccaactgcctggaggccgagcggctgggcgccccctgtggcccagatggcggcaagaagaagcacctgcacaactgccacatccctggctgcggcaaggcctatgccaagaccagccacctgaaggcccacctgcgctggcacagcggggaccggccctttgtgtgcaactggctgttctgtgggaagcgcttcaccaggagtgatgagctgcagaggcacctgcagacccacacaggcaccaagaagttcccctgtgctgtgtgcagcagggtcttcatgagaagtgaccacctggccaagcacatgaagacccatgagggcgccaaggaggaggccgccggggccgccagcggggagggcaaggccggcggcgctgtggagcccccaggcggcaagggcaagcgggaggccgagggctctgtggcccccagcaactag

SEQ ID NO: 16980 - DNA, 1131 bp, Artificial Sequence; identical to SEQ ID NO: 16979
  Description of Artificial Sequence: Synthetic coding sequence

SEQ ID NO: 16981 - DNA, 1455 bp, Artificial Sequence
  Description of Artificial Sequence: Synthetic coding sequence
atggccaccagcatcctgggggaggagccccgcttcggcaccacccccctggccatgctggccgccacctgcaacaagattggcaacaccagccccctgaccaccctgcctgagagcagcgcctttgccaagggcggcttccacccctggaagaggagcagcagcagctgcaacctgggcagcagcctgagcggctttgctgtggccaccggcggccggggcagcggcggcctggccggcggcagcggggccgccaacagcgccttctgcctggccagcaccagccccaccagcagcgccttcagcagtgactatggaggcctcttcagcaacagcgctgctgctgctgctgctgctgctggggtgagcccccaggaggccggcggccagagcgccttcatcagcaaggtgcacaccacagctgctgatggcctgtacccccgggtgggcatggcccacccctatgaatcctggtacaagagcggcttccacagcaccctggccgccggggaggtgaccaacggggccgccagctcctggtgggatgtgcacagcagccctggctcctggctggaggtgcagaacccagctgggggcctgcagagcagcctgcacagcggggccccccaggccagcctgcacagccagctgggcacctacaacccagacttcagcagcctgacccacagcgccttcagcagcacaggcctgggcagcagcgctgctgctgccagccacctgctgagcaccagccagcacctgctggcccaggacggcttcaagcctgtgctgcccagctacagcgacagcagcgctgctgtggccgctgctgctgccagcgccatgatcagcggggctgctgctgctgctgctgggggcagcagcgcccggagcgcccggcgctacagcggccgggccacctgtgactgccccaactgccaggaggccgagcggctgggccctgctggggccagcctgcggaggaagggcctgcacagctgccacatccctggctgcggcaaggtgtatggcaagaccagccacctgaaggcccacctgcgctggcacactggagagcggccctttgtgtgcaactggctgttctgtgggaagcgcttcaccaggagtgatgagctgcagaggcacctgcggacccacactggagagaagagatttgcctgccctgtgtgcaacaagcgcttcatgagaagtgaccacctgagcaagcacatcaagacccacaatggaggcggcggcggcaagaagggcagtgacagcgacacagatgccagcaacctggagacccccaggtctgagagcccagacctgatcctgcatgacagcggcgtgtctgctgcccgggctgctgctgctgctgctgctgctgctgctgctgctgctgctgctgccagcgctgggggcaaggaggccgccagcggccccaatgacagctag

SEQ ID NO: 16982 - DNA, 1125 bp, Artificial Sequence
  Description of Artificial Sequence: Synthetic coding sequence
atgagccgggtgcccagccccccacctcctgctgagatgagcagcggccctgtggccgagagctggtgctacacccagatcaaggtggtgaagttctcctacatgtggaccatcaacaacttctccttctgccgggaggagatgggagaggtgatcaagagcagcaccttcagcagcggggccaatgacaagctgaagtggtgcctgcgggtgaaccccaagggcctggatgaggagagcaaggactacctgagcctgtacctgctgctggtgtcctgccccaagtctgaggtgcgggccaagttcaagttcagcatcctgaatgccaagggggaggagaccaaggccatggagagccagagggcctacagatttgtgcagggcaaggactggggcttcaagaagttcatccggcgggacttcctgctggatgaggccaacggcctgctgcctgatgacaagctgaccctcttctgtgaggtgtctgtggtgcaggacagcgtgaacatcagcggccagaacaccatgaacatggtgaaggtgcctgaatgtcggctggctgatgagctgggcggcctgtgggagaacagccgcttcacagactgctgcctgtgtgtggccggccaggagttccaggcccacaaggccatcctggccgcccggagccctgtgttcagcgccatgtttgaacatgagatggaggagagcaagaagaacagagtggagatcaatgatgtggagcctgaggtgttcaaggagatgatgtgcttcatctacaccgggaaggcccccaacctggacaagatggctgatgacctgctggccgctgctgacaagtatgccctggagcggctgaaggtgatgtgtgaagatgccctgtgcagcaacctgtctgtggagaatgctgctgagatcctgatcctggccgacctgcacagcgctgaccagctgaagacccaggccgtggacttcatcaactaccacgccagtgatgtgctggagaccagcggctggaagtccatggtggtgagccacccccacctggtggccgaggcctaccgcagcctggccagcgcccagtgccccttcctgggcccccccaggaagaggctgaagcagagctag

SEQ ID NO: 16983 - DNA, 1125 bp, Artificial Sequence; identical to SEQ ID NO: 16982
  Description of Artificial Sequence: Synthetic coding sequence

SEQ ID NO: 16984 - DNA, 1125 bp, Artificial Sequence; identical to SEQ ID NO: 16982
  Description of Artificial Sequence: Synthetic coding sequence

SEQ ID NO: 16985 - DNA, 99 bp, Artificial Sequence
  Description of Artificial Sequence: Synthetic coding sequence
atgagccgggtgcccagccccccacctcctgctgagatgagcagcggccctgtggccgagagctggtgctacacccagatcaaggtggtgaagttctag

SEQ ID NO: 16986 - DNA, 777 bp, Artificial Sequence
  Description of Artificial Sequence: Synthetic coding sequence
atggagagccagagggcctacagatttgtgcagggcaaggactggggcttcaagaagttcatccggcgggacttcctgctggatgaggccaacggcctgctgcctgatgacaagctgaccctcttctgtgaggtgtctgtggtgcaggacagcgtgaacatcagcggccagaacaccatgaacatggtgaaggtgcctgaatgtcggctggctgatgagctgggcggcctgtgggagaacagccgcttcacagactgctgcctgtgtgtggccggccaggagttccaggcccacaaggccatcctggccgcccggagccctgtgttcagcgccatgtttgaacatgagatggaggagagcaagaagaacagagtggagatcaatgatgtggagcctgaggtgttcaaggagatgatgtgcttcatctacaccgggaaggcccccaacctggacaagatggctgatgacctgctggccgctgctgacaagtatgccctggagcggctgaaggtgatgtgtgaagatgccctgtgcagcaacctgtctgtggagaatgctgctgagatcctgatcctggccgacctgcacagcgctgaccagctgaagacccaggccgtggacttcatcaactaccacgccagtgatgtgctggagaccagcggctggaagtccatggtggtgagccacccccacctggtggccgaggcctaccgcagcctggccagcgcccagtgccccttcctgggcccccccaggaagaggctgaagcagagctag

SEQ ID NO: 16987 - DNA, 1125 bp, Artificial Sequence; identical to SEQ ID NO: 16982
  Description of Artificial Sequence: Synthetic coding sequence

SEQ ID NO: 16988 - DNA, 1125 bp, Artificial Sequence; identical to SEQ ID NO: 16982
  Description of Artificial Sequence: Synthetic coding sequence

SEQ ID NO: 16989 - DNA, 717 bp, Artificial Sequence
  Description of Artificial Sequence: Synthetic coding sequence
atgagccgggtgcccagccccccacctcctgctgagatgagcagcggccctgtggccgagagctggtgctacacccagatcaaggtggtgaagttctcctacatgtggaccatcaacaacttctccttctgccgggaggagatgggagaggtgatcaagagcagcaccttcagcagcggggccaatgacaagctgaagtggtgcctgcgggtgaaccccaagggcctggatgaggagagcaaggactacctgagcctgtacctgctgctggtgtcctgccccaagtctgaggtgcgggccaagttcaagttcagcatcctgaatgccaagggggaggagaccaaggccatggagagccagagggcctacagatttgtgcagggcaaggactggggcttcaagaagttcatccggcgggacttcctgctggatgaggccaacggcctgctgcctgatgacaagctgaccctcttctgtgaggtgtctgtggtgcaggacagcgtgaacatcagcggccagaacaccatgaacatggtgaaggtgcctgaatgtcggctggctgatgagctgggcggcctgtgggagaacagccgcttcacagactgctgcctgtgtgtggccggccaggagttccaggcccacaaggccatcctggccgcccggagccctgtgttcagcgccatgtttgaacatgagatggaggagagcaagaagtag

SEQ ID NO: 16990 - DNA, 561 bp, Artificial Sequence
  Description of Artificial Sequence: Synthetic coding sequence
atgagccgggtgcccagccccccacctcctgctgagatgagcagcggccctgtggccgagagctggtgctacacccagatcaaggtggtgaagttctcctacatgtggaccatcaacaacttctccttctgccgggaggagatgggagaggtgatcaagagcagcaccttcagcagcggggccaatgacaagctgaagtggtgcctgcgggtgaaccccaagggcctggatgaggagagcaaggactacctgagcctgtacctgctgctggtgtcctgccccaagtctgaggtgcgggccaagttcaagttcagcatcctgaatgccaagggggaggagaccaaggccatggagagccagagggcctacagatttgtgcagggcaaggactggggcttcaagaagttcatccggcgggacttcctgctggatgaggccaacggcctgctgcctgatgacaagctgaccctcttctgtgaggtgtctgtggtgcaggacagcgtgaacatcagcggccagaacaccatgaacatggtgaaggtgcctgaatgtcggctgtag

SEQ ID NO: 16991 - DNA, 123 bp, Artificial Sequence
  Description of Artificial Sequence: Synthetic coding sequence
atgagccgggtgcccagccccccacctcctgctgagatgagcagcggccctgtggccgagagctggtgctacacccagatcaaggtggtgaagttctcctacatgtggaccatcaacaactag

SEQ ID NO: 16992 - DNA, 789 bp, Artificial Sequence
  Description of Artificial Sequence: Synthetic coding sequence
atgagccgggtgcccagccccccacctcctgctgagatgagcagcggccctgtggccgagagctggtgctacacccagatcaaggtggtgaagttctcctacatgtggaccatcaacaacttctccttctgccgggaggagatgggagaggtgatcaagagcagcaccttcagcagcggggccaatgacaagctgaagtggtgcctgcgggtgaaccccaagggcctggatgaggagagcaaggactacctgagcctgtacctgctgctggtgtcctgccccaagtctgaggtgcgggccaagttcaagttcagcatcctgaatgccaagggggaggagaccaaggccatggagagccagagggcctacagatttgtgcagggcaaggactggggcttcaagaagttcatccggcgggacttcctgctggatgaggccaacggcctgctgcctgatgacaagctgaccctcttctgtgaggtgtctgtggtgcaggacagcgtgaacatcagcggccagaacaccatgaacatggtgaaggtgcctgaatgtcggctggctgatgagctgggcggcctgtgggagaacagccgcttcacagactgctgcctgtgtgtggccggccaggagttccaggcccacaaggccatcctggccgcccggagccctgtgttcagcgccatgtttgaacatgagatggaggagagcaagaagaacagagtggagatcaatgatgtggagcctgaggtgttcaaggagatgatgtgcttcatctacaccgggaagtag

SEQ ID NO: 16993 - DNA, 201 bp, Artificial Sequence
  Description of Artificial Sequence: Synthetic coding sequence
atgagccgggtgcccagccccccacctcctgctgagatgagcagcggccctgtggccgagagctggtgctacacccagatcaaggtggtgaagttctcctacatgtggaccatcaacaacttctccttctgccgggaggagatgggagaggtgatcaagagcagcaccttcagcagcggggccaatgacaagctgaagtag

SEQ ID NO: 16994 - DNA, 984 bp, Artificial Sequence
  Description of Artificial Sequence: Synthetic coding sequence
atgggagaggtgatcaagagcagcaccttcagcagcggggccaatgacaagctgaagtggtgcctgcgggtgaaccccaagggcctggatgaggagagcaaggactacctgagcctgtacctgctgctggtgtcctgccccaagtctgaggtgcgggccaagttcaagttcagcatcctgaatgccaagggggaggagaccaaggccatggagagccagagggcctacagatttgtgcagggcaaggactggggcttcaagaagttcatcagaagagacttcctgctggatgaggccaacggcctgctgcctgatgacaagctgaccctcttctgtgaggtgtctgtggtgcaggacagcgtgaacatcagcggccagaacaccatgaacatggtgaaggtgcctgagtgccgcctggctgatgagctgggcggcctgtgggagaacagccgcttcacagactgctgcctgtgtgtggccggccaggagttccaggcccacaaggccatcctggccgcccggagccctgtgttttctgccatgtttgagcacgagatggaggagagcaagaagaacagagtggagatcaatgatgtggagcctgaggtgttcaaggagatgatgtgcttcatctacacaggcaaggcccccaacctggacaagatggctgatgacctgctggccgctgctgacaagtatgccctggagcggctgaaggtgatgtgtgaagatgccctgtgcagcaacctgtctgtggagaatgctgctgagatcctgatcctggccgacctgcacagcgctgaccagctgaagacccaggccgtggacttcatcaactaccacgccagtgatgtgctggagaccagcggctggaagtccatggtggtgagccacccccacctggtggccgaggcctaccgcagcctggccagcgcccagtgccccttcctgggcccccccaggaagaggctgaagcagagctag

SEQ ID NO: 16995 - DNA, 417 bp, Artificial Sequence
  Description of Artificial Sequence: Synthetic coding sequence
atgagccgggtgcccagccccccacctcctgctgagatgagcagcggccctgtggccgagagctggtgctacacccagatcaaggtggtgaagttctcctacatgtggaccatcaacaacttctccttctgccgggaggagatgggagaggtgatcaagagcagcaccttcagcagcggggccaatgacaagctgaagtggtgcctgcgggtgaaccccaagggcctggatgaggagagcaaggactacctgagcctgtacctgctgctggtgtcctgccccaagtctgaggtgcgggccaagttcaagttcagcatcctgaatgccaagggggaggagaccaaggccatggagagccagagggcctacagatttgtgcagggcaaggactggggcttcaagaagttcatcagatag

SEQ ID NO: 16996 - DNA, 354 bp, Artificial Sequence
  Description of Artificial Sequence: Synthetic coding sequence
atgagccgggtgcccagccccccacctcctgctgagatgagcagcggccctgtggccgagagctggtgctacacccagatcaaggtggtgaagttctcctacatgtggaccatcaacaacttctccttctgccgggaggagatgggagaggtgatcaagagcagcaccttcagcagcggggccaatgacaagctgaagtggtgcctgcgggtgaaccccaagggcctggatgaggagagcaaggactacctgagcctgtacctgctgctggtgtcctgccccaagtctgaggtgcgggccaagttcaagttcagcatcctgaatgccaagggggaggagaccaaggccatgtag

SEQ ID NO: 16997 - DNA, 1179 bp, Artificial Sequence
  Description of Artificial Sequence: Synthetic coding sequence
atgagccgggagcccaccccacccctgcccggggacatgagcacaggccccatcgccgagagctggtgctacacccaggtgaaggtggtgaagttctcctacatgtggaccatcaacaacttctccttctgccgggaggagatgggagaggtgctgaagagcagcaccttcagcagcggccccagcgacaagatgaagtggtgcctgcgggtgaaccccaagggcctggatgatgagagcaaggactacctgagcctgtacctgctgctggtgtcctgccccaagtctgaggtgcgggccaagttcaagttcagcctgctgaatgccaagcgggaggagaccaaggccatggagagccagagggcctacagatttgtgcagggcaaggactggggcttcaagaagttcatccggcgggacttcctgctggatgaggccaacggcctgctgcctgatgacaagctgaccctcttctgtgaggtgtctgtggtgcaggacagcgtgaacatcagcggccacaccaacaccaacaccctgaaggtgcctgaatgtcggctggccgaggacctgggcaacctgtgggagaacacccgcttcacagactgcagcttctttgtgcggggccaggagttcaaggcccacaagtctgtgctggccgcccggagccctgtgttcaatgccatgtttgaacatgagatggaggagagcaagaagaacagagtggagatcaatgacctggaccctgaggtgttcaaggagatgatgaggttcatctacacaggccgggcccccaacctggacaagatggctgacaacctgctggccgctgctgacaagtatgccctggagcggctgaaggtgatgtgtgaggaggccctgtgcagcaacctgtctgtggagaatgtggccgacaccctggtgctggccgacctgcacagcgctgagcagctgaaggcccaggccatcgacttcatcaaccgctgcagcgtgctgcggcagctgggctgcaaggatggcaagaactggaacagcaaccaggccacagacatcatggagaccagcggctggaagtccatgatccagagccacccccacctggtggccgaggccttccgggccctggccagcgcccagtgcccccagtttggcatccccaggaagaggctgaagcagagctag

SEQ ID NO: 16998 - DNA, 9675 bp, Artificial Sequence
  Description of Artificial Sequence: Synthetic coding sequence
atgcagaaggcccggggcaccagaggagaagatgctggcacccgggccccacccagccctggggtgccccccaagagggccaaggtgggcgccggcggcggggcccctgtggccgtggccggggcccctgtgttcctgcggcccctgaagaatgctgctgtgtgtgccggcagtgatgtgcggctgcgggtggtggtgtctggcaccccccagcccagcctgcgctggttcagagatggccagctgctgcctgccccagcccctgagcccagctgcctgtggctgcggcgctgtggggcccaggatgctggggtgtacagctgcatggcccagaatgaaagaggccgggccagctgtgaggccgtgctgactgtgctggaggtgggggacagcgagacagcagaagatgacatcagtgatgtgcagggcacccagaggctggagctgagagatgatggagccttcagcacccccactggaggcagtgacaccctggtgggcaccagcctggacaccccacccacctctgtgacaggcaccagcgaggagcaggtgtcctggtggggcagcggccagacagtgctggagcaggaggccggcagcggcggcggcacccggcggctgcccggcagcccccggcaggcccaggccaccggggccggccccaggcacctgggcgtggagcccctggtgcgggccagccgggccaacctggtgggcgcctcctggggcagcgaggacagcctgtctgtggccagtgacctgtatggcagcgccttcagcctgtaccggggccgggccctgagcatccacgtgtctgtgccccagagcggcctgcggcgggaggagccagacctgcagccccagctggccagcgaggccccccggcggcctgcccagcccccacccagcaagagcgccctgctgcccccacccagcccccgggtgggcaagaggagccccccaggccccccagcccagcctgctgccacccccaccagcccccacaggaggacccaggagcctgtgctgcctgaggacaccaccacagaggagaagaggggcaagaagagcaagagcagcggccccagcctggccggcacagctgagagccggccccagacccccctgtctgaggccagcggccgcctgagcgccctgggccgcagcccccggctggtgcgggccggcagccgcatcctggacaagctgcagttctttgaggagaggagaagaagcctggagaggagtgacagccccccagcccccctgcggccctgggtgcccctgaggaaggcccggagcctggagcagcccaagtctgagcggggggccccctggggcacccctggggccagccaggaggagctgcgggcccctggctctgtggccgagaggagaagactcttccagcagaaggccgccagcctggatgagaggacccggcagaggagccctgccagtgacctggagctgcgctttgcccaggagctgggccgcatccgccgcagcaccagccgggaggagctggtgcgcagccatgagagcctgcgggccaccctgcagagggcccccagcccccgggagcccggggagcccccactcttcagccggcccagcacccccaagaccagcagagctgtgtccccagctgctgcccagccccccagccccagcagcgctgagaagccaggagatgagcccggccggcccaggagccggggccctgctggccgcacagagcccggggagggcccccagcaggaggtgagaagaagagaccagttccccctgaccaggagccgggccatccaggagtgccgcagccctgtgcccccacctgctgctgaccccccagaggcccggaccaaggcccctcctggcaggaagcgggagcccccagcccaggccgtgcgcttcctgccctgggccaccccaggcctggagggcgctgctgtgccccagaccctggagaagaacagagctggccctgaggccgagaagaggctgcggcggggccctgaggaggatggcccctggggcccctgggacagaagaggagcccggagccagggcaaaggaagaagagcccggcccaccagccctgagctggagagcagtgatgacagctatgtgtctgctggggaggagcccctggaggcccctgtgtttgagatccccctgcagaatgtggtggtggcccctggagcagatgtgctgctgaagtgcatcatcacagccaaccccccaccccaggtgtcctggcacaaggatggcagcgccctgcggtctgagggccgcctgctgctgcgggcagagggggagcggcacaccctgctgctgcgggaggcccgggctgctgatgctggcagctacatggccacagccaccaatgagctgggccaggccacctgtgccgccagcctgactgtgcggcctgggggcagcaccagccccttcagcagccccatcaccagtgatgaggagtacctgagccccccagaggagttccctgagcccggggagacctggcccaggacccccaccatgaagcccagccccagccagaacagaagaagcagtgacaccggcagcaaggccccacccaccttcaaggtgtccctgatggaccagagcgtgcgggagggccaggatgtgatcatgagcatccgggtgcagggcgagcccaagcctgtggtgtcctggctgaggaaccggcagcctgtgcggccagaccagaggagatttgctgaggaggccgagggcggcctgtgccgcctgcgcatcctggccgctgagagaggagatgctggcttctacacctgcaaggctgtgaatgaatatggagcccggcagtgtgaggcccggctggaggtgcgggcccaccctgagagccgcagcctggccgtgctggcccccctgcaggatgtggatgtgggcgctggggagatggccctgtttgagtgcctggtggccggccccacagatgtggaggtggactggctgtgccggggccgcctgctgcagcctgccctgctgaagtgcaagatgcactttgatggcaggaagtgcaagctgctgctgacctctgtgcatgaagatgacagcggcgtgtacacctgcaagctgagcacagccaaggatgagctgacctgcagcgcccggctgactgtgcggcccagcctggcccccctcttcacccggctgctggaggatgtggaggtgctggagggccgggccgccaggtttgactgcaagatcagcggcaccccacctcctgtggtgacctggacccacttcggctgccccatggaggagagcgagaacctgcggctgcggcaggacggcggcctgcacagcctgcacatcgcccacgtgggctctgaagatgagggcctgtatgctgtgtctgctgtgaacacccacggccaggcccactgcagcgcccagctgtatgtggaggagcccaggacagctgccagcggccccagcagcaagctggagaagatgcccagcatccctgaggagcctgagcagggcgagctggagcggctgagcatcccagacttcctgcggcccctgcaggacctggaggtgggcctggccaaggaggccatgctggagtgccaggtgacaggcctgccctaccccaccatctcctggttccacaacggccaccgcatccagagcagtgatgacaggaggatgacccagtacagagatgtgcaccggctggtgtttcctgctgtgggcccccagcacgccggcgtgtacaagagcgtcatcgccaacaagctgggcaaggccgcctgctacgcccacctgtatgtgacagatgtggtgcccggccccccagatggagccccccaggtggtggccgtgactggaaggatggtgaccctgacctggaaccccccaagaagcctggacatggccattgatcctgacagcctgacctacacagtgcagcaccaggtgctgggcagtgaccagtggacagccctggtgacaggcctgcgggagcccggctgggccgccaccggcctgaggaaaggagtgcagcacatcttccgggtgctgagcaccaccgtgaagagcagcagcaagcccagcccccccagcgagcctgtgcagctgctggagcacggccccaccctggaggaggccccagccatgctggacaagccagacatcgtgtatgtggtggagggccagcctgcctctgtgacagtgaccttcaaccacgtggaggcccaggtggtgtggaggagctgccgcggggccctgctggaggcccgggccggcgtgtatgagctgagccagccagatgatgaccagtactgcctgcgcatctgccgggtgtcccggcgggacatgggcgccctgacctgcacagccaggaacagacatggcacccagacctgcagcgtgaccctggagctggccgaggcccccaggtttgagagcatcatggaggatgtggaggtgggcgctggggagacagccaggtttgctgtggtggtggagggcaagcccctgcctgacatcatgtggtacaaggatgaggtgctgctgacagagagcagccacgtgtcctttgtgtatgaagaaaatgaatgttccctggtggtgctgagcactggagcccaggatggaggagtgtacacctgcacagcccagaacctggccggggaggtgtcctgcaaggccgagctggccgtgcacagcgcccagacagccatggaggtggagggcgtgggggaggatgaggaccaccggggccgccgcctgagtgacttctatgacatccaccaggagatcggccgcggggccttctcctacctgcggcgcatcgtggagaggagcagcggcctggagtttgctgccaagttcatccccagccaggccaagcccaaggccagcgcccggcgggaggcccggctgctggcccggctgcagcacgactgtgtgctgtacttccacgaggcctttgagaggagaagaggcctggtgattgtgacagagctgtgcacagaggagctgctggagagaattgccaggaagcccaccgtgtgtgagagcgagatccgggcctacatgaggcaggtgctggagggcatccactacctgcaccagagccacgtgctgcacctggatgtgaagccagagaacctgctggtgtgggatggagctgctggggagcagcaggtgcgcatctgtgactttggaaatgcccaggagctgaccccaggagagccccagtactgccagtatggcaccccagagtttgtggcccctgagatcgtgaaccagagccctgtgtctggagtgacagacatctggcctgtgggcgtggtggccttcctgtgcctgaccggcatcagcccctttgtgggggagaatgacaggaccaccctgatgaacatccggaactacaacgtggcctttgaggagaccaccttcctgagcctgagccgggaggcccggggcttcctgatcaaggtgctggtgcaggaccggctgcggcccacagctgaggagaccctggagcacccctggttcaagacccaggccaagggagctgaggtgtccacagaccacctgaagctgttcctgagcagaagacgctggcagaggagccagatctcctacaagtgccacctggtgctgcggcccatccctgagctgctgcgggcccctcctgagcgggtgtgggtgaccatgccccggcggcccccaccttctgggggcctgagcagcagcagtgacagcgaggaggaggagctggaggagctgcccagcgtgccccggcccctgcagcctgagttcagcggcagccgggtgtccctgacagacatccccacagaagatgaggccctgggcaccccagagactggagctgccacccccatggactggcaggagcagggccgggcccccagccaggaccaggaggcccccagccctgaggccctgcccagccctggccaggagcctgctgctggggccagcccccggcggggggagctgcggcggggcagcagcgctgagagcgccctgcccagggctggcccccgggagctgggccggggcctgcacaaggccgcctctgtggagctgccccagaggaggagccccagccctggggccacccggctggcccggggcggcctgggggagggggagtatgcccagaggctgcaggccctgcggcagaggctgctgcggggcggcccagaagatggcaaggtgtctggcctgcggggccccctgctggagagcctgggcggccgggcccgggaccccaggatggcccgggccgccagcagcgaggccgccccccaccaccagccccccctggagaacagaggcctgcagaagagcagcagcttcagccagggcgaggccgagccccggggccgccacagaagagctggggcccccctggagatccctgtggcccggctgggcgcccggcggctgcaggagagccccagcctgagcgccctgtctgaggcccagcccagcagccctgcccggcccagcgcccccaagcccagcacccccaagtctgctgagcccagcgccaccacccccagtgatgccccccagcccccagccccccagcctgcccaggacaaggcccctgagcccaggcctgagcctgtgcgggccagcaagccagcccccccaccccaggccctgcagaccctggccctgcccctgaccccctatgcccagatcatccagagcctgcagctgagcggccacgcccagggccccagccagggccctgctgccccacccagcgagcccaagccccacgccgctgtgtttgcccgggtggccagccccccacctggggcccctgagaagagggtgcccagcgctgggggcccccctgtgctggccgagaaggcccgggtgcccaccgtgcccccccggcccggcagcagcctgagcagcagcattgagaacctggagagcgaggccgtgtttgaggccaagttcaagaggagccgggagagccccctgagcctgggcctgcggctgctgagccgcagccgctctgaggagcggggccccttcagaggagctgaggaggaggatggcatctaccggcccagccctgctggcacccccctggagctggtgcggcggcctgagaggagccgctctgtgcaggacctgcgggctgtgggggagcccggcctggtgcggcggctgagcctgagcctgagccagaggctgcggaggaccccaccagcccagaggcacccagcctgggaggcccggggaggagatggagagagcagcgagggcggcagcagcgcccggggcagccctgtgctggccatgagaagaaggctgtccttcaccctggagcggctgagcagccggctgcagaggagcggcagcagtgaagattctggaggagccagcggccgcagcacccccctgtttggccgcctgcggcgggccaccagcgagggggagagcctgcggcggctgggcctgccccacaaccagctggccgcccaggccggggccaccaccccatctgctgagagcctgggcagcgaggccagcgccaccagcggcagcagcgcccctggagagagccgcagccggctgcgctggggcttcagccggcccaggaaggacaagggcctgagcccccccaacctgagcgcctctgtgcaggaggagctgggccaccagtatgtgcgctctgagagtgacttcccccctgtgttccacatcaagctgaaggaccaggtgctgctggagggggaggccgccaccctgctgtgcctgcctgctgcctgcccagccccccacatctcctggatgaaggacaagaagagcctgcggtctgagcccagcgtcatcatcgtgtcctgcaaggatggccggcagctgctgagcatccccagggctgggaagagacatgctggcctgtatgagtgcagcgccaccaacgtgctgggcagcatcaccagcagctgcaccgtggccgtggcccgggtgcctgggaagctggcccctcctgaggtgccccagacctaccaggacacagccctggtgctgtggaagccaggggacagccgggccccctgcacctacaccctggagaggagagtggatggagagagcgtgtggcaccctgtgagcagcggcatcccagactgctactacaacgtgacccacctgcctgtgggcgtgacagtgcgcttccgggtggcctgtgccaacagagctggccagggccccttcagcaacagcagcgagaaggtgtttgtgcggggcacccaggacagcagcgctgtgcccagcgctgcccaccaggaggcccctgtgaccagcaggcctgcccgggcccggcccccagacagccccaccagcctggccccacccctggccccagctgcccccaccccacccagcgtgacagtgagccccagcagcccccccaccccacccagccaggccctgagcagcctgaaggctgtgggccccccaccccagaccccaccaagaagacaccggggcctgcaggccgcccggcctgctgagcccaccctgcccagcacccacgtgacccccagcgagcccaagccctttgtgctggacaccggcacccccatcccagccagcaccccccagggcgtgaagcctgtgagcagcagcacccctgtgtatgtggtgaccagctttgtgtctgcccccccagcccctgagcccccagcccctgagcccccacctgagcccaccaaggtgacagtgcagagcctgagccctgccaaggaggtggtgagcagccctggcagcagccccaggagcagccccaggcctgagggcaccaccctgcggcagggccccccccagaagccctacaccttcctggaggagaaggcccggggccgctttggagtggtgcgggcctgcagagaaaatgccaccggccgcacctttgtggccaagatcgtgccctatgctgctgagggcaagagaagagtgctgcaggagtatgaggtgctgcggaccctgcaccacgagcgcatcatgagcctgcacgaggcctacatcaccccccgctacctggtgctgattgctgagagctgtggcaaccgggagctgctgtgtggcctgagtgaccgcttccgctacagtgaagatgatgtggccacctacatggtgcagctgctgcagggcctggactacctgcacggccaccacgtgctgcacctggacatcaagccagacaacctgctgctggccccagacaatgccctgaagatcgtggactttggcagcgcccagccctacaacccccaggccctgcggcccctgggccacaggacaggcaccctggagttcatggcccctgagatggtgaagggggagcccatcggcagcgccacagacatctggggcgccggcgtgctgacctacatcatgctgagcggccgcagccccttctatgagccagacccccaggagacagaggccagaattgtgggcggccgctttgatgccttccagctgtaccccaacaccagccagagcgccaccctcttcctgaggaaggtgctgtctgtgcacccctggctgagccggcccagcagctgcctgtctgtgtgccacaaggagatcaagatggccagcagctag

SEQ ID NO: 16999 - DNA, 9804 bp, Artificial Sequence
  Description of Artificial Sequence: Synthetic coding sequence
atgcagaaggcccggggcaccagaggagaagatgctggcacccgggccccacccagccctggggtgccccccaagagggccaaggtgggcgccggcggcggggcccctgtggccgtggccggggcccctgtgttcctgcggcccctgaagaatgctgctgtgtgtgccggcagtgatgtgcggctgcgggtggtggtgtctggcaccccccagcccagcctgcgctggttcagagatggccagctgctgcctgccccagcccctgagcccagctgcctgtggctgcggcgctgtggggcccaggatgctggggtgtacagctgcatggcccagaatgaaagaggccgggccagctgtgaggccgtgctgactgtgctggaggtgggggacagcgagacagcagaagatgacatcagtgatgtgcagggcacccagaggctggagctgagagatgatggagccttcagcacccccactggaggcagtgacaccctggtgggcaccagcctggacaccccacccacctctgtgacaggcaccagcgaggagcaggtgtcctggtggggcagcggccagacagtgctggagcaggaggccggcagcggcggcggcacccggcggctgcccggcagcccccggcaggcccaggccaccggggccggccccaggcacctgggcgtggagcccctggtgcgggccagccgggccaacctggtgggcgcctcctggggcagcgaggacagcctgtctgtggccagtgacctgtatggcagcgccttcagcctgtaccggggccgggccctgagcatccacgtgtctgtgccccagagcggcctgcggcgggaggagccagacctgcagccccagctggccagcgaggccccccggcggcctgcccagcccccacccagcaagagcgccctgctgcccccacccagcccccgggtgggcaagaggagccccccaggccccccagcccagcctgctgccacccccaccagcccccacaggaggacccaggagcctgtgctgcctgaggacaccaccacagaggagaagaggggcaagaagagcaagagcagcggccccagcctggccggcacagctgagagccggccccagacccccctgtctgaggccagcggccgcctgagcgccctgggccgcagcccccggctggtgcgggccggcagccgcatcctggacaagctgcagttctttgaggagaggagaagaagcctggagaggagtgacagccccccagcccccctgcggccctgggtgcccctgaggaaggcccggagcctggagcagcccaagtctgagcggggggccccctggggcacccctggggccagccaggaggagctgcgggcccctggctctgtggccgagaggagaagactcttccagcagaaggccgccagcctggatgagaggacccggcagaggagccctgccagtgacctggagctgcgctttgcccaggagctgggccgcatccgccgcagcaccagccgggaggagctggtgcgcagccatgagagcctgcgggccaccctgcagagggcccccagcccccgggagcccggggagcccccactcttcagccggcccagcacccccaagaccagcagagctgtgtccccagctgctgcccagccccccagccccagcagcgctgagaagccaggagatgagcccggccggcccaggagccggggccctgctggccgcacagagcccggggagggcccccagcaggaggtgagaagaagagaccagttccccctgaccaggagccgggccatccaggagtgccgcagccctgtgcccccacctgctgctgaccccccagaggcccggaccaaggcccctcctggcaggaagcgggagcccccagcccaggccgtgcgcttcctgccctgggccaccccaggcctggagggcgctgctgtgccccagaccctggagaagaacagagctggccctgaggccgagaagaggctgcggcggggccctgaggaggatggcccctggggcccctgggacagaagaggagcccggagccagggcaaaggaagaagagcccggcccaccagccctgagctggagagcagtgatgacagctatgtgtctgctggggaggagcccctggaggcccctgtgtttgagatccccctgcagaatgtggtggtggcccctggagcagatgtgctgctgaagtgcatcatcacagccaaccccccaccccaggtgtcctggcacaaggatggcagcgccctgcggtctgagggccgcctgctgctgcgggcagagggggagcggcacaccctgctgctgcgggaggcccgggctgctgatgctggcagctacatggccacagccaccaatgagctgggccaggccacctgtgccgccagcctgactgtgcggcctgggggcagcaccagccccttcagcagccccatcaccagtgatgaggagtacctgagccccccagaggagttccctgagcccggggagacctggcccaggacccccaccatgaagcccagccccagccagaacagaagaagcagtgacaccggcagcaaggccccacccaccttcaaggtgtccctgatggaccagagcgtgcgggagggccaggatgtgatcatgagcatccgggtgcagggcgagcccaagcctgtggtgtcctggctgaggaaccggcagcctgtgcggccagaccagaggagatttgctgaggaggccgagggcggcctgtgccgcctgcgcatcctggccgctgagagaggagatgctggcttctacacctgcaaggctgtgaatgaatatggagcccggcagtgtgaggcccggctggaggtgcgggcccaccctgagagccgcagcctggccgtgctggcccccctgcaggatgtggatgtgggcgctggggagatggccctgtttgagtgcctggtggccggccccacagatgtggaggtggactggctgtgccggggccgcctgctgcagcctgccctgctgaagtgcaagatgcactttgatggcaggaagtgcaagctgctgctgacctctgtgcatgaagatgacagcggcgtgtacacctgcaagctgagcacagccaaggatgagctgacctgcagcgcccggctgactgtgcggcccagcctggcccccctcttcacccggctgctggaggatgtggaggtgctggagggccgggccgccaggtttgactgcaagatcagcggcaccccacctcctgtggtgacctggacccacttcggctgccccatggaggagagcgagaacctgcggctgcggcaggacggcggcctgcacagcctgcacatcgcccacgtgggctctgaagatgagggcctgtatgctgtgtctgctgtgaacacccacggccaggcccactgcagcgcccagctgtatgtggaggagcccaggacagctgccagcggccccagcagcaagctggagaagatgcccagcatccctgaggagcctgagcagggcgagctggagcggctgagcatcccagacttcctgcggcccctgcaggacctggaggtgggcctggccaaggaggccatgctggagtgccaggtgacaggcctgccctaccccaccatctcctggttccacaacggccaccgcatccagagcagtgatgacaggaggatgacccagtacagagatgtgcaccggctggtgtttcctgctgtgggcccccagcacgccggcgtgtacaagagcgtcatcgccaacaagctgggcaaggccgcctgctacgcccacctgtatgtgacagatgtggtgcccggccccccagatggagccccccaggtggtggccgtgactggaaggatggtgaccctgacctggaaccccccaagaagcctggacatggccattgatcctgacagcctgacctacacagtgcagcaccaggtgctgggcagtgaccagtggacagccctggtgacaggcctgcgggagcccggctgggccgccaccggcctgaggaaaggagtgcagcacatcttccgggtgctgagcaccaccgtgaagagcagcagcaagcccagcccccccagcgagcctgtgcagctgctggagcacggccccaccctggaggaggccccagccatgctggacaagccagacatcgtgtatgtggtggagggccagcctgcctctgtgacagtgaccttcaaccacgtggaggcccaggtggtgtggaggagctgccgcggggccctgctggaggcccgggccggcgtgtatgagctgagccagccagatgatgaccagtactgcctgcgcatctgccgggtgtcccggcgggacatgggcgccctgacctgcacagccaggaacagacatggcacccagacctgcagcgtgaccctggagctggccgaggcccccaggtttgagagcatcatggaggatgtggaggtgggcgctggggagacagccaggtttgctgtggtggtggagggcaagcccctgcctgacatcatgtggtacaaggatgaggtgctgctgacagagagcagccacgtgtcctttgtgtatgaagaaaatgaatgttccctggtggtgctgagcactggagcccaggatggaggagtgtacacctgcacagcccagaacctggccggggaggtgtcctgcaaggccgagctggccgtgcacagcgcccagacagccatggaggtggagggcgtgggggaggatgaggaccaccggggccgccgcctgagtgacttctatgacatccaccaggagatcggccgcggggccttctcctacctgcggcgcatcgtggagaggagcagcggcctggagtttgctgccaagttcatccccagccaggccaagcccaaggccagcgcccggcgggaggcccggctgctggcccggctgcagcacgactgtgtgctgtacttccacgaggcctttgagaggagaagaggcctggtgattgtgacagagctgtgcacagaggagctgctggagagaattgccaggaagcccaccgtgtgtgagagcgagatccgggcctacatgaggcaggtgctggagggcatccactacctgcaccagagccacgtgctgcacctggatgtgaagccagagaacctgctggtgtgggatggagctgctggggagcagcaggtgcgcatctgtgactttggaaatgcccaggagctgaccccaggagagccccagtactgccagtatggcaccccagagtttgtggcccctgagatcgtgaaccagagccctgtgtctggagtgacagacatctggcctgtgggcgtggtggccttcctgtgcctgaccggcatcagcccctttgtgggggagaatgacaggaccaccctgatgaacatccggaactacaacgtggcctttgaggagaccaccttcctgagcctgagccgggaggcccggggcttcctgatcaaggtgctggtgcaggaccggctgcggcccacagctgaggagaccctggagcacccctggttcaagacccaggccaagggagctgaggtgtccacagaccacctgaagctgttcctgagcagaagacgctggcagaggagccagatctcctacaagtgccacctggtgctgcggcccatccctgagctgctgcgggcccctcctgagcgggtgtgggtgaccatgccccggcggcccccaccttctgggggcctgagcagcagcagtgacagcgaggaggaggagctggaggagctgcccagcgtgccccggcccctgcagcctgagttcagcggcagccgggtgtccctgacagacatccccacagaagatgaggccctgggcaccccagagactggagctgccacccccatggactggcaggagcagggccgggcccccagccaggaccaggaggcccccagccctgaggccctgcccagccctggccaggagcctgctgctggggccagcccccggcggggggagctgcggcggggcagcagcgctgagagcgccctgcccagggctggcccccgggagctgggccggggcctgcacaaggccgcctctgtggagctgccccagaggaggagccccagccctggggccacccggctggcccggggcggcctgggggagggggagtatgcccagaggctgcaggccctgcggcagaggctgctgcggggcggcccagaagatggcaaggtgtctggcctgcggggccccctgctggagagcctgggcggccgggcccgggaccccaggatggcccgggccgccagcagcgaggccgccccccaccaccagccccccctggagaacagaggcctgcagaagagcagcagcttcagccagggcgaggccgagccccggggccgccacagaagagctggggcccccctggagatccctgtggcccggctgggcgcccggcggctgcaggagagccccagcctgagcgccctgtctgaggcccagcccagcagccctgcccggcccagcgcccccaagcccagcacccccaagtctgctgagcccagcgccaccacccccagtgatgccccccagcccccagccccccagcctgcccaggacaaggcccctgagcccaggcctgagcctgtgcgggccagcaagccagcccccccaccccaggccctgcagaccctggccctgcccctgaccccctatgcccagatcatccagagcctgcagctgagcggccacgcccagggccccagccagggccctgctgccccacccagcgagcccaagccccacgccgctgtgtttgcccgggtggccagccccccacctggggcccctgagaagagggtgcccagcgctgggggcccccctgtgctggccgagaaggcccgggtgcccaccgtgcccccccggcccggcagcagcctgagcagcagcattgagaacctggagagcgaggccgtgtttgaggccaagttcaagaggagccgggagagccccctgagcctgggcctgcggctgctgagccgcagccgctctgaggagcggggccccttcagaggagctgaggaggaggatggcatctaccggcccagccctgctggcacccccctggagctggtgcggcggcctgagaggagccgctctgtgcaggacctgcgggctgtgggggagcccggcctggtgcggcggctgagcctgagcctgagccagaggctgcggaggaccccaccagcccagaggcacccagcctgggaggcccggggaggagatggagagagcagcgagggcggcagcagcgcccggggcagccctgtgctggccatgagaagaaggctgtccttcaccctggagcggctgagcagccggctgcagaggagcggcagcagtgaagattctggaggagccagcggccgcagcacccccctgtttggccgcctgcggcgggccaccagcgagggggagagcctgcggcggctgggcctgccccacaaccagctggccgcccaggccggggccaccaccccatctgctgagagcctgggcagcgaggccagcgccaccagcggcagcagcgcccctggagagagccgcagccggctgcgctggggcttcagccggcccaggaaggacaagggcctgagcccccccaacctgagcgcctctgtgcaggaggagctgggccaccagtatgtgcgctctgagagtgacttcccccctgtgttccacatcaagctgaaggaccaggtgctgctggagggggaggccgccaccctgctgtgcctgcctgctgcctgcccagccccccacatctcctggatgaaggacaagaagagcctgcggtctgagcccagcgtcatcatcgtgtcctgcaaggatggccggcagctgctgagcatccccagggctgggaagagacatgctggcctgtatgagtgcagcgccaccaacgtgctgggcagcatcaccagcagctgcaccgtggccgtggcccgggtgcctgggaagctggcccctcctgaggtgccccagacctaccaggacacagccctggtgctgtggaagccaggggacagccgggccccctgcacctacaccctggagaggagagtggatggagagagcgtgtggcaccctgtgagcagcggcatcccagactgctactacaacgtgacccacctgcctgtgggcgtgacagtgcgcttccgggtggcctgtgccaacagagctggccagggccccttcagcaacagcagcgagaaggtgtttgtgcggggcacccaggacagcagcgctgtgcccagcgctgcccaccaggaggcccctgtgaccagcaggcctgcccgggcccggcccccagacagccccaccagcctggccccacccctggccccagctgcccccaccccacccagcgtgacagtgagccccagcagcccccccaccccacccagccaggccctgagcagcctgaaggctgtgggccccccaccccagaccccaccaagaagacaccggggcctgcaggccgcccggcctgctgagcccaccctgcccagcacccacgtgacccccagcgagcccaagccctttgtgctggacaccggcacccccatcccagccagcaccccccagggcgtgaagcctgtgagcagcagcacccctgtgtatgtggtgaccagctttgtgtctgcccccccagcccctgagcccccagcccctgagcccccacctgagcccaccaaggtgacagtgcagagcctgagccctgccaaggaggtggtgagcagccctggcagcagccccaggagcagccccaggcctgagggcaccaccctgcggcagggccccccccagaagccctacaccttcctggaggagaaggcccggggccgctttggagtggtgcgggcctgcagagaaaatgccaccggccgcacctttgtggccaagatcgtgccctatgctgctgagggcaagagaagagtgctgcaggagtatgaggtgctgcggaccctgcaccacgagcgcatcatgagcctgcacgaggcctacatcaccccccgctacctggtgctgattgctgagagctgtggcaaccgggagctgctgtgtggcctgagtgaccgcttccgctacagtgaagatgatgtggccacctacatggtgcagctgctgcagggcctggactacctgcacggccaccacgtgctgcacctggacatcaagccagacaacctgctgctggccccagacaatgccctgaagatcgtggactttggcagcgcccagccctacaacccccaggccctgcggcccctgggccacaggacaggcaccctggagttcatggcccctgagatggtgaagggggagcccatcggcagcgccacagacatctggggcgccggcgtgctgacctacatcatgctgagcggccgcagccccttctatgagccagacccccaggagacagaggccagaattgtgggcggccgctttgatgccttccagctgtaccccaacaccagccagagcgccaccctcttcctgaggaaggtgctgtctgtgcacccctggagccggcccagcctgcaggactgcctggcccacccctggctgcaggatgcctacctgatgaagctgcggcggcagaccctgaccttcaccaccaaccggctgaaggagttcctgggggagcagaggagaagaagagctgaggccgccaccaggcacaaggtgctgctgcggagctacccaggcggcccctag

SEQ ID NO: 17000 - DNA, 342 bp, Artificial Sequence
  Description of Artificial Sequence: Synthetic coding sequence
atgaagcccagccccagccagaacagaagaagcagtgacaccggcagcaaggccccacccaccttcaaggtgtccctgatggaccagagcgtgcgggagggccaggacgtcatcatgagcatccgggtgcagggcgagcccaagcctgtggtgtcctggctgaggaaccggcagcctgtgcggccagaccagaggagatttgctgaggaggccgagggcggcctgtgccgcctgcgcatcctggccgctgagagaggagatgctggcttctacacctgcaaggctgtgaatgaatatggagcccggcagtgtgaggcccggctggaggtgcggggggagtag

SEQ ID NO: 17001 - DNA, 342 bp, Artificial Sequence; identical to SEQ ID NO: 17000
  Description of Artificial Sequence: Synthetic coding sequence

SEQ ID NO: 17002 - DNA, 342 bp, Artificial Sequence; identical to SEQ ID NO: 17000
  Description of Artificial Sequence: Synthetic coding sequence

SEQ ID NO: 17003 - DNA, 513 bp, Artificial Sequence
  Description of Artificial Sequence: Synthetic coding sequence
atggccacagccaccaatgagctgggccaggccacctgtgccgccagcctgactgtgcggcctgggggcagcaccagccccttcagcagccccatcaccagtgatgaggagtacctgagccccccagaggagttccctgagcccggggagacctggcccaggacccccaccatgaagcccagccccagccagaacagaagaagcagtgacaccggcagcaaggccccacccaccttcaaggtgtccctgatggaccagagcgtgcgggagggccaggatgtgatcatgagcatccgggtgcagggcgagcccaagcctgtggtgtcctggctgaggaaccggcagcctgtgcggccagaccagaggagatttgctgaggaggccgagggcggcctgtgccgcctgcgcatcctggccgctgagagaggagatgctggcttctacacctgcaaggctgtgaatgaatatggagcccggcagtgtgaggcccggctggaggtgcggggggagtag

SEQ ID NO: 17004 - DNA, 1038 bp, Artificial Sequence
  Description of Artificial Sequence: Synthetic coding sequence
atgatcagccctgtgctgatcctcttcagcagcttcctgtgccacgtggccatcgccggccgcacctgccccaagccagatgacctgcccttcagcacagtggtgcccctgaagaccttctatgagcctggagaggagatcacctacagctgcaagccaggctacgtgtccagaggaggcatgaggaagttcatctgccccctgaccggcctgtggcccatcaacaccctgaagtgcaccccccgggtgtgcccctttgctggcatcctggagaatggagctgtgcgctacaccacctttgagtaccccaacaccatctccttcagctgcaacacaggcttctacctgaatggagctgacagcgccaagtgcacagaggagggcaagtggagccctgagctgcctgtgtgtgcccccatcatctgccccccacccagcatccccacctttgccaccctgcgggtgtacaagcccagcgctggcaacaacagcctgtacagagacacagctgtgtttgaatgtctgccccagcacgccatgtttggaaatgacaccatcacctgcaccacccacggcaactggaccaagctgcctgaatgtcgggaggtgaagtgccccttccccagcaggccagacaatggatttgtgaactacccagccaagcccaccctgtactacaaggacaaggccaccttcggctgccatgatggctacagcctggatggccctgaggagattgaatgtaccaagctgggcaactggagcgccatgcccagctgcaaggccagctgcaaggtgcctgtgaagaaggccaccgtggtgtaccagggcgagcgggtgaagatccaggagaagttcaagaatggcatgctgcacggggacaaggtgtccttcttctgcaagaacaaggagaagaagtgcagctacacagaagatgcccagtgcattgatggcaccatcgaggtgcccaagtgcttcaaggagcacagcagcctggccttctggaagacagatgccagtgatgtgaagccctgctag

SEQ ID NO: 17005 - DNA, 1278 bp, Artificial Sequence
  Description of Artificial Sequence: Synthetic coding sequence
atggccagcagcatcatctgccaggagcactgccagatcagcggccaggccaagattgacatcctgctggtgggagatgtgacagtgggctacctggccgacacagtgcagaagctgtttgccaacattgctgaggtgaccatcaccatcagtgacaccaaggaggccgccgccctgctggatgactgcatcttcaacatggtgctgctgaaggtgcccagcagcctgtctgctgaggagctggaggccatcaagctgatccgctttgggaagaagaagaacacccacagcctgtttgtgttcatcatccctgagaacttcaagggctgcatcagcggccacggcatggacatcgccctgacagagcccctgaccatggagaagatgagcaatgtggtgaagtactggaccacctgccccagcaacacagtgaagacagaaaatgccaccggccctgaggagctgggcctgcccctgcagaggagctacagcgagcacctgggctacttccccacagacctgtttgcctgcagcgagagcctgagaaatggaaatggcctggagctgaatgccagcctgtctgaatttgagaagaacaagaagatcagcctgctgcacagcagcaaggagaagctgcggcgggagcgcatcaagtactgctgtgagcagctgcggaccctgctgccctacgtgaagggcaggaagaatgatgctgcctctgtgctggaggccaccgtggactatgtgaagtacatccgggagaagatcagccctgctgtgatggcccagatcacagaggccctgcagagcaacatgaggttctgcaagaagcagcagacccccatcgagctgagcctgcccggcaccgtgatggcccagagagaaaattctgtgatgagcacctacagccctgagcggggcctgcagttcctgaccaacacctgctggaatggctgcagcaccccagatgctgagagcagcctggatgaagctgtgcgggtgcccagcagcagcgcctctgaaaatgccatcggggacccctacaagacccacatcagcagcgctgccctgagcctgaacagcctgcacacagtgcgctactacagcaaggtgacccccagctatgatgccacagctgtgaccaaccagaacatcagcatccacctgcccagcgccatgcctcctgtgtccaagctgctgcccaggcactgcaccagcggcctgggccagacctgcaccacccaccccaactgcctgcagcagttctgggcctactag

SEQ ID NO: 17006 - DNA, 1509 bp, Artificial Sequence; identical to SEQ ID NO: 15104
  Description of Artificial Sequence: Synthetic coding sequence

SEQ ID NO: 17007 - DNA, 777 bp, Artificial Sequence
  Description of Artificial Sequence: Synthetic coding sequence
atgaagaccccaaatgcccaggaggccgagggccagcagaccagggctgctgctggccgggccaccggcagcgccaacatgaccaagaagaaggtgtcccagaagaagcagaggggccggcccagcagccagcccaggagaaatattgtgggctgccgcatcagccacggctggaaggagggagatgagcccatcacccagtggaagggcaccgtgctggaccaggtgcccatcaaccccagcctgtacctggtgaagtatgatggcatcgactgtgtgtatggcctggagctgcacagagatgagcgggtgctgagcctgaagatcctgagtgacagagtggccagcagccacatcagtgatgccaacctggccaacaccatcatcggcaaggctgtggagcacatgtttgaaggagaacatggcagcaaggatgagtggaggggcatggtgctggcccaggcccccatcatgaaggcctggttctacatcacctatgagaaggaccctgtgctgtacatgtaccagctgctggatgactacaaggagggggacctgcgcatcatgcctgagagcagcgagagccccccaacagagcgggagcccggcggcgtggtggatggcctcatcggcaagcacgtggagtacaccaaggaggatggcagcaagagaattggcatggtgatccaccaggtggaggccaagcccagcgtgtacttcatcaagtttgatgatgacttccacatctacgtgtatgacctggtgaagaagagctag

SEQ ID NO: 17008 - DNA, 777 bp, Artificial Sequence; identical to SEQ ID NO: 17007
  Description of Artificial Sequence: Synthetic coding sequence

SEQ ID NO: 17009 - DNA, 474 bp, Artificial Sequence
  Description of Artificial Sequence: Synthetic coding sequence
atgaagaccccaaatgcccaggaggccgagggccagcagaccagggctgctgctggccgggccaccggcagcgccaacatgaccaagaagaaggtgtcccagaagaagcagaggggccggcccagcagccagcccaggagaaatattgtgggctgccgcatcagccacggctggaaggagggagatgagcccatcacccagtggaagggcaccgtgctggaccagctgctggatgactacaaggagggggacctgcgcatcatgcctgagagcagcgagagccccccaacagagcgggagcctggaggagtggtggatggcctgattggcaagcacgtggagtacaccaaggaggatggcagcaagagaattggcatggtgatccaccaggtggaggccaagcccagcgtgtacttcatcaagtttgatgatgacttccacatctacgtgtatgacctggtgaagaagagctag

SEQ ID NO: 17010 - DNA, 777 bp, Artificial Sequence; identical to SEQ ID NO: 17007
  Description of Artificial Sequence: Synthetic coding sequence

SEQ ID NO: 17011 - DNA, 744 bp, Artificial Sequence
  Description of Artificial Sequence: Synthetic coding sequence
atgaagaccccaaatgcccaggaggccgagggccagcagaccagggctgctgctggccgggccaccggcagcgccaacatgaccaagaagaaggtgtcccagaagaagcagaggggccggcccagcagccagcccaggagaaatattgtgggctgccgcatcagccacggctggaaggagggagatgagcccatcacccagtggaagggcaccgtgctggaccaggtgcccatcaaccccagcctgtacctggtgaagtatgatggcatcgactgtgtgtatggcctggagctgcacagagatgagcgggtgctgagcctgaagatcctgagtgacagagtggccagcagccacatcagtgatgccaacctggccaacaccatcatcggcaaggctgtggagcacatgtttgaaggagaacatggcagcaaggatgagtggaggggcatggtgctggcccaggcccccatcatgaaggcctggttctacatcacctatgagaaggaccctgtgctgtacatgtaccagctgctggatgactacaaggagggggacctgcgcatcatgcctgagagcagcgagagccccccaacagagcgggagcccggcggcgtggtggatggcctcatcggcaagcacgtggagtacaccaaggaggatggcagcaagagaattggcatggtgatccaccaggtggaggccaagcccagcgtgtacttcatcaagtttgatgatgacttctag

SEQ ID NO: 17012 - DNA, 1506 bp, Artificial Sequence
  Description of Artificial Sequence: Synthetic coding sequence
atggagaccatcctggagcagcagaggcgctaccacgaggagaaggagcggctgatggatgtgatggccaaggagatgctgaccaagaagagcaccctgcgggaccagatcaacagcgaccacaggacccgggccatgcaggaccgctacatggaggtgtctggcaacctgcgggacctgtatgatgacaaggatggcctgaggaaggaggagctgaatgccatcagcggccccaatgaatttgctgagttctacaaccggctgaagcagatcaaggagttccacaggaagcaccccaatgagatctgtgtgcccatgtctgtggagtttgaggagctgctgaaggcccgggagaaccccagcgaggaggcccagaacctggtggagttcacagatgaggagggctacggccgctacctggacctgcatgactgctacctgaagtacatcaacctgaaggccagcgagaagctggactacatcacctacctgagcatctttgaccagctgtttgacatccccaaggagaggaagaatgctgagtacaagcgctacctggagatgctgctggagtacctgcaggactacacagacagagtgaagcccctgcaggaccagaatgagctgtttgggaagatccaggccgagtttgagaagaagtgggagaatggcaccttccctggctggcccaaggagaccagcagcgccctgacccacgccggggcccacctggacctgagcgccttcagctcctgggaggagctggccagcctgggcctggaccggctgaagagcgccctgctggccctgggcctgaagtgtggcggcaccctggaggagcgggcccagaggctcttcagcaccaagggcaagagcctggagagcctggacaccagcctgtttgccaagaaccccaagagcaagggcaccaagagggacacagagaggaacaaggacatcgccttcctggaggcccagatctatgaatatgtggagatcctgggggagcagaggcacctgacccatgaaaatgtgcagaggaagcaggccaggactggagaggagcgggaggaggaggaggaggagcagatcagcgagagcgagagtgaagatgaagaaaatgagatcatctacaaccccaagaacctgcccctgggctgggatggcaagcccatcccctactggctgtacaagctgcacggcctgaacatcaactacaactgtgagatctgtggcaactacacctaccggggccccaaggccttccagaggcactttgctgagtggaggcatgcccacggcatgcgctgcctgggcatccccaacacagcccactttgccaacgtgacccagattgaagatgctgtgtccctgtgggccaagctgaagctgcagaaggccagcgagcgctggcagcctgacacagaggaggagtatgaggacagcagtggaaatgtggtgaacaagaagacctatgaggacctgaagaggcagggcctgctgtag

SEQ ID NO: 17013 - DNA, 1347 bp, Artificial Sequence
  Description of Artificial Sequence: Synthetic coding sequence
atggagaccatcctggagcagcagaggcgctaccacgaggagaaggagcggctgatggatgtgatggccaaggagatgctgaccaagaagagcaccctgcgggaccagatcaacagcgaccacaggacccgggccatgcaggacatctgtgtgcccatgtctgtggagtttgaggagctgctgaaggcccgggagaaccccagcgaggaggcccagaacctggtggagttcacagatgaggagggctacggccgctacctggacctgcatgactgctacctgaagtacatcaacctgaaggccagcgagaagctggactacatcacctacctgagcatctttgaccagctgtttgacatccccaaggagaggaagaatgctgagtacaagcgctacctggagatgctgctggagtacctgcaggactacacagacagagtgaagcccctgcaggaccagaatgagctgtttgggaagatccaggccgagtttgagaagaagtgggagaatggcaccttccctggctggcccaaggagaccagcagcgccctgacccatgctggggcccacctggacctgagcgccttcagctcctgggaggagctggccagcctgggcctggaccggctgaagagcgccctgctggccctgggcctgaagtgtggcggcaccctggaggagcgggcccagaggctcttcagcaccaagggcaagagcctggagagcctggacaccagcctgtttgccaagaaccccaagagcaagggcaccaagagggacacagaaagaaacaaggacatcgccttcctggaggcccagatctatgaatatgtggagatcctgggggagcagaggcacctgacccatgaaaatgtgcagaggaagcaggccaggactggagaggagcgggaggaggaggaggaggagcagatcagcgagagcgagagtgaagatgaggagaatgagatcatctacaaccccaagaacctgcccctgggctgggatggcaagcccatcccctactggctgtacaagctgcacggcctgaacatcaactacaactgtgagatctgtggcaactacacctaccggggccccaaggccttccagaggcactttgctgagtggaggcatgcccacggcatgcgctgcctgggcatccccaacacagcccactttgccaacgtgacccagattgaagatgctgtgtccctgtgggccaagctgaagctgcagaaggccagcgagcgctggcagcctgacacagaggaggagtatgaggacagcagtggaaatgtggtgaacaagaagacctatgaggacctgaagaggcagggcctgctgtag

SEQ ID NO: 17014 - DNA, 261 bp, Artificial Sequence
  Description of Artificial Sequence: Synthetic coding sequence
atgacagaccgctacaccatccacagccagctggagcacctgcagagcaagtacatcggcactggacatgctgacaccaccaagtgggagtggctggtgaaccagcaccgggacagctactgcagctacatgggccactttgacctgctgaactactttgccatcgcagaaaatgaaagcaaggcccgggtgcgcttcaacctgatggagaagatgctgcagccctgtggccccccagctgacaagccagaagaaaattag

SEQ ID NO: 17015 - DNA, 3012 bp, Artificial Sequence
  Description of Artificial Sequence: Synthetic coding sequence
atgtacggggccagcggcggccgggccaagccagagaggaagagcggggccaaggaggaggccggccctggaggagctgggggcggcggcagccgggtggagctgctggtgtttggctacgcctgcaagctgttcagagatgatgagcgggccctggcccaggagcagggccagcacctgatcccctggatgggagaccacaagatcctgattgacagatatgatggccggggccacctgcatgacctgtctgaatatgatgctgagtacagcacctggaacagagactaccagctgtctgaggaggaggcccgcatcgaggccctgtgtgatgaggagcgctacctggccctgcacacagacctgctggaggaggaggcccggcaggaggaggagtacaagaggctgtctgaggccctggccgaggatggcagctacaatgctgtgggcttcacctacggcagtgactactatgaccccagcgagcccacagaggaggaggagcccagcaagcagcgggagaagaatgaagctgagaacctggaggagaatgaggagccctttgtggcccccctgggcctgtctgtgcccagtgatgtggagctgcccccaacagccaagatgcacgccatcatcgagaggacagccagctttgtgtgccggcagggcgcccagtttgagatcatgctgaaggccaagcaggccaggaacagccagtttgacttcctgcgctttgaccactacctgaacccctactacaagttcatccagaaggccatgaaggagggccgctacacagtgctggccgagaacaagagtgatgagaagaagaagtctggagtgtccagtgacaatgaagatgatgatgatgaggaggatggcaactacctgcaccccagcctgtttgccagcaagaagtgcaaccggctggaggagctgatgaagcccctgaaggtggtggaccctgaccaccccctggccgccctggtgaggaaggcccaggccgacagcagcacccccaccccccacaatgctgatggagcccctgtgcagcccagccaggtggagtacacagctgacagcacagtggccgccatgtactacagctactacatgctgcctgatggcacctactgcctggcccctcctcctcctggcattgatgtgaccacctactacagcaccctgcctgctggggtgacagtgagcaacagccctggggtgaccaccacagcccctcctcctcctggcaccacccccctgcccccacccaccacagctgagaccagcagcggggccaccagcaccaccaccaccaccagcgccctggcccctgtggccgccatcatccccccacctccagatgtgcagcccgtcatcgacaagctggccgagtatgtggccagaaatggcctgaagtttgagacctctgtgcgggccaagaatgaccagagatttgagttcctgcagccctggcaccagtacaatgcctactatgagttcaagaagcagttcttcctgcagaaggagggcggggacagcatgcaggccgtgtctgcccctgaggaggcccccacagacagcgcccctgagaagcccagtgatgctggggaggatggagccccagaagatgctgctgaggtgggcgcccgggccggcagcggcggcaagaaggaggccagcagcagcaagacagtgcctgatggcaagctggtgaaggccagctttgcccccatcagctttgccatcaaggccaaggaaaatgacctgctgcccctggagaagaacagagtgaagctggatgatgacagtgatgatgatgaggagagcaaggagggccaggagagcagcagcagcgctgccaacaccaacccagctgtggccccaccctgtgtggtggtggaggagaagaagccccagctgacccaggaggagctggaggccaagcaggccaagcagaagctggaggaccggctggccgccgccgcccgggagaagctggcccaggccagcaaggagagcaaggagaagcagctgcaggccgagaggaagaggaaggccgccctcttcctgcagaccctgaagaaccccctgcctgaggccgaggccggcaagattgaggagagccccttctctgtggaggagagcagcaccaccccctgccccctgctgactggaggccggcccctgcccaccctggaggtgaagcccccagaccggcccagcagcaagagcaaggaccccccccgggaggaggagaaggagaagaagaagaagaagcacaagaagaggagcaggaccaggagccgcagccccaagtaccacagcagcagcaagagccgcagccgcagccacagcaaggccaagcacagcctgcccagcgcctacagaacagtgcggcgcagccgggtgacagccagccctggcaccctgcgggcagagccctgccagagcagcgcctctgtgacagctgctgctgagcccggcagctaccaggccgccagcaccaccaccaggtttgacagcgccagcagctttgagggcaagccaggcaagaccagccgcagccgcagccgcagccccaggagaagagcccacagccctgagaggagaagagaggagaggtctgtgcccacagcctacagagtgagccgcagccctggggccagcaggaagaggaccaggagccgcagcccccatgagaagaagaagaagaggaggagccgcagcaggaccaagagcaaggcccggagccagagcgtgagccccagcaagcaggccgcccccaggcctgctgccccagctgcccacagcgcccacagcgcctctgtgtcccctgtggagagccggggcagcagccaggagaggagcagaggagtgtcccaggagaaggaggcccagatcagcagcgccatcgtgtcctctgtgcagagcaagatcacccaggacctgatggccaaggtgcgggccatgctggccgccagcaagaacctgcagaccagcgccagctag

SEQ ID NO: 17016 - DNA, 2856 bp, Artificial Sequence
  Description of Artificial Sequence: Synthetic coding sequence
atgtacggggccagcggcggccgggccaagccagagaggaagagcggggccaaggaggaggccggccctggaggagctgggggcggcggcagccgggtggagctgctggtgtttggctacgcctgcaagctgttcagagatgatgagcgggccctggcccaggagcagggccagcacctgatcccctggatgggagaccacaagatcctgattgacagatatgatggccggggccacctgcatgacctgtctgaatatgatgctgagtacagcacctggaacagagactaccagctgtctgaggaggaggcccgcatcgaggccctgtgtgatgaggagcgctacctggccctgcacacagacctgctggaggaggaggcccggcaggaggaggagtacaagaggctgtctgaggccctggccgaggatggcagctacaatgctgtgggcttcacctacggcagtgactactatgaccccagcgagcccacagaggaggaggagcccagcaagcagcgggagaagaatgaagctgagaacctggaggagaatgaggagccctttgtggcccccctgggcctgtctgtgcccagtgatgtggagctgcccccaacagccaagatgcacgccatcatcgagaggacagccagctttgtgtgccggcagggcgcccagtttgagatcatgctgaaggccaagcaggccaggaacagccagtttgacttcctgcgctttgaccactacctgaacccctactacaagttcatccagaaggccatgaaggagggccgctacacagtgctggccgagaacaagagtgatgagaagaagaagtctggagtgtccagtgacaatgaagatgatgatgatgaggaggatggcaactacctgcaccccagcctgtttgccagcaagaagtgcaaccggctggaggagctgatgaagcccctgaaggtggtggaccctgaccaccccctggccgccctggtgaggaaggcccaggccgacagcagcacccccaccccccacaatgctgatggagcccctgtgcagcccagccaggtggagtacacagctgacagcacagtggccgccatgtactacagctactacatgctgcctgatggcacctactgcctggcccctcctcctcctggcattgatgtgaccacctactacagcaccctgcctgctggggtgacagtgagcaacagccctggggtgaccaccacagcccctcctcctcctggcaccacccccctgcccccacccaccacagctgagaccagcagcggggccaccagcaccaccaccaccaccagcgccctggcccctgtggccgccatcatccccccacctccagatgtgcagcccgtcatcgacaagctggccgagtatgtggccagaaatggcctgaagtttgagacctctgtgcgggccaagaatgaccagagatttgagttcctgcagccctggcaccagtacaatgcctactatgagttcaagaagcagttcttcctgcagaaggagggcggggacagcatgcaggccgtgtctgcccctgaggaggcccccacagacagcgcccctgagaagcccagtgatgctggggaggatggagccccagaagatgctgctgaggtgggcgcccgggccggcagcggcggcaagaaggaggccagcagcagcaagacagtgcctgatggcaagctggtgaaggccagctttgcccccatcagctttgccatcaaggccaaggaaaatgacctgctgcccctggagaagaacagagtgaagctggatgatgacagtgatgatgatgaggagagcaaggagggccaggagagcagcagcagcgctgccaacaccaacccagctgtggccccaccctgtgtggtggtggaggagaagaagccccagctgacccaggaggagctggaggccaagcaggccaagcagaagctggaggaccggctggccgccgccgcccgggagaagctggcccaggccagcaaggagagcaaggagaagcagctgcaggccgagaggaagaggaaggccgccctcttcctgcagaccctgaagaaccccctgcctgaggccgaggccggcaagattgaggagagccccttctctgtggaggagagcagcaccaccccctgccccctgctgactggaggccggcccctgcccaccctggaggtgaagcccccagaccggcccagcagcaagagcaaggaccccccccgggaggaggagaaggagaagaagaagaagaagcacaagaagaggagcaggaccaggagccgcagccccaagtaccacagcagcagcaagagccgcagccgcagccacagcaaggccaagcacagcctgcccagcgcctacagaacagtgcggcgcagccgcagccgcagccgcagccccaggagaagagcccacagccctgagaggagaagagaggagaggtctgtgcccacagcctacagagtgagccgcagccctggggccagcaggaagaggaccaggagccgcagcccccatgagaagaagaagaagaggaggagccgcagcaggaccaagagcaaggcccggagccagagcgtgagccccagcaagcaggccgcccccaggcctgctgccccagctgcccacagcgcccacagcgcctctgtgtcccctgtggagagccggggcagcagccaggagaggagcagaggagtgtcccaggagaaggaggcccagatcagcagcgccatcgtgtcctctgtgcagagcaagatcacccaggacctgatggccaaggtgcgggccatgctggccgccagcaagaacctgcagaccagcgccagctag

SEQ ID NO: 17017 - DNA, 1644 bp, Artificial Sequence
  Description of Artificial Sequence: Synthetic coding sequence
atgggagaccacaagatcctgattgacagatatgatggccggggccacctgcatgacctgtctgaatatgatgctgagtacagcacctggaacagagactaccagctgtctgaggaggaggccagaattgaggccctgtgtgatgaggagcgctacctggccctgcacacagacctgctggaggaggaggcccggcaggaggaggagtacaagaggctgtctgaggccctggctgaagatggcagctacaatgctgtgggcttcacctacggcagtgactactatgaccccagcgagcccacagaggaggaggagcccagcaagcagcgggagaagaatgaagctgagaacctggaggagaatgaggagccctttgtggcccccctgggcctgtctgtgcccagtgatgtggagctgcccccaacagccaagatgcacgccatcattgaaagaacagccagctttgtgtgccggcagggcgcccagtttgagatcatgctgaaggccaagcaggccaggaacagccagtttgacttcctgcgctttgaccactacctgaacccctactacaagttcatccagaaggccatgaaggagggccgctacacagtgctggccgagaacaagagtgatgagaagaagaagagcggcgtgtccagtgacaatgaagatgatgatgatgaagaagatggcaactacctgcaccccagcctgtttgccagcaagaagtgcaaccggctggaggagctgatgaagcccctgaaggtggtggaccctgaccaccccctggccgccctggtgaggaaggcccaggccgacagcagcacccccaccccccacaatgctgatggagcccctgtgcagcccagccaggtggagtacacagctgacagcacagtggccgccatgtactacagctactacatgctgcctgatggcacctactgcctggcccctcctcctcctggcattgatgtgaccacctactacagcaccctgcctgctggggtgacagtgagcaacagccctggggtgaccaccacagcccctcctcctcctggcaccacccccctgcccccacccaccacagctgagaccagcagcggggccaccagcaccaccaccaccaccagcgccctggcccctgtggccgccatcatccccccacctccagatgtgcagcctgtgattgacaagctggccgagtatgtggccagaaatggcctgaagtttgagacctctgtgcgggccaagaatgaccagagatttgagttcctgcagccctggcaccagtacaatgcctactatgagttcaagaagcagttcttcctgcagaaggagggcggggacagcatgcaggccgtgtctgcccctgaggaggcccccacagattctgcccctgagaagcccagtgatgctggagaagatggagccccagaagatgctgctgaggtgggcgcccgggccggcagcggcggcaagaaggaggccagcagcagcaagacagtgcctgatggcaagctggtgaaggccagctttgcccccatcagctttgccatcaaggccaaggaaaatgacctgctgcccctggagaagaacaggaagaagaggaagaagaggaagaggaagagcaccaagaagtag

SEQ ID NO: 17018 - DNA, 2091 bp, Artificial Sequence
  Description of Artificial Sequence: Synthetic coding sequence
atggaggtgagcagccccagccctgcccagaggctgcggaggaagaagaggcccatggtgcagggccctgctggctgccaggtgttccagcccagccccagcggcggcacagctggggaccccggcggcctgagtgaccccttctacccacccaggagcggcagcctggccctgggggaccccagcagtgaccctgcctgcagccagagcggccccatggaggccgaggaggacagcctgcctgagcagccagaagattctgcccagctgcagcaggagaagcccagcctgtacatcggcgtgcggggcaccgtggtgcgctccatgcaggaggtgctgtggacccggctgcgggagctgcctgaccctgtgctgtctgaggaggtggtggagggcattgctgctggcattgaagctgccctgtgggacctgacccagggcaccaacggccgctacaagaccaagtaccgcagcctgctcttcaacctgcgggaccccaggaacctggacctcttcctgaaggtggtgcatggagatgtgaccccctatgacctggtgaggatgagctccatgcagctggccccccaggagctggcccgctggagggaccaggaggagaagaggggcctgaacatcatcgagcagcagcagaaggagccctgccgcctgcctgccagcaagatgacccacaagggggaggtggagatccagagggacatggaccagaccctgaccctggaggacctggtgggcccccagatgttcatggactgcagcccccaggccctgcccatcgccagcgaggacaccaccggccagcacgaccaccacttcctggaccccaactgccacatctgcaaggactgggagcccagcaatgagctgctgggcagctttgaagctgccaagagctgtggggacaacatcttccagaaggccctgagccagacccccatgcctgcccctgagatgcccaagacccgggagctgagccccacagagccccaggacagagtgccccccagcggcctgcacgtgcctgctgcccccaccaaggccctgccctgcctgcccccctgggagggcgtgctggacatgttcagcatcaagcgcttccgggcccgggcccagctggtgtctggccacagctgccgcctggtgcaggccctgcccaccgtcatccgctctgctggctgcatccccagcaacatcgtgtgggacctgctggccagcatctgcccagccaaggccaaggatgtgtgtgtggtgcggctgtgcccccacggggcccgggacacccagaactgccgcctgctgtacagctacctgaatgaccggcagagacatggcctggcctctgtggagcacatgggcatggtgctgctgcccctgcctgccttccagcccctgcccacccggctgcggcccctgggcggccctggcctggaggtgacccacagcagcctgctgctggccgtgctgctgcccaaggagggcctgcctgacacagctggcagcagcccctggctgggcaaggtgcagaagatggtgtccttcaacagcaaggtggagaagcgctactaccagccagatgacagaagacccaacgtgcccctgaagggcaccccacctcctggaggagcctggcagcagagccagggccggggcagcatcgccccccggggcatcagcgcctggcagaggcctccccggggccggggccgcctgtggccagagcctgagaactggcagcaccctggccggggccagtggcccccagagcccggcctgcggcagagccagcacccctacagcgtggccccagctggccacggcttcggccggggccagcacttccaccgggacagctgcccccaccaggccctgctgcggcacctggagagcctggccaccatgagccaccagctgcaggccctgctgtgcccccagaccaagagcagcatcccccggcccctgcagaggctgagcagcgccctggccgcccctgagcccccaggccctgcccgggacagcagcctgggccccacagatgaggccggctctgaatgtcccttccccaggaaggcctag

SEQ ID NO: 17019 - DNA, 1032 bp, Artificial Sequence
  Description of Artificial Sequence: Synthetic coding sequence
ggcaccaagtgcctggagagcctgctgggctctgtgcccccaccctgccccggcctgcacagcctgcgggagctgcctgaccctgtgctgtctgaggaggtggtggagggcattgctgctggcatcgaggccgccctgtgggacctgacccagggcaccaacggccgctacaagaccaagtaccgcagcctgctcttcaacctgcgggaccccaggaacctggacctcttcctgaaggtggtgcatggagatgtgaccccctatgacctggtgaggatgagctccatgcagctggccccccaggagctggcccgctggagggaccaggaggagaagaggggcctgaacatcatcgagcagcagcagaaggagccctgccgcctgcctgccagcaagatgacccacaagggggaggtggagatccagagggacatggaccagaccctgaccctggaggacctgggcccccagatgttcatggactgcagcccccaggccctgcccatcgccagcgaggacaccaccggccagcacgaccaccacttcctggaccccaactgccacatctgcaaggactgggagcccagcaatgagctgctgggcagctttgaagctgccaagagctgtggggacaacatcttccagaaggccctgagccagacccccatgcccccaccctgggagggcgtgctggacatgttcagcatcaagcgcttccgggcccgggcccagctggtgtctggccacagctgccgcctggtgcaggccctgcccaccgtcatccgctctgctggctgcatccccagcaacatcgtgtgggacctgctggccagcatctgcccagccaaggccaaggtgtggaggagcctgacccaggtgtgctgctggctgtgctgcagccccaggaagggcttccagacccagcagggccctgcccctggctggggccgcttcaagcgctggagccccagcacagtgcgctggaggcgggacaccatcagccagatgactggaggccgcatgtgcccctag

SEQ ID NO: 17020 - DNA, 3651 bp, Artificial Sequence
  Description of Artificial Sequence: Synthetic coding sequence
atgagccaggccggagatgtggagggccccagcactggagaccctgtgctgagcccccagcacaactgtgagctgctgcagaacatggagggcgccagctccatgcctggcctgagcccagatggccctggggccagcagcggccctggggtgcgggccggcagcaggaggaagatccccaggaaggaggccctgcggggcggcagcagcagagctgctggagctgctgaggtgcggcctggggtgctggagctgctggccgtggtgcagagccggggctccatgctggcccctggcctgcacatgcagctgcccagcgtgcccacccagggccgggccctgaccagcaagaggctgcaggtgtccctgtgtgacatcctggatgacagctgccccaggaagctgtgcagccgctctgctggcctgcctgagcgggccctggcctgccgggagcggctggccggcgtggaggaggtgtcctgcctgcggccccgggaggccagagatggcggcatgagcagccctggctgtgacagaagaagccccaccctgagcaaggaggagcccccaggccggcccctgaccagcagcccagaccctgtgcctgtgcgggtgaggaagaagtggaggcggcagggcgcccacagtgaatgtgaggagggcgctggggacttcctgtggctggaccagagccccaggggggacaacctgctgtctgtgggggaccccccccaggtggccgacctggagagcctgggcggcccctgccggccccccagccccaaggacaccggcagcggccctggagagcccggcggcagcggggccggctgtgccagcggcacagagaagtttggctacctgcctgccactggagatggcccccagcccggcagcccctgtggccctgtgggcttccctgtgcccagcggcggggagagcctgagcagcgctgcccaggccccaccccagagcgctgccctgtgcctgggcgccagcgcccaggccagcgctgagcagcaggaggccgtgtgtgtggtgaggactggaagtgatgagggccaggccccagcccaggaccaggaggagctggaggccaaggcccagcctgccagccggggccgcctggagcagggcctggccgccccagctgacacctgtgccagcagccgggagcccctgggcggcctgagcagcagcctggacacagaggccagccgggcctgcagcggccccttcatggagcagaggaggagcaagggcaccaagaacctgaagaagggccctgtgccctgtgcccaggaccggggcacagacaggagcagtgacaacagccaccaggacaggcctgaggagcccagccctgggggctgcccccggctggaggaggtgaagatcccccacggcgtgaagctggtgtgctacctgggcagcggccctgtgatccagctgctgggcgccatcagccacggccaggccggcggccagctgccccccaagctggaggtgctggaggacctgatggaggtgagcagccccagccctgcccagaggctgcggaggaagaagaggcccatggtgcagggccctgctggctgccaggtgttccagcccagccccagcggcggcacagctggggaccccggcggcctgagtgaccccttctacccacccaggagcggcagcctggccctgggggaccccagcagtgaccctgcctgcagccagagcggccccatggaggccgaggaggacagcctgcctgagcagcctgaggacagcgcccagctgcagcaggagaagcccagcctgtacatcggcgtgcggggcaccgtggtgcgctccatgcaggaggtgctgtggacccggctgcgggagctgcctgaccctgtgctgtctgaggaggtggtggagggcattgctgctggcatcgaggccgccctgtgggacctgacccagggcaccaacggccgctacaagaccaagtaccgcagcctgctcttcaacctgcgggaccccaggaacctggacctcttcctgaaggtggtgcatggagatgtgaccccctatgacctggtgaggatgagctccatgcagctggccccccaggagctggcccgctggagggaccaggaggagaagaggggcctgaacatcatcgagcagcagcagaaggagccctgccgcctgcctgccagcaagatgacccacaagggggaggtggagatccagagggacatggaccagaccctgaccctggaggacctggtgggcccccagatgttcatggactgcagcccccaggccctgcccatcgccagcgaggacaccaccggccagcacgaccaccacttcctggaccccaactgccacatctgcaaggactgggagcccagcaatgagctgctgggcagctttgaggccgccaagagctgtggggacaacatcttccagaaggccctgagccagacccccatgcctgcccctgagatgcccaagacccgggagctgagccccacagagccccaggacagagtgcccccatctggcctgcacgtgcctgctgcccccaccaaggccctgccctgcctgcccccctgggagggcgtgctggacatgttcagcatcaagcgcttccgggcccgggcccagctggtgtctggccacagctgccgcctggtgcaggccctgcccaccgtcatccgctctgctggctgcatccccagcaacatcgtgtgggacctgctggccagcatctgcccagccaaggccaaggatgtgtgtgtggtgcggctgtgcccccatggagcccgggacacccagaactgccgcctgctgtacagctacctgaatgaccggcagagacatggcctggcctctgtggagcacatgggcatggtgctgctgcccctgcctgccttccagcccctgcccacccggctgcggcccctgggcggccctggcctgtgggccctgcctgtgagccccctgctgagccctggcctggaggtgacccacagcagcctgctgctggccgtgctgctgcccaaggagggcctgcctgacacagctggcagcagcccctggctgggcaaggtgcagaagatggtgtccttcaacagcaaggtggagaagcgctactaccagccagatgacagaagacccaacgtgcccctgaagggcaccccacctcctggaggagcctggcagcagagccagggccggggcagcatcgccccccggggcatcagcgcctggcagaggcctccccggggccggggccgcctgtggccagagcctgagaactggcagcaccctggccggggccagtggcccccagagcccggcctgcggcagagccagcacccctacagcgtggccccagctggccacggcttcggccggggccagcacttccaccgggacagctgcccccaccaggccctgctgcggcacctggagagcctggccaccatgagccaccagctgcaggccctgctgtgcccccagaccaagagcagcatcccccggcccctgcagaggctgagcagcgccctggccgcccctgagcccccaggccctgcccgggacagcagcctgggccccacagatgaggccggctctgaatgtcccttccccaggaaggcctag

SEQ ID NO: 17021 - DNA, 1635 bp, Artificial Sequence
  Description of Artificial Sequence: Synthetic coding sequence
atgagccaggccggagatgtggagggccccagcactggagaccctgtgctgagcccccagcacaactgtgagctgctgcagaacatggagggcgccagctccatgcctggcctgagcccagatggccctggggccagcagcggccctggggtgcgggccggcagcaggaggaagatccccaggaaggaggccctgcggggcggcagcagcagagctgctggagctgctgaggtgcggcctggggtgctggagctgctggccgtggtgcagagccggggctccatgctggcccctggcctgcacatgcagctgcccagcgtgcccacccagggccgggccctgaccagcaagaggctgcaggtgtccctgtgtgacatcctggatgacagctgccccaggaagctgtgcagccgctctgctggcctgcctgagcgggccctggcctgccgggagcggctggccggcgtggaggaggtgtcctgcctgcggccccgggaggccagagatggcggcatgagcagccctggctgtgacagaagaagccccaccctgagcaaggaggagcccccaggccggcccctgaccagcagcccagaccctgtgcctgtgcgggtgaggaagaagtggaggcggcagggcgcccacagtgaatgtgaggagggcgctggggacttcctgtggctggaccagagccccaggggggacaacctgctgtctgtgggggaccccccccaggtggccgacctggagagcctgggcggcccctgccggccccccagccccaaggacaccggcagcggccctggagagcccggcggcagcggggccggctgtgccagcggcacagagaagtttggctacctgcctgccactggagatggcccccagcccggcagcccctgtggccctgtgggcttccctgtgcccagcggcggggagagcctgagcagcgctgcccaggccccaccccagagcgctgccctgtgcctgggcgccagcgcccaggccagcgctgagcagcaggaggccgtgtgtgtggtgaggactggaagtgatgagggccaggccccagcccaggaccaggaggagctggaggccaaggcccagcctgccagccggggccgcctggagcagggcctggccgccccagctgacacctgtgccagcagccgggagcccctgggcggcctgagcagcagcctggacacagaggccagccgggcctgcagcggccccttcatggagcagaggaggagcaagggcaccaagaacctgaagaagggccctgtgccctgtgcccaggaccggggcacagacaggagcagtgacaacagccaccaggacaggcctgaggagcccagccctgggggctgcccccggctggaggaggtgaagatcccccacggcgtgaagctggtgtgctacgtgttccagcccagccccagcggcggcacagctggggaccccggcggcctgagtgaccccttctacccacccaggagcggcagcctggccctgggggaccccagcagtgaccctgcctgcagccagagcggccccatggaggccgaggaggacagcctgcctgagcagccagaagattctgccttcggcagcagccagacccagtgctag

SEQ ID NO: 17022 - DNA, 810 bp, Artificial Sequence
  Description of Artificial Sequence: Synthetic coding sequence
atgcaggaggtgctgtggacccggctgcgggagctgcctgaccctgtgctgtctgaggaggtggtggagggcattgctgctggcattgaagctgccctgtgggacctgacccagggcaccaacggccgctacaagaccaagtaccgcagcctgctcttcaacctgcgggaccccaggaacctggacctcttcctgaaggtggtgcatggagatgtgaccccctatgacctggtgaggatgagctccatgcagctggccccccaggagctggcccgctggagggaccaggaggagaagaggggcccccagatgttcatggactgcagcccccaggccctgcccatcgccagcgaggacaccaccggccagcacgaccaccacttcctggaccccaactgccacatctgcaaggactgggagcccagcaatgagctgctgggcagctttgaagctgccaagagctgtggggacaacatcttccagaaggccctgagccagacccccatgcctgcccctgagatgcccaagacccgggagctgagccccacagagccccaggacagatgtggggtgggcagccgggaggtggacaacccagctggcctgcggggccggcccccacctggggccacagacatcgccctggccttccctgtgtggccctgggccagcctgcccagcctgggcaacctgaccttccccatctgtgccatggagctgatcatcccagcctcctggcagcccccagcccagggccaggcctgggcctctgtgcctgtgcccaccgtgggcacccaggacctgctgtag

SEQ ID NO: 17023 - DNA, 63 bp, Artificial Sequence
  Description of Artificial Sequence: Synthetic coding sequence
atggaggtgagcagccccagccctgcccagaggctgcggaggaagaagaggcccatggtgtag

SEQ ID NO: 17024 - DNA, 264 bp, Artificial Sequence
  Description of Artificial Sequence: Synthetic coding sequence
atggaggtgagcagccccagccctgcccagaggctgcggaggaagaagaggcccatggtgcagggccctgctggctgccaggtgttccagcccagccccagcggcggcacagctggggaccccggcggcctgagtgaccccttctacccacccaggagcggcagcctggccctgggggaccccagcagtgaccctgcctgcagccagagcggccccatggaggccgaggaggacagcctgcctgagcagcctgaggacagctag

SEQ ID NO: 17025 - DNA, 3612 bp, Artificial Sequence
  Description of Artificial Sequence: Synthetic coding sequence
atgagccaggccggagatgtggagggccccagcactggagaccctgtgctgagcccccagcacaactgtgagctgctgcagaacatggagggcgccagctccatgcctggcctgagcccagatggccctggggccagcagcggccctggggtgcgggccggcagcaggaggaagatccccaggaaggaggccctgcggggcggcagcagcagagctgctggagctgctgaggtgcggcctggggtgctggagctgctggccgtggtgcagagccggggctccatgctggcccctggcctgcacatgcagctgcccagcgtgcccacccagggccgggccctgaccagcaagaggctgcaggtgtccctgtgtgacatcctggatgacagctgccccaggaagctgtgcagccgctctgctggcctgcctgagcgggccctggcctgccgggagcggctggccggcgtggaggaggtgtcctgcctgcggccccgggaggccagagatggcggcatgagcagccctggctgtgacagaagaagccccaccctgagcaaggaggagcccccaggccggcccctgaccagcagcccagaccctgtgcctgtgcgggtgaggaagaagtggaggcggcagggcgcccacagtgaatgtgaggagggcgctggggacttcctgtggctggaccagagccccaggggggacaacctgctgtctgtgggggaccccccccaggtggccgacctggagagcctgggcggcccctgccggccccccagccccaaggacaccggcagcggccctggagagcccggcggcagcggggccggctgtgccagcggcacagagaagtttggctacctgcctgccactggagatggcccccagcccggcagcccctgtggccctgtgggcttccctgtgcccagcggcggggagagcctgagcagcgctgcccaggccccaccccagagcgctgccctgtgcctgggcgccagcgcccaggccagcgctgagcagcaggaggccgtgtgtgtggtgaggactggaagtgatgagggccaggccccagcccaggaccaggaggagctggaggccaaggcccagcctgccagccggggccgcctggagcagggcctggccgccccagctgacacctgtgccagcagccgggagcccctgggcggcctgagcagcagcctggacacagaggccagccgggcctgcagcggccccttcatggagcagaggaggagcaagggcaccaagaacctgaagaagggccctgtgccctgtgcccaggaccggggcacagacaggagcagtgacaacagccaccaggacaggcctgaggagcccagccctgggggctgcccccggctggaggaggtgaagatcccccacggcgtgaagctggtgtgctacctgggcagcggccctgtgatccagctgctgggcgccatcagccacggccaggccggcggccagctgccccccaagctggaggtgctggaggacctgatggaggtgagcagccccagccctgcccagaggctgcggaggaagaagaggcccatggtgcagggccctgctggctgccaggtgttccagcccagccccagcggcggcacagctggggaccccggcggcctgagtgaccccttctacccacccaggagcggcagcctggccctgggggaccccagcagtgaccctgcctgcagccagagcggccccatggaggccgaggaggacagcctgcctgagcagcctgaggacagcgcccagctgcagcaggagaagcccagcctgtacatcggcgtgcggggcaccgtggtgcgctccatgcaggaggtgctgtggacccggctgcgggagctgcctgaccctgtgctgtctgaggaggtggtggagggcattgctgctggcatcgaggccgccctgtgggacctgacccagggcaccaacggccgctacaagaccaagtaccgcagcctgctcttcaacctgcgggaccccaggaacctggacctcttcctgaaggtggtgcatggagatgtgaccccctatgacctggtgaggatgagctccatgcagctggccccccaggagctggcccgctggagggaccaggaggagaagaggggcctgaacatcatcgagcagcagcagaaggagccctgccgcctgcctgccagcaagatgacccacaagggggaggtggagatccagagggacatggaccagaccctgaccctggaggacctggtgggcccccagatgttcatggactgcagcccccaggccctgcccatcgccagcgaggacaccaccggccagcacgaccaccacttcctggaccccaactgccacatctgcaaggactgggagcccagcaatgagctgctgggcagctttgaggccgccaagagctgtggggacaacatcttccagaaggccctgagccagacccccatgcctgcccctgagatgcccaagacccgggagctgagccccacagagccccaggacagagtgcccccatctggcctgcacgtgcctgctgcccccaccaaggccctgccctgcctgcccccctgggagggcgtgctggacatgttcagcatcaagcgcttccgggcccgggcccagctggtgtctggccacagctgccgcctggtgcaggccctgcccaccgtcatccgctctgctggctgcatccccagcaacatcgtgtgggacctgctggccagcatctgcccagccaaggccaaggatgtgtgtgtggtgcggctgtgcccccatggagcccgggacacccagaactgccgcctgctgtacagctacctgaatgaccggcagagacatggcctggcctctgtggagcacatgggcatggtgctgctgcccctgcctgccttccagcccctgcccacccggctgcggcccctgggcggccctggcctggaggtgacccacagcagcctgctgctggccgtgctgctgcccaaggagggcctgcctgacacagctggcagcagcccctggctgggcaaggtgcagaagatggtgtccttcaacagcaaggtggagaagcgctactaccagccagatgaccggcggcccaacgtgcccctgaagggcaccccacctcctgggggcgcctggcagcagagccagggccggggcagcatcgccccccggggcatcagcgcctggcagaggcctccccggggccggggccgcctgtggccagagcctgagaactggcagcaccctggccggggccagtggcccccagagcccggcctgcggcagagccagcacccctacagcgtggccccagctggccacggcttcggccggggccagcacttccaccgggacagctgcccccaccaggccctgctgcggcacctggagagcctggccaccatgagccaccagctgcaggccctgctgtgcccccagaccaagagcagcatcccccggcccctgcagaggctgagcagcgccctggccgcccctgagcccccaggccctgcccgggacagcagcctgggccccacagatgaagctggcagcgagtgccccttccccaggaaggcctag

SEQ ID NO: 17026 - DNA, 3939 bp, Artificial Sequence
  Description of Artificial Sequence: Synthetic coding sequence
atggaggaggaggatgagagccggggcaagacagaggagagcggggaggacagaggagatggccccccagaccgggaccccaccctgagccccagcgccttcatcctgcgggccatccagcaggccgtgggcagcagcctgcagggcgacctgcccaatgacaaggatggcagccgctgccacggcctgcgctggaggcgctgccgcagccccaggtctgagcccaggagccaggagagcggcggcacagacacagccaccgtgctggacatggccacagacagcttcctggccggcctggtgtctgtgctggaccccccagacacctgggtgcccagccggctggacctgcggcctggagagagcgaggacatgctggagctggtggccgaggtgcgcatcggggaccgggaccccatccccctgcctgtgcccagcctgctgccccggctgcgggcctggaggacaggcaagacagtgagcccccagagcaacagcagccggcccacctgtgcccggcacctgaccctgggcactggagatggcggccctgcccctcctccagcccccagcagcgccagcagcagccccagccccagccccagcagcagcagccccagccccccacctcctcctcctcctccagcccccccagcccccccagcccccaggtttgacatctatgaccccttccaccccacagatgaggcctacagccccccaccagcccctgagcagaagtatgacccctttgagcccaccggcagcaaccccagcagcagcgctggcacccccagccctgaggaggaggaggaggaggaggaggaggaggaggaggaggaggaggatgaggaggaggaggagggcctgagccagagcatcagccgcatcagcgagaccctggccggcatctatgatgacaacagcctgagccaggacttccctggagatgagagccccaggccagatgcccagcccacccagcccaccccagcccctggcaccccaccccaggtggacagcaccagggcagatggagccatgagaagaagagtgtttgtggtgggcacagaagctgaggcctgccgggagggcaaggtgtctgtggaggtggtgacagctgggggcgccgccctgcccccacccctgctgcccccaggggacagcgagattgaggagggggagatcgtgcagcctgaggaggagccccggctggccctgagcctcttccggcctgggggccgggccgcccggcccaccccagctgccagcgccacccccacagcccagcccctgccccagcccccagccccccgggccccagaaggagatgacttcctgagcctgcatgctgagagtgatggagagggcgccctgcaggtggacctgggggagcccgccccagcccccccagctgctgacagccgctggggcggcctggacctgcggaggaagatcctgacccagaggcgggagcgctaccggcagaggagccccagccctgccccagccccagccccagctgctgctgctggcccccccaccaggaagaagagccggcgggagaggaagaggtctggagaggccaaggaggccgccagcagcagcagcggcacccagcctgcccccccagccccagccagcccctgggacagcaagaagcacaggagccgggacaggaagccaggcagccacgccagcagcagcgcccggcggcgcagccgcagccgcagccgcagccgcagcaccaggagaagaagccgcagcacagacagaagaagaggaggcagccgccgcagccgcagccgggagaagagaagaagaagaagaagaagtgccagccccccaccagccaccagcagcagcagcagcagccggcgggagcggcaccggggcaagcacagagatggcggcggcagcaagaagaagaagaagaggagccgcagcagaggagagaagaggtctggagatggcagcgagaaggccccagccccagcccccccacccagcggcagcaccagctgtggggaccgggacagcagaagaagaggagctgtgcccccatccatccaggacctgacagaccatgacctgtttgccatcaagaggaccatcaccgtgggccgcctggacaagagtgacccccggggccccagccctgccccagccagcagccccaagcgggaggtgctgtatgacagcgagggcctgagcggggaggagcggggcggcaagagcagccagaaggacagaagaagaagtggggccgccagcagcagcagcagcagccgggagaagggcagcaggaggaaggccctggatggaggagaccgggaccgggaccgggaccgggaccgggaccgggacaggagcagcaagaaggcccggccccccaaggagagcgcccccagcagcggccccccacccaagccccctgtgagcagcggcagcggcagcagcagcagcagcagcagctgcagcagcaggaaggtgaagctgcagagcaaggtggccgtgctgatccgggagggcgtgagcagcaccaccccagccaaggatgctgccagcgctggcctgggcagcattggagtgaagttcagccgggaccgggagagccgcagccccttcctgaagccagatgagcgggcccccacagagatggccaaggccgcccctggcagcaccaagcccaagaagaccaaggtgaaggccaaggccggggccaagaagaccaagggcaccaagggcaagaccaagcccagcaagaccaggaagaaggtgcgcagcggcggcggcagcggcggcagcggcggccaggtgtccctgaagaagagcaaggctgacagctgcagccaggccgccggcaccaagggagctgaggagacctcctggagcggggaggagcgggccgccaaggtgcccagcaccccaccacccaaggccgcccctcctcctccagccctgaccccagacagccagacagtggacagcagctgcaagaccccagaggtgtccttcctgcctgaggaggccacagaggaggccggcgtgcggggcggcgctgaggaggaggaggaggaggaggaggaggaggaggaggaggaggaggaggaggagcagcagcctgccaccaccacagccaccagcacagctgctgctgcccccagcacagcccccagcgctggcagcacagctggggacagcggggctgaagatggccctgccagccgggtgtcccagctgcccaccctgcccccacccatgccctggaacctgcctgctggggtggactgcaccaccagcggcgtgctggccctgacagccctgctcttcaagatggaggaggccaacctggccagccgggccaaggcccaggagctgatccaggccaccaaccagatcctgagccacaggaagccacccagcagcctgggcatgaccccagcccctgtgcccaccagcctgggcctgcccccaggccccagcagctacctgctgcccggcagcctgcccctgggcggctgcggcagcaccccacccacccccaccggcctggccgccaccagtgacaagcgggagggcagcagcagcagcgagggccgcggggacacagacaagtacctgaagaagctgcacacccaggagagagctgtggaggaggtgaagctggccatcaagccctactaccagaagaaggacatcaccaaggaggagtacaaggacatcctgaggaaggctgtgcacaagatctgccacagcaagtctggagagatcaaccctgtgaaggtgagcaacctggtgcgggcctacgtgcagcgctaccgctacttcaggaagcacggcaggaagccaggggaccccccaggcccccccaggcctcccaaggagcccggccccccagacaagggcggccctggcctgcccctgccccccctgtag

SEQ ID NO: 17027 - DNA, 660 bp, Artificial Sequence
  Description of Artificial Sequence: Synthetic coding sequence
atggaggaggaggatgagagccggggcaagacagaggagagcggggaggacagaggagatggccccccagaccgggaccccaccctgagccccagcgccttcatcctgcgggccatccagcaggccgtgggcagcagcctgcagggcgacctgcccaatgacaaggatggcagccgctgccacggcctgcgctggaggcgctgccgcagccccaggtctgagcccaggagccaggagagcggcggcacagacacagccaccgtgctggacatggccacagacagcttcctggccggcctggtgtctgtgctggaccccccagacacctgggtgcccagccggctggacctgcggcctggagagagcgaggacatgctggagctggtggccgaggtgcgcatcggggaccgggaccccatccccctgcctgtgcccagcctgctgccccggctgcgggcctggaggacaggcaagacagtgagcccccagagcaacagcagccggcccacctgtgcccggcacctgaccctgggcactggagatggcccctgccccaccccctgccccctgctgtgcatcctgctgcccttccccttcagcctcatcttcctgcccttccccagccccacccccacagcccccagcccccagttccactag

SEQ ID NO: 17028 - DNA, 3444 bp, Artificial Sequence
  Description of Artificial Sequence: Synthetic coding sequence
atggatgctgtgaatgccttcaaccaggagctgttcagcctgatggacatgaagccacccatcagccgggccaagatgatcctgatcaccaaggccgccatcaaggccatcaagctgtacaagcacgtggtgcagatcgtggagaagttcatcaagaagtgcaagccagagtacaaggtgcccggcctgtatgtgattgacagcatcgtgcggcagagccgccaccagtttggaacagacaaggatgtgtttggcccccgcttcagcaagaacatcacagccaccttccagtacctgtacctgtgccccagcgaggacaagagcaagatcgtgcgggtgctgaacctgtggcagaagaatggagtcttcaagattgagatcatccagcccctgctggacatggccgccggcaccagcaatgctgcccctgtggccgagaatgtgaccaacaatgaaggcagccccccacctcctgtgaaggtgtcctctgagccccccacccaggccacccccaacagcgtgcctgctgtgccccagctgcccagcagtgatgcctttgctgctgtggcccagctgttccagaccacccagggccagcagctgcagcagatcctgcagaccttccagcagccccccaagccccagagccctgccctggacaatgctgtgatggcccaggtgcaggccatcacagcccagctgaagaccacccccacccagcccagcgagcagaaggccgccttccccccacctgagcagaagacagcctttgacaagaagctgctggacagatttgattatgatgatgagcctgaggccgtggaggagagcaagaaggaggacaccacagctgtgaccaccacagccccagctgctgctgtgcccccagcccccacagccaccgtgcctgctgctgctgccccagctgctgccagccccccaccaccccaggcccccttcggcttccctggagatggcatgcagcagcctgcctacacccagcaccagaacatggaccagttccagcccaggatgatgggcatccagcaggaccccatgcaccaccaggtgcccctgccccccaacggccagatgcctggcttcggcctgctgcccaccccacccttcccccccatggcccagcccgtcatcccccccaccccacctgtgcagcagcccttccaggccagcttccaggcccagaatgagcccctgacccagaagccccaccagcaggagatggaggtggagcagccctgcatccaggaggtgaagaggcacatgtctgacaacaggaagagccgcagccgcagcgccagccgcagccccaagagaagaagaagccgcagcggcagccgcagcagaagaagccgccaccggcgcagccgcagccgcagccgggacagaagaagacacagccccaggagccgcagccaggagcggcgggaccgggagaaggagcgggagcggcggcagaagggcctgccccaggtgaagccagagacagcctctgtgtgcagcaccaccctgtgggtgggccagctggacaagaggaccacccagcaggatgtggccagcctgctggaggagtttggccccatcgagagcatcaacatgatccccccccggggctgtgcctacatcgtgatggtgcaccggcaggatgcctaccgggccctgcagaagctgagccggggcaactacaaggtgaaccagaagagcatcaagatcgcctgggccctgaacaagggcatcaaggctgactacaagcagtactgggatgtggagctgggcgtgacctacatcccctgggacaaggtgaagccagaggagctggagagcttctgtgagggcggcatgctggacagcgacaccctgaacccagactggaagggcatccccaagaagccagaaaatgaggtggcccagaatggaggagctgagaccagccacacagagcctgtgagccccatccccaagcccctgcctgtgcctgtgccccccatccctgtgcctgcccccatcaccgtgcccccaccccaggtgcccccccaccagcccggcccccctgtggtgggcgccctgcagcccccagccttcaccccacccctgggcatccccccacctggctttggacctggggtgcccccacctcctcctcctccacccttcctgcggcccggcttcaaccccatgcacctgcccccaggcttcctgcccccaggccccccaccacccatcaccccacctgtgtccatccccccaccccacaccccacccatcagcatccccaacagcaccatcgccggcatcaatgaagacaccaccaaggacctgagcatcggcaaccccatccccaccgtggtgtctggggcccggggaaatgctgagagcggggacagcgtgaagatgtatggcagcgctgtgcccccagctgcccccaccaacctgcccaccccacctgtgacccagcctgtgtccctgctgggcacccagggcgtggcccctggccctgtgattggcctgcaggcccccagcacaggcctgctgggcgcccggcccggcctcatccccctgcagaggcctcctggcatgcccccaccccacctgcagcgcttccccctgatgccaccccggcccatgccaccccacatgatgcaccggggccccccacctggccctgggggctttgccatgcctcctcctcatggcatgaagggccccttccccccccacggcccctttgtgcggcctgggggcatgcctggcctgggcggccctggccctggccctgggggcccagaagatagagatggccggcagcagcccccccagcagccccagcagcagccccagccccaggccccccagcagccccagcagcagcagcagcagcagcccccacccagccagcagcccccacccacccagcagcagccccagcagttcagaaatgacaaccggcagcagttcaacagcggccgggaccaggagcgcttcggccgccgcagctttggaaacagagtggagaatgaccgggagagatatggcaacagaaatgatgaccgggacaacagcaacagagaccggcgggagtggggcagaagaagcccagaccgggacagacaccgggacctggaggagaggaacagaagaagcagcggccaccgggaccgggagcgggacagccgggaccgggagagcagaagagagaaggaggaggcccggggcaaggagaagccagaggtgacagacagagctgggggcaacaagacagtggagccccccatcagccaggtgggcaatgtggacacagccagcgagctggagaagggcgtgtctgaggccgctgtgctgaagcccagcgaggagctgcctgctgaggccaccagctctgtggagcctgagaaggacagcggcagcgctgctgaggcccccaggtag

SEQ ID NO: 17029 - DNA, 3378 bp, Artificial Sequence
  Description of Artificial Sequence: Synthetic coding sequence
atggatgctgtgaatgccttcaaccaggagctgttcagcctgatggacatgaagccacccatcagccgggccaagatgatcctgatcaccaaggccgccatcaaggccatcaagctgtacaagcacgtggtgcagatcgtggagaagttcatcaagaagtgcaagccagagtacaaggtgcccggcctgtatgtgattgacagcatcgtgcggcagagccgccaccagtttggaacagacaaggatgtgtttggcccccgcttcagcaagaacatcacagccaccttccagtacctgtacctgtgccccagcgaggacaagagcaagatcgtgcgggtgctgaacctgtggcagaagaatggagtcttcaagattgagatcatccagcccctgctggacatggccgccggcaccagcaatgctgcccctgtggccgagaatgtgaccaacaatgaaggcagccccccacctcctgtgaaggtgtcctctgagccccccacccaggccacccccaacagcgtgcctgctgtgccccagctgcccagcagtgatgcctttgctgctgtggcccagctgttccagaccacccagggccagcagctgcagcagatcctgcagaccttccagcagccccccaagccccagagccctgccctggacaatgctgtgatggcccaggtgcaggccatcacagcccagctgaagaccacccccacccagcccagcgagcagaaggccgccttccccccacctgagcagaagacagcctttgacaagaagctgctggacagatttgattatgatgatgagcctgaggccgtggaggagagcaagaaggaggacaccacagctgtgaccaccacagccccagctgctgctgtgcccccagcccccacagccaccgtgcctgctgctgctgccccagctgctgccagccccccaccaccccaggcccccttcggcttccctggagatggcatgcagcagcctgcctacacccagcaccagaacatggaccagttccagcccaggatgatgggcatccagcaggaccccatgcaccaccaggtgcccctgccccccaacggccagatgcctggcttcggcctgctgcccaccccacccttcccccccatggcccagcccgtcatcccccccaccccacctgtgcagcagcccttccaggccagcttccaggcccagaatgagcccctgacccagaagccccaccagcaggagatggaggtggagcagccctgcatccaggaggtgaagaggcacatgtctgacaacaggaagagccgcagccgcagcgccagccgcagccccaagagaagaagaagccgcagcggcagccgcagcagaagaagccgccaccggcgcagccgcagccgcagccgggacagaagaagacacagccccaggagccgcagccaggagcggcgggaccgggagaaggagcgggagcggcggcagaagggcctgccccaggtgaagccagagacagcctctgtgtgcagcaccaccctgtgggtgggccagctggacaagaggaccacccagcaggatgtggccagcctgctggaggagtttggccccatcgagagcatcaacatgatccccccccggggctgtgcctacatcgtgatggtgcaccggcaggatgcctaccgggccctgcagaagctgagccggggcaactacaaggtgaaccagaagagcatcaagatcgcctgggccctgaacaagggcatcaaggctgactacaagcagtactgggatgtggagctgggcgtgacctacatcccctgggacaaggtgaagccagaggagctggagagcttctgtgagggcggcatgctggacagcgacaccctgaacccagactggaagggcatccccaagaagccagaaaatgaggtggcccagaatggaggagctgagaccagccacacagagcctgtgagccccatccccaagcccctgcctgtgcctgtgccccccatccctgtgcctgcccccatcaccgtgcccccaccccaggtgcccccccaccagcccggcccccctgtggtgggcgccctgcagcccccagccttcaccccacccctgggcatccccccacctggctttggacctggggtgcccccacctcctcctcctccacccttcctgcggcccggcttcaaccccatgcacctgcccccaggcttcctgcccccaggccccccaccacccatcaccccacctgtgtccatccccccaccccacaccccacccatcagcatccccaacctggtgtctggggcccggggaaatgctgagagcggggacagcgtgaagatgtatggcagcgctgtgcccccagctgcccccaccaacctgcccaccccacctgtgacccagcctgtgtccctgctgggcacccagggcgtggcccctggccctgtgattggcctgcaggcccccagcacaggcctgctgggcgcccggcccggcctcatccccctgcagaggcctcctggcatgcccccaccccacctgcagcgcttccccctgatgccaccccggcccatgccaccccacatgatgcaccggggccccccacctggccctgggggctttgccatgcctcctcctcatggcatgaagggccccttccccccccacggcccctttgtgcggcctgggggcatgcctggcctgggcggccctggccctggccctgggggcccagaagatagagatggccggcagcagcccccccagcagccccagcagcagccccagccccaggccccccagcagccccagcagcagcagcagcagcagcccccacccagccagcagcccccacccacccagcagcagccccagcagttcagaaatgacaaccggcagcagttcaacagcggccgggaccaggagcgcttcggccgccgcagctttggaaacagagtggagaatgaccgggagagatatggcaacagaaatgatgaccgggacaacagcaacagagaccggcgggagtggggcagaagaagcccagaccgggacagacaccgggacctggaggagaggaacagaagaagcagcggccaccgggaccgggagcgggacagccgggaccgggagagcagaagagagaaggaggaggcccggggcaaggagaagccagaggtgacagacagagctgggggcaacaagacagtggagccccccatcagccaggtgggcaatgtggacacagccagcgagctggagaagggcgtgtctgaggccgctgtgctgaagcccagcgaggagctgcctgctgaggccaccagctctgtggagcctgagaaggacagcggcagcgctgctgaggcccccaggtag

SEQ ID NO: 17030 - DNA, 3399 bp, Artificial Sequence
  Description of Artificial Sequence: Synthetic coding sequence
atggatgctgtgaatgccttcaaccaggagctgttcagcctgatggacatgaagccacccatcagccgggccaagatgatcctgatcaccaaggccgccatcaaggccatcaagtgcaagccagagtacaaggtgcccggcctgtatgtgattgacagcatcgtgcggcagagccgccaccagtttggaacagacaaggatgtgtttggcccccgcttcagcaagaacatcacagccaccttccagtacctgtacctgtgccccagcgaggacaagagcaagatcgtgcgggtgctgaacctgtggcagaagaatggagtcttcaagattgagatcatccagcccctgctggacatggctgctggcaccagcaatgctgcccctgtggctgaaaatgtgaccaacaatgaaggcagccccccacctcctgtgaaggtgagcagcgagccccccacccaggccacccccaacagcgtgcctgctgtgccccagctgcccagcagtgatgcctttgctgctgtggcccagctgttccagaccacccagggccagcagctgcagcagatcctgcagaccttccagcagccccccaagccccagagccctgccctggacaatgctgtgatggcccaggtgcaggccatcacagcccagctgaagaccacccccacccagcccagcgagcagaaggccgccttccccccacctgagcagaagacagcctttgacaagaagctgctggacagatttgattatgatgatgagcctgaggccgtggaggagagcaagaaggaggacaccacagctgtgaccaccacagccccagctgctgctgtgcccccagcccccacagccaccgtgcctgctgctgctgccccagctgctgccagccccccaccaccccaggcccccttcggcttccctggagatggcatgcagcagcctgcctacacccagcaccagaacatggaccagttccagcccaggatgatgggcatccagcaggaccccatgcaccaccaggtgcccctgcccccaaatggccagatgcctggcttcggcctgctgcccaccccacccttcccccccatggcccagcctgtgatcccccccaccccacctgtgcagcagcccttccaggccagcttccaggcccagaatgagcccctgacccagaagccccaccagcaggagatggaggtggagcagccctgcatccaggaggtgaagaggcacatgtctgacaacaggaagagccgcagccgcagcgccagccgcagccccaagagaagaagaagccgcagcggcagccgcagccgccgcagccgccacagaagaagccgcagccgcagccgggacagaagaagacacagccccaggagccgcagccaggagcggcgggaccgggagaaggagcgggagcggcggcagaagggcctgccccaggtgaagccagagacagcctctgtgtgcagcaccaccctgtgggtgggccagctggacaagaggaccacccagcaggatgtggccagcctgctggaggagtttggccccatcgagagcatcaacatgatccccccccggggctgtgcctacatcgtgatggtgcaccggcaggatgcctaccgggccctgcagaagctgagccggggcaactacaaggtgaaccagaagagcatcaagatcgcctgggccctgaacaagggcatcaaggctgactacaagcagtactgggatgtggagctgggcgtgacctacatcccctgggacaaggtgaagccagaggagctggagagcttctgtgagggcggcatgctggacagcgacaccctgaacccagactggaagggcatccccaagaagccagaaaatgaggtggcccagaatggaggagctgagaccagccacacagagcctgtgagccccatccccaagcccctgcctgtgcctgtgccccccatccctgtgcctgcccccatcaccgtgcccccaccccaggtgcccccccaccagcccggcccccctgtggtgggcgccctgcagcccccagccttcaccccacccctgggcatccccccacctggcttcggccctggggtgcccccacctcctcctcctccacccttcctgcggcccggcttcaaccccatgcacctgcccccaggcttcctgcccccaggccccccaccacccatcaccccacctgtgtccatccccccaccccacaccccacccatcagcatccccaacagcaccatcgccggcatcaatgaagacaccaccaaggacctgagcatcggcaaccccatccccaccgtggtgtctggggcccggggaaatgctgagagcggggacagcgtgaagatgtatggcagcgctgtgcccccagctgcccccaccaacctgcccaccccacctgtgacccagcctgtgtccctgctgggcacccagggcgtggcccctggccctgtgattggcctgcaggcccccagcacaggcctgctgggcgcccggcccggcctcatccccctgcagaggcctcctggcatgcccccaccccacctgcagcgcttccccctgatgccaccccggcccatgccaccccacatgatgcaccggggccccccacctggccctgggggctttgccatgcccccaccccacggcatgaagggccccttcccccctcatggcccctttgtgcggcctgggggcatgcctggcctgggcggccctggccctggccctgggggccctgaggacagagatggccggcagcagcccccccagcagccccagcagcagccccagccccaggccccccagcagccccagcagcagcagcagcagcagcccccacccagccagcagcccccacccacccagcagcagccccagcagttcagaaatgacaaccggcagcagttcaacagcggccgggaccaggagagatttggaagaagaagctttggaaacagagtggagaatgaccgggagagatatggcaacagaaatgatgaccgggacaacagcaacagagacagaagagagtggggccgccgcagcccagaccgggacagacaccgggacctggaggagaggaacagaagaagcagcggccaccgggaccgggagcgggacagccgggaccgggagagccggcgggagaaggaggaggcccggggcaaggagaagccagaggtgacagaccgggccggcggcaacaagacagtggagccccccatcagccaggtgggcaatgtggacacagccagcgagctggagaagggcgtgtctgaggccgctgtgctgaagcccagcgaggagctgcctgctgaggccaccagctctgtggagcctgagaaggacagcggcagcgctgctgaggcccccaggtag

SEQ ID NO: 17031 - DNA, 3816 bp, Artificial Sequence
  Description of Artificial Sequence: Synthetic coding sequence
atggaggccgtgaagaccttcaacagcgagctgtacagcctgaatgactacaagccacccatcagcaaggccaagatgacccagatcaccaaggccgccatcaaggccatcaagttctacaagcacgtggtgcagagcgtggagaagttcatccagaagtgcaagccagagtacaaggtgcccggcctgtatgtgattgacagcatcgtgcggcagagccgccaccagtttggccaggagaaggatgtgtttgccccccgcttcagcaacaacatcatcagcaccttccagaacctgtaccgctgccctggagatgacaagagcaagatcgtgcgggtgctgaacctgtggcagaagaacaacgtgttcaagtctgagatcatccagcccctgctggacatggccgccggcatccccccacctgtggtgacccctgtgctggccagcaccaccacagccatgagcaacaccccaggcacccctgtgacccctgtgaccccagccaacgtggtgcagggcctgcctgacccctgggtgtcccagatcaccaacacagacaccctggccgctgtggcccagatcctgcagagcccccagggccagcagctgcagcagctgatccagaccctgcagatccagcagcagaagccccagcccagcatcctgcaggccctggatgctggcctggtggtgcagctgcaggccctgacagcccagctgacagctgctgctgctgctgccaacaccctgacccccctggagcagggcgtgtccttcaacaagaagctgatggacagatttgattttggagaagattctgagcacagcgaggagcccaagaaggagatcccagccagccagctgagccacgtgtctgagagcgtgaacaacagcatcttccaccagattgctgagcagctgcagcagcagaacctggagcacctgcggcagcagctgctggagcagcagcagccccagaaggccaccccccaggacagccaggagggcaccttcggcagcgagcacagcgccagccccagccagggcagcagccagcagcacttcctggagcctgaggtgaacctggatgacagcattgacatccagcagcaggacatggacattgatgagggccaggatggagtggaggaggaggtgtttgagcaggaggccaagaaggtggccgtgcgcagccgcagcaggacccacagccgcagccgcagccgcagccccaggaagaggaggagccgcagccgcagcggcagcaggaagaggaagcacaggaagaggagccgcagccgcagccgggagaggaagaggaagagcagccgcagctacagcagcgagcggcgggcccgggagcgggagaaggagcggcagaagaagggcctgccccccatccgcagcaagaccctgtctgtgtgcagcaccaccctgtgggtgggccaggtggacaagaaggccacccagcaggacctgaccaacctgtttgaggagtttggccagatcgagagcatcaacatgatccccccccggggctgtgcctacgtgtgcatggtgcaccggcaggatgccttccgggccctgcagaagctgagcagcggcagctacaagattggcagcaaggtgatcaagatcgcctgggccctgaacaagggcgtgaagacagagtacaagcagttctgggatgtggacctgggcgtgacctacatcccctgggagaaggtgaaggtggatgacctggagggctttgctgagggcggcatgattgaccaggagaccgtgaacacagagtgggagaccgtgaagagcagcgagcctgtgaaggagaccgtgcagaccacccagagccccacccctgtggagaaggagaccgtggtgaccacccaggccgaggtgtttcctcctcctgtggccatgctgcagatccctgtggccccagctgtgcccaccgtgtccctggtgcccccagccttccctgtgtccatgcctgtgcccccacctggcttcagccccatccccccaccacccttcctgcgggccagcttcaaccccagccagcccccacctggcttcatgcctcctcctgtgcccccacctgtggtgcccccacccaccatcccccctgtggtgcccaccagcctggtgcagcccagcctgtccatgaccccagagaccgtgaaggatgtgggcttcggcagcctggtgattcctgggggctctgtggccagcaacctggccaccagcgccctgcctgctggaaatgtgttcaatgcccccaccaagcaggccgagcctgaggagaaggtgccccacctgattgaccaccagatcagcagcggggagaacaccaggagcgtcatccccaatgacatcagcagcaatgctgccatcctgggcggccagcccccaaatgtgaccagcaacagcggcatcctgggcgtgcagaggcccaacgtgagcagcaacagcgagatcctgggcgtgcggcccagcaatgtgagcagcagcagcggcatcatcgccgcccagccccccaacatcctgaacaacagcggcatcctgggcatccagcccccatctgtgagcaacagcagcggcctgctgggcgtgctgccccccaacatccccaacaacagcggcctggtgggcgtgcagcccccaaatgtgcccaacaccccaggcctgctgggcacccagcccccagctggcccccagaacctgccccccctgagcatccccaaccagaggatgcccaccatgcccatgctggacatccggcccggcctcatcccccaggcccctggcccccgcttccccctcatccagcccggcatccccccccagaggggcatccccccacccagcgtgctggacagcgccctgcaccccccaccccggggccccttccccccaggggacatcttcagccagcctgagcggcccttcctggcccctggccggcagagcgtggacaacgtgaccaaccctgagaagaggatccccctgggcaatgacaacatccagcaggagggggaccgggactaccgcttcccccccatcgagacccgggagagcatcagccggcccccacctgtggatgtgagagatgtggtgggccggcccatcgacccccgggagggccctggccggccccccctggatggccgggaccacttcggccggccccctgtggacatccgggagaacctggtgcggcccggcatcgaccacctgggcagaagagaccacttcggcttcaaccctgagaagccctggggccacagaggagactttgatgagcgggagcaccgggtgctgcctgtgtatggaggccccaagggcctgcacgaggagcggggccgcttccgcagcggcaactacagatttgaccccaggagcggcccctggaacagaggatttggccaggaggtgcaccgggactttgatgacagaagaagaccctgggagcggcagagggacagagatgaccgggactttgacttctgccgggagatgaatggaaaccggctgggccgggaccgcatccagaacacctgggtgcccccaccccacgcccgggtgtttgactactttgaaggagccaccagccagaggaaaggagacaacgtgccccaggtgaatggagaaaatacagaaagacatgcccagcccccacccatccctgtgcagaatgaccctgagctgtatgagaagctgaccagcagcaatgagatcaacaaggagaagagtgacacagtggccgacattgaaagtgagcctgtggtggagagcacagaaacagagggcacctag

SEQ ID NO: 17032 - DNA, 4014 bp, Artificial Sequence
  Description of Artificial Sequence: Synthetic coding sequence
atgccccagcccctgctgcctgccctgccccccctgagcagccccagcggggccggcagctgtggccccagcggaggagaatgttctggaagaagactcttcagaagaagagcccggggcctgcggagtgacaacatggaggccgtgaagaccttcaacagcgaggactgtgccagcaccccagcctgcacagactgcttcagcagctccatggacaccaggagcatcctgtacagcctgaatgactacaagccacccatcagcaaggccaagatgacccagatcaccaaggccgccatcaaggccatcaagttctacaagcacgtggtgcagagcgtggagaagttcatccagaagtgcaagccagagtacaaggtgcccggcctgtatgtgattgacagcatcgtgcggcagagccgccaccagtttggccaggagaaggatgtgtttgccccccgcttcagcaacaacatcatcagcaccttccagaacctgtaccgctgccctggagatgacaagagcaagatcgtgcgggtgctgaacctgtggcagaagaacaacgtgttcaagtctgagatcatccagcccctgctggacatggccgccggcatccccccacctgtggtgacccctgtgctggccagcaccaccacagccatgagcaacaccccaggcacccctgtgacccctgtgaccccagccaacgtggtgcagggcctgcctgacccctgggtgtcccagatcaccaacacagacaccctggccgctgtggcccagatcctgcagagcccccagggccagcagctgcagcagctgatccagaccctgcagatccagcagcagaagccccagcccagcatcctgcaggccctggatgctggcctggtggtgcagctgcaggccctgacagcccagctgacagctgctgctgctgctgccaacaccctgacccccctggagcagggcgtgtccttcaacaagaagctgatggacagatttgattttggagaagattctgagcacagcgaggagcccaagaaggagatcccagccagccagctgagccacgtgtctgagagcgtgaacaacagcatcttccaccagattgctgagcagctgcagcagcagaacctggagcacctgcggcagcagctgctggagcagcagcagccccagaaggccaccccccaggacagccaggagggcaccttcggcagcgagcacagcgccagccccagccagggcagcagccagcagcacttcctggagcctgaggtgaacctggatgacagcattgacatccagcagcaggacatggacattgatgagggccaggatggagtggaggaggaggtgtttgagcaggaggccaagaaggtggccgtgcgcagccgcagcaggacccacagccgcagccgcagccgcagccccaggaagaggaggagccgcagccgcagcggcagcaggaagaggaagcacaggaagaggagccgcagccgcagccgggagaggaagaggaagagcagccgcagctacagcagcgagcggcgggcccgggagcgggagaaggagcggcagaagaagggcctgccccccatccgcagcaagaccctgtctgtgtgcagcaccaccctgtgggtgggccaggtggacaagaaggccacccagcaggacctgaccaacctgtttgaggagtttggccagatcgagagcatcaacatgatccccccccggggctgtgcctacgtgtgcatggtgcaccggcaggatgccttccgggccctgcagaagctgagcagcggcagctacaagattggcagcaaggtgatcaagatcgcctgggccctgaacaagggcgtgaagacagagtacaagcagttctgggatgtggacctgggcgtgacctacatcccctgggagaaggtgaaggtggatgacctggagggctttgctgagggcggcatgattgaccaggagaccgtgaacacagagtgggagaccgtgaagagcagcgagcctgtgaaggagaccgtgcagaccacccagagccccacccctgtggagaaggagaccgtggtgaccacccaggccgaggtgtttcctcctcctgtggccatgctgcagatccctgtggccccagctgtgcccaccgtgtccctggtgcccccagccttccctgtgtccatgcctgtgcccccacctggcttcagccccatccccccaccacccttcctgcgggccagcttcaaccccagccagcccccacctggcttcatgcctcctcctgtgcccccacctgtggtgcccccacccaccatcccccctgtggtgcccaccagcctggtgcagcccagcctgtccatgaccccagagaccgtgaaggatgtgggcttcggcagcctggtgattcctgggggctctgtggccagcaacctggccaccagcgccctgcctgctggaaatgtgttcaatgcccccaccaagcaggccgagcctgaggagaaggtgccccacctgattgaccaccagatcagcagcggggagaacaccaggagcgtcatccccaatgacatcagcagcaatgctgccatcctgggcggccagcccccaaatgtgaccagcaacagcggcatcctgggcgtgcagaggcccaacgtgagcagcaacagcgagatcctgggcgtgcggcccagcaatgtgagcagcagcagcggcatcatcgccgcccagccccccaacatcctgaacaacagcggcatcctgggcatccagcccccatctgtgagcaacagcagcggcctgctgggcgtgctgccccccaacatccccaacaacagcggcctggtgggcgtgcagcccccaaatgtgcccaacaccccaggcctgctgggcacccagcccccagctggcccccagaacctgccccccctgagcatccccaaccagaggatgcccaccatgcccatgctggacatccggcccggcctcatcccccaggcccctggcccccgcttccccctcatccagcccggcatccccccccagaggggcatccccccacccagcgtgctggacagcgccctgcaccccccaccccggggccccttccccccaggggacatcttcagccagcctgagcggcccttcctggcccctggccggcagagcgtggacaacgtgaccaaccctgagaagaggatccccctgggcaatgacaacatccagcaggagggggaccgggactaccgcttcccccccatcgagacccgggagagcatcagccggcccccacctgtggatgtgagagatgtggtgggccggcccatcgacccccgggagggccctggccggccccccctggatggccgggaccacttcggccggccccctgtggacatccgggagaacctggtgcggcccggcatcgaccacctgggcagaagagaccacttcggcttcaaccctgagaagccctggggccacagaggagactttgatgagcgggagcaccgggtgctgcctgtgtatggaggccccaagggcctgcacgaggagcggggccgcttccgcagcggcaactacagatttgaccccaggagcggcccctggaacagaggatttggccaggaggtgcaccgggactttgatgacagaagaagaccctgggagcggcagagggacagagatgaccgggactttgacttctgccgggagatgaatggaaaccggctgggccgggaccgcatccagaacacctgggtgcccccaccccacgcccgggtgtttgactactttgaaggagccaccagccagaggaaaggagacaacgtgccccaggtgaatggagaaaatacagaaagacatgcccagcccccacccatccctgtgcagaatgaccctgagctgtatgagaagctgaccagcagcaatgagatcaacaaggagaagagtgacacagtggccgacattgaaagtgagcctgtggtggagagcacagaaacagagggcacctag

SEQ ID NO: 17033 - DNA, 3816 bp, Artificial Sequence; identical to SEQ ID NO: 17031
  Description of Artificial Sequence: Synthetic coding sequence

SEQ ID NO: 17034 - DNA, 2262 bp, Artificial Sequence
  Description of Artificial Sequence: Synthetic coding sequence
atggagcgggcccggcctgagcccccaccccagccccggcccctgcggcctgcccccccacccctgcctgtggagggcaccagcttctgggccgccgccatggagcccccacccagcagccccaccctgtctgctgctgccagcgccaccctggccagcagctgtggggaggccgtggccagcggcctgcagcctgctgtgcggcggctgctgcaggtgaagccagagcaggtgctgctgctgccccagccccaggcccagaatgaggaggccgccgccagcagcgcccaggcccggctgctgcagttccggccagacctgcggctgctgcagcccccaacagccagtgatggagccaccagcaggcctgagctgcaccctgtgcagcccctggccctgcacgtgaaggccaagaagcagaagctgggccccagcctggaccagagcgtgggccccagaggagctgtggagaccggcccccgggccagccgggtggtgaagctggagggccctggccctgccctgggctacttcagaggagatgagaagggcaagctggaggccgaggaggtgatgagggacagcatgcagggcggggccggcaagagccctgctgccatccgggagggcgtcatcaagacagaggagcctgagcggctgctggaggactgccgcctgggcgctgagcccgccagcaatggcctggtgcacggcagcgctgaggtgatcctggcccccaccagcggggccttcggcccccaccagcaggacctgcgcatccccctgaccctgcacacagtgcccccaggggcccgcatccagttccagggcgcccctccttctgagctgatccggctgaccaaggtgcccctgacccctgtgcccaccaagatgcagagcctgctggagcccagcgtgaagattgagaccaaggatgtgcccctgactgtgctgcccagtgatgctggcatcccagacacccccttcagcaaggacagaaatggccacgtgaagaggcccatgaatgccttcatggtgtgggcccgcatccacaggcctgccctggccaaggccaacccagctgccaacaatgctgagatctctgtgcagctgggcctggagtggaacaagctgtctgaggagcagaagaagccctactatgatgaggcccagaagatcaaggagaagcaccgggaggagttccctggctgggtgtaccagcccaggcctgggaagaggaagcgcttccccctgtctgtgtccaatgtgttttctggcaccacccagaacatcatcagcaccaaccccaccaccgtgtacccctaccgcagccccacctacagcgtggtgatccccagcctgcagaaccccatcacccaccctgtgggggagaccagccctgccatccagctgcccaccccagctgtgcagagccccagccctgtgaccctcttccagcccagcgtgtcctctgctgcccaggtggccgtgcaggaccccagcctgcctgtgtacccagccctgcccccccagcgcttcaccggccccagccagacagacacccaccagctgcacagcgaggccacccacacagtgaagcagcccacccctgtgtccctggagagcgccaaccgcatcagcagcagcgccagcacagcccacgccaggtttgccaccagcaccatccagcccccccgggagtacagctctgtgagcccctgccccaggtctgcccccatcccccaggccagccccatcccccacccccacgtgtaccagcccccacccctgggccacccagccaccctgtttggcaccccaccccgcttctccttccaccacccctacttcctgcccggcccccactacttccccagcagcacctgcccctacagccggccccccttcggctacggcaacttccccagctccatgccagaatgtctgagctactatgaagatcgctaccccaagcatgagggcatcttcagcaccctgaacagagactacagcttccgggactacagcagcgagtgcacccacagcgagaacagccgcagctgtgagaacatgaatggcaccagctactacaacagccacagccacagcggggaggagaacctgaaccctgtgccccagctggacatcggcaccctggagaatgtgttcaccgcccccaccagcacccccagcagcatccagcaggtgaatgtgacagacagtgatgaggaggaggaggagaaggtgctgcgggacctgtag

SEQ ID NO: 17035 - DNA, 1506 bp, Artificial Sequence
  Description of Artificial Sequence: Synthetic coding sequence
atggagcgggcccggcctgagcccccaccccagccccggcccctgcggcctgcccccccacccctgcctgtggagggcaccagcttctgggccgccgccatggagcccccacccagcagccccaccctgtctgctgctgccagcgccaccctggccagcagctgtggggaggccgtggccagcggcctgcagcctgctgtgcggcggctgctgcaggtgaagccagagcaggtgctgctgctgccccagccccaggcccagaatgaggaggccgccgccagcagcgcccaggcccggctgctgcagttccggccagacctgcggctgctgcagcccccaacagccagtgatggagccaccagcaggcctgagctgcaccctgtgcagcccctggccctgcacgtgaaggccaagaagcagaagctgggccccagcctggaccagagcgtgggccccagaggagctgtggagaccggcccccgggccagccgggtggtgaagctggagggccctggccctgccctgggctacttcagaggagatgagaagggcaagctggaggccgaggaggtgatgagggacagcatgcagggcggggccggcaagagccctgctgccatccgggagggcgtcatcaagacagaggagcctgagcggctgctggaggactgccgcctgggcgctgagcccgccagcaatggcctggtgcacggcagcgctgaggtgatcctggcccccaccagcggggccttcggcccccaccagcaggacctgcgcatccccctgaccctgcacacagtgcccccaggggcccgcatccagttccagggcgcccctccttctgagctgatccggctgaccaaggtgcccctgacccctgtgcccaccaagatgcagagcctgctggagcccagcgtgaagattgagaccaaggatgtgcccctgactgtgctgcccagtgatgctggcatcccagacacccccttcagcaaggacagaaatggccacgtgaagaggcccatgaatgccttcatggtgtgggcccgcatccacaggcctgccctggccaaggccaacccagctgccaacaatgctgagatctctgtgcagctgggcctggagtggaacaagctgtctgaggagcagaagaagccctactatgatgaggcccagaagatcaaggagaagcaccgggaggagttccctggctgggtgtaccagcccaggcctgggaagaggaagcgcttccccctgtctgtgtccaatgtgttttctggcaccacccagaacatcatcagcaccaaccccaccaccgtgtacccctaccgcagccccacctacagcgtggtgatccccagcctgcagaaccccatcacccaccctgtggtgcacgccctgactgtgggcctgcccctggccatggagatcttccgggtgcagtgccagaatgccctggtgatcatgaagacaggcacccagaacatgagggtgtccttccagctgtag

SEQ ID NO: 17036 - DNA, 585 bp, Artificial Sequence
  Description of Artificial Sequence: Synthetic coding sequence
atgcccagcagccccctgcgggtggccgtggtgtgcagcagcaaccagaacagatccatggaggcccacaacatcctgagcaagaggggcttctctgtgcgcagctttggcaccggcacccacgtgaagctgcccggccctgccccagacaagcccaacgtgtatgacttcaagaccacctatgaccagatgtacaatgacctgctgaggaaggacaaggagctgtacacccagaatggcatcctgcacatgctggacaggaacaagaggatcaagcccaggcctgagcgcttccagaactgcaaggacctgtttgacctgatcctgacctgtgaggagcgggtgtatgaccaggtggtggaggacctgaacagccgggagcaggagacctgccagcctgtgcacgtggtgaatgtggacatccaggacaaccacgaggaggccaccctgggcgccttcctgatctgtgagctgtgccagtgcatccagcacacagaggacatggagaatgaaattgatgagctgctgcaggagtttgaggagaagagcggccgcaccttcctgcacacagtgtgcttctactag

SEQ ID NO: 17037 - DNA, 462 bp, Artificial Sequence
  Description of Artificial Sequence: Synthetic coding sequence
atgcccagcagccccctgcgggtggccgtggtgtgcagcagcaaccagaacagatccatggaggcccacaacatcctgagcaagaggggcttctctgtgcgcagctttggcaccggcacccacgtgaagctgcccggccctgccccagacaagcccaacgtgtatgacttcaagaccacctatgaccagatgtacaatgacctgctgaggaaggacaaggagctgtaccccagcggcctgcccttcaagaaccccccctgtggccccccctggaaggtgctgcgggtggcccgggcccaggaggcctgccaccctgtgcagtgcacccactggctgctgtgcctgtgtgagagcctggtgtccatccctggggcccggcgcatcgtgcacggcctggtgcctgtgccccccatggctgtgggcgtggtgcggaggacagacacagtgtggggcagcccctag

SEQ ID NO: 17038 - DNA, 489 bp, Artificial Sequence
  Description of Artificial Sequence: Synthetic coding sequence
atgcccagcagccccctgcgggtggccgtggtgtgcagcagcaaccagaacagatccatggaggcccacaacatcctgagcaagaggggcttctctgtgcgcagctttggcaccggcacccacgtgaagctgcccggccctgccccagacaagcccaacgtgtatgacttcaagaccacctatgaccagatgtacaatgacctgctgaggaaggacaaggagctgtacacccagaatggcatcctgcacatgctggacaggaacaagaggatcaagcccaggcctgagcgcttccagaactgcaaggacctgtttgacctgatcctgacctgtgaggagcgggtgtatgaccaggtggtggagggggaggaggccgccgcctgctgggccggcctgcagcagctgagccagggcctgggcatgcctgctggcccccaccacgaccagtacagccccagccgggtggccggggccggggagcagacctag

SEQ ID NO: 17039 - DNA, 336 bp, Artificial Sequence
  Description of Artificial Sequence: Synthetic coding sequence
atgctggacaggaacaagaggatcaagcccaggcctgagcgcttccagaactgcaaggacctgtttgacctgatcctgacctgtgaggagcgggtgtatgaccaggtggtggaggacctgaacagccgggagcaggagacctgccagcctgtgcacgtggtgaatgtggacatccaggacaaccacgaggaggccaccctgggcgccttcctgatctgtgagctgtgccagtgcatccagcacacagaggacatggagaatgaaattgatgagctgctgcaggagtttgaggagaagagcggccgcaccttcctgcacacagtgtgcttctactag

SEQ ID NO: 17040 - DNA, 609 bp, Artificial Sequence
  Description of Artificial Sequence: Synthetic coding sequence
atgttcacagagctgcggagcaagctgagccccccccggggccgggccggggctgtgcgggccggctttggagagaggagagatgtggatgccacagcccacttctccttctgcaggaccctgctggagcacacagtgtctgctgagagcatcccctgccacctgcccaggaccccaggcaccagcctgacctggcatgacagccgcagccagagagctgccagcagccggcccatcaagctgctgcagcagcctggaacagacaccccccagggccgcctgtacagcgaccactacggcctgtaccacaccagccccagcctgggcggcctgaccaggcctgtggtgctgtggagccagcaggatgtgtgcaagtggctgaagaagcactgcccccacaactacctggtgtatgtggaggccttcagccagcacgccatcaccggccgggccctgctgcggctgaatgctgagaagctgcagaggatgggcctggcccaggaggcccagaggcaggaggtgctgcagcaggtgctgcggctgcaggtgcgggaggagggccgcagcctgcagctgctgagccaggccagctttgggaagatgtcctag

SEQ ID NO: 17041 - DNA, 321 bp, Artificial Sequence
  Description of Artificial Sequence: Synthetic coding sequence
atgttcacagagctgcggagcaagctgagccccccccggggccgggccggggctgtgcgggccggctttggagagaggagagatgtggatggctctgtgcacctgcagatcccctaccgggccttcatccacagcttcatcgacaatgaatgtggggtgcccctgtgcaaccagacctggatcaagaccccagccagcccagattctgccacagcccacttctccttctgcaggaccctgctggagcacacagtgtctgctgagagcatcccctgccacctgcccaggaccccaggcaccagcctgacctggcatgactag

SEQ ID NO: 17042 - DNA, 2046 bp, Artificial Sequence
  Description of Artificial Sequence: Synthetic coding sequence
atgagcaagggcatcctgcaggtgcacccccccatctgtgactgccccggctgccgcatcagcagccctgtgaacagaggccgcctggccgacaagaggacagtggccctgcctgctgccaggaacctgaagaaggagaggacccccagcttcagcgccagtgatggagacagtgatggcagcggccccacctgtggcagaagacctggcctgaagcaggaggatggcccccacatccgcatcatgaagagaagagtgcacacccactgggatgtgaacatctccttccgggaggccagctgcagccaggacggcaacctgcccaccctcatcagctctgtgcacaggagccgccacctggtgatgcctgagcaccagagccgctgtgagttccagaggggcagcctggagatcggcctgcggcctgctggggacctgctgggcaagaggctgggccgcagcccccgcatcagcagtgactgcttcagcgagaagagggcccggtctgagagcccccaggaggccctgctgctgccccgggagctgggccccagcatggcccctgaggaccactacagaaggctggtgtctgccctgtctgaggccagcacctttgaggacccccagaggctgtaccacctgggcctgcccagccatggagaagatcctccctggcatgaccccccccaccacctgcccagccatgacctgctgcgggtgcggcaggaggtggccgctgctgccctgcggggccccagcggcctggaggcccacctgcccagcagcacagctggccagaggaggaagcagggcctggcccagcaccgggagggcgccgccccagctgctgcccccagcttcagcgagcgggagctgccccagcccccacccctgctgagcccccagaatgccccccacgtggccctgggcccccacctgcggccccccttcctgggcgtgcccagcgccctgtgccagaccccaggctacggcttcctgcccccagcccaggccgagatgtttgcctggcagcaggagctgctgaggaagcagaacctggcccggctggagctgcctgctgacctgctgcggcagaaggagctggagagcgcccggccccagctgctggcccctgagacagccctgcggcccaatgatggagctgaggagctgcagaggagaggagccctgctggtgctgaaccacggggccgcccccctgctggccctgcccccccagggccccccaggcagcggcccccccacccccagccgggacagcgcccggcgggcccccaggaagggcggccctggccctgccagcgcccggcccagcgagagcaaggagatgactggagcccggctgtgggcccaggacggctctgaagatgagccccccaaggacagtgatggagaggaccctgagacagctgctgtgggctgccggggccccaccccaggccaggccccagctggaggagctggagctgagggcaagggcctcttccctggcagcaccctgcccctgggcttcccctatgctgtgagcccctacttccacactggagctgtgggcggcctgtccatggatggagaggaggccccagccccagaagatgtgaccaagtggacagtggatgatgtgtgcagctttgtgggcggcctgagcggctgtggggagtacaccagggtcttccgggagcagggcattgatggagagaccctgcccctgctgacagaggagcacctgctgaccaacatgggcctgaagctgggccctgccctgaagatccgggcccaggtggcccggcggctgggccgggtcttctacgtggccagcttccctgtggccctgcccctgcagccccccaccctgcgggcccctgagcgggagctgggcaccggggagcagcccctgagccccaccacagccaccagcccctacggcggcggccacgccctggccggccagaccagccccaagcaggagaatggcaccctggccctgctgcccggggccccagaccccagccagcccctgtgctag

SEQ ID NO: 17043 - DNA, 540 bp, Artificial Sequence
  Description of Artificial Sequence: Synthetic coding sequence
atgagcaagggcatcctgcaggtgcacccccccatctgtgactgccccggctgccgcatcagcagccctgtgaacagaggccgcctggccgacaagaggacagtggccctgcctgctgccaggaacctgaagaaggagaggacccccagcttcagcgccagtgatggagacagtgatggcagcggccccacctgtggcagaagacctggcctgaagcaggaggatggcccccacatccgcatcatgaagagaagagtgcacacccactgggatgtgaacatctccttccgggaggccagctgcagccaggacggcaacctgcccaccctcatcagctctgtgcacaggagccgccacctggtgatgcctgagcaccagagccgctgtgagttccagaggggcagcctggagatcggcctgcggcctgctggggacctgctgggcaagaggctgggccgcagcccccgcatcagcagtgactgcttcagcgagaagagggcccggtctgagagcccccaggaggccctgctgctgccctag

SEQ ID NO: 17044 - DNA, 330 bp, Artificial Sequence
  Description of Artificial Sequence: Synthetic coding sequence
atgagcaagggcatcctgcaggtgcacccccccatctgtgactgccccggctgccgcatcagcagccctgtgaacagaggccgcctggccgacaagaggacagtggccctgcctgctgccaggaacctgaagaaggagaggacccccagcttcagcgccagtgatggagacagtgatggcagcggccccacctgtggcagaagacctggcctgaagcaggaggatggcccccacatccgcatcatgaagagaagagtgcacacccactgggatgtgaacatctccttccgggaggccagctgcagccaggacggcaacctgcccacctag

SEQ ID NO: 17045 - DNA, 606 bp, Artificial Sequence
  Description of Artificial Sequence: Synthetic coding sequence
atggctgtggaggccctgcactgcggcctgaacccccggggcatcgaccacccagcccatgctgagggcatcaagctgcagatcgagggggagggcgtggagagccagagcatcaagaacaagaacttccagaaggtgcctgaccagaagggcacccccaagaggctgcaggccgaggccgagacagccaagagcgccaccgtgaagctgagcaagcctgtggccctgtggacccagcaggatgtgtgcaagtggctgaagaagcactgccccaaccagtaccagatctacagcgagagcttcaagcagcacgacatcaccggccgggccctgctgcggctgacagacaagaagctggagaggatgggcatcgcccaggagaacctgcggcagcacatcctgcagcaggtgctgcagctgaaggtgcgggaggaggtgaggaacctgcagctgctgacccagggcaccctgctgctgcctgatggctggatggatggagagatccggaggaagaccaccctgctgctgggccagacaggagtgcgggagaacctgctgctcttcctgcaccgcatcagcatcatcgagaacagcatccagatctag

SEQ ID NO: 17046 - DNA, 486 bp, Artificial Sequence
  Description of Artificial Sequence: Synthetic coding sequence
atggctgtggaggccctgcactgcggcctgaacccccggggcatcgaccacccagcccatgctgagggcatcaagctgcagatcgagggggagggcgtggagagccagagcatcaagaacaagaacttccagaaggtgcctgaccagaagggcacccccaagaggctgcaggccgaggccgagacagccaagagcgccaccgtgaagctgagcaagcctgtggccctgtggacccagcaggatgtgtgcaagtggctgaagaagcactgccccaaccagtaccagatctacagcgagagcttcaagcagcacgacatcaccggccgggccctgctgcggctgacagacaagaagctggagaggatgggcatcgcccaggagaacctgcggcagcacatcctgcagcaggtgctgcagctgaaggtgcgggaggaggtgaggaacctgcagctgctgacccaggccagcagcgagggcagcccctag

SEQ ID NO: 17047 - DNA, 279 bp, Artificial Sequence
  Description of Artificial Sequence: Synthetic coding sequence
atgaggagctgcctgatgcctggaaatgagatgtccatgaccagccctgagggcacagagcccaagggcaagcagaggcgctggcagaggcagaagaccttcggcggcggcaccatgcacagccaggacagccaggagattgatggcaagagcctgctgctgatgaccagaaatgatgtgctgaccggcctgcagctgaagctgggccctgccctgaagatctatgagtaccacgtgaagcccctgcagaccaagcacctgaagaacaacagcagctag

SEQ ID NO: 17048 - DNA, 309 bp, Artificial Sequence
  Description of Artificial Sequence: Synthetic coding sequence
atgctgtctgtggacatggagaacaaggaaaatggatctgtgggcgtgaagaacagcatggagaatggccggcccccagaccctgctgactgggccgtgatggatgtggtgaactacttcagaacagtgggctttgaggagcaggccagcgccttccaggagcaggagattgatggcaagagcctgctgctgatgaccagaaatgatgtgctgaccggcctgcagctgaagctgggccctgccctgaagatctatgagtaccacgtgaagcccctgcagaccaagcacctgaagaacaacagcagctag

SEQ ID NO: 17049 - DNA, 309 bp, Artificial Sequence; identical to SEQ ID NO: 17048
  Description of Artificial Sequence: Synthetic coding sequence

SEQ ID NO: 17050 - DNA, 309 bp, Artificial Sequence; identical to SEQ ID NO: 17048
  Description of Artificial Sequence: Synthetic coding sequence

SEQ ID NO: 17051 - DNA, 369 bp, Artificial Sequence
  Description of Artificial Sequence: Synthetic coding sequence
atggccaacagcctgctggagggcgtgtttgctgaggtgaaggagccctgcagcctgcccatgctgtctgtggacatggagaacaaggaaaatggatctgtgggcgtgaagaacagcatggagaatggccggcccccagaccctgctgactgggccgtgatggatgtggtgaactacttcagaacagtgggctttgaggagcaggccagcgccttccaggagcaggagattgatggcaagagcctgctgctgatgaccagaaatgatgtgctgaccggcctgcagctgaagctgggccctgccctgaagatctatgagtaccacgtgaagcccctgcagaccaagcacctgaagaacaacagcagctag

SEQ ID NO: 17052 - DNA, 351 bp, Artificial Sequence
  Description of Artificial Sequence: Synthetic coding sequence
atgagaggagtggccgaggtgaaggagccctgcagcctgcccatgctgtctgtggacatggagaacaaggaaaatggatctgtgggcgtgaagaacagcatggagaatggccggcccccagaccctgctgactgggccgtgatggatgtggtgaactacttcagaacagtgggctttgaggagcaggccagcgccttccaggagcaggagattgatggcaagagcctgctgctgatgaccagaaatgatgtgctgaccggcctgcagctgaagctgggccctgccctgaagatctatgagtaccacgtgaagcccctgcagaccaagcacctgaagaacaacagcagctag

SEQ ID NO: 17053 - DNA, 309 bp, Artificial Sequence; identical to SEQ ID NO: 17048
  Description of Artificial Sequence: Synthetic coding sequence

SEQ ID NO: 17054 - DNA, 3666 bp, Artificial Sequence
  Description of Artificial Sequence: Synthetic coding sequence
atgatcaccagcgagctgcctgtgctgcaggacagcaccaatgagaccacagcccacagtgatgctggcagcgagctggaggagacagaggtgaagggcaagaggaagaggggccggcccggccggccccccagcaccaacaagaagcccaggaagagccctggagagaagagccgcatcgaggccggcatcagaggagctggccggggccgggccaacggccacccccagcagaatggagagggggagcctgtgaccctgtttgaggtggtgaagctgggcaagagcgccatgcagagcgtggtggatgactggattgagagctacaagcaggaccgggacatcgccctgctggacctgatcaacttcttcatccagtgcagcggctgccggggcaccgtgcgcatcgagatgttcaggaacatgcagaatgctgagatcatcaggaagatgacagaggagtttgatgaagattctggggactaccccctgaccatgcctggcccccagtggaagaagttccgcagcaacttctgtgagttcatcggcgtgctgatccggcagtgccagtacagcatcatctatgatgagtacatgatggacaccgtcatcagcctgctgaccggcctgagtgacagccaggtgcgggccttccgccacaccagcaccctggccgccatgaagctgatgacagccctggtgaatgtggccctgaacctgagcatccaccaggacaacacccagaggcagtatgaagctgagaggaacaagatgattggcaagagggccaatgaaaggctggagctgctgctgcagaagaggaaggagctgcaggagaaccaggatgaaattgagaacatgatgaacagcatcttcaagggcatctttgtgcaccgctacagagatgccatcgccgagatccgggccatctgcatcgaggagattggagtgtggatgaagatgtacagtgatgccttcctgaatgacagctacctgaagtatgtgggctggaccctgcatgaccggcagggcgaggtgcggctgaagtgcctgaaggccctgcagagcctgtacaccaaccgggagctgttccccaagctggagctgttcaccaaccgcttcaaggaccgcatcgtgtccatgaccctggacaaggagtatgatgtggccgtggaggccatccggctggtgaccctcatcctgcacggcagcgaggaggccctgagcaatgaagactgtgaaaatgtgtaccacctggtgtacagcgcccacaggcctgtggccgtggccgccggggagttcctgcacaagaagctgttcagcagacatgacccccaggccgaggaggccctggccaagaggcggggcaggaacagccccaatggaaacctgatccgcatgctggtgctcttcttcctggagagcgagctgcacgagcacgccgcctacctggtggacagcctgtgggagagcagccaggagctgctgaaggactgggagtgcatgacagagctgctgctggaggagcctgtgcagggcgaggaggccatgtctgaccggcaggagagcgccctgattgagctgatggtgtgcaccatccggcaggccgctgaggcccacccccctgtgggccggggcaccgggaagagggtgctgacagccaaggagaggaagacccagattgatgacaggaacaagctgacagagcacttcatcatcaccctgcccatgctgctgagcaagtacagcgcagatgctgagaaggtggccaacctgctgcagatcccccagtactttgacctggagatctacagcacaggccgcatggagaagcacctggatgccctgctgaagcagatcaagtttgtggtggagaagcacgtggagagtgatgtgctggaggcctgcagcaagacctacagcatcctgtgcagcgaggagtacaccatccagaacagagtggacatcgcccggagccagctgattgatgaatttgtggaccgcttcaaccacagcgtggaggacctgctgcaggagggggaggaggctgatgatgatgacatctacaacgtgctgagcaccctgaagaggctgaccagcttccacaatgcccatgacctgaccaagtgggacctgtttggaaactgctaccgcctgctgaagacaggcatcgagcacggggccatgcctgagcagatcgtggtgcaggccctgcagtgcagccactacagcatcctgtggcagctggtgaagatcacagatggcagccccagcaaggaggacctgctggtgctgaggaagacagtgaagagcttcctggccgtgtgccagcagtgcctgagcaatgtgaacacccctgtgaaggagcaggccttcatgctgctgtgtgacctgctgatgatcttcagccaccagctgatgactggaggccgggagggcctgcagcccctggtgttcaacccagacaccggcctgcagagcgagctgctgagctttgtgatggaccacgtgttcatcgaccaggatgaggagaaccagagcatggagggagatgaagaagatgaggccaacaagattgaggccctgcacaagagaagaaacctgctggccgccttcagcaagctgatcatctatgacatcgtggacatgcatgctgctgctgacatcttcaagcactacatgaagtactacaatgactatggagacatcatcaaggagaccctgagcaagacccggcagattgacaagatccagtgtgccaagaccctcatcctgagcctgcagcagctgttcaatgagctggtgcaggagcagggccccaacctggacaggaccagcgcccacgtgtctggcatcaaggagctggccaggagatttgccctgaccttcggcctggaccagatcaagacccgggaggccgtggccaccctgcacaaggatggcatcgagtttgccttcaagtaccagaaccagaagggccaggagtaccccccacccaacctggccttcctggaggtgctgtctgagttcagcagcaagctgctgcggcaggacaagaagacagtgcacagctacctggagaagttcctgacagagcagatgatggagaggagagaagatgtgtggctgcccctcatctcctacagaaacagcctggtgactggaggagaagatgacaggatgtctgtgaacagcggcagcagcagcagcaagaccagctctgtgaggaacaagaagggccggccccccctgcacaagaagagggtggaggatgagagcctggacaacacctggctgaacagaacagacaccatgatccagaccccaggccccctgcctgccccccagctgaccagcacagtgctgcgggagaacagccggcccatgggagaccagatccaggagcctgagagcgagcacggcagcgagccagacttcctgcacaacagaggcctgatggaggaggatgctgagcccatctttgaagatgtgatgatgagcagccgcagccagctggaggacatgaatgaggagtttgaggacaccatggtgattgacctgccccccagcaggaacagaagagaaagagctgagctgcggccagacttctttgacagcgctgccatcattgaagatgacagcggcttcggcatgcccatgttttag

SEQ ID NO: 17055 - DNA, 3777 bp, Artificial Sequence
  Description of Artificial Sequence: Synthetic coding sequence
atgatcaccagcgagctgcctgtgctgcaggacagcaccaatgagaccacagcccacagtgatgctggcagcgagctggaggagacagaggtgaagggcaagaggaagaggggccggcccggccggccccccagcaccaacaagaagcccaggaagagccctggagagaagagccgcatcgaggccggcatcagaggagctggccggggccgggccaacggccacccccagcagaatggagagggggagcctgtgaccctgtttgaggtggtgaagctgggcaagagcgccatgcagagcgtggtggatgactggattgagagctacaagcaggaccgggacatcgccctgctggacctgatcaacttcttcatccagtgcagcggctgccggggcaccgtgcgcatcgagatgttcaggaacatgcagaatgctgagatcatcaggaagatgacagaggagtttgatgaagattctggggactaccccctgaccatgcctggcccccagtggaagaagttccgcagcaacttctgtgagttcatcggcgtgctgatccggcagtgccagtacagcatcatctatgatgagtacatgatggacaccgtcatcagcctgctgaccggcctgagtgacagccaggtgcgggccttccgccacaccagcaccctggccgccatgaagctgatgacagccctggtgaatgtggccctgaacctgagcatccaccaggacaacacccagaggcagtatgaagctgagaggaacaagatgattggcaagagggccaatgaaaggctggagctgctgctgcagaagaggaaggagctgcaggagaaccaggatgaaattgagaacatgatgaacagcatcttcaagggcatctttgtgcaccgctacagagatgccatcgccgagatccgggccatctgcatcgaggagattggagtgtggatgaagatgtacagtgatgccttcctgaatgacagctacctgaagtatgtgggctggaccctgcatgaccggcagggcgaggtgcggctgaagtgcctgaaggccctgcagagcctgtacaccaaccgggagctgttccccaagctggagctgttcaccaaccgcttcaaggaccgcatcgtgtccatgaccctggacaaggagtatgatgtggccgtggaggccatccggctggtgaccctcatcctgcacggcagcgaggaggccctgagcaatgaagactgtgaaaatgtgtaccacctggtgtacagcgcccacaggcctgtggccgtggccgccggggagttcctgcacaagaagctgttcagcagacatgacccccaggccgaggaggccctggccaagaggcggggcaggaacagccccaatggaaacctgatccgcatgctggtgctcttcttcctggagagcgagctgcacgagcacgccgcctacctggtggacagcctgtgggagagcagccaggagctgctgaaggactgggagtgcatgacagagctgctgctggaggagcctgtgcagggcgaggaggccatgtctgaccggcaggagagcgccctgattgagctgatggtgtgcaccatccggcaggccgctgaggcccacccccctgtgggccggggcaccgggaagagggtgctgacagccaaggagaggaagacccagattgatgacaggaacaagctgacagagcacttcatcatcaccctgcccatgctgctgagcaagtacagcgcagatgctgagaaggtggccaacctgctgcagatcccccagtactttgacctggagatctacagcacaggccgcatggagaagcacctggatgccctgctgaagcagatcaagtttgtggtggagaagcacgtggagagtgatgtgctggaggcctgcagcaagacctacagcatcctgtgcagcgaggagtacaccatccagaacagagtggacatcgcccggagccagctgattgatgaatttgtggaccgcttcaaccacagcgtggaggacctgctgcaggagggggaggaggctgatgatgatgacatctacaacgtgctgagcaccctgaagaggctgaccagcttccacaatgcccatgacctgaccaagtgggacctgtttggaaactgctaccgcctgctgaagacaggcatcgagcacggggccatgcctgagcagatcgtggtgcaggccctgcagtgcagccactacagcatcctgtggcagctggtgaagatcacagatggcagccccagcaaggaggacctgctggtgctgaggaagacagtgaagagcttcctggccgtgtgccagcagtgcctgagcaatgtgaacacccctgtgaaggagcaggccttcatgctgctgtgtgacctgctgatgatcttcagccaccagctgatgactggaggccgggagggcctgcagcccctggtgttcaacccagacaccggcctgcagagcgagctgctgagctttgtgatggaccacgtgttcatcgaccaggatgaggagaaccagagcatggagggagatgaagaagatgaggccaacaagattgaggccctgcacaagagaagaaacctgctggccgccttcagcaagctgatcatctatgacatcgtggacatgcatgctgctgctgacatcttcaagcactacatgaagtactacaatgactatggagacatcatcaaggagaccctgagcaagacccggcagattgacaagatccagtgtgccaagaccctcatcctgagcctgcagcagctgttcaatgagctggtgcaggagcagggccccaacctggacaggaccagcgcccacgtgtctggcatcaaggagctggccaggagatttgccctgaccttcggcctggaccagatcaagacccgggaggccgtggccaccctgcacaaggatggcatcgagtttgccttcaagtaccagaaccagaagggccaggagtaccccccacccaacctggccttcctggaggtgctgtctgagttcagcagcaagctgctgcggcaggacaagaagacagtgcacagctacctggagaagttcctgacagagcagatgatggagaggagagaagatgtgtggctgcccctcatctcctacagaaacagcctggtgactggaggagaagatgacaggatgtctgtgaacagcggcagcagcagcagcaagaccagctctgtgaggaacaagaagggccggccccccctgcacaagaagagggtggaggatgagagcctggacaacacctggctgaacagaacagacaccatgatccagaccccaggccccctgcctgccccccagctgaccagcacagtgctgcgggagaacagccggcccatgggagaccagatccaggagcctgagagcgagcacggcagcgagccagacttcctgcacaacccccagatgcagatctcctggctgggccagcccaagctggaggacctgaacaggaaggacagaacaggcatgaactacatgaaggtgaggactggagtgagacatgctgtgcggggcctgatggaggaggatgctgagcccatctttgaagatgtgatgatgagcagccgcagccagctggaggacatgaatgaggagtttgaggacaccatggtgattgacctgccccccagcaggaacagaagagagcgggcagagctgcggccagacttctttgattctgctgccatcattgaagatgattctggcttcggcatgcccatgttttag

SEQ ID NO: 17056 - DNA, 2997 bp, Artificial Sequence
  Description of Artificial Sequence: Synthetic coding sequence
atgaagctgatgacagccctggtgaatgtggccctgaacctgagcatccaccaggacaacacccagaggcagtatgaagctgagaggaacaagatgattggcaagagggccaatgaaaggctggagctgctgctgcagaagaggaaggagctgcaggagaaccaggatgaaattgagaacatgatgaacagcatcttcaagggcatctttgtgcaccgctacagagatgccatcgccgagatccgggccatctgcatcgaggagattggagtgtggatgaagatgtacagtgatgccttcctgaatgacagctacctgaagtatgtgggctggaccctgcatgaccggcagggcgaggtgcggctgaagtgcctgaaggccctgcagagcctgtacaccaaccgggagctgttccccaagctggagctgttcaccaaccgcttcaaggaccgcatcgtgtccatgaccctggacaaggagtatgatgtggccgtggaggccatccggctggtgaccctcatcctgcacggcagcgaggaggccctgagcaatgaagactgtgaaaatgtgtaccacctggtgtacagcgcccacaggcctgtggccgtggccgccggggagttcctgcacaagaagctgttcagcagacatgacccccaggccgaggaggccctggccaagaggcggggcaggaacagccccaatggaaacctgatccgcatgctggtgctcttcttcctggagagcgagctgcacgagcacgccgcctacctggtggacagcctgtgggagagcagccaggagctgctgaaggactgggagtgcatgacagagctgctgctggaggagcctgtgcagggcgaggaggccatgtctgaccggcaggagagcgccctgattgagctgatggtgtgcaccatccggcaggccgctgaggcccacccccctgtgggccggggcaccgggaagagggtgctgacagccaaggagaggaagacccagattgatgacaggaacaagctgacagagcacttcatcatcaccctgcccatgctgctgagcaagtacagcgcagatgctgagaaggtggccaacctgctgcagatcccccagtactttgacctggagatctacagcacaggccgcatggagaagcacctggatgccctgctgaagcagatcaagtttgtggtggagaagcacgtggagagtgatgtgctggaggcctgcagcaagacctacagcatcctgtgcagcgaggagtacaccatccagaacagagtggacatcgcccggagccagctgattgatgaatttgtggaccgcttcaaccacagcgtggaggacctgctgcaggagggggaggaggctgatgatgatgacatctacaacgtgctgagcaccctgaagaggctgaccagcttccacaatgcccatgacctgaccaagtgggacctgtttggaaactgctaccgcctgctgaagacaggcatcgagcacggggccatgcctgagcagatcgtggtgcaggccctgcagtgcagccactacagcatcctgtggcagctggtgaagatcacagatggcagccccagcaaggaggacctgctggtgctgaggaagacagtgaagagcttcctggccgtgtgccagcagtgcctgagcaatgtgaacacccctgtgaaggagcaggccttcatgctgctgtgtgacctgctgatgatcttcagccaccagctgatgactggaggccgggagggcctgcagcccctggtgttcaacccagacaccggcctgcagagcgagctgctgagctttgtgatggaccacgtgttcatcgaccaggatgaggagaaccagagcatggagggagatgaagaagatgaggccaacaagattgaggccctgcacaagagaagaaacctgctggccgccttcagcaagctgatcatctatgacatcgtggacatgcatgctgctgctgacatcttcaagcactacatgaagctgttcaatgagctggtgcaggagcagggccccaacctggacaggaccagcgcccacgtgtctggcatcaaggagctggccaggagatttgccctgaccttcggcctggaccagatcaagacccgggaggccgtggccaccctgcacaaggatggcatcgagtttgccttcaagtaccagaaccagaagggccaggagtaccccccacccaacctggccttcctggaggtgctgtctgagttcagcagcaagctgctgcggcaggacaagaagacagtgcacagctacctggagaagttcctgacagagcagatgatggagaggagagaagatgtgtggctgcccctcatctcctacagaaacagcctggtgactggaggagaagatgacaggatgtctgtgaacagcggcagcagcagcagcaagaccagctctgtgaggaacaagaagggccggccccccctgcacaagaagagggtggaggatgagagcctggacaacacctggctgaacagaacagacaccatgatccagaccccaggccccctgcctgccccccagctgaccagcacagtgctgcgggagaacagccggcccatgggagaccagatccaggagcctgagagcgagcacggcagcgagccagacttcctgcacaacccccagatgcagatctcctggctgggccagcccaagctggaggacctgaacaggaaggacagaacaggcatgaactacatgaaggtgaggactggagtgagacatgctgtgcggggcctgatggaggaggatgctgagcccatctttgaagatgtgatgatgagcagccgcagccagctggaggacatgaatgaggagtttgaggacaccatggtgattgacctgccccccagcaggaacagaagagagcgggcagagctgcggccagacttctttgattctgctgccatcattgaagatgattctggcttcggcatgcccatgttttag

SEQ ID NO: 17057 - DNA, 2529 bp, Artificial Sequence
  Description of Artificial Sequence: Synthetic coding sequence
atgaccctggacaaggagtatgatgtggccgtggaggccatccggctggtgaccctcatcctgcagctgttcagcagacatgacccccaggccgaggaggccctggccaagaggcggggcaggaacagccccaatggaaacctgatccgcatgctggtgctcttcttcctggagagcgagctgcacgagcacgccgcctacctggtggacagcctgtgggagagcagccaggagctgctgaaggactgggagtgcatgacagagctgctgctggaggagcctgtgcagggcgaggaggccatgtctgaccggcaggagagcgccctgattgagctgatggtgtgcaccatccggcaggccgctgaggcccacccccctgtgggccggggcaccgggaagagggtgctgacagccaaggagaggaagacccagattgatgacaggaacaagctgacagagcacttcatcatcaccctgcccatgctgctgagcaagtacagcgcagatgctgagaaggtggccaacctgctgcagatcccccagtactttgacctggagatctacagcacaggccgcatggagaagcacctggatgccctgctgaagcagatcaagtttgtggtggagaagcacgtggagagtgatgtgctggaggcctgcagcaagacctacagcatcctgtgcagcgaggagtacaccatccagaacagagtggacatcgcccggagccagctgattgatgaatttgtggaccgcttcaaccacagcgtggaggacctgctgcaggagggggaggaggctgatgatgatgacatctacaacgtgctgagcaccctgaagaggctgaccagcttccacaatgcccatgacctgaccaagtgggacctgtttggaaactgctaccgcctgctgaagacaggcatcgagcacggggccatgcctgagcagatcgtggtgcaggccctgcagtgcagccactacagcatcctgtggcagctggtgaagatcacagatggcagccccagcaaggaggacctgctggtgctgaggaagacagtgaagagcttcctggccgtgtgccagcagtgcctgagcaatgtgaacacccctgtgaaggagcaggccttcatgctgctgtgtgacctgctgatgatcttcagccaccagctgatgactggaggccgggagggcctgcagcccctggtgttcaacccagacaccggcctgcagagcgagctgctgagctttgtgatggaccacgtgttcatcgaccaggatgaggagaaccagagcatggagggagatgaagaagatgaggccaacaagattgaggccctgcacaagagaagaaacctgctggccgccttcagcaagctgatcatctatgacatcgtggacatgcatgctgctgctgacatcttcaagcactacatgaagtactacaatgactatggagacatcatcaaggagaccctgagcaagacccggcagattgacaagatccagtgtgccaagaccctcatcctgagcctgcagcagctgttcaatgagctggtgcaggagcagggccccaacctggacaggaccagcgcccacgtgtctggcatcaaggagctggccaggagatttgccctgaccttcggcctggaccagatcaagacccgggaggccgtggccaccctgcacaaggatggcatcgagtttgccttcaagtaccagaaccagaagggccaggagtaccccccacccaacctggccttcctggaggtgctgtctgagttcagcagcaagctgctgcggcaggacaagaagacagtgcacagctacctggagaagttcctgacagagcagatgatggagaggagagaagatgtgtggctgcccctcatctcctacagaaacagcctggtgactggaggagaagatgacaggatgtctgtgaacagcggcagcagcagcagcaagaccagctctgtgaggaacaagaagggccggccccccctgcacaagaagagggtggaggatgagagcctggacaacacctggctgaacagaacagacaccatgatccagaccccaggccccctgcctgccccccagctgaccagcacagtgctgcgggagaacagccggcccatgggagaccagatccaggagcctgagagcgagcacggcagcgagccagacttcctgcacaacccccagatgcagatctcctggctgggccagcccaagctggaggacctgaacaggaaggacagaacaggcatgaactacatgaaggtgaggactggagtgagacatgctgtgcggggcctgatggaggaggatgctgagcccatctttgaagatgtgatgatgagcagccgcagccagctggaggacatgaatgaggagtttgaggacaccatggtgattgacctgccccccagcaggaacagaagagagcgggcagagctgcggccagacttctttgattctgctgccatcattgaagatgattctggcttcggcatgcccatgttttag

SEQ ID NO: 17058 - DNA, 405 bp, Artificial Sequence
  Description of Artificial Sequence: Synthetic coding sequence
atgatcttctccatgctgaggaagctgcccaaggtgacctgcagagatgtgctgcctgagatccgggccatctgcatcgaggagatcggctgctggatgcagagctacagcaccagcttcctgacagacagctacctgaagtacatcggctggaccctgcatgacaagcaccgggaggtgcgggtgaagtgtgtgaaggccctgaagggcctgtatggcaacagagacctgacagcccggctggagctgttcaccggccgcttcaaggactggatggtgtccatgattgtggaccgggagtacagcgtggccgtggaggccgtgcggctgctgatcctgatcctgaagaacatggagggcgtgctgatggatgtggactgtgagagcgtgtaccccatcgtgtag

SEQ ID NO: 17059 - DNA, 618 bp, Artificial Sequence
  Description of Artificial Sequence: Synthetic coding sequence
atgatcttctccatgctgaggaagctgcccaaggtgacctgcagagatgtgctgcctgagatccgggccatctgcatcgaggagatcggctgctggatgcagagctacagcaccagcttcctgacagacagctacctgaagtacatcggctggaccctgcatgacaagcaccgggaggtgcgggtgaagtgtgtgaaggccctgaagggcctgtatggcaacagagacctgacagcccggctggagctgttcaccggccgcttcaaggactggatggtgtccatgattgtggaccgggagtacagcgtggccgtggaggccgtgcggctgctgatcctgatcctgaagctgttctacccagaatgtgagatccgcaccatgggcggccgggagcagaggcagagccctggggcccagaggaccttcttccagctgctgctgtccttctttgtggagagcaagctgcatgaccatgctgcctacctggtggacaacctgtgggactgtgccggcacccagctgaaggactgggagggcctgaccagcctgctgctggagaaggaccagagcacctgccacatggagcccggccctggcaccttccacctgctgggctag

SEQ ID NO: 17060 - DNA, 456 bp, Artificial Sequence
  Description of Artificial Sequence: Synthetic coding sequence
atgcagcaccgggaggtgcgggtgaagtgtgtgaaggccctgaagggcctgtatggcaacagagacctgacagcccggctggagctgttcaccggccgcttcaaggactggatggtgtccatgattgtggaccgggagtacagcgtggccgtggaggccgtgcggctgctgatcctgatcctgaagctgttctacccagaatgtgagatccgcaccatgggcggccgggagcagaggcagagccctggggcccagaggaccttcttccagctgctgctgtccttctttgtggagagcaagctgcatgaccatgctgcctacctggtggacaacctgtgggactgtgccggcacccagctgaaggactgggagggcctgaccagcctgctgctggagaaggaccagagcacctgccacatggagcccggccctggcaccttccacctgctgggctag

SEQ ID NO: 17061 - DNA, 387 bp, Artificial Sequence
  Description of Artificial Sequence: Synthetic coding sequence
atgatcttctccatgctgaggaagctgcccaaggtgacctgcagagatgtgctgcctgagatccgggccatctgcatcgaggagatcggctgctggatgcagagctacagcaccagcttcctgacagacagctacctgaagtacatcggctggaccctgcatgacaagcaccgggaggtgcgggtgaagtgtgtgaaggccctgaagggcctgtatggcaacagagacctgacagcccggctggagctgttcaccggccgcttcaaggactggatggtgtccatgattgtggaccgggagtacagcgtggccgtggaggccgtgcggctgctgatcctgatcctgaagattggcagccagaccccagccacccgggagtgcatctag

SEQ ID NO: 17062 - DNA, 378 bp, Artificial Sequence
  Description of Artificial Sequence: Synthetic coding sequence
atgcagcaccgggaggtgcgggtgaagtgtgtgaaggccctgaagggcctgtatggcaacagagacctgacagcccggctggagctgttcaccggccgcttcaaggactggatggtgtccatgattgtggaccgggagtacagcgtggccgtggaggccgtgcggctgctgatcctgatcctgaagctgttctacccagaatgtgagatccgcaccatgggcggccgggagcagaggcagagccctggggcccagaggaccttcttccagctgctgctgtccttctttgtggagagcaaggtgacctacacagagaggaccctggccgtggtgcacaggacctacaagtgggccggcgtgggcggcagccggctgtag

SEQ ID NO: 17063 - DNA, 240 bp, Artificial Sequence
  Description of Artificial Sequence: Synthetic coding sequence
atgggcggccgggagcagaggcagagccctggggcccagaggaccttcttccagctgctgctgtccttctttgtggagagcaagctgcatgaccatgctgcctacctggtggacaacctgtgggactgtgccggcacccagctgaaggactgggagggcctgaccagcctgctgctggagaaggaccagagcacctgccacatggagcccggccctggcaccttccacctgctgggctag

SEQ ID NO: 17064 - DNA, 405 bp, Artificial Sequence; identical to SEQ ID NO: 17058
  Description of Artificial Sequence: Synthetic coding sequence

SEQ ID NO: 17065 - DNA, 405 bp, Artificial Sequence; identical to SEQ ID NO: 17058
  Description of Artificial Sequence: Synthetic coding sequence

SEQ ID NO: 17066 - DNA, 405 bp, Artificial Sequence; identical to SEQ ID NO: 17058
  Description of Artificial Sequence: Synthetic coding sequence

SEQ ID NO: 17067 - DNA, 618 bp, Artificial Sequence
  Description of Artificial Sequence: Synthetic coding sequence
atgatcttctccatgctgaggaagctgcccaaggtgacctgcagagatgtgctgcctgagatccgggccatctgcatcgaggagatcggctgctggatgcagagctacagcaccagcttcctgacagacagctacctgaagtacatcggctggaccctgcatgacaagcaccgggaggtgcgggtgaagtgtgtgaaggccctgaagggcctgtatggcaacagagacctgacagcccggctggagctgttcaccggctgcttcaaggactggatggtgtccatgatcatggaccgggagtacagcgtggccgtggaggccgtgcggctgctgatcctgatcctgaagctgttctacccagaatgtgagatccgcaccatgggcggccgggagcagaggcagagccctggggcccagaggaccttcttccagctgctgctgtccttctttgtggagagcaagctgcatgaccatgctgcctacctggtggacaacctgtgggactgtgccggcacccagctgaaggactgggagggcctgaccagcctgctgctggagaaggaccagagcacctgccacatggagcccggccctggcaccttccacctgctgggctag

SEQ ID NO: 17068 - DNA, 405 bp, Artificial Sequence
  Description of Artificial Sequence: Synthetic coding sequence
atgatcttctccatgctgaggaagctgcccaaggtgacctgcagagatgtgctgcctgagatccgggccatctgcatcgaggagatcggctgctggatgcagagctacagcaccagcttcctgacagacagctacctgaagtacatcggctggaccctgcatgacaagcaccgggaggtgcgggtgaagtgtgtgaaggccctgaagggcctgtatggcaacagagacctgacagcccggctggagctgttcaccggctgcttcaaggactggatggtgtccatgatcatggaccgggagtacagcgtggccgtggaggccgtgcggctgctgatcctgatcctgaagaacatggagggcgtgctgatggatgtggactgtgagagcgtgtaccccatcgtgtag

SEQ ID NO: 17069 - DNA, 456 bp, Artificial Sequence
  Description of Artificial Sequence: Synthetic coding sequence
atgcagcaccgggaggtgcgggtgaagtgtgtgaaggccctgaagggcctgtatggcaacagagacctgacagcccggctggagctgttcaccggctgcttcaaggactggatggtgtccatgatcatggaccgggagtacagcgtggccgtggaggccgtgcggctgctgatcctgatcctgaagctgttctacccagaatgtgagatccgcaccatgggcggccgggagcagaggcagagccctggggcccagaggaccttcttccagctgctgctgtccttctttgtggagagcaagctgcatgaccatgctgcctacctggtggacaacctgtgggactgtgccggcacccagctgaaggactgggagggcctgaccagcctgctgctggagaaggaccagagcacctgccacatggagcccggccctggcaccttccacctgctgggctag

SEQ ID NO: 17070 - DNA, 351 bp, Artificial Sequence
  Description of Artificial Sequence: Synthetic coding sequence
atgatcttctccatgctgaggaagctgcccaaggtgacctgcagagatgtgctgcctgagatccgggccatctgcatcgaggagatcggctgctggatgcagagctacagcaccagcttcctgacagacagctacctgaagtacatcggctggaccctgcatgacaagcaccgggaggtgcgggtgaagtgtgtgaaggccctgaagggcctgtatggcaacagagacctgacagcccggctggagctgttcaccggctgcttcaaggactggatggtgtccatgatcatggaccgggagtacagcgtggccgtggaggccgtgcggctgctgatcctgatcctgaagtag

SEQ ID NO: 17071 - DNA, 3708 bp, Artificial Sequence
  Description of Artificial Sequence: Synthetic coding sequence
atggcccacctggagctgctgctggtggagaacttcaagtcctggaggggccggcaggtgattggccccttccgccgcttcacctgcatcatcggccccaacggcagcggcaagagcaatgtgatggatgccctgagctttgtgatgggagagaagatcgccaacctgcgggtgaagaacatccaggagctgatccacggggcccacatcggcaagcccatcagcagcagcgcctctgtgaagatcatctacgtggaggagagcggggaggagaagacctttgcccgcatcatccggggcggctgcagcgagttccgcttcaatgacaacctggtgagccgctctgtgtacatcgccgagctggagaagattggcatcatcgtgaaggcccagaactgcctggtgttccagggcaccgtggagagcatctctgtgaagaagcccaaggagaggacccagttctttgaggagatcagcaccagcggggagctgattggagaatatgaggagaagaagaggaagctgcagaaggccgaggaggatgcccagttcaacttcaacaagaagaagaacattgctgctgagcggcggcaggccaagctggagaaggaggaggccgagcgctaccagagcctgctggaggagctgaagatgaacaagatccagctgcagctgttccagctgtaccacaatgagaagaagatccacctgctgaacaccaagctggagcacgtgaacagagacctgtctgtgaagcgggagagcctgagccaccacgagaacatcgtgaaggccaggaagaaggagcacggcatgctgacccggcagctgcagcagacagagaaggagctgaagtctgtggagaccctgctgaaccagaagaggccccagtacatcaaggccaaggagaacaccagccaccacctgaagaagctggatgtggccaagaagagcatcaaggacagcgagaagcagtgcagcaagcaggaggatgacatcaaggccctggagacagagctggccgacctggatgctgcctggaggagctttgagaagcagatcgaggaggagatcctgcacaagaagagggacatcgagctggaggccagccagctggaccgctacaaggagctgaaggagcaggtgaggaagaaggtggccaccatgacccagcagctggagaagctgcagtgggagcagaagacagatgaggagcggctggcctttgagaagagaagacatggagaggtgcagggcaacctgaagcagatcaaggagcagatcgaggaccacaagaagagaattgagaagctggaggagtacaccaagacctgcatggactgcctgaaggagaagaagcagcaggaggagaccctggtggatgaaattgagaagaccaagagcaggatgtctgagttcaatgaggagctgaacctgatccgctctgagctgcagaatgccggcatcgacacccatgagggcaagaggcagcagaagagagctgaggtgctggagcacctgaagaggctgtacccagacagcgtgtttggccgcctgtttgacctgtgccaccccatccacaagaagtaccagctggccgtgaccaaggtgtttggccgcttcatcacagccatcgtggtggccagcgagaaggtggccaaggactgcatccgcttcctgaaggaggagagagctgagcctgagaccttcctggccctggactacctggacatcaagcccatcaatgaaaggctgcgggagctgaagggctgcaagatggtgattgatgtgatcaagacccagttcccccagctgaagaaggtgatccagtttgtgtgtggaaatggcctggtgtgtgagaccatggaggaggcccggcacatcgccctgagcggccctgagcggcagaagacagtggccctggatggcaccctcttcctgaagtctggagtcatcagcggcggcagcagtgacctgaagtacaaggcccgctgctgggatgagaaggagctgaagaacctgcgggacagaagaagccagaagatccaggagctgaagggcctgatgaagaccctgaggaaggagacagacctgaagcagatccagaccctcatccagggcacccagacccggctgaagtacagccagaatgagctggagatgatcaagaagaagcacctggtggccttctaccaggagcagagccagctgcagagcgagctgctgaacatcgagagccagtgcatcatgctgtctgagggcatcaaggagcggcagaggcgcatcaaggagttccaggagaagattgacaaggtggaggatgacatcttccagcacttctgtgaggagattggagtggagaacatccgggagtttgagaacaagcacgtgaagaggcagcaggagattgaccagaagaggctggagtttgagaagcagaagacccggctgaatgtgcagctggagtacagccgcagccacctgaagaagaagctgaacaagatcaacaccctgaaggagaccatccagaagggctctgaagatattgaccacctgaagaaggccgaggagaactgcctgcagacagtgaatgagctgatggccaagcagcagcagctgaaggacatccgggtgacccagaacagcagcgctgagaaggtgcagacccagatcgaggaggagaggaagaagttcctggccgtggaccgggaggtgggcaagctgcagaaggaggtggtgtccatccagaccagcctggagcagaagaggctggagaagcacaacctgctgctggactgcaaggtgcaggacatcgagatcatcctgctgagcggcagcctggatgacatcatcgaggtggagatgggcacagaagctgagagcacccaggccaccatcgacatctatgagaaggaggaggcctttgaaattgactacagcagcctgaaggaggacctgaaggccctgcagagcgaccaggagattgaggcccacctgcggctgctgctgcagcaggtggccagccaggaggacatcctgctgaagacagctgcccccaacctgcgggccctggagaacctgaagacagtgcgggacaagttccaggagagcacagatgcctttgaggccagcaggaaggaggcccggctgtgccggcaggagtttgagcaggtgaagaagagaagatatgacctcttcacccagtgctttgagcacgtgtccatcagcattgaccagatctacaagaagctgtgcaggaacaacagcgcccaggccttcctgagcccagaaaatcctgaggagccctacctggagggcatctcctacaactgtgtggcccctgggaagcgcttcatgcccatggacaacctgtctggaggagagaagtgtgtggccgccctggccctgctgtttgctgtgcacagcttccggcctgcccccttctttgtgctggatgaggtggatgctgccctggacaacaccaacatcggcaaggtgagcagctacatcaaggagcagacccaggaccagttccagatgatcgtcatcagcctgaaggaggagttctacagcagagcagatgccctgattggcatctacccagaatatgatgactgcatgttcagccgggtgctgaccctggacctgagccagtacccagacacagagggccaggagagcagcaagagacatggagagagcaggtag

SEQ ID NO: 17072 - DNA, 3486 bp, Artificial Sequence
  Description of Artificial Sequence: Synthetic coding sequence
atggcccacctggagctgctgctggtggagaacttcaagtcctggaggggccggcaggtgattggccccttccgccgcttcacctgcatcatcggccccaacggcagcggcaagagcaatgtgatggatgccctgagctttgtgatgggagagaagatcgccaacctgcgggtgaagaacatccaggagctgatccacggggcccacatcggcaagcccatcagcagcagcgcctctgtgaagatcatctacgtggaggagagcggggaggagaagacctttgcccgcatcatccggggcggctgcagcgagttccgcttcaatgacaacctggtgagccgctctgtgtacatcgccgagctggagaagattggcatcatcgtgaaggcccagaactgcctggtgttccagggcaccgtggagagcatctctgtgaagaagcccaaggagaggacccagttctttgaggagatcagcaccagcggggagctgattggagaatatgaggagaagaagaggaagctgcagaaggccgaggaggatgcccagttcaacttcaacaagaagaagaacattgctgctgagcggcggcaggccaagctggagaaggaggaggccgagcgctaccagagcctgctggaggagctgaagatgaacaagatccagctgcagctgttccagctgtaccacaatgagaagaagatccacctgctgaacaccaagctggagcacgtgaacagagacctgtctgtgaagcgggagagcctgagccaccacgagaacatcgtgaaggccaggaagaaggagcacggcatgctgacccggcagctgcagcagacagagaaggagctgaagtctgtggagaccctgctgaaccagaagaggccccagtacatcaaggccaaggagaacaccagccaccacctgaagaagctggatgtggccaagaagagcatcaaggacagcgagaagcagtgcagcaagcaggaggatgacatcaaggccctggagacagagctggccgacctggatgctgcctggaggagctttgagaagcagatcgaggaggagatcctgcacaagaagagggacatcgagctggaggccagccagctggaccgctacaaggagctgaaggagcaggtgaggaagaaggtggccaccatgacccagcagctggagaagctgcagtgggagcagaagacagatgaggagcggctggcctttgagaagagaagacatggagaggtgcagggcaacctgaagcagatcaaggagcagatcgaggaccacaagaagagaattgagaagctggaggagtacaccaagacctgcatggactgcctgaaggagaagaagcagcaggaggagaccctggtggatgaaattgagaagaccaagagcaggatgtctgagttcaatgaggagctgaacctgatccgctctgagctgcagaatgccggcatcgacacccatgagggcaagaggcagcagaagagagctgaggtgctggagcacctgaagaggctgtacccagacagcgtgtttggccgcctgtttgacctgtgccaccccatccacaagaagtaccagctggccgtgaccaaggtgtttggccgcttcatcacagccatcgtggtggccagcgagaaggtggccaaggactgcatccgcttcctgaaggaggagagagctgagcctgagaccttcctggccctggactacctggacatcaagcccatcaatgaaaggctgcgggagctgaagggctgcaagatggtgattgatgtgatcaagacccagttcccccagctgaagaaggtgatccagtttgtgtgtggaaatggcctggtgtgtgagaccatggaggaggcccggcacatcgccctgagcggccctgagcggcagaagacagtggccctggatggcaccctcttcctgaagtctggagtcatcagcggcggcagcagtgacctgaagtacaaggcccgctgctgggatgagaaggagctgaagaacctgcgggacagaagaagccagaagatccaggagctgaagggcctgatgaagaccctgaggaaggagacagacctgaagcagatccagaccctcatccagggcacccagacccggctgaagtacagccagaatgagctggagatgatcaagaagaagcacctggtggccttctaccaggagcagagccagctgcagagcgagctgctgaacatcgagagccagtgcatcatgctgtctgagggcatcaaggagcggcagaggcgcatcaaggagttccaggagaagattgacaaggtggaggatgacatcttccagcacttctgtgaggagattggagtggagaacatccgggagtttgagaacaagcacgtgaagaggcagcaggagattgaccagaagaggctggagtttgagaagcagaagacccggctgaatgtgcagctggagtacagccgcagccacctgaagaagaagctgaacaagatcaacaccctgaaggagaccatccagaagggctctgaagatattgaccacctgaagaaggccgaggagaactgcctgcagacagtgaatgagctgatggccaagcagcagcagctgaaggacatccgggtgacccagaacagcagcgctgagaaggtgcagacccagatcgaggaggagaggaagaagttcctggccgtggaccgggaggtgggcaagctgcagaaggaggtggtgtccatccagaccagcctggagcagaagaggctggagaagcacaacctgctgctggactgcaaggtgcaggacatcgagatcatcctgctgagcggcagcctggatgacatcatcgaggtggagatgggcacagaagctgagagcacccaggccaccatcgacatctatgagaaggaggaggcctttgaaattgactacagcagcctgaaggaggacctgaaggccctgcagagcgaccaggagattgaggcccacctgcggctgctgctgcagcaggtggccagccaggaggacatcctgctgaagacagctgcccccaacctgcgggccctggagaacctgaagacagtgcgggacaagttccaggagagcacagatgcctttgaggccagcaggaaggaggcccggctgtgccggcaggagtttgagcaggtgaagaagagaagatatgacctcttcacccagtgctttgagcacgtgtccatcagcattgaccagatctacaagaagctgtgcaggaacaacagcgcccaggtgagcagctacatcaaggagcagacccaggaccagttccagatgatcgtcatcagcctgaaggaggagttctacagcagagcagatgccctgattggcatctacccagaatatgatgactgcatgttcagccgggtgctgaccctggacctgagccagtacccagacacagagggccaggagagcagcaagagacatggagagagcaggtag

SEQ ID NO: 17073 - DNA, 5754 bp, Artificial Sequence
  Description of Artificial Sequence: Synthetic coding sequence
atggctgctgctgatggcggcggccctggaggagcctctgtgggcacagaggaggatggcggcggcgtgggccacaggacagtgtacctgtttgacagaagagagaaggagagcgagctgggggaccggcccctgcaggtgggggagaggagtgactatgccggcttccgggcctgtgtgtgccagaccctgggcatcagccctgaggagaagtttgtgatcaccaccaccagcaggaaggagatcacctgtgacaactttgatgagaccgtgaaggatggagtgaccctgtacctgctgcagagcgtgaaccagctgctgctgacagccaccaaggagagaattgacttcctgccccactatgacaccctggtgaagagcggcatgtatgagtactatgccagcgagggccagaaccccctgccctttgccctggccgagctgattgacaacagcctgagcgccaccagcaggaacatcggcgtgcggcgcatccagatcaagctgctgtttgatgagacccagggcaagccagctgtggccgtgattgacaatggccggggcatgaccagcaagcagctgaacaactgggccgtgtaccgcctgagcaagttcacccggcagggcgactttgaaagtgaccacagcggctacgtgcggcctgtgcctgtgcccaggagcctgaacagcgacatctcctactttggagtgggcggcaagcaggccgtgttctttgtgggccagagcgccaggatgatcagcaagccagctgacagccaggatgtgcatgagctggtgctgagcaaggaggactttgagaagaaggagaagaacaaggaggccatctacagcggctacatccggaacaggaagcccagcgacagcgtgcacatcaccaatgatgatgagcgcttcctgcaccacctgatcatcgaggagaaggagaaggacagcttcaccgctgtggtgatcactggagtgcagcctgagcacatccagtacctgaagaactacttccacctgtggacccggcagctggcccacatctaccactactacatccacggccccaagggaaatgagatccgcaccagcaaggaggtggagcccttcaacaacatcgacatcgagatctccatgtttgagaagggcaaggtgcccaagatcgtgaacctgcgggagatccaggatgacatgcagaccctgtatgtgaacacagctgctgacagctttgagttcaaggcccacgtggagggagatggagtggtggagggcatcatccgctaccaccccttcctgtatgaccgggagacctacccagatgacccctgcttccccagcaagctgaaggatgaagatgatgaagatgactgcttcatcctggagaaggccgcccggggcaagaggcccatctttgagtgcttctggaatggccgcctcatcccctacacctctgtggaggactttgactggtgcaccccacccaagaagaggggcctggcccccatcgagtgctacaaccgcatcagcggggccctcttcaccaatgacaagttccaggtgtccaccaacaagctgaccttcatggacctggagctgaagctgaaggacaagaacaccctcttcacccgcatcctgaatggccaggagcagaggatgaagattgaccgggagtttgccctgtggctgaaggactgccacgagaagtatgacaagcagatcaagttcaccctcttcaagggcgtcatcaccaggccagacctgcccagcaagaagcagggcccctgggccacctacgccgccatcgagtgggatggcaagatctacaaggccggccagctggtgaagaccatcaagaccctgcccctcttctacggcagcatcgtgcgcttcttcctgtatggagaccatgatggagaggtgtatgccaccggcggggaggtgcagatcgccatggagccccaggccctgtatgatgaggtgaggacagtgcccatcgccaagctggacagaacagtggccgagaaggctgtgaagaagtatgtggaggatgagatggcccggctgcctgaccggctgtctgtgacctggccagaaggagatgagctgctgcccaatgaggtgcggcctgctggcacccccatcggggccctgcgcatcgagatcctgaacaagaagggggaggccatgcagaagctgcccggcaccagccacggcggcagcaagaagctgctggtggagctgaaggtgatcctgcacagcagcagcggcaacaaggagatcatcagccacatcagccagcacggcggcaagtggccctactggttcaagaagatggagaacatccagaagctgggcaactacaccctgaagctgcaggtggtgctgaatgaaagcaatgctgacacctacgccggccggcccctgcccagcaaggccatcaagttctctgtgaaggagggcaagccagagaagttctcctttggcctgctggacctgcccttccgggtgggcgtgcccttcaacatccccctggagttccaggatgaatttggccacaccagccagctggtgacagacatccagcctgtgctggaggccagcggcctgagcctgcactatgaggagatcaccaagggccccaactgtgtgatccggggcgtgacagccaagggccctgtgaacagctgccagggcaagaactacaacctgaaggtgaccctgcccggcctgaaggaggacagccagatcctgaagatccggctgctgcccggccacccccggcggctgaaggtgaagccagacagcgagatcctggtgattgaaaatggaacagccttccccttccaggtggaggtgctggatgaaagtgacaacatcacagcccagcccaagctgattgtgcactgcaagttcagcggggcccccaacctgcctgtgtatgtggtggactgcagcagcagcggcaccagcatcctgaccggcagcgccatccaggtgcagaacatcaagaaggaccagaccctgaaggccagaattgagatccccagctgcaaggatgtggcccctgtggagaagaccatcaagctgctgcccagcagccacgtggcccggctgcagatcttctctgtggagggccagaaggccatccagatcaagcaccaggatgaggtgaactggattgctggggacatcatgcacaacctgatcttccagatgtatgatgaaggagagcgggagatcaacatcaccagcgccctggccgagaagatcaaggtgaactggaccccagagatcaacaaggagcacctgctgcagggcctgctgcctgatgtgcaggtgcccacctctgtgaaggacatgagatactgccaggtgtccttccaggatgaccacgtgtccctggagagcgccttcaccgtgcggcccctgcctgatgagcccaagcacctgaagtgtgagatgaagggcggcaagacagtgcagatgggccaggagctgcagggcgaggtggtgatcatcatcacagaccagtatggcaaccagatccaggccttcagccccagcagcctgagcagcctgagcattgctggggtgggcctggacagcagcaacctgaagaccaccttccaggagaacacccagagcatctctgtgcggggcatcaagttcatccctggccccccaggcaacaaggacctgtgcttcacctggagggagttcagtgacttcatccgggtgcagctgatcagcggccccccagccaagctgctgctgattgactggccagagctgaaggagagcatccctgtgatcaatggccgggacctgcagaaccccatcatcgtgcagctgtgtgaccagtgggacaacccagcccctgtgcagcacgtgaagatcagcctgaccaaggccagcaacctgaagctgatgcccagcaaccagcagcacaagacagatgagaagggccgggccaacctgggcgtcttctctgtgtttgcccccagaggagagcacaccctgcaggtgaaggccatctacaacaagagcatcatcgagggccccatcatcaagctgatgatcctgcctgaccctgagaagcctgtgcggctgaatgtgaagtatgacaaggatgccagcttcctggccggcggcctcttcacagacttcatgatcagcgtcatcagtgaagatgacagcatcatcaagaacatcaacccagcccgcatctccatgaagatgtggaagctgagcaccagcggcaaccggcccccagccaatgctgagaccttcagctgcaacaagatcaaggacaatgacaaggaggatggctgcttctacttccgggacaaggtgatccccaacaaggtgggcacctactgcatccagtttggcttcatgatggacaagaccaacatcctgaacagcgagcaggtgattgtggaggtgctgcccaaccagcctgtgaagctggtgcccaagatcaagccacccaccccagctgtgtccaatgtgcgctctgtggccagcaggaccctggtgcgggacctgcacctgagcatcacagatgattatgacaaccacactggaattgacctggtgggcaccatcatcgccaccatcaagggcagcaatgaggaggacacagacacccccctcttcatcggcaaggtgaggaccctggagttcccctttgtgaatggatctgctgagatcatgagcctggtgctggccgagagcagccctggccgggacagcacagagtacttcatcgtgtttgagccccggctgcccctgctgagcaggaccctggagccctacatcctgcccttcatgttctacaatgatgtgaagaagcagcagcagatggccgccctgaccaaggagaaggaccagctgagccagagcatcgtgatgtacaagagcctgtttgaggccagccagcagctgctgaatgagatgaagtgccaggtggaggaggcccggctgaaggaggcccagctgagaaatgagctgaagatccacaacatcgacatccccaccacccagcaggtgccccacatcgaggccctgctgaagaggaagctgtctgagcaggaggagctgaagaagaagcccaggaggagctgcaccctgcccaactacaccaagggcagcggagatgtgctgggcaagatcgcccacctggcccagattgaagatgacagagctgccatggtgatctcctggcacctggccagtgacatggactgtgtggtgaccctgaccacagatgctgcccggcgcatctatgatgagacccagggccggcagcaggtgctgcccctggacagcatctacaagaagaccctgcctgactggaagaggagcctgccccacttcagaaatggcaagctgtacttcaagcccatcggggaccctgtgtttgcccgggacctgctgaccttcccagacaacgtggagcactgtgaaacagtgtttggcatgctgctgggggacaccatcatcctggacaacctggatgctgccaaccactacaggaaggaggtggtgaagatcacccactgccccaccctgctgaccagagatggagaccgcatccgcagcaatggcaagtttggaggcctgcagaacaaggccccacccatggacaagctgcggggcatggtgtttggagcccctgtgcccaagcagtgcctgatcctgggggagcagatcgtgcacgcctgtgtgcccagctacagcggcggctag

SEQ ID NO: 17074 - DNA, 6018 bp, Artificial Sequence
  Description of Artificial Sequence: Synthetic coding sequence
atggctgctgctgatggcggcggccctggaggagcctctgtgggcacagaggaggatggcggcggcgtgggccacaggacagtgtacctgtttgacagaagagagaaggagagcgagctgggggaccggcccctgcaggtgggggagaggagtgactatgccggcttccgggcctgtgtgtgccagaccctgggcatcagccctgaggagaagtttgtgatcaccaccaccagcaggaaggagatcacctgtgacaactttgatgagaccgtgaaggatggagtgaccctgtacctgctgcagagcgtgaaccagctgctgctgacagccaccaaggagagaattgacttcctgccccactatgacaccctggtgaagagcggcatgtatgagtactatgccagcgagggccagaaccccctgccctttgccctggccgagctgattgacaacagcctgagcgccaccagcaggaacatcggcgtgcggcgcatccagatcaagctgctgtttgatgagacccagggcaagccagctgtggccgtgattgacaatggccggggcatgaccagcaagcagctgaacaactgggccgtgtaccgcctgagcaagttcacccggcagggcgactttgaaagtgaccacagcggctacgtgcggcctgtgcctgtgcccaggagcctgaacagcgacatctcctactttggagtgggcggcaagcaggccgtgttctttgtgggccagagcgccaggatgatcagcaagccagctgacagccaggatgtgcatgagctggtgctgagcaaggaggactttgagaagaaggagaagaacaaggaggccatctacagcggctacatccggaacaggaagcccagcgacagcgtgcacatcaccaatgatgatgagcgcttcctgcaccacctgatcatcgaggagaaggagaaggacagcttcaccgctgtggtgatcactggagtgcagcctgagcacatccagtacctgaagaactacttccacctgtggacccggcagctggcccacatctaccactactacatccacggccccaagggaaatgagatccgcaccagcaaggaggtggagcccttcaacaacatcgacatcgagatctccatgtttgagaagggcaaggtgcccaagatcgtgaacctgcgggagatccaggatgacatgcagaccctgtatgtgaacacagctgctgacagctttgagttcaaggcccacgtggagggagatggagtggtggagggcatcatccgctaccaccccttcctgtatgaccgggagacctacccagatgacccctgcttccccagcaagctgaaggatgaagatgatgaagatgactgcttcatcctggagaaggccgcccggggcaagaggcccatctttgagtgcttctggaatggccgcctcatcccctacacctctgtggaggactttgactggtgcaccccacccaagaagaggggcctggcccccatcgagtgctacaaccgcatcagcggggccctcttcaccaatgacaagttccaggtgtccaccaacaagctgaccttcatggacctggagctgaagctgaaggacaagaacaccctcttcacccgcatcctgaatggccaggagcagaggatgaagattgaccgggagtttgccctgtggctgaaggactgccacgagaagtatgacaagcagatcaagttcaccctcttcaagggcgtcatcaccaggccagacctgcccagcaagaagcagggcccctgggccacctacgccgccatcgagtgggatggcaagatctacaaggccggccagctggtgaagaccatcaagaccctgcccctcttctacggcagcatcgtgcgcttcttcctgtatggagaccatgatggagaggtgtatgccaccggcggggaggtgcagatcgccatggagccccaggccctgtatgatgaggtgaggacagtgcccatcgccaagctggacagaacagtggccgagaaggctgtgaagaagtatgtggaggatgagatggcccggctgcctgaccggctgtctgtgacctggccagaaggagatgagctgctgcccaatgaggtgcggcctgctggcacccccatcggggccctgcgcatcgagatcctgaacaagaagggggaggccatgcagaagctgcccggcaccagccacggcggcagcaagaagctgctggtggagctgaaggtgatcctgcacagcagcagcggcaacaaggagatcatcagccacatcagccagcacggcggcaagtggccctactggttcaagaagatggagaacatccagaagctgggcaactacaccctgaagctgcaggtggtgctgaatgaaagcaatgctgacacctacgccggccggcccctgcccagcaaggccatcaagttctctgtgaaggagggcaagccagagaagttctcctttggcctgctggacctgcccttccgggtgggcgtgcccttcaacatccccctggagttccaggatgaatttggccacaccagccagctggtgacagacatccagcctgtgctggaggccagcggcctgagcctgcactatgaggagatcaccaagggccccaactgtgtgatccggggcgtgacagccaagggccctgtgaacagctgccagggcaagaactacaacctgaaggtgaccctgcccggcctgaaggaggacagccagatcctgaagatccggctgctgcccggccacccccggcggctgaaggtgaagccagacagcgagatcctggtgattgaaaatggaacagccttccccttccaggtggaggtgctggatgaaagtgacaacatcacagcccagcccaagctgattgtgcactgcaagttcagcggggcccccaacctgcctgtgtatgtggtggactgcagcagcagcggcaccagcatcctgaccggcagcgccatccaggtgcagaacatcaagaaggaccagaccctgaaggccagaattgagatccccagctgcaaggatgtggcccctgtggagaagaccatcaagctgctgcccagcagccacgtggcccggctgcagatcttctctgtggagggccagaaggccatccagatcaagcaccaggatgaggtgaactggattgctggggacatcatgcacaacctgatcttccagatgtatgatgaaggagagcgggagatcaacatcaccagcgccctggccgagaagatcaaggtgaactggaccccagagatcaacaaggagcacctgctgcagggcctgctgcctgatgtgcaggtgcccacctctgtgaaggacatgagatactgccaggtgtccttccaggatgaccacgtgtccctggagagcgccttcaccgtgcggcccctgcctgatgagcccaagcacctgaagtgtgagatgaagggcggcaagacagtgcagatgggccaggagctgcagggcgaggtggtgatcatcatcacagaccagtatggcaaccagatccaggccttcagccccagcagcctgagcagcctgagcattgctggggtgggcctggacagcagcaacctgaagaccaccttccaggagaacacccagagcatctctgtgcggggcatcaagttcatccctggccccccaggcaacaaggacctgtgcttcacctggagggagttcagtgacttcatccgggtgcagctgatcagcggccccccagccaagctgctgctgattgactggccagagctgaaggagagcatccctgtgatcaatggccgggacctgcagaaccccatcatcgtgcagctgtgtgaccagtgggacaacccagcccctgtgcagcacgtgaagatcagcctgaccaaggccagcaacctgaagctgatgcccagcaaccagcagcacaagacagatgagaagggccgggccaacctgggcgtcttctctgtgtttgcccccagaggagagcacaccctgcaggtgaaggccatctacaacaagagcatcatcgagggccccatcatcaagctgatgatcctgcctgaccctgagaagcctgtgcggctgaatgtgaagtatgacaaggatgccagcttcctggccggcggcctcttcacagacttcatgatcagcgtcatcagtgaagatgacagcatcatcaagaacatcaacccagcccgcatctccatgaagatgtggaagctgagcaccagcggcaaccggcccccagccaatgctgagaccttcagctgcaacaagatcaaggacaatgacaaggaggatggctgcttctacttccgggacaaggtgatccccaacaaggtgggcacctactgcatccagtttggcttcatgatggacaagaccaacatcctgaacagcgagcaggtgattgtggaggtgctgcccaaccagcctgtgaagctggtgcccaagatcaagccacccaccccagctgtgtccaatgtgcgctctgtggccagcaggaccctggtgcgggacctgcacctgagcatcacagatgattatgacaaccacactggaattgacctggtgggcaccatcatcgccaccatcaagggcagcaatgaggaggacacagacacccccctcttcatcggcaaggtgaggaccctggagttcccctttgtgaatggatctgctgagatcatgagcctggtgctggccgagagcagccctggccgggacagcacagagtacttcatcgtgtttgagccccggctgcccctgctgagcaggaccctggagccctacatcctgcccttcatgttctacaatgatgtgaagaagcagcagcagatggccgccctgaccaaggagaaggaccagctgagccagagcatcgtgatgtacaagagcctgtttgaggccagccagcagctgctgaatgagatgaagtgccaggtggaggaggcccggctgaaggaggcccagctgagaaatgagctgaagatccacaacatcgacatccccaccacccagcaggtgccccacatcgaggccctgctgaagaggaagctgtctgagcaggaggagctgaagaagaagcccaggaggagctgcaccctgcccaactacaccaagggcagcggagatgtgctgggcaagatcgcccacctggcccagattgaagatgacagagctgccatggtgatctcctggcacctggccagtgacatggactgtgtggtgaccctgaccacagatgctgcccggcgcatctatgatgagacccagggccggcagcaggtgctgcccctggacagcatctacaagaagaccctgcctgactggaagaggagcctgccccacttcagaaatggcaagctgtacttcaagcccatcggggaccctgtgtttgcccgggacctgctgaccttcccagacaacgtggagcactgtgaaacagtgtttggcatgctgctgggggacaccatcatcctggacaacctggatgctgccaaccactacaggaaggaggtggtgaagatcacccactgccccaccctgctgaccagagatggagaccgcatccgcagcaatggcaagtttggaggcctgcagaacaaggccccacccatggacaagctgcggggcatggtgtttggagcccctgtgcccaagcagtgcctgatcctgggggagcagattgacctgctgcagcagtacagatctgctgtgtgcaagctggacagcgtgaacaaggacctgaacagccagctggagtacctgcggaccccagacatgaggaagaagaagcaggagctggatgagcacgagaagaacctgaagctgattgaggagaagctgggcatgacccccatcaggaagtgcaatgacagcctgcggcacagccccaaggtggagaccacagactgccctgtgccccccaagaggatgaggcgggaggccacccggcagaaccgcatcatcaccaagacagatgtgtag

SEQ ID NO: 17075 - DNA, 384 bp, Artificial Sequence
  Description of Artificial Sequence: Synthetic coding sequence
atgcccaagagcaaggagctggtgagcagcagcagcagcggcagtgacagcgacagcgaggtggacaagaagctgaagaggaagaagcaggtggcccctgagaagcctgtgaagaagcagaagacaggagagaccagccgggccctgagcagcagcaagcagagcagcagcagcagagatgacaacatgttccagatcggcaagatgagatatgtgtctgtgcgggacttcaagggcaaggtgctgattgacatccgggagtactggatggaccctgagggggagatgaagccaggcaggaagggcatcagcctgaaccctgagcagtggagccagctgaaggagcagatcagtgacattgatgatgctgtgaggaagctgtag

SEQ ID NO: 17076 - DNA, 384 bp, Artificial Sequence; identical to SEQ ID NO: 17075
  Description of Artificial Sequence: Synthetic coding sequence

SEQ ID NO: 17077 - DNA, 384 bp, Artificial Sequence; identical to SEQ ID NO: 17075
  Description of Artificial Sequence: Synthetic coding sequence

SEQ ID NO: 17078 - DNA, 201 bp, Artificial Sequence
  Description of Artificial Sequence: Synthetic coding sequence
atgcccaagagcaaggagctggtgagcagcagcagcagcggcagtgacagcgacagcgaggtggacaagaagctgaagaggaagaagcaggtggcccctgagaagcctgtgaagaagcagaagacaggagagaccagccgggccctgagcagcagcaagcagagcagcagcagcagagatgacaacatgttccaggtgtag

SEQ ID NO: 17079 - DNA, 384 bp, Artificial Sequence; identical to SEQ ID NO: 17075
  Description of Artificial Sequence: Synthetic coding sequence

SEQ ID NO: 17080 - DNA, 384 bp, Artificial Sequence; identical to SEQ ID NO: 17075
  Description of Artificial Sequence: Synthetic coding sequence

SEQ ID NO: 17081 - DNA, 372 bp, Artificial Sequence
  Description of Artificial Sequence: Synthetic coding sequence
atgcccaagagcaaggagctggtgagcagcagcagcagcggcagtgacagcgacagcgaggtggacaagaagctgaagaggaagaagcaggtggcccctgagaagcctgtgaagaagcagaagacaggagagaccagccgggccctgagcagcagcaagcagagcagcagcagcagagatgacaacatgttccagatcggcaagatgagatatgtgtctgtgcgggacttcaagggcaaggtgctgattgacatccgggagtactggatggaccctgagggggagatgaagccaggcaggaagggcatcagcctgaaccctgagcagtggagccagctgaaggagcagatcctggtggccctgtggcagtag

SEQ ID NO: 17082 - DNA, 2241 bp, Artificial Sequence
  Description of Artificial Sequence: Synthetic coding sequence
atggcctggatccgcagcacctgcatcctcttcttcaccctgctgtttgcccacatcgctgctgtgcccatcaagtacctgcctgaggagaatgtgcatgatgctgactttggagagcagaaggacatcagcgagatcaacctggccgccggcctggacctcttccagggcgacatcctgctgcagaagagcagaaatggcctgcgggaccccaacacccgctggaccttccccatcccctacatcctggccgacaacctgggcctgaatgccaagggggccatcctgtatgcctttgagatgttccggctgaagagctgtgtggacttcaagccctatgaaggagagagcagctacatcatcttccagcagtttgatggctgctggagcgaggtgggggaccagcacgtgggccagaacatcagcatcggccagggctgtgcctacaaggccatcattgaacatgagatcctgcacgccctgggcttctaccacgagcagagcaggacagacagagatgattatgtgaacatctggtgggaccagatcctgagcggctaccagcacaactttgacacctatgatgacagcctcatcacagacctgaacaccccctatgactatgagagcctgatgcactaccagcccttctccttcaacaagaatgcctctgtgcccaccatcacagccaagatccctgagttcaacagcatcatcggccagaggctggacttcagcgccatcgacctggagcggctgaacaggatgtacaactgcaccaccacccacaccctgctggaccactgcacctttgagaaggccaacatctgtggcatgatccagggcaccagagatgacacagactgggcccaccaggacagcgcccaggccggggaggtggaccacaccctgctgggccagtgcacaggagctggctacttcatgcagttcagcaccagcagcggcagcgctgaggaggccgccctgctggagagccgcatcctgtaccccaagaggaagcagcagtgcctgcagttcttctacaagatgacaggcagccccagcgaccggctggtggtgtgggtgagaagagatgacagcactggaaatgtgaggaagctggtgaaggtgcagaccttccagggagatgatgaccacaactggaagatcgcccacgtggtgctgaaggaggagcagaagttccgctacctgttccagggcaccaagggggacccccagaacagcactggaggcatctacctggatgacatcaccctgacagagaccccctgccccactggagtgtggacagtgaggaacttcagccaggtgctggagaacaccagcaagggggacaagctgcagagcccccgcttctacaacagcgagggctacggctttggagtgaccctgtaccccaacagccgggagagcagcggctacctgcggctggccttccacgtgtgcagcggggagaatgatgccatcctggagtggcctgtggagaaccggcaggtgatcatcaccatcctggaccaggagccagatgtgaggaacaggatgagcagctccatggtgttcaccaccagcaagagccacaccagccctgccatcaatgacaccgtcatctgggaccggcccagccgggtgggcacctaccacacagactgcaactgcttccgcagcattgacctgggctggagcggcttcatcagccaccagatgctgaagaggaggagcttcctgaagaatgatgacctgatcatctttgtggactttgaggacatcacccacctgagccagacagaggtgcccaccaagggcaagaggctgagcccccagggcctcatcctgcagggccaggagcagcaggtgtctgaggagggcagcggcaaggccatgctggaggaggccctgcctgtgtccctgagccagggccagcccagccggcagaagaggtctgtggagaacacaggccccctggaggaccacaactggccccagtacttccgggacccctgtgaccccaacccctgccagaatgatggcatctgtgtgaatgtgaagggcatggccagctgccgctgcatcagcggccacgccttcttctacacaggagagcgctgccaggccgtgcaggtgcacggctctgtgctgggcatggtgattggaggaacagctggggtcatcttcctgaccttcagcatcatcgccatcctgagccagaggcccaggaagtag

SEQ ID NO: 17083 - DNA, 2826 bp, Artificial Sequence
  Description of Artificial Sequence: Synthetic coding sequence
atggagggcgccagccgggtgtgccggcagggccgggtggccctgcctgctgaggaggactacctgcccctgaagccccgggtgggcaaggccgccaaggagtaccccttcatcctggatgccttccagcgggaggccatccagtgtgtggacaacaaccagagcgtgctggtgtctgcccacaccagcgctgggaagacagtgtgtgccgagtatgccatcgccctggccctgcgggagaagcagagggtcatcttcaccagccccatcaaggccctgagcaaccagaagtaccgggagatgtatgaggagttccaggatgtgggcctgatgactggagatgtgaccatcaaccccacagccagctgcctggtgatgaccacagagatcctgcgctccatgctgtaccggggcagcgaggtgatgagggaggtggcctgggtgatctttgatgagatccactacatgagggacagcgagcggggcgtggtgtgggaggagaccatcatcctgctgcctgacaacgtgcactacgtgttcctgagcgccaccatccccaatgcccggcagtttgctgagtggatctgccacctgcacaagcagccctgccacgtgatctacacagactaccggcccacccccctgcagcactacatcttccctgctggaggagatggcctgcacctggtggtggatgaaaatggagacttccgggaggacaacttcaacacagccatgcaggtgctgagagatgctggggacctggccaagggggaccagaagggcaggaagggcggcaccaagggccccagcaatgtgttcaagatcgtgaagatgatcatggagaggaacttccagcctgtgatcatcttctccttcagcaagaaggactgtgaggcctatgccctgcagatgaccaagctggacttcaacacagatgaggagaagaagatggtggaggaggtgttcagcaatgccatcgactgcctgagtgatgaggacaagaagctgccccaggtggagcacgtgctgcccctgctgaagaggggcatcggcatccaccacggcggcctgctgcccatcctgaaggagaccatcgagatcctcttcagcgagggcctcatcaaggccctgtttgccacagagacctttgccatgggcatcaacatgcctgccaggacagtgctcttcaccaatgccaggaagtttgatggcaaggacttccgctggatcagcagtggagagtacatccagatgagcggccgggccggcagaagaggcatggatgaccggggcatcgtcatcctgatggtggatgagaagatgagccccaccatcggcaagcagctgctgaagggcagcgctgaccccctgaacagcgccttccacctgacctacaacatggtgctgaacctgctgcgggtggaggagatcaaccctgagtacatgctggagaagagcttctaccagttccagcactaccgggccatccctggggtggtggagaaggtgaagaacagcgaggagcagtacaacaagatcgtcatccccaatgaggagagcgtggtgatctactacaagatccggcagcagctggccaagctgggcaaggagattgaggagtacatccacaagcccaagtactgcctgcccttcctgcagcccggccgcctggtgaaggtgaagaatgaaggagatgactttggctggggcgtggtggtgaacttcagcaagaagagcaatgtgaagcccaacagcggggagctggaccccctgtatgtggtggaggtgctgctgcgctgcagcaaggagagcctgaagaacagcgccacagaagctgccaagccagccaagccagatgagaagggggagatgcaggtggtgcctgtgctggtgcacctgctgagcgccatcagctctgtgcggctgtacatccccaaggacctgcggcctgtggacaaccggcagagcgtgctgaagagcatccaggaggtgcagaagcgcttcccagatggcatccccctgctggaccccattgatgacatgggcatccaggaccagggcctgaagaaggtgatccagaaggtggaggcctttgagcacaggatgtacagccaccccctgcacaatgaccccaacctggagaccgtgtacaccctgtgtgagaagaaggcccagatcgccatcgacatcaagagcgccaagcgggagctgaagaaggccaggacagtgctgcagatggatgagctgaagtgcaggaagagggtgctgcggcggctgggctttgccaccagcagtgatgtgattgagatgaagggccgggtggcctgtgagatcagcagcgcagatgagctgctgctgacagagatgatgtttaatggcctcttcaatgacctgtctgctgagcaggccacagccctgctgagctgctttgtgttccaggagaacagcagcgagatgcccaagctgacagagcagctggccggccccctgcggcagatgcaggagtgtgccaagagaattgccaaggtgtctgctgaggccaagctggagattgatgaggagacctacctgagcagcttcaagccccacctgatggatgtggtgtacacctgggccaccggggccacctttgcccacatctgcaagatgacagatgtgtttgagggcagcatcatccgctgcatgaggcggctggaggagctgctgcggcagatgtgccaggccgccaaggccatcggcaacacagagctggagaacaagtttgctgagggcatcaccaagatcaagagggacatcgtgtttgctgccagcctgtacctgtag

SEQ ID NO: 17084 - DNA, 3144 bp, Artificial Sequence
  Description of Artificial Sequence: Synthetic coding sequence
atggatgctgaggccgaggacaagaccctgcggaccaggagcaaaggaacagaggtgcccatggacagcctcatccaggagctgtctgtggcctatgactgcagcatggccaagaagaggacagctgaggaccaggccctgggcgtgcctgtgaacaagaggaagagcctgctgatgaagcccaggcactacagccccaaggctgactgccaggaggacagaagtgacagaacagaagatgatggccccctggagacccacggccacagcacagctgaggagatcatgatcaagcccatggatgagagcctgctgagcacagcccaggagaacagcagcaggaaggaggaccgctacagctgctaccaggagctgatggtgaagagcctgatgcacctgggcaagtttgagaagaatgtgtctgtgcagacagtgtctgagaacctgaatgacagcggcatccagagcctgaaggccgagagtgatgaagcagatgagtgcttcctgatccacagtgatgatggccgggacaagattgatgacagccagccccccttctgcagcagtgatgacaatgaaagcaacagcgagagcgcagaaaatggctgggacagcggcagcaacttcagcgaggagaccaagccaccccgggtgcccaagtatgtgctgacagaccacaagaaggacctgctggaggtgcctgagatcaagacagaaggagacaagttcatcccctgtgaaaatagatgtgacagcgagacagagaggaaggacccccagaatgccctggccgagcccctggatggaaatgcccagcccagcttcccagatgtggaggaggaggacagcgagagcctggccgtgatgacagaggagggcagtgacctggagaaggccaagggcaacctgagcctgctggagcaggccatcgccctgcaggccgagcggggctgtgtgttccacaacacctacaaggagctggaccgcttcctgctggagcacctggccggggagcggcggcagaccaaggtgattgacatgggcggccggcagatcttcaacaacaagcacagccccaggcctgagaagcgggagaccaagtgccccatccctggctgtgatggcaccggccacgtgacaggcctgtacccccaccacaggagcctgagcggctgcccccacaaggtgcgggtgcccctggagatcctggccatgcatgaaaatgtgctgaagtgccccaccccaggctgcaccggccggggccacgtgaacagcaacagaaacacccacaggagcctgagcggctgccccatcgctgctgctgagaagctggccatgagccaggacaagaaccagctggacagcccccagacaggccagtgcccagaccaggcccacaggaccagcctggtgaagcagatcgagttcaacttccccagccaggccatcaccagcccccgggccaccgtgtccaaggagcaggagaagtttgggaaggtgccctttgattatgccagctttgatgcccaggtgtttgggaagaggcccctcatccagacagtgcagggcaggaagaccccacccttccctgagagcaagcacttccccaaccctgtgaagttccccaaccggctgcccagcgctggggcccacacccagagccctggccgggccagcagctacagctatggccagtgcagcgaggacacccacatcgctgctgctgctgccatcctgaacctgagcacccgctgccgggaggccacagacatcctgagcaacaagccccagagcctgcacgccaagggagctgagattgaggtggatgaaaatggcaccctggacctgtccatgaagaagaaccgcatcctggacaagagcgcccccctgaccagcagcaacaccagcatccccacccccagcagcagccccttcaagaccagcagcatcctggtgaatgctgccttctaccaggccctgtgtgaccaggagggctgggacacccccatcaactacagcaagacccacggcaagacagaggaggagaaggagaaggaccctgtgagcagcctggagaacctggaggagaagaagtttcctggagaggccagcatccccagccccaagcccaagctgcacgcccgggacctgaagaaggagctgatcacctgccccaccccaggctgtgatggcagcggccacgtgacaggcaactatgccagccacaggtctgtgtctggctgccccctggccgacaagaccctgaagagcctgatggccgccaacagccaggagctgaagtgccccaccccaggctgtgatggcagcggccacgtgacaggcaactatgccagccacaggagcctgagcggctgcccccgggccaggaaaggaggagtgaagatgacccccaccaaggaggagaaggaggaccctgagctgaagtgccctgtgattggctgtgatggccagggccacatcagcggcaagtacaccagccacaggacagccagcggctgccccctggccgccaagaggcagaaggagaaccccctgaatggagccagcctgtcctggaagctgaacaagcaggagctgccccactgccccctgcccggctgcaatggcctgggccacgtgaacaacgtgtttgtgacccacaggagcctgagcggctgccccctgaatgcccaggtgatcaagaagggcaaggtgtctgaggagctgatgaccatcaagctgaaggccactggaggcatcgagagtgatgaggagatccgccacctggatgaggagatcaaggagctgaatgaaagcaacctgaagattgaagctgacatgatgaagctgcagacccagatcacctccatggagagcaacctgaagaccatcgaggaggagaacaagctgattgagcagaacaatgaaagcctgctgaaggagctggccggcctgagccaggccctgatcagcagcctggccgacatccagctgccccagatgggccccatcagcgagcagaactttgaggcctacgtgaacaccctgacagacatgtacagcaacctggagcgggactacagccctgagtgcaaggccctgctggagagcatcaagcaggccgtgaagggcatccacgtgtag

SEQ ID NO: 17085 - DNA, 1863 bp, Artificial Sequence
  Description of Artificial Sequence: Synthetic coding sequence
atggatgctgaggccgaggacaagaccctgcggaccaggagcaaaggaacagaggtgcccatggacagcctcatccaggagctgtctgtggcctatgactgcagcatggccaagaagaggacagctgaggaccaggccctgggcgtgcctgtgaacaagaggaagagcctgctgatgaagcccaggcactacagccccaaggctgactgccaggaggacagaagtgacagaacagaagatgatggccccctggagacccacggccacagcacagctgaggagatcatgatcaagcccatggatgagagcctgctgagcacagcccaggagaacagcagcaggaaggaggaccgctacagctgctaccaggagctgatggtgaagagcctgatgcacctgggcaagtttgagaagaatgtgtctgtgcagacagtgtctgagaacctgaatgacagcggcatccagagcctgaaggccgagagtgatgaagcagatgagtgcttcctgatccacagtgatgatggccgggacaagattgatgacagccagccccccttctgcagcagtgatgacaatgaaagcaacagcgagagcgcagaaaatggctgggacagcggcagcaacttcagcgaggagaccaagccaccccgggtgcccaagtatgtgctgacagaccacaagaaggacctgctggaggtgcctgagatcaagacagaaggagacaagttcatcccctgtgaaaatagatgtgacagcgagacagagaggaaggacccccagaatgccctggccgagcccctggatggaaatgcccagcccagcttcccagatgtggaggaggaggacagcgagagcctggccgtgatgacagaggagggcagtgacctggagaaggccaagggcaacctgagcctgctggagcaggccatcgccctgcaggccgagcggggctgtgtgttccacaacacctacaaggagctggaccgcttcctgctggagcacctggccggggagcggcggcagaccaaggtgattgacatgggcggccggcagatcttcaacaacaagcacagccccaggcctgagaagcgggagaccaagtgccccatccctggctgtgatggcaccggccacgtgacaggcctgtacccccaccacaggagcctgagcggctgcccccacaaggtgcgggtgcccctggagatcctggccatgcatgaaaatgtgctgaagtgccccaccccaggctgcaccggccggggccacgtgaacagcaacagaaacacccacaggagcctgagcggctgccccatcgctgctgctgagaagctggccatgagccaggacaagaaccagctggacagcccccagacaggccagtgcccagaccaggcccacaggaccagcctggtgaagcagatcgagttcaacttccccagccaggccatcaccagcccccgggccaccgtgtccaaggagcaggagaagtttgggaaggtgccctttgattatgccagctttgatgcccaggtgtttgggaagaggcccctcatccagacagtgcagggcaggaagaccccacccttccctgagagcaagcacttccccaaccctgtgaagttccccaaccggctgcccagcgctggggcccacacccagagccctggccgggccagcagctacagctatggccagtgcagcgaggacacccacatcgctgctgctgctgccatcctgaacctgagcacccgctgccgggaggccacagacatcctgagcaacaagccccagagcctgcacgccaagggagctgagattgaggtggatgaaaatggcaccctggacctgtccatgaagaagtag

SEQ ID NO: 17086 - DNA, 42 bp, Artificial Sequence
  Description of Artificial Sequence: Synthetic coding sequence
atggatgctgaggccgaggacaagaccctgcggaccaggtag

SEQ ID NO: 17087 - DNA, 990 bp, Artificial Sequence
  Description of Artificial Sequence: Synthetic coding sequence
atgtctgctgctggcctgctggccccagccccagcccaggccggggcccccccagcccctgagtactacccagaggaggatgaggagctggagagcgcagaagatgatgagaggagctgccggggccgggagagtgatgaggacacagaagatgccagcgagacagacctggccaagcatgatgaagaagattatgtggagatgaaggagcagatgtaccaggacaagctggccagcctgaagaggcagctgcagcagctgcaggagggcaccctgcaggagtaccagaagaggatgaagaagctggaccagcagtacaaggagcgcatcagaaatgctgacaccctgctgctgcaggcccagacagagcaggtggagaggaactacatcaaggagaagaaggctgctgtgaaggagtttgaggacaagaaggtggagctgaaggagaacctgattgctgagctggaggagaagaagaagatgattgaaaatgagaagctgaccatggagctgaccggggacagcatggaggtgaagcccatcatgaccaggaagctgcggcggcggcccaatgaccctgtgcccatcccagacaagaggaggaagccagccccagcccagctgaactacctgctgacagatgagcagatcatggaggacctgcggaccctgaacaagctgaagagccccaagaggcctgccagccccagcagccctgagcacctgcctgccaccccagctgagagccctgcccagagatttgaggccagaattgaagatggcaagctgtactatgacaagcgctggtaccacaagagccaggccatctacctggagagcaaggacaaccagaagctgagctgtgtgatcagctctgtgggcgccaatgagatctgggtgaggaagaccagtgacagcaccaagatgaggatctacctgggccagctgcagaggggcctgtttgtgatcagaagaagatctgctgcctag

SEQ ID NO: 17088 - DNA, 987 bp, Artificial Sequence
  Description of Artificial Sequence: Synthetic coding sequence
atgtctgctgctggcctgctggccccagccccagcccaggccggggcccccccagcccctgagtactacccagaggaggatgaggagctggagagcgcagaagatgatgagaggagctgccggggccgggagagtgatgaggacacagaagatgccagcgagacagacctggccaagcatgatgaagaagattatgtggagatgaaggagcagatgtaccaggacaagctggccagcctgaagaggcagctgcagcagctgcaggagggcaccctgcaggagtaccagaagaggatgaagaagctggaccagcagtacaaggagcgcatcagaaatgctgagctgttcctgcagctggagacagagcaggtggagaggaactacatcaaggagaagaaggctgctgtgaaggagtttgaggacaagaaggtggagctgaaggagaacctgattgctgagctggaggagaagaagaagatgattgaaaatgagaagctgaccatggagctgactggagacagcatggaggtgaagcccatcatgaccaggaagctgcggcggcggcccaatgaccctgtgcccatcccagacaagaggaggaagccagccccagcccagctgaactacctgctgacagatgagcagatcatggaggacctgcggaccctgaacaagctgaagagccccaagaggcctgccagccccagcagccctgagcacctgcctgccaccccagctgagagccctgcccagagatttgaggccagaattgaagatggcaagctgtactatgacaagcgctggtaccacaagagccaggccatctacctggagagcaaggacaaccagaagctgagctgtgtgatcagctctgtgggcgccaatgagatctgggtgaggaagaccagtgacagcaccaagatgaggatctacctgggccagctgcagaggggcctcttcgtcatcagaagaagatctgctgcctag

SEQ ID NO: 17089 - DNA, 591 bp, Artificial Sequence
  Description of Artificial Sequence: Synthetic coding sequence
atggccagcaatgtgaccaacaagacagaccccctcttcagcagcagctttgacctggactatgacttccagagggactactatgacaggatgtacagctacccagcccgggtgcccccacctccacccatcgcccgggctgtggtgcccagcaagaggcagagggtgtctggcaacaccagccggcggggcaagagcggcttcaacagcaagagcggccagaggggcagcagcaagagcggcaagctgaagggagatgacctgcaggccatcaagaaggagctgacccagatcaagcagaaggtggacagcctgctggagaacctggagaagattgagaaggagcagagcaagcaggccgtggagatgaagaatgacaagtctgaggaggagcagagcagcagctctgtgaagaaggatgagaccaacgtgaagatggagagcgagggcggcgcagatgattctgctgaggagggggacctgctggatgatgatgacaatgaagatagaggagatgaccaggtgaagaccaccgggaaggagaggaagcgctggtggaggggggcccagggccacatggagtgcctgtag

SEQ ID NO: 17090 - DNA, 1197 bp, Artificial Sequence
  Description of Artificial Sequence: Synthetic coding sequence
atggctgtgaccctggacaaggatgcctactaccgccgggtgaagaggctgtacagcaactggaggaaaggagaagatgaatatgccaacgtggatgccatcgtggtgtctgtgggcgtggatgaggagatcgtgtatgccaagagcacagccctgcagacctggctgtttggctatgagctgacagacaccatcatggtgttctgtgatgacaagatcatcttcatggccagcaagaagaaggtggagttcctgaagcagatcgccaacaccaagggaaatgaaaatgccaacggggccccagccatcaccctgctgatccgggagaagaatgaaagcaacaagagcagctttgacaagatgattgaggccatcaaggagagcaagaatggcaagaagattggagtcttcagcaaggacaagtttcctggagagttcatgaagtcctggaatgactgcctgaacaaggagggctttgacaagattgacatctctgctgtggtggcctacaccatcgctgtgaaggaggatggagagctgaacctgatgaagaaggccgccagcatcaccagcgaggtgttcaacaagttcttcaaggagcgggtgatggagatcgtggatgctgatgagaaggtgcgccacagcaagctggccgagagcgtggagaaggccatcgaggagaagaagtacctggccggggctgaccccagcacagtggagatgtgctacccacccatcatccagagcggcggcaactacaacctgaagttctctgtggtgtctgacaagaaccacatgcactttggagccatcacctgtgccatgggcatccgcttcaagagctactgcagcaacctggtgaggaccctgatggtggaccccagccaggaggtgcaggagaactacaacttcctgctgcagctgcaggaggagctgctgaaggagctgcggcatggagtgaagatctgtgatgtgtacaatgctgtgatggatgtggtgaagaagcagaagccagagctgctgaacaagatcaccaagaacctgggcttcggcatgggcatcgagttccgggagggcagcctggtgatcaacagcaagaaccagtacaagctgaagaagggcatggtgttcagcatcaacctgggcttcagtgacctgaccaacaagaagaagaagaagaagaagaaggccaagtag

SEQ ID NO: 17091 - DNA, 954 bp, Artificial Sequence
  Description of Artificial Sequence: Synthetic coding sequence
atgaacaacacagctgccagccccatgagcacagccaccagcagcagcggccgcagcacaggcaagagcatcagctttgccacagagctgcagagcatgatgtacagcctgggagatgcccggcggcccctgcatgaaacagctgtgctggtggaggatgtggtgcacacccagctgatcaacctgctgcagcaggccgctgaggtgtcccagctgcggggggcccgggtcatcaccccagaggacctgctcttcctgatgaggaaggacaagaagaagctgcggcggctgctgaagtacatgttcatccgggactacaagagcaagatcgtgaagggcattgatgaagatgacctgctggaggacaagctgagcggcagcaacaatgccaacaagaggcagaagatcgcccaggacttcctgaacagcattgaccagacaggagagctgctggccatgtttgaagatgatgaaattgatgaggtgaagcaggagaggatggagcgggcagagcggcagacccgcatcatggattctgcccagtatgcagagttctgtgagagccggcagctgtccttcagcaagaaggccagcaagttccgggactggctggactgcagctccatggagatcaagcccaacgtggtggccatggagatcctggcctacctggcctatgagaccgtggcccagctggtggacctggccctgctggtgcggcaggacatggtgaccaaggccggggaccccttcagccacgccatcagcgccaccttcatccagtaccacaacagcgctgagagcacagctgcctgtggggtggaggcccacagtgatgccatccagccctgccacatccgggaggccatccgccgctacagccacagaattggccccctgagccccttcaccaatgcctacagaagaaatggcatggccttcctggcctgctag

SEQ ID NO: 17092 - DNA, 327 bp, Artificial Sequence
  Description of Artificial Sequence: Synthetic coding sequence
atggagatcctggcctacctggcctatgaaacagtggcccagctggtggacctggccctgctggtgcggcaggacatggtgaccaaggccggggaccccttcagccacgccatcagcgccaccttcatccagtaccacaacagcgctgagagcacagctgcctgtggggtggaggcccacagtgatgccatccagccctgccacatccgggaggccatccgccgctacagccaccgcatcggccccctgagccccttcaccatctccttcagcctgacagagtgcctgccccaggagtgggatggcttcagcagcctgctgatgtag

SEQ ID NO: 17093 - DNA, 954 bp, Artificial Sequence; identical to SEQ ID NO: 17091
  Description of Artificial Sequence: Synthetic coding sequence

SEQ ID NO: 17094 - DNA, 987 bp, Artificial Sequence
  Description of Artificial Sequence: Synthetic coding sequence
atggtggtgtttggcaccaccttcttcaactttgacagcttcatcggcaagacagacagcattgagatcatcggcaagtctgtgttcccctactgctaccacaacatcctgcccctgctgaatgattctggccgctacagcctgggagatgcccggcggcccctgcacgagacagctgtgctggtggaggatgtggtgcacacccagctgatcaacctgctgcagcaggccgctgaggtgtcccagctgcggggggcccgggtcatcaccccagaggacctgctcttcctgatgaggaaggacaagaagaagctgcggcggctgctgaagtacatgttcatccgggactacaagagcaagatcgtgaagggcattgatgaagatgacctgctggaggacaagctgagcggcagcaacaatgccaacaagaggcagaagatcgcccaggacttcctgaacagcattgaccagacaggagagctgctggccatgtttgaagatgatgaaattgatgaggtgaagcaggagaggatggagagagctgagcggcagacccgcatcatggacagcgcccagtatgcagagttctgtgagagccggcagctgtccttcagcaagaaggccagcaagttccgggactggctggactgcagctccatggagatcaagcccaacgtggtggccatggagatcctggcctacctggcctatgaaacagtggcccagctggtggacctggccctgctggtgcggcaggacatggtgaccaaggccggggaccccttcagccacgccatcagcgccaccttcatccagtaccacaacagcgctgagagcacagctgcctgtggggtggaggcccacagtgatgccatccagccctgccacatccgggaggccatccgccgctacagccaccgcatcggccccctgagccccttcaccaatgcctacagaagaaatggcatggccttcctggcctgctag

SEQ ID NO: 17095 - DNA, 987 bp, Artificial Sequence; identical to SEQ ID NO: 17094
  Description of Artificial Sequence: Synthetic coding sequence

SEQ ID NO: 17096 - DNA, 954 bp, Artificial Sequence; identical to SEQ ID NO: 17091
  Description of Artificial Sequence: Synthetic coding sequence

SEQ ID NO: 17097 - DNA, 624 bp, Artificial Sequence
  Description of Artificial Sequence: Synthetic coding sequence
atggccggccctgccacccagagccccatgaagctgatggccctgcagctgctgctgtggcacagcgccctgtggacagtgcaggaggccacccccctgggccctgccagcagcctgccccagagcttcctgctgaagtgcctggagcaggtgaggaagatccagggagatggagctgccctgcaggagaagctggtgtctgaatgtgccacctacaagctgtgccaccctgaggagctggtgctgctgggccacagcctgggcatcccctgggcccccctgagcagctgccccagccaggccctgcagctggccggctgcctgagccagctgcacagcggcctcttcctgtaccagggcctgctgcaggccctggagggcatcagccctgagctgggccccaccctggacaccctgcagctggatgtggccgactttgccaccaccatctggcagcagatggaggagctgggcatggccccagccctgcagcccacccagggcgccatgcctgcctttgccagcgccttccagaggagagctggaggagtgctggtggccagccacctgcagagcttcctggaggtgtcctacagagtgctgcggcacctggcccagccctag

SEQ ID NO: 17098 - DNA, 2220 bp, Artificial Sequence
  Description of Artificial Sequence: Synthetic coding sequence
atggccccccagaagcacggcggcggcggcggcggcggcagcggccccagcgctggcagcggcggcggcggctttggaggcagcgctgctgtggccgccgccacagccagcggcggcaagagcggcggcggcagctgtggcggcggcggcagctacagcgccagcagcagcagcagcgctgctgctgctgctggagctgctgtgctgcctgtgaagaagcccaagatggagcacgtgcaggccgaccacgagctgttcctgcaggcctttgagaagcccacccagatctaccgcttcctgcggaccaggaacctgattgcccccatcttcctgcacaggaccctgacctacatgagccacaggaacagcaggaccaacatcaagaggaagaccttcaaggtggatgacatgctgagcaaggtggagaagatgaagggggagcaggagagccacagcctgagcgcccacctgcagctgaccttcaccggcttcttccacaagaatgacaagcccagccccaacagtgaaaatgagcagaacagcgtgaccctggaggtgctgctggtgaaggtgtgccacaagaagaggaaggatgtgtcctgccccatccggcaggtgcccaccgggaagaagcaggtgcccctgaacccagacctgaaccagaccaagccaggcaacttccccagcctggccgtgagcagcaatgaatttgagcccagcaacagccacatggtgaagagctacagcctgctcttccgggtgaccaggcctggaagaagagagttcaacggcatgatcaatggagagaccaatgaaaatattgatgtgaatgaggagctgcctgcccggaggaagaggaacagagaagatggagagaagacctttgtggcccagatgacagtgtttgacaagaacagaaggctgcagctgctggatggagaatatgaggtggccatgcaggagatggaggagtgccccatcagcaagaagagggccacctgggagaccatcctggatggcaagaggctgcccccatttgagaccttcagccagggccccaccctgcagttcaccctgcgctggacaggagagaccaatgacaagagcacagcccccatcgccaagcccctggccaccaggaacagcgagagcctgcaccaggagaacaagccaggctctgtgaagcccacccagaccatcgctgtgaaggagagcctgaccacagacctgcagaccaggaaggagaaggacaccccaaatgaaaatcggcagaagctgcgcatcttctaccagttcctgtacaacaacaacacccggcagcagacagaggccagagatgacctgcactgcccctggtgcaccctgaactgcaggaagctgtacagcctgctgaagcacctgaagctgtgccacagccgcttcatcttcaactacgtgtaccaccccaagggggccagaattgatgtgtccatcaatgaatgttatgatggcagctatgccggcaacccccaggacatccaccggcagcccggctttgccttcagcagaaatggacctgtgaagaggacccccatcacccacatcctggtgtgccggcccaagaggaccaaggcctccatgtctgagttcctggagagtgaagatggagaggtggagcagcagaggacctacagcagcggccacaaccggctgtacttccacagcgacacctgcctgcccctgcggccccaggagatggaggtggacagtgaagatgagaaggaccctgagtggctgcgggagaagaccatcacccagatcgaggagttcagtgatgtgaatgaaggagagaaggaggtgatgaagctgtggaacctgcacgtgatgaagcacggcttcatcgctgacaaccagatgaaccacgcctgcatgctgtttgtggagaactacggccagaagatcatcaagaagaacctgtgcaggaacttcatgctgcacctggtgtccatgcatgacttcaacctgatcagcatcatgagcattgacaaggctgtgaccaagctgcgggagatgcagcagaagctggagaagggggagagcgccagccctgccaatgaggagatcacagaggagcagaatggaacagccaacggcttcagcgagatcaacagcaaggagaaggccctggagacagacagcgtgtctggagtgtccaagcagagcaagaagcagaagctgtag

SEQ ID NO: 17099 - DNA, 1938 bp, Artificial Sequence
  Description of Artificial Sequence: Synthetic coding sequence
atgagcctgaagatggacaacagagatgtggccggcaaggccaaccgctggtttggagtggccccacccaagagcggcaagatgaacatgaacatcctgcaccaggaggagctgattgcccagaagaagcgggagattgaggccaagatggagcagaaggccaagcagaaccaggtggccagcccccagcccccccaccctggagagatcaccaatgcccacaacagcagctgcatcagcaacaagtttgccaatgatggcagcttcctgcagcagttcctgaagctgcagaaggcccagaccagcacagatgcccccaccagcgcccccagcgccccacccagcacccccacccccagcgctgggaagaggagcctgctgatcagcagaagaacaggcctgggcctggccagcctgcccggccctgtgaagagctacagccacgccaagcagctgcctgtggcccaccggcccagcgtcttccagagcccagatgaagatgaggaggaggactatgagcagtggctggagatcaaggtgagccccccagagggcgctgagaccaggaaggtgattgagaagctggccaggtttgtggccgagggcggccctgagctggagaaggtggccatggaggactacaaggacaacccagcctttgccttcctgcatgacaagaacagccgggagttcctgtactacaggaagaaggtggccgagatcaggaaggaggcccagaagagccaggccgccagccagaaggtgtccccaccagaagatgaggaggtgaagaacctggccgagaagctggcccgcttcatcgcagatggcggccctgaggtggagaccatcgccctgcagaacaaccgggagaaccaggccttctccttcctgtatgagcccaacagccagggctacaagtactaccggcagaagctggaggagttcaggaaggccaaggccagcagcacaggcagcttcaccgccccagaccccggcctgaagaggaagagccccccagaggccctgagcggcagcctgcccccagccaccacctgcccagccagcagcaccccagcccccaccatcatcccagccccagctgcccctgggaagccagccagcgctgccaccgtgaagaggaagaggaagagccgctggggccctgaggaggacaaggtggagctgcccccagctgagctggtgcagagagatgtggatgccagccccagccccctgtctgtgcaggacctgaagggcctgggctatgagaagggcaagcctgtgggcctggtgggcgtgacagagctgagtgatgcccagaagaagcagctgaaggagcagcaggagatgcagcagatgtatgacatgatcatgcagcacaagagggccatgcaggacatgcagctgctgtgggagaaggctgtgcagcagcaccagcacggctatgacagtgatgaggaggtggacagcgagctgggcacctgggagcaccagctgcggaggatggagatggacaagacccgggagtgggccgagcagctgaccaagatgggccggggcaagcacttcatcggggacttcctgcccccagatgagctggagaagttcatggagaccttcaaggccctgaaggagggccgggagccagactacagcgagtacaaggagttcaagctgactgtggagaacatcggctaccagatgctgatgaagatgggctggaaggagggggagggcctgggcagcgagggccagggcatcaagaaccctgtgaacaagggcaccaccaccgtggatggagctggcttcggcatcgacaggcctgctgagctgagcaaagaagatgatgaatatgaggccttcaggaagaggatgatgctggcctaccgcttccggcccaaccccctgaacaacccccggcggccctactactag

SEQ ID NO: 17100 - DNA, 669 bp, Artificial Sequence
  Description of Artificial Sequence: Synthetic coding sequence
atgagcctgaagatggacaacagagatgtggccggcaaggccaaccgctggtttggagtggccccacccaagagcggcaagatgaacatgaacatcctgcaccaggaggagctgattgcccagaagaagcgggagattgaggccaagatggagcagaaggccaagcagaaccaggtggccagcccccagcccccccaccctggagagatcaccaatgcccacaacagcagctgcatcagcaacaagtttgccaatgatggcagcttcctgcagcagttcctgaagctgcagaaggcccagaccagcacagatgcccccaccagcgcccccagcgccccacccagcacccccacccccagcgctgggaagaggagcctgctgatcagcagaagaacaggcctgggcctggccagcctgcccggccctgtgaagagctacagccacgccaagcagctgcctgtggcccaccggcccagcgtcttccagagcccagatgaagatgaggaggaggactatgagcagtggctggagatcaaggtgtgcctgaccaagacagtgcggcccaccccacccagctcctggtgctttgtgcccggcctgggcaccccagacagcctgctgcacctgaccctcttcagcccccaccccctgtgccgctgtggcccctag

SEQ ID NO: 17101 - DNA, 558 bp, Artificial Sequence
  Description of Artificial Sequence: Synthetic coding sequence
atgagcctgaagatggacaacagagatgtggccggcaaggccaaccgctggtttggagtggccccacccaagagcggcaagatgaacatgaacatcctgcaccaggaggagctgattgcccagaagaagcgggagattgaggccaagatggagcagaaggccaagcagaaccaggtggccagcccccagcccccccaccctggagagatcaccaatgcccacaacagcagctgcatcagcaacaagtttgccaatgatggcagcttcctgcagcagttcctgaagctgcagaaggcccagaccagcacagatgcccccaccagcgcccccagcgccccacccagcacccccacccccagcgctgggaagaggagcctgctgatcagcagaagaacaggcctgggcctggccagcctgcccggccctgtgaagagctacagccacgccaagcagctgcctgtggcccaccggcccagcgtcttccagagcccagatgaagatgaggaggaggactatgagcagtggctggagatcaagggccgccgctggctgaggtag

SEQ ID NO: 17102 - DNA, 3093 bp, Artificial Sequence
  Description of Artificial Sequence: Synthetic coding sequence
atggccgcccggcgcatcacccaggagacctttgatgctgtgctgcaggagaaggccaagcgctaccacatggatgccagcggggaggccgtgtctgagaccctgcagttcaaggcccaggacctgctgcgggctgtgcccaggagcagagctgagatgtatgatgatgtgcacagtgatggccgctacagcctgagcggctctgtggcccacagcagagatgctggccgggagggcctgcggagtgatgtgtttcctggccccagcttccgcagcagcaaccccagcatcagtgatgacagctacttcagaaaagaatgtggccgggacctggagttcagccacagcgacagccgggaccaggtgattggccacaggaagctgggccacttccgcagccaggactggaagtttgccctgcggggctcctgggagcaggactttggccaccctgtgtcccaggagagctcctggagccaggagtacagctttggccccagcgctgtgctgggggactttggcagcagccggctgattgagaaggagtgcctggagaaggagagccgggactatgatgtggaccaccctggagaggccgacagcgtgctgcggggcggcagccaggtgcaggcccggggccgggccctgaacatcgtggaccaggagggcagcctgctgggcaagggggagacccagggcctgctgacagccaagggcggcgtgggcaagctggtgaccctgagaaatgtgtccaccaagaagatccccaccgtgaaccgcatcacccccaagacccagggcaccaaccagatccagaagaacacccccagcccagatgtgaccctgggcaccaaccctggaacagaggacatccagttccccatccagaagatccccctgggcctggacctgaagaacctgcggctgcccaggaggaagatgagctttgacatcatcgacaagagtgatgtgttcagccgcttcggcatcgagatcatcaagtgggccggcttccacaccatcaaggatgacatcaagttcagccagctgttccagaccctgtttgagctggagacagagacctgtgccaagatgctggccagcttcaagtgcagcctgaagccagagcaccgggacttctgcttcttcaccatcaagttcctgaagcacagcgccctgaagaccccccgggtggacaatgagttcctgaacatgctgctggacaagggagctgtgaagaccaagaactgcttctttgagatcatcaagccctttgacaagtacatcatgaggctgcaggaccggctgctgaagtctgtgacccccctgctgatggcctgcaatgcctatgagctgtctgtgaagatgaagaccctgagcaaccccctggacctggccctggccctggagaccaccaacagcctgtgcaggaagagcctggccctgctgggccagaccttcagcctggccagcagcttccggcaggagaagatcctggaggccgtgggcctgcaggacatcgcccccagccctgctgccttccccaactttgaggacagcaccctgtttggccgggagtacatcgaccacctgaaggcctggctggtgagcagcggctgccccctgcaggtgaagaaggccgagcctgagcccatgagggaggaggagaagatgatcccccccaccaagccagagatccaggccaaggcccccagcagcctgagtgatgctgtgccccagagagctgaccaccgggtggtgggcaccatcgaccagctggtgaagagggtcatcgagggcagcctgagccccaaggagaggaccctgctgaaggaggaccctgcctactggttcctgagtgatgagaacagcctggagtacaagtactacaagctgaagctggccgagatgcagaggatgtctgagaacctgcggggagctgaccagaagcccaccagcgctgactgtgctgtgcgggccatgctgtacagcagagctgtgaggaacctgaagaagaagctgctgccctggcagaggcggggcctgctgcgggcccagggcctgcggggctggaaggcccggcgggccaccaccggcacccagaccctgctgagcagcggcacccggctgaagcaccacggccggcaggcccctggcctgagccaggccaagcccagcctgcctgacagaaatgatgctgccaaggactgccccccagaccctgtgggccccagcccccaggaccccagcctggaggccagcggccccagccccaagccagctggggtggacatcagcgaggccccccagaccagcagcccctgccccagcgctgacatcgacatgaagaccatggagacagctgagaagctggccaggtttgtggcccaggtgggccctgagattgagcagttcagcattgagaacagcacagacaacccagacctgtggttcctgcatgaccagaacagcagcgccttcaagttctacaggaagaaggtgtttgagctgtgccccagcatctgcttcaccagcagcccccacaacctgcacactggaggaggagacaccaccggcagccaggagagccctgtggacctgatggagggggaggccgagtttgaagatgagcccccaccccgggaggccgagctggagagccctgaggccagcagcggcacctgcttccccaggaagaggatcagcagcaagagcctgaaggtgggcatgatcccagcccccaagagggtgtgcctgatccaggagcccaaggtgcatgagcctgtgagaattgcctatgaccggccccggggccggcccatgagcaagaagaagaagcccaaggacctggactttgcccagcagaagctgacagacaagaacctgggcttccagatgctgcagaagatgggctggaaggagggccacggcctgggcagcctgggcaagggcatccgggagcctgtgtctgtgggcaccccatctgagggggagggcctgggcgcagatggccaggagcacaaggaggacacctttgatgtgttccggcagaggatgatgcagatgtaccgccacaagagggccaacaagtag

SEQ ID NO: 17103 - DNA, 3249 bp, Artificial Sequence
  Description of Artificial Sequence: Synthetic coding sequence
atggccgcccggcgcatcacccaggagacctttgatgctgtgctgcaggagaaggccaagcgctaccacatggatgccagcggggaggccgtgtctgagaccctgcagttcaaggcccaggacctgctgcgggctgtgcccaggagcagagctgagatgtatgatgatgtgcacagtgatggccgctacagcctgagcggctctgtggcccacagcagagatgctggccgggagggcctgcggagtgatgtgtttcctggccccagcttccgcagcagcaaccccagcatcagtgatgacagctacttcagaaaagaatgtggccgggacctggagttcagccacagcgacagccgggaccaggtgattggccacaggaagctgggccacttccgcagccaggactggaagtttgccctgcggggctcctgggagcaggactttggccaccctgtgtcccaggagagctcctggagccaggagtacagctttggccccagcgctgtgctgggggactttggcagcagccggctgattgagaaggagtgcctggagaaggagagccgggactatgatgtggaccaccctggagaggccgacagcgtgctgcggggcggcagccaggtgcaggcccggggccgggccctgaacatcgtggaccaggagggcagcctgctgggcaagggggagacccagggcctgctgacagccaagggcggcgtgggcaagctggtgaccctgagaaatgtgtccaccaagaagatccccaccgtgaaccgcatcacccccaagacccagggcaccaaccagatccagaagaacacccccagcccagatgtgaccctgggcaccaaccctggaacagaggacatccagttccccatccagaagatccccctgggcctggacctgaagaacctgcggctgcccaggaggaagatgagctttgacatcatcgacaagagtgatgtgttcagccgcttcggcatcgagatcatcaagtgggccggcttccacaccatcaaggatgacatcaagttcagccagctgttccagaccctgtttgagctggagacagagacctgtgccaagatgctggccagcttcaagtgcagcctgaagccagagcaccgggacttctgcttcttcaccatcaagttcctgaagcacagcgccctgaagaccccccgggtggacaatgagttcctgaacatgctgctggacaagggagctgtgaagaccaagaactgcttctttgagatcatcaagccctttgacaagtacatcatgaggctgcaggaccggctgctgaagtctgtgacccccctgctgatggcctgcaatgcctatgagctgtctgtgaagatgaagaccctgagcaaccccctggacctggccctggccctggagaccaccaacagcctgtgcaggaagagcctggccctgctgggccagaccttcagcctggccagcagcttccggcaggagaagatcctggaggccgtgggcctgcaggacatcgcccccagccctgctgccttccccaactttgaggacagcaccctgtttggccgggagtacatcgaccacctgaaggcctggctggtgagcagcggctgccccctgcaggtgaagaaggccgagcctgagcccatgagggaggaggagaagatgatcccccccaccaagccagagatccaggccaaggcccccagcagcctgagtgatgctgtgccccagagagctgaccaccgggtggtgggcaccatcgaccagctggtgaagagggtcatcgagggcagcctgagccccaaggagaggaccctgctgaaggaggaccctgcctactggttcctgagtgatgagaacagcctggagtacaagtactacaagctgaagctggccgagatgcagaggatgtctgagaacctgcggggagctgaccagaagcccaccagcgctgactgtgctgtgcgggccatgctgtacagcagagctgtgaggaacctgaagaagaagctgctgccctggcagaggcggggcctgctgcgggcccagggcctgcggggctggaaggcccggcgggccaccaccggcacccagaccctgctgagcagcggcacccggctgaagcaccacggccggcaggcccctggcctgagccaggccaagcccagcctgcctgacagaaatgatgctgccaaggactgccccccagaccctgtgggccccagcccccaggaccccagcctggaggccagcggccccagccccaagccagctggggtggacatcagcgaggccccccagaccagcagcccctgccccagcgctgacatcgacatgaagaccatggagacagctgagaagctggccaggtttgtggcccaggtgggccctgagattgagcagttcagcattgagaacagcacagacaacccagacctgtggttcctgcatgaccagaacagcagcgccttcaagttctacaggaagaaggtgtttgagctgtgccccagcatctgcttcaccagcagcccccacaacctgcacactggaggaggagacaccaccggcagccaggagagccctgtggacctgatggagggggaggccgagtttgaagatgagcccccaccccgggaggccgagctggagagccctgaggtgatgcctgaggaggaggatgaagatgatgaagatggaggagaggaggccccagcccctggaggagctgggaagtctgagggcagcaccccagcagatggcctgcctggagaggccgcagaagatgacctggccggggccccagccctgagccaggccagcagcggcacctgcttccccaggaagaggatcagcagcaagagcctgaaggtgggcatgatcccagcccccaagagggtgtgcctgatccaggagcccaaggtgcatgagcctgtgagaattgcctatgaccggccccggggccggcccatgagcaagaagaagaagcccaaggacctggactttgcccagcagaagctgacagacaagaacctgggcttccagatgctgcagaagatgggctggaaggagggccacggcctgggcagcctgggcaagggcatccgggagcctgtgtctgtgggcaccccatctgagggggagggcctgggcgcagatggccaggagcacaaggaggacacctttgatgtgttccggcagaggatgatgcagatgtaccgccacaagagggccaacaagtag

SEQ ID NO: 17104 - DNA, 3249 bp, Artificial Sequence; identical to SEQ ID NO: 17103
  Description of Artificial Sequence: Synthetic coding sequence

SEQ ID NO: 17105 - DNA, 2586 bp, Artificial Sequence
  Description of Artificial Sequence: Synthetic coding sequence
atgacagccacctttgccaagaatgtggccggcatctggaacttcctgaccctcatcctgggcaccaggagcctggccactggaaactggggcatctctgtgctgaggactggaaacctgcggtctgtggtgctgggcaacaagaccctggccatccagttcctgaagagccccctgggccacaggagcatcgtgctgatccccctgggcctggacctgaagaacctgcggctgcccaggaggaagatgagctttgacatcatcgacaagagtgatgtgttcagcagatttggaattgagatcatcaagtgggccggcttccacaccatcaaggatgacatcaagttcagccagctgttccagaccctgtttgagctggagacagagacctgtgccaagatgctggccagcttcaagtgcagcctgaagccagagcaccgggacttctgcttcttcaccatcaagttcctgaagcacagcgccctgaagaccccccgggtggacaatgagttcctgaacatgctgctggacaagggagctgtgaagaccaagaactgcttctttgagatcatcaagccctttgacaagtacatcatgaggctgcaggaccggctgctgaagtctgtgacccccctgctgatggcctgcaatgcctatgagctgtctgtgaagatgaagaccctgagcaaccccctggacctggccctggccctggagaccaccaacagcctgtgcaggaagagcctggccctgctgggccagaccttcagcctggccagcagcttccggcaggagaagatcctggaggccgtgggcctgcaggacatcgcccccagccctgctgccttccccaactttgaggacagcaccctgtttggccgggagtacatcgaccacctgaaggcctggctggtgagcagcggctgccccctgcaggtgaagaaggccgagcctgagcccatgagggaggaggagaagatgatcccccccaccaagccagagatccaggccaaggcccccagcagcctgagtgatgctgtgccccagagagctgaccaccgggtggtgggcaccatcgaccagctggtgaagagggtgattgagggcagcctgagccccaaggagaggaccctgctgaaggaggaccctgcctactggttcctgagtgatgagaacagcctggagtacaagtactacaagctgaagctggccgagatgcagaggatgtctgagaacctgcggggagctgaccagaagcccaccagcgctgactgtgctgtgcgggccatgctgtacagcagagctgtgaggaacctgaagaagaagctgctgccctggcagaggcggggcctgctgcgggcccagggcctgcggggctggaaggcccggcgggccaccaccggcacccagaccctgctgagcagcggcacccggctgaagcaccacggccggcaggcccctggcctgagccaggccaagcccagcctgcctgacagaaatgatgctgccaaggactgccccccagaccctgtgggccccagcccccaggaccccagcctggaggccagcggccccagccccaagccagctggggtggacatcagcgaggccccccagaccagcagcccctgccccagcgctgacatcgacatgaagaccatggagacagctgagaagctggccaggtttgtggcccaggtgggccctgagattgagcagttcagcattgagaacagcacagacaacccagacctgtggttcctgcatgaccagaacagcagcgccttcaagttctacaggaagaaggtgtttgagctgtgccccagcatctgcttcaccagcagcccccacaacctgcacactggaggaggagacaccaccggcagccaggagagccctgtggacctgatggagggggaggccgagtttgaagatgagcccccaccccgggaggccgagctggagagccctgaggtgatgcctgaggaggaggatgaagatgatgaagatggaggagaggaggccccagcccctgggggcgccggcaagtctgagggcagcaccccagcagatggcctgcccggggaggccgcagaagatgacctggccggggccccagccctgagccaggccagcagcggcacctgcttccccaggaagaggatcagcagcaagagcctgaaggtgggcatgatcccagcccccaagagggtgtgcctgatccaggagcccaaggtgcatgagcctgtgcgcatcgcctatgaccggccccggggccggcccatgagcaagaagaagaagcccaaggacctggactttgcccagcagaagctgacagacaagaacctgggcttccagatgctgcagaagatgggctggaaggagggccacggcctgggcagcctgggcaagggcatccgggagcctgtgtctgtgtatgctgctggcagcctgggctgggagtgggtgggcccccagagcttccacctgcagcctgctgcctggctgctgcacagccaggacggcctgcagctggccgtggacttctgcttcctgaacagaagacacctgcagatgaggagctag

SEQ ID NO: 17106 - DNA, 534 bp, Artificial Sequence
  Description of Artificial Sequence: Synthetic coding sequence
tgaatgaagcacacagccacagcccgcttccagaggaaccacaggctcatcagcgagatcctgtctgagagcgtggtgcctgatgtgcgctctgtggtgaccacagccaggatgcaggtgctgaagaggcaggtgcagagcctgatggtgcaccagaggaagctggaggccgagctgctgcagatcgaggagcggcaccaggagaagaagaggaagttcctggagagcacagacagcttcaacaatgagctgaagaggctgtgtggcctgaaggtggaggtggacatggagaagattgctgctgagatcgcccaggccgaggagcaggccaggaagaggcaggaggagcgggagaaggaggccgctgagcaggccgagaggagccagagcagcatcgtgcctgaggaggagcaggccgccaacaagggggaggagaagaaggatgatgagaacatccccatggagacagagaagaactgccagctgtgccccaggaagaccctgaccagccgctacacagacttcccagactag

SEQ ID NO: 17107 - DNA, 1236 bp, Artificial Sequence
  Description of Artificial Sequence: Synthetic coding sequence
atgagcaagaggcccagctatgcccccccacccaccccagccccagccacccagatgcccagcaccccaggctttgtgggctacaacccctacagccacctggcctacaacaactaccgcctgggcggcaaccctggcaccaacagccgggtgacagccagcagcggcatcaccatccccaagccacccaagcccccagacaagcccctgatgccctacatgagatacagcaggaaggtgtgggaccaggtgaaggccagcaacccagacctgaagctgtgggagatcggcaagatcatcggcggcatgtggagggacctgacagatgaggagaagcaggagtacctgaatgaatatgaagctgagaagattgagtacaatgaatccatgaaggcctaccacaacagccctgcctacctggcctacatcaatgccaagagcagagctgaggccgccctggaggaggagagccggcagaggcagagcaggatggagaagggggagccctacatgagcatccagcctgcagaagatcctgatgattatgatgatggcttctccatgaagcacacagccacagcccgcttccagaggaaccacaggctcatcagcgagatcctgtctgagagcgtggtgcctgatgtgcgctctgtggtgaccacagccaggatgcaggtgctgaagaggcaggtgcagagcctgatggtgcaccagaggaagctggaggccgagctgctgcagatcgaggagcggcaccaggagaagaagaggaagttcctggagagcacagacagcttcaacaatgagctgaagaggctgtgtggcctgaaggtggaggtggacatggagaagattgctgctgagatcgcccaggccgaggagcaggccaggaagaggcaggaggagcgggagaaggaggccgctgagcaggccgagaggagccagagcagcatcgtgcctgaggaggagcaggccgccaacaagggggaggagaagaaggatgatgagaacatccccatggagacagaggagacccacctggaggagaccacagagagccagcagaatggagaggagggcaccagcaccccagaggacaaggagagcggccaggagggcgtggacagcatggccgaggagggcaccagtgacagcaacacaggcagcgagagcaacagcgccaccgtggaggagcccccaacagaccccatcccagaagatgagaagaaggagtag

SEQ ID NO: 17108 - DNA, 987 bp, Artificial Sequence
  Description of Artificial Sequence: Synthetic coding sequence
atgagcaagaggcccagctatgcccccccacccaccccagccccagccacagccagcagcggcatcaccatccccaagccacccaagcccccagacaagcccctgatgccctacatgagatacagcaggaaggtgtgggaccaggtgaaggccagcaacccagacctgaagctgtgggagatcggcaagatcattggaggcatgtggagggacctgacagatgaggagaagcaggagtacctgaatgaatatgaggccgagaagattgagtacaatgaatccatgaaggcctaccacaacagccctgcctacctggcctacatcaatgccaagagcagagctgaggccgccctggaggaggagagccggcagaggcagagcaggatggagaagggggagccctacatgagcatccagcctgctgaggaccctgatgattatgatgatggcttctccatgaagcacacagccacagcccgcttccagaggaaccacaggctcatcagcgagatcctgtctgagagcgtggtgcctgatgtgcgctctgtggtgaccacagccaggatgcaggtgctgaagaggcaggtgcagagcctgatggtgcaccagaggaagctggaggccgagctgctgcagatcgaggagcggcaccaggagaagaagaggaagttcctggagagcacagacagcttcaacaatgagctgaagaggctgtgtggcctgaaggtggaggtggacatggagaagattgctgctgagatcgcccaggccgaggagcaggccaggaagaggcaggaggagcgggagaaggaggccgctgagcaggccgagaggagccagagcagcatcgtgcctgaggaggagcaggccgccaacaagggggaggagaagaaggatgatgagaacatccccatggagacagagaagaactgccagctgtgccccaggaagaccctgaccagccgctacacagacttcccagactag

SEQ ID NO: 17109 - DNA, 570 bp, Artificial Sequence
  Description of Artificial Sequence: Synthetic coding sequence
tgagcagaagatcctgatgattatgatgatggcttctccatgaagcacacagccacagcccgcttccagaggaaccacaggctcatcagcgagatcctgtctgagagcgtggtgcctgatgtgcgctctgtggtgaccacagccaggatgcaggtgctgaagaggcaggtgcagagcctgatggtgcaccagaggaagctggaggccgagctgctgcagatcgaggagcggcaccaggagaagaagaggaagttcctggagagcacagacagcttcaacaatgagctgaagaggctgtgtggcctgaaggtggaggtggacatggagaagattgctgctgagatcgcccaggccgaggagcaggccaggaagaggcaggaggagcgggagaaggaggccgctgagcaggccgagaggagccagagcagcatcgtgcctgaggaggagcaggccgccaacaagggggaggagaagaaggatgatgagaacatccccatggagacagagaagaactgccagctgtgccccaggaagaccctgaccagccgctacacagacttcccagactag

SEQ ID NO: 17110 - DNA, 1182 bp, Artificial Sequence
  Description of Artificial Sequence: Synthetic coding sequence
atgcccagcaccccaggctttgtgggctacaacccctacagccacctggcctacaacaactaccgcctgggcggcaaccctggcaccaacagccgggtgacagccagcagcggcatcaccatccccaagccacccaagcccccagacaagcccctgatgccctacatgagatacagcaggaaggtgtgggaccaggtgaaggccagcaacccagacctgaagctgtgggagatcggcaagatcatcggcggcatgtggagggacctgacagatgaggagaagcaggagtacctgaatgaatatgaagctgagaagattgagtacaatgaatccatgaaggcctaccacaacagccctgcctacctggcctacatcaatgccaagagcagagctgaggccgccctggaggaggagagccggcagaggcagagcaggatggagaagggggagccctacatgagcatccagcctgcagaagatcctgatgattatgatgatggcttctccatgaagcacacagccacagcccgcttccagaggaaccacaggctcatcagcgagatcctgtctgagagcgtggtgcctgatgtgcgctctgtggtgaccacagccaggatgcaggtgctgaagaggcaggtgcagagcctgatggtgcaccagaggaagctggaggccgagctgctgcagatcgaggagcggcaccaggagaagaagaggaagttcctggagagcacagacagcttcaacaatgagctgaagaggctgtgtggcctgaaggtggaggtggacatggagaagattgctgctgagatcgcccaggccgaggagcaggccaggaagaggcaggaggagcgggagaaggaggccgctgagcaggccgagaggagccagagcagcatcgtgcctgaggaggagcaggccgccaacaagggggaggagaagaaggatgatgagaacatccccatggagacagaggagacccacctggaggagaccacagagagccagcagaatggagaggagggcaccagcaccccagaggacaaggagagcggccaggagggcgtggacagcatggccgaggagggcaccagtgacagcaacacaggcagcgagagcaacagcgccaccgtggaggagcccccaacagaccccatcccagaagatgagaagaaggagtag

SEQ ID NO: 17111 - DNA, 474 bp, Artificial Sequence
  Description of Artificial Sequence: Synthetic coding sequence
ctgtctgagagcgtggtgcctgatgtgcgctctgtggtgaccacagccaggatgcaggtgctgaagaggcaggtgcagagcctgatggtgcaccagaggaagctggaggccgagctgctgcagatcgaggagcggcaccaggagaagaagaggaagttcctggagagcacagacagcttcaacaatgagctgaagaggctgtgtggcctgaaggtggaggtggacatggagaagattgctgctgagatcgcccaggccgaggagcaggccaggaagaggcaggaggagcgggagaaggaggccgctgagcaggccgagaggagccagagcagcatcgtgcctgaggaggagcaggccgccaacaagggggaggagaagaaggatgatgagaacatccccatggagacagagaagaactgccagctgtgccccaggaagaccctgaccagccgctacacagacttcccagactag

SEQ ID NO: 17112 - DNA, 1026 bp, Artificial Sequence
  Description of Artificial Sequence: Synthetic coding sequence
atgccctacatgagatacagcaggaaggtgtgggaccaggtgaaggccagcaacccagacctgaagctgtgggagatcggcaagatcatcggcggcatgtggagggacctgacagatgaggagaagcaggagtacctgaatgaatatgaagctgagaagattgagtacaatgaatccatgaaggcctaccacaacagccctgcctacctggcctacatcaatgccaagagcagagctgaggccgccctggaggaggagagccggcagaggcagagcaggatggagaagggggagccctacatgagcatccagcctgcagaagatcctgatgattatgatgatggcttctccatgaagcacacagccacagcccgcttccagaggaaccacaggctcatcagcgagatcctgtctgagagcgtggtgcctgatgtgcgctctgtggtgaccacagccaggatgcaggtgctgaagaggcaggtgcagagcctgatggtgcaccagaggaagctggaggccgagctgctgcagatcgaggagcggcaccaggagaagaagaggaagttcctggagagcacagacagcttcaacaatgagctgaagaggctgtgtggcctgaaggtggaggtggacatggagaagattgctgctgagatcgcccaggccgaggagcaggccaggaagaggcaggaggagcgggagaaggaggccgctgagcaggccgagaggagccagagcagcatcgtgcctgaggaggagcaggccgccaacaagggggaggagaagaaggatgatgagaacatccccatggagacagaggagacccacctggaggagaccacagagagccagcagaatggagaggagggcaccagcaccccagaggacaaggagagcggccaggagggcgtggacagcatggccgaggagggcaccagtgacagcaacacaggcagcgagagcaacagcgccaccgtggaggagcccccaacagaccccatcccagaagatgagaagaaggagtag

SEQ ID NO: 17113 - DNA, 708 bp, Artificial Sequence
  Description of Artificial Sequence: Synthetic coding sequence
atgcagaggcggggccagagggacctgtggaggcacaacaagagctgtgccaggaaccgctgcccccggcccccccgggagcggggcggggccggcttcccctgggtgcgggcccagctgtctgtgcggcagttcaccctgcgggtgcgggtgcccggccctgtgcacctgcggggccgcagccccaccccagccctggaccccctggcccccctgaaccccctcatccggggccccaggaccccaggcctgcggcgctggatccagagcctggccctgctgctgcccaactgcagcagcagccgcatccccaccgtgccccggccccacagcggcctgtgggtgcagagcgacttccccctgggcttcctgagcaggacagagccccggctgaccaggagctgccgcggggccttccgcagcccccggcccctgcccaagagcggccaggctgatggcaccagcgaggagagcctgcacctggacatccagaagctgaaggagaagagggacatgctggacaaggagatcagccagtttgtgtctgagggctacagcgtggatgagctggaggaccacatcacccagctgcacgagtacaatgacatcaaggatgtgggccagatgctgatgggcaagctggccgtcatccggggcgtgaccaccaaggagctgtacccagagtttggcctggacatgaatgactag

SEQ ID NO: 17114 - DNA, 924 bp, Artificial Sequence
  Description of Artificial Sequence: Synthetic coding sequence
atgaagaacctggtggtgcccatgtgggagggcaagtggaagacagccaagagggccaggatgaactacaaggtgaagctggaggagatcagcggcctgctggtggatgccctgtacaccaacaccatctactacctgatcaaggtggactaccgggaggtgtggctgatccgcctcttctacaacttctccttcctggagaagaaccaggacttcaccttcaagatggagagccccagcgacagcgctgtggtgctgcccagcaccccccaggccagcgccaaccccagcagcccctacaccaacagcagcaggaagcagcccatgtctgccaccctgcgggagcggctgaggaagacccgcttctccttcaacagcagctacaacgtggtgaagaggctgaaggtggagagcgaggagaatgaccagaccttcagcgagaagccagccagcagcacagaggagaactgcctggagttccaggagagcttcaagcacattgattctgaatttgaggagaacaccaacctgaagaacaccctgaagaacctgaatgtgtgtgagagccagagcctggacagcggcagctgcagcgccctgcagaatgaatttgtgtctgagaagctgcccaagcagaggctgaatgctgagaaggccaagctggtgaagcaggtgcaggagaaggaggacctgctgcggcggctgaagctggtgaagatgtaccgcagcaagaatgacctgagccagctgcagctgctgatcaagaagtggaggagctgcagccagctgctgctgtatgagctgcagagcgctgtgtctgaggagaacaagaagctgagcctgacccagctgattgaccactacggcctggatgacaagctgctgcactacaacagaagtgaggaggagttcattgatgtgtag

SEQ ID NO: 17115 - DNA, 738 bp, Artificial Sequence
  Description of Artificial Sequence: Synthetic coding sequence
atggccgagggggagaagaaccaggacttcaccttcaagatggagagccccagcgacagcgctgtggtgctgcccagcaccccccaggccagcgccaaccccagcagcccctacaccaacagcagcaggaagcagcccatgtctgccaccctgcgggagcggctgaggaagacccgcttctccttcaacagcagctacaacgtggtgaagaggctgaaggtggagagcgaggagaatgaccagaccttcagcgagaagccagccagcagcacagaggagaactgcctggagttccaggagagcttcaagcacattgattctgaatttgaggagaacaccaacctgaagaacaccctgaagaacctgaatgtgtgtgagagccagagcctggacagcggcagctgcagcgccctgcagaatgaatttgtgtctgagaagctgcccaagcagaggctgaatgctgagaaggccaagctggtgaagcaggtgcaggagaaggaggacctgctgcggcggctgaagctggtgaagatgtaccgcagcaagaatgacctgagccagctgcagctgctgatcaagaagtggaggagctgcagccagctgctgctgtatgagctgcagagcgctgtgtctgaggagaacaagaagctgagcctgacccagctgattgaccactacggcctggatgacaagctgctgcactacaacagaagtgaggaggagttcattgatgtgtag

SEQ ID NO: 17116 - DNA, 699 bp, Artificial Sequence
  Description of Artificial Sequence: Synthetic coding sequence
atggagagccccagcgacagcgctgtggtgctgcccagcaccccccaggccagcgccaaccccagcagcccctacaccaacagcagcaggaagcagcccatgtctgccaccctgcgggagcggctgaggaagacccgcttctccttcaacagcagctacaacgtggtgaagaggctgaaggtggagagtgaagaaaatgaccagaccttcagcgagaagccagccagcagcacagaggagaactgcctggagttccaggagagcttcaagcacatcgacagcgagtttgaggagaacaccaacctgaagaacaccctgaagaacctgaatgtgtgtgagagccagagcctggacagcggcagctgcagcgccctgcagaatgaatttgtgtctgagaagctgcccaagcagaggctgaatgctgagaaggccaagctggtgaagcaggtgcaggagaaggaggacctgctgcggcggctgaagctggtgaagatgtaccgcagcaagaatgacctgagccagctgcagctgctgatcaagaagtggaggagctgcagccagctgctgctgtatgagctgcagagcgctgtgtctgaggagaacaagaagctgagcctgacccagctgattgaccactacggcctggatgacaagctgctgcactacaacagaagtgaggaggagttcattgatgtgtag

SEQ ID NO: 17117 - DNA, 1059 bp, Artificial Sequence
  Description of Artificial Sequence: Synthetic coding sequence
atgttccggggcctgagctcctggctgggcctgcagcagcctgtggccggcggcggccagcccaatggagatgcccctcctgagcagcccagcgagaccgtggccgagagcgctgaggaggagctgcagcaggccggggaccaggagctgctgcaccaggccaaggactttggaaactacctgttcaactttgccagcgctgccaccaagaagatcacagaatctgtggccgagacagcccagaccatcaagaagtctgtggaggagggcaagattgatggcatcatcgacaagaccatcattggagacttccagaaggagcagaagaagtttgtggaggagcagcacaccaagaagtctgaggccgctgtgcccccctgggtggacaccaatgatgaggagaccatccagcagcagatcctggccctgtctgctgacaagaggaacttcctgcgggaccccccagctggggtgcagttcaactttgattttgaccagatgtaccctgtggccctggtgatgctgcaggaggatgagctgctgagcaagatgagatttgccctggtgcccaagctggtgaaggaggaggtgttctggaggaactacttctacagagtgtccctcatcaagcagagcgcccagctgacagccctggccgcccagcagcaggccgccggcaaggaggagaagagcaatggccgggagcaggacctgcccctggccgaggccgtgcggcccaagaccccacctgtggtgatcaagagccagctgaagacccaggaggatgaggaggagatcagcaccagccctggggtgtctgaatttgtgtctgatgcctttgatgcctgcaacctgaaccaggaggacctgaggaaggagatggagcagctggtgctggacaagaagcaggaggagacagctgtgctggaggaggacagcgctgactgggagaaggagctgcagcaggagctgcaggagtatgaggtggtgacagaaagtgagaagagagatgagaactgggacaaggagattgagaagatgctgcaggaggagaactag

SEQ ID NO: 17118 - DNA, 2439 bp, Artificial Sequence
  Description of Artificial Sequence: Synthetic coding sequence
atgcaggccaagaacaaggatgccctgcagcccatcaaggaggacagaacaggcaaggcccaggatgatgccttctggctgcagagcctcatcacagatgccttccatgacaagggcttccagaagatcaaggagtacttccagcagaaggagagccacttcccccagaagtacaaccggctgctgctgtaccgcctggacaggagcatcaacaaggagctggacaagaatgagttccagagcgtgtccctgctgctgaagtgcatccagcgcttcctggtggatggcctgaaggaggatgagcccctgctgatccggcagggcctcatccccaagctggtgtcctggtttgagaggaccaccggcatcctgaccagcgagggcctggccagtgacaccagcctcatctgtgtgattgaggacttctttgacacagccctgatcatcagccgcagcagcagcgagggcaagatccagatgctggacagcttcctgctgagcctgggcttcctggtgacagagaagacagtgaaccacctgctgcagcaggagggcctgaagaccttcaactgcatcctgcatgctgtgccccgggaggagaggaagaagttccccctgtctgagggcatgtgccacctgatgaaggacctggcccggaccctgctgactgtgggggactatgaccagcaggtggccatcagcgaggccctgtgccgcctgaccatcaagaagagcagagatgagctggtgcacaagtggtttgatgatgaggtgattgctgaggccttcaaggagatcaaggaccgggagtttgaaacagacagccgccgcttcctgaaccacctgaacaaccggctgggggaccagaggagagtgtacagcttcccctgcatcgccgcctttgctgatgaacatgagatgaggaagccagcagatgagaagctggagaagttctggattgacttcaacctgggcagccagagcgtgaccttctacatcgacaatgctgagaacaccctgtgggacagcgtgaccctgcccaaggaggccgtgatgaacttcagcatcacagaaacagagaagatcaagatcttcatcatctacctgaagaagcccatgatcatctcctacaaggaggtgatgaagattgagatccactttgacctgcagttcaacatcagccaggtgtccatccaggccctgggggaggacaagcagatgctgcctgaccagaccaagatcagcagcgagctgttcagcaagagtgacaaggaggaccgggagagccccagcggcctggagcgggagacagagcaggccgaggagagcaccaacatggtggagttcatgtctgcagaagatgaccgctgcctgatcaccctgcacctgaatgaccagagcgagccccctgtgattggagagcccgccagtgacagccacctgcagcctgtgcccccatttggagtgcctgacttcccccagcagcccaagagccactacaggaagcacctgttcagcgagagcaaccaggacagcagcaccagcgagctgtcctggaccagcaaccagaagaagaagagcctgaagagctacagcagcaggaagaagaccaggaccaggagcaacctgcgcatcctgcctgtgttcccccccagcagcggcagcggccacgagaaggaccaggccaagctgctgagccccagcgagaaggagatccctgagcagaacaacaccaccagccccaagaccagcgagcagaagttccaggacagctttgccttcctgacagctgaggacagcgcccagaagacagagctgcaggacccccacagcctgtctgagctgagcagcctgaagcacagtgaagatgaggagaagcccaagatcgtgaaccaggagagcctgacagagagcaccagcctgaagcacaagctgaggaacctggaggacaaggacatccctgagggcagctttgccaagagccagcagagccggctggaggaggaggtggcccctggcagccccttcagcatcacagaggagcgggagctgcctgagggcatcagcaccagcagcctggaggtggtgcctgagaacctgaatggaagtgccatcctgcccacctttgagaacttcaccaagaagaggaagaggaaatatgagctgcgctacaggaagaggcccttcaacagtgaaaatgccaagaaggccccagactgcctgatcaagctgctgaaccagatgcagctgttccggctgaacaagctggagcgcttccagaacctggtgctgcaggagctgagcagcctgaagcaggacatccaggccctggagcacctggagaaggaggtgctggagttctggggcaagcagagcgctgacctgcagagcttctgtgacctgcaggtgctgcgcttcaacagcacccagaccagctag

SEQ ID NO: 17119 - DNA, 867 bp, Artificial Sequence
  Description of Artificial Sequence: Synthetic coding sequence
atgctggacagcttcctgctgagcctgggcttcctggtgacagagaagacagtgaaccacctgctgcagcaggagggcctgaagaccttcaactgcatcctgcatgctgtgccccgggaggagaggaagaagttccccctgtctgagggcatgtgccacctgatgaaggacctggcccggaccctgctgactgtgggggactatgaccagcaggtggccatcagcgaggccctgtgccgcctgaccatcaagaagagcagagatgagctggtgcacaagtggtttgatgatgaggtgattgctgaggccttcaaggagatcaaggaccgggagtttgaaacagacagccgccgcttcctgaaccacctgaacaaccggctgggggaccagaggagagtgtacagcttcccctgcatcgccgcctttgctgatgagcacgagatgaggaagccagcagatgagaagctggagaagttctggattgacttcaacctgggcagccagagcgtgaccttctacatcgacaatgctgagaacaccctgtgggacagcgtgaccctgcccaaggaggccgtgatgaacttcagcatcacagaaacagagaagatcaagatcttcatcatctacctgaagaagcccatgatcatctcctacaaggaggtgatgaagattgagatccactttgacctgcagttcaacatcagccaggtgtccatccaggccctgggggaggacaagcagatgctgcctgaccagaccaagatcagcagcgagctgttcagcaagagtgacaaggaggaccgggagagccccagcggcctggagcgggagacagaggtgtccctgcagaagaccagcctgctgtag

SEQ ID NO: 17120 - DNA, 1845 bp, Artificial Sequence
  Description of Artificial Sequence: Synthetic coding sequence
atgggagactggatgacagtgacagaccccggcctgagcagcgagagcaagaccatcagccagtacaccagcgagaccaagatgagccccagcagcctgtacagccagcaggtgctgtgcagcagcatccccctgagcaagaatgtgcacagcttcttcagcgccttctgcacagaggacaacatcgagcagagcatctcctacctggaccaggagctgaccaccttcggcttccccagcctgtatgaggagagcaagggcaaggagaccaagcgggagctgaacatcgtggccgtgctgaactgcatgaatgagctgctggtgctgcagaggaagaacctgctggcccaggagaatgtggagacccagaacctgaagctgggcagtgacatggaccacctgcagagctgctacagcaagctgaaggagcagctggagaccagcagaagagagatgattggcctgcaggagcgggaccggcagctgcagtgcaagaacagaaacctgcaccagctgctgaagaatgagaaggatgaggtgcagaagctgcagaacatcatcgccagccgggccacccagtacaaccacgacatgaagaggaaggagcgggagtacaacaagctgaaggagcggctgcaccagctggtgatgaacaagaaggacaagaagatcgccatggacatcctgaactacgtgggccgggcagatggcaagaggggctcctggaggacaggcaagacagaggccagaaatgaagatgagatgtacaagatcctgctgaatgactatgagtaccggcagaagcagatcctgatggagaatgctgagctgaagaaggtgctgcagcagatgaagaaggagatgatcagcctgctgagcccccagaagaagaagccccgggagcgggtggatgacagcactggaacagtcatcagtgatgtggaggaggatgctggggagctgagccgggagagcatgtgggacctgagctgtgaaacagtgcgggagcagctgaccaacagcatcaggaagcagtggaggatcctgaagagccacgtggagaagctggacaaccaggtgtccaaggtgcacctggagggcttcaatgatgaagatgtgatcagccggcaggaccacgagcaggagacagagaagctggagctggagatccagcagtgcaaggagatgatcaagacccagcagcagctgctgcagcagcagctggccacagcctatgatgatgacaccaccagcctgctgcgggactgctacctgctggaggagaaggagcggctgaaggaggagtggagcctcttcaaggagcagaagaagaactttgagcgggagcggcgctccttcacagaggccgccatccggctgggcctggagaggaaggcctttgaggaggagcgggcctcctggctgaagcagcagttcctgaacatgaccacctttgaccaccagaacagtgaaaatgtgaagctgttcagcgccttcagcggcagcagtgactgggacaacctgattgtgcacagccggcagccccagaagaagccccacagcgtgtccaatggcagccctgtgtgcatgagcaagctgaccaagagcctgcctgccagccccagcaccagtgacttctgccagaccaggagctgcatcagcgagcacagcagcatcaacgtgctgaacatcacagctgaggagatcaagcccaaccaggtgggcggagaatgtaccaaccagaagtggagcgtggccagcaggcctggcagccaggagggctgctacagcggctgcagcctgagctacaccaacagccacgtggagaaggatgacctgccctag

SEQ ID NO: 17121 - DNA, 1683 bp, Artificial Sequence
  Description of Artificial Sequence: Synthetic coding sequence
atgggagactggatgacagtgacagaccccggcctgagcagcgagagcaagaccatcagccagtacaccagcgagaccaagatgagccccagcagcctgtacagccagcaggtgctgtgcagcagcatccccctgagcaagaatgtgcacagcttcttcagcgccttctgcacagaggacaacatcgagcagagcatctcctacctggaccaggagctgaccaccttcggcttccccagcctgtatgaggagagcaagggcaaggagaccaagcgggagctgaacatcgtggccgtgctgaactgcatgaatgagctgctggtgctgcagaggaagaacctgctggcccaggagaatgtggagacccagaacctgaagctgggcagtgacatggaccacctgcagagctgctacagcaagctgaaggagcagctggagaccagcagaagagagatgattggcctgcaggagcgggaccggcagctgcagtgcaagaacagaaacctgcaccagctgctgaagaatgagaaggatgaggtgcagaagctgcagaacatcatcgccagccgggccacccagtacaaccacgacatgaagaggaaggagcgggagtacaacaagctgaaggagcggctgcaccagctggtgatgaacaagaaggacaagaagatcgccatggacatcctgaactacgtgggccgggcagatggcaagaggggctcctggaggacaggcaagacagaggccagaaatgaagatgagatgtacaagatcctgctgaatgactatgagtaccggcagaagcagatcctgatggagaatgctgagctgaagaaggtgctgcagcagatgaagaaggagatgatcagcctgctgagcccccagaagaagaagccccgggagcgggtggatgacagcactggaacagtcatcagtgatgtggaggaggatgctggggagctgagccgggagagcatgtgggacctgagctgtgaaacagtgcgggagcagctgaccaacagcatcaggaagcagtggaggatcctgaagagccacgtggagaagctggacaaccaggtgtccaaggtgcacctggagggcttcaatgatgaagatgtgatcagccggcaggaccacgagcaggagacagagaagctggagctggagatccagcagtgcaaggagatgatcaagacccagcagcagctgctgcagcagcagctggccacagcctatgatgatgacaccaccagcctgctgcgggactgctacctgctggaggagaaggagcggctgaaggaggagtggagcctcttcaaggagcagaagaagaactttgagcgggagcggcgctccttcacagaggccgccatccggctgggcctggagaggaaggcctttgaggaggagcgggcctcctggctgaagcagcagttcctgaacatgaccacctttgaccaccagaacagtgaaaatgtgaagctgttcagcgccttcagcggcagcagtgactgggacaacctgattgtgcacagccggcagccccagaagaagccccacagcgtgtccaatggcagccctgtgtgcatgagcaagctgaccaagagcctgcctgccagccccagcaccagtgacttctgccagaccaggagctgcatcagcgagcaccgggccaagaactag

SEQ ID NO: 17122 - DNA, 543 bp, Artificial Sequence
  Description of Artificial Sequence: Synthetic coding sequence
atgggagactggatgacagtgacagaccccggcctgagcagcgagagcaagaccatcagccagtacaccagcgagaccaagatgagccccagcagcctgtacagccagcaggtgctgtgcagcagcatccccctgagcaagaatgtgcacagcttcttcagcgccttctgcacagaggacaacatcgagcagagcatctcctacctggaccaggagctgaccaccttcggcttccccagcctgtatgaggagagcaagggcaaggagaccaagcgggagctgaacatcgtggccgtgctgaactgcatgaatgagctgctggtgctgcagaggaagaacctgctggcccaggagaatgtggagacccagaacctgaagctgggcagtgacatggaccacctgcagagctgctacagcaagctgaaggagcagctggagaccagcagaagagagatgattggcctgcaggagcgggaccggcagctgcagtgcaagaacagaaacctgcaccagctgctgaagaatgagaaggatgaggtgtag

SEQ ID NO: 17123 - DNA, 1764 bp, Artificial Sequence
  Description of Artificial Sequence: Synthetic coding sequence
atgagccccagcagcctgtacagccagcaggtgctgtgcagcagcatccccctgagcaagaatgtgcacagcttcttcagcgccttctgcacagaggacaacatcgagcagagcatctcctacctggaccaggagctgaccaccttcggcttccccagcctgtatgaggagagcaagggcaaggagaccaagcgggagctgaacatcgtggccgtgctgaactgcatgaatgagctgctggtgctgcagaggaagaacctgctggcccaggagaatgtggagacccagaacctgaagctgggcagtgacatggaccacctgcagagctgctacagcaagctgaaggagcagctggagaccagccggcgggagatgattggcctgcaggagcgggaccggcagctgcagtgcaagaacagaaacctgcaccagctgctgaagaatgagaaggatgaggtgcagaagctgcagaacatcatcgccagccgggccacccagtacaaccacgacatgaagaggaaggagcgggagtacaacaagctgaaggagcggctgcaccagctggtgatgaacaagaaggacaagaagatcgccatggacatcctgaactacgtgggccgggcagatggcaagaggggctcctggaggacaggcaagacagaggccagaaatgaagatgagatgtacaagatcctgctgaatgactatgagtaccggcagaagcagatcctgatggagaatgctgagctgaagaaggtgctgcagcagatgaagaaggagatgatcagcctgctgagcccccagaagaagaagccccgggagcgggtggatgacagcacaggcaccgtcatcagtgatgtggaggaggatgctggggagctgagccgggagagcatgtgggacctgagctgtgagaccgtgcgggagcagctgaccaacagcatcaggaagcagtggaggatcctgaagagccacgtggagaagctggacaaccaggtgtccaaggtgcacctggagggcttcaatgatgaagatgtgatcagccggcaggaccacgagcaggagacagagaagctggagctggagatccagcagtgcaaggagatgatcaagacccagcagcagctgctgcagcagcagctggccacagcctatgatgatgacaccaccagcctgctgcgggactgctacctgctggaggagaaggagcggctgaaggaggagtggagcctcttcaaggagcagaagaagaactttgagcgggagaggaggagcttcacagaagctgccatccggctgggcctggagaggaaggcctttgaggaggagcgggcctcctggctgaagcagcagttcctgaacatgaccacctttgaccaccagaacagtgaaaatgtgaagctgttcagcgccttcagcggcagcagtgactgggacaacctgattgtgcacagccggcagccccagaagaagccccacagcgtgtccaatggcagccctgtgtgcatgagcaagctgaccaagagcctgcctgccagccccagcaccagtgacttctgccagaccaggagctgcatcagcgagcacagcagcatcaacgtgctgaacatcacagctgaggagatcaagcccaaccaggtgggcggggagtgcaccaaccagaagtggagcgtggccagccggcccggcagccaggagggctgctacagcggctgcagcctgagctacaccaacagccacgtggagaaggatgacctgccctag

SEQ ID NO: 17124 - DNA, 1515 bp, Artificial Sequence
  Description of Artificial Sequence: Synthetic coding sequence
atgggagactggatgacagtgacagatcctgagagcaagaccatcagccagtacaccagcgagaccaagatgagccccagcagcctgtacagccagcaggtgctgtgcagcagcatccccctgagcaagaatgtgcacagcttcttcagcgccttctgcacagaggacaacatcgagcagagcatctcctacctggaccaggagctgaccaccttcggcttccccagcctgtatgaggagagcaagggcaaggagaccaagcgggagctgaacatcgtggccgtgctgaactgcatgaatgagctgctggtgctgcagaggaagaacctgctggcccaggagaatgtggagacccagaacctgaagctgggcagtgacatggaccacctgcagagctgctacagcaagctgaaggagcagctggagaccagcagaagagagatgattggcctgcaggagcgggaccggcagctgcagtgcaagaacagaaacctgcaccagctgctgaagaatgagaaggatgaggtgcagaagctgcagaacatcatcgccagccgggccacccagtacaaccacgacatgaagaggaaggagcgggagtacaacaagctgaaggagcggctgcaccagctggtgatgaacaagaaggacaagaagatcgccatggacatcctgaactacgtgggccgggcagatggcaagaggggctcctggaggacaggcaagacagaggccagaaatgaagatgagatgtacaagatcctgctgaatgactatgagtaccggcagaagcagatcctgatggagaatgctgagctgaagaaggtgctgcagcagatgaagaaggagatgatcagcctgctgagcccccagaagaagaagccccgggagcgggtggatgacagcactggaacagtcatcagtgatgtggaggaggatgctggggagctgagccgggagagcatgtgggacctgagctgtgaaacagtgcgggagcagctgaccaacagcatcaggaagcagtggaggatcctgaagagccacgtggagaagctggacaaccaggtgtccaaggtgcacctggagggcttcaatgatgaagatgtgatcagccggcaggaccacgagcaggagacagagaagctggagctggagatccagcagtgcaaggagatgatcaagacccagcagcagctgctgcagcagcagctggccacagcctatgatgatgacaccaccagcctgctgcgggactgctacctgctggaggagaaggagcggctgaaggaggagtggagcctcttcaaggagcagaagaagaactttgagcgggagcggcgctccttcacagaggccgccatccggctgggcctggagatcggcttcctgctgctgtctgtgctgcacaagaagagcctgctgggcatccaccacagcagcacagtgagccgctgtggggtgcggcggcagtgcaaccaggactacatctgctgcctgaagaagaagggcatctag

SEQ ID NO: 17125 - DNA, 672 bp, Artificial Sequence
  Description of Artificial Sequence: Synthetic coding sequence
atgaatggagatgatgcctttgcccggcggcccaccgtgggcgcccagatccctgagaagatccagaaggcctttgatgacatcgccaagtacttcagcaaggaggagtgggagaagatgaaggccagcgagaagatcttctacgtgtacatgaagaggaaatatgaggccatgaccaagctgggcttcaaggccaccctgccccccttcatgtgcaacaagagagctgaggacttccagggcaatgacctggacaatgaccccaacagaggcaaccaggtggagcggccccagatgaccttcggccgcctgcagggcatcagccccaagatcatgcccaagaagccagctgaggagggcaatgattctgaggaggtgcctgaggccagcggcccccagaatgatggcaaggagctgtgccccccaggcaagcccaccaccagcgagaagatccacgagaggagcggcaaccgggaggcccaggagaaggaggagcggcggggcacagcccaccgctggagcagccagaacacccacaacatcggccgcttcagcctgagcacctccatgggcgctgtgcacggcacccccaagaccatcacccacaacagagaccccaagggcggcaacatgcctggccccacagactgtgtgcgggagaacagctggtag

SEQ ID NO: 17126 - DNA, 567 bp, Artificial Sequence
  Description of Artificial Sequence: Synthetic coding sequence
atgaatggagatgatgcctttgcccggcggcccaccgtgggcgcccagatccctgagaagatccagaaggcctttgatgacatcgccaagtacttcagcaaggaggagtgggagaagatgaaggccagcgagaagatcttctacgtgtacatgaagaggaaatatgaggccatgaccaagctgggcttcaaggccaccctgccccccttcatgtgcaacaagagagctgaggacttccagggcaatgacctggacaatgaccccaacagaggcaaccaggtggagcggccccagatgaccttcggccgcctgcagggcatcagccccaagatcatgcccaagaagccagctgaggagggcaatgattctgaggaggtgcctgaggccagcggcccccagaatgatggcaaggagctgtgccccccaggcaagcccaccaccagcgagaagatccacgagaggagcggccccaagagaggagagcacgcctggacccaccggctgcgggagaggaagcagctggtgatctatgaggagatcagtgaccctgaagaagatgatgaatag

SEQ ID NO: 17127 - DNA, 567 bp, Artificial Sequence
  Description of Artificial Sequence: Synthetic coding sequence
atgaatggagatgatgcctttgcccggcggcccagagatgatgcccagatcagcgagaagctgaggaaggcctttgatgacatcgccaagtacttcagcaagaaggagtgggagaagatgaagagcagcgagaagatcgtgtatgtgtacatgaagctgaactatgaggtgatgaccaagctgggcttcaaggtgaccctgccccccttcatgaggagcaagagagctgctgacttccacggcaatgactttggaaatgacaggaaccacaggaaccaggtggagcggccccagatgaccttcggcagcctgcagaggatcttccccaagatcatgcccaagaagccagctgaggaggagaatggcctgaaggaggtgcctgaggccagcggcccccagaatgatggcaagcagctgtgccccccaggcaaccccagcaccctggagaagatcaacaagaccagcggccccaagaggggcaagcacgcctggacccaccggctgcgggagaggaagcagctggtggtgtatgaggagatcagtgaccctgaagaagatgatgaatag

SEQ ID NO: 17128 - DNA, 462 bp, Artificial Sequence
  Description of Artificial Sequence: Synthetic coding sequence
atgaatggagatgatgcctttgcccggcggcccagagatgatgcccagatcagcgagaagctgaggaaggcctttgatgacatcgccaagtacttcagcaagaaggagtgggagaagatgaagagcagcgagaagatcgtgtatgtgtacatgaagctgaactatgaggtgatgaccaagctgggcttcaaggtgaccctgccccccttcatgaggagcaagagagctgctgacttccacggcaatgactttggaaatgacaggaaccacaggaaccaggtggagcggccccagatgaccttcggcagcctgcagaggatcttccccaaggaccccaagggcggcaacatgcctggccccacagactgtgtgcgggagagctcctggtggttcatgaagaggtctgccaccctgaggaagatgaccagcaacagcccccggggctatgacacctgcccctag

SEQ ID NO: 17129 - DNA, 690 bp, Artificial Sequence
  Description of Artificial Sequence: Synthetic coding sequence
atgaatggagatgatgcctttgtgagaagaccccgggtgggcagccagatccctgagaagatgcagaagcacccctggaggcaggtgtgtgaccggggcatccacctggtgaacctgagccccttctggaaggtgggccgggagcccgccagcagcatcaaggccctgctgtgtggccgcggggaggcccgggcctttgatgacatcgccaagtacttcagcgagaaggagtgggagaagatgaaggccagcgagaagatcatctacgtgtacatgaagaggaaatatgaggccatgaccaagctgggcttcaaggccaccctgccccccttcatgaggaacaagagggtggccgacttccagggcaatgactttgacaatgaccccaacagaggcaaccaggtggagcacccccagatgaccttcggccgcctgcagggcatcttccccaagatcaccccagagaagccagctgaggagggcaatgacagcaaaggagtgcctgaggccagcggcccccagaacaacgggaagcagctgcggcccagcggcaagctgaacaccagcgagaaggtgaacaagaccagcggccccaagaggggcaagcacgcctggacccaccgggtgcgggagaggaagcagctggtgatctatgaggagatcagtgacccccaggaggatgatgaatag

SEQ ID NO: 17130 - DNA, 567 bp, Artificial Sequence
  Description of Artificial Sequence: Synthetic coding sequence
atgaatggagatgatgcctttgtgagaagaccccgggtgggcagccagatccctgagaagatgcagaaggcctttgatgacatcgccaagtacttcagcgagaaggagtgggagaagatgaaggccagcgagaagatcatctacgtgtacatgaagaggaaatatgaggccatgaccaagctgggcttcaaggccaccctgccccccttcatgaggaacaagagggtggccgacttccagggcaatgactttgacaatgaccccaacagaggcaaccaggtggagcacccccagatgaccttcggccgcctgcagggcatcttccccaagatcaccccagagaagccagctgaggagggcaatgacagcaagggcgtgcctgaggccagcggcccccagaacaacgggaagcagctgcggcccagcggcaagctgaacaccagcgagaaggtgaacaagaccagcggccccaagaggggcaagcacgcctggacccaccgggtgcgggagaggaagcagctggtgatctatgaggagatcagtgacccccaggaggatgatgaatag

SEQ ID NO: 17131 - DNA, 567 bp, Artificial Sequence; identical to SEQ ID NO: 17130
  Description of Artificial Sequence: Synthetic coding sequence

SEQ ID NO: 17132 - DNA, 387 bp, Artificial Sequence
  Description of Artificial Sequence: Synthetic coding sequence
ctcatcaccagcgctgctgaatgtccccacgccacagaggtgtccctggagtttggaaacctgtaccagcagaggaagatcctgatgtacagcctgtctgtggagcacccccagatgaccttcggccgcctgcagggcatcttccccaagatcaccccagagaagccagctgaggagggcaatgacagcaagggcgtgcctgaggccagcggcccccagaacaacgggaagcagctgcggcccagcggcaagctgaacaccagcgagaaggtgaacaagaccagcggccccaagaggggcaagcacgcctggacccaccgggtgcgggagaggaagcagctggtgatctatgaggagatcagtgacccccaggaggatgatgaatag

SEQ ID NO: 17133 - DNA, 273 bp, Artificial Sequence
  Description of Artificial Sequence: Synthetic coding sequence
atgaccttcggccgcctgcagaggatcatccccaagatcatgcctgagaagccagctgaggagggcagtgacagcaagggcgtgcctgaggccagcggcccccagaatgatggcaagaagctgtgccccccaggcaaggccagcagcagcgagaagatccacgagaggagcggccccaagaggggcaagcacgcctggacccaccggctgcgggagaggaagcagctggtgatctatgaggagatcagtgaccctgaagaagatgacaagtag

SEQ ID NO: 17134 - DNA, 567 bp, Artificial Sequence
  Description of Artificial Sequence: Synthetic coding sequence
atgaatggagatgatgcctttgccaagaggcccagagatgatgccaaggccagcgagaagaggagcaaggcctttgatgacatcgccaagtacttcagcaaggaggagtgggagaagatgaagttcagcgagaagatcagctgtgtgcacatgaagaggaaatatgaggccatgaccaagctgggcttcaacgtgaccctgagcctcttcatgaggaacaagagggccacagacagccagagaaatgacagcgacaatgacaggaacagaggaaatgaggtggagcggccccagatgaccttcggccgcctgcagaggatcatccccaagatcatgcctgagaagccagctgaggagggcagtgacagcaagggcgtgcctgaggccagcggcccccagaatgatggcaagaagctgtgccccccaggcaaggccagcagcagcgagaagatccacgagaggagcggccccaagaggggcaagcacgcctggacccaccggctgcgggagaggaagcagctggtgatctatgaggagatcagtgaccctgaagaagatgacaagtag

SEQ ID NO: 17135 - DNA, 567 bp, Artificial Sequence
  Description of Artificial Sequence: Synthetic coding sequence
atgaatggagatgatgcctttgcccggcggcccagggctggggcccagatccctgagaagatccagaagagctttgatgacatcgccaagtacttcagcaagaaggagtgggagaagatgaagagcctggagaagatctcctatgtgtacatgaagaggaaatatgaggccatgaccaagctgggcttcaaggccaccctgccccccttcatgcacaacacaggagccacagacctgcagggcaatgactttgacaatgacaggaaccagggcaaccaggtggagcggccccagatgaccttctgccgcctgcagaggatcttccccaagatcatgcccaagaagccagctgaggagggcaatgacagcaagggcgtgcctgaggccagcggcagccagaatgatggcaagcacctgtgccccccaggcaagcccagcaccagcgagaagatcaacaagaccagcggccccaagaggggcaagcacgcctggacccaccggctgcgggagaggaagcagctggtgatctatgaggagatcagtgaccctgaagaagatgatgaatag

SEQ ID NO: 17136 - DNA, 567 bp, Artificial Sequence
  Description of Artificial Sequence: Synthetic coding sequence
atgaatggagatgatgcctttgcccggcggcccagggctggcagccagatccctgagaagatccagaaggcctttgatgacatcgccaagtacttcagcaagaaggagtgggagaagatgaagagcagcgagaagatcatctacgtgtacatgaagaggaaatatgaggccatgaccaagctgggcttcaaggccaccctgccccccttcatgtgcaacacaggagccacagacctgcagggcaatgactttgacaatgacaggaaccacaggaaccaggtggagaggagccagatgaccttcggccgcctgcagggcatcttccccaagatcatgcccaagaagccagctgaggtgggcaatgacagcaaggaggtgcctgaggccagcggcctgcagaatgatggcaagcagctgtgccccccaggcaagcccaccaccagcgagaagatcaacaaggccagcggccccaagaggggcaagcacgcctggacccaccggctgcgggagaggaagcagctggtgatctatgaggagatcagtgaccctgaagaagatgatgaatag

SEQ ID NO: 17137 - DNA, 567 bp, Artificial Sequence; identical to SEQ ID NO: 17136
  Description of Artificial Sequence: Synthetic coding sequence

SEQ ID NO: 17138 - DNA, 5481 bp, Artificial Sequence
  Description of Artificial Sequence: Synthetic coding sequence
atgaggcctggctgtgacctgctgctgcgggccgccgccaccgtgacagctgccatcatgtctgacagcgacagcgaggaggacagcagcggcggcggccccttcaccctggccggcatcctgtttggaaacatcagcggggccggccagctggagggggagagcgtgctggatgatgagtgcaagaagcacctggccggcctgggcgccctgggcctgggcagcctcatcacagagctgacagccaatgaggagctgactggaactggaggagccctggtgaatgatgagggctggatccgcagcacagaagatgctgtggactacagcgacatcaatgaggtggctgaagatgagagccagaggcaccagcagaccatgggcagcctgcagcccctgtaccacagcgactatgatgaagatgattatgatgctgactgtgaggacatcgactgcaagctgatgcctcctcctcctcctcctcctggccccatgaagaaggacaaggaccaggatgccatcacctgtgtgtctgagagcggggaggacatcatcctgcccagcatcatcgcccccagcttcctggccagcgagaaggtggacttcagcagctacagcgacagcgagagcgagatgggcccccaggaggccacccaggccgagagtgaagatggcaagctgaccctgcccctggccggcatcatgcagcatgatgccaccaagctgctgcccagcgtgacagagctgtttcctgagttccggcctgggaaggtgctgcgcttcctgcacctgtttggacctgggaagaatgtgcccagcgtgtggaggtctgcccggaggaagaggaagaagcaccgggagctgatccaggaggagcagatccaggaggtggagtgcagcgtggagagcgaggtgtcccagaagagcctgtggaactatgactatgcccctcctcctcctcctgagcagtgcctggctgatgatgagatcaccatgatggtgcctgtggagagcaagttcagccagagcactggagatgtggacaaggtgacagacaccaagccccgggtggccgagtggaggtatggccctgcccggctgtggtatgacatgctgggcgtgtctgaagatggcagcggctttgattatggcttcaagctgaggaagacccagcacgagcccgtcatcaagagcaggatgatggaggagttcaggaagctggaggagagcaatggaacagacctgctggctgatgagaacttcctgatggtgacccagctgcactgggaggacagcatcatctgggatggagaggacatcaagcacaagggcaccaagccccagggcgccagcctggccggctggctgcccagcatcaagaccagaaatgtgatggcctacaacgtgcagcagggctttgcccccaccctggatgatgacaagccctggtacagcatcttccccatcgacaatgaagacctggtgtatggccgctgggaggacaacatcatctgggatgcccaggccatgccccggctgctggagccccctgtgctggccctggaccccaatgatgagaacctgatcctggagatcccagatgagaaggaggaggccaccagcaacagccccagcaaggagagcaagaaggagagcagcctgaagaagagccgcatcctgctgggcaagacaggagtcatccgggaggagccccagcagaacatgagccagcctgaggtgaaggacccctggaacctgagcaatgatgagtactacttccccaagcagcagggcctgcggggcacctttggaggcaacatcatccagcacagcatcccagccatggagctgtggcagcccttcttccccacccacatgggccccatcaagatccggcagttccacaggcctcccctgaagaagtacagctttggagccctgagccagcccggcccccacagcgtgcagcccctgctgaagcacatcaagaagaaggccaagatgagggagcaggagcggcaggccagcggcggcggggagctgttcttcatgaggaccccccaggacctgaccgggaaggatggagacctgatcctggccgagtacagtgaagaaaatggccccctgatgatgcaggtgggcatggccaccaagatcaagaactactacaagaggaagccaggcaaggaccccggggccccagactgcaagtacggggagaccgtgtactgccacaccagccccttcctgggcagcctgcaccctggccagctgctgcaggccctggagaacaacctcttccgggcccctgtgtacctgcacaagatgcctgagacagacttcctgatcatccgcacccggcagggctactacatccgggagctggtggacatctttgtggtgggccagcagtgccccctgtttgaggtgcccggccccaacagccggcgggccaacatgcacatccgggacttcctgcaggtgttcatctaccgcctcttctggaagagcaaggaccggccccggcgcatccgcatggaggacatcaagaaggccttccccagccacagcgagagcagcatcaggaagaggctgaagctgtgtgccgacttcaagaggacaggcatggacagcaactggtgggtgctgaagagtgacttccggctgcccacagaggaggagatccgggccaaggtgtccccagagcagtgctgtgcctactacagcatgattgctgccaagcagaggctgaaggatgctggctacggggagaagagcttctttgcccctgaggaggagaatgaggaggacttccagatgaagattgatgatgaggtgcacgccgccccctggaacaccacccgggccttcatcgccgccatgaagggcaagtgcctgctggaggtgactggagtggccgaccccaccggctgtggggagggcttctcctatgtgaagatccccaacaagcccacccagcagaaggatgacaaggagccccaggccgtgaagaagacagtgactggaacagatgctgacctgcggcggctgagcctgaagaatgccaagcagctgctgaggaagtttggagtgcctgaggaggagatcaagaagctgagccgctgggaggtgattgatgtggtgaggaccatgagcacagagcaggcccacagcggggagggccccatgagcaagtttgcccggggcagccgcttctctgtggccgagcaccaggagcgctacaaggaggagtgccagaggatctttgacctgcagaacaaggtgctgagcagcacagaggtgctgagcacagacacagacagcatctctgctgaggacagcgactttgaggagatgggcaagaacatcgagaacatgctgcagaacaagaagaccagcagccagctgagccgggagtgggaggagcaggagaggaaggagctgcggaggatgctgctggtggccggcagcgctgccagcggcaacaaccacagagatgatgtgacagcctccatgaccagcctgaagagcagcgccaccggccactgcctgaagatctaccgcaccttcagagatgaggagggcaaggagtatgtgcgctgtgaaacagtgaggaagccagctgtgattgatgcctacgtgcgcatccgcaccaccaaggatgagaagttcatccagaagtttgccctgtttgatgagaagcaccgggaggagatgaggaaggagcggcggcgcatccaggagcagctgcggcggctgaagaggaaccaggagaaggagaagctgaagggccccccagagaagaagcccaagaagatgaaggagaggccagacctgaagctgaagtgtggggcctgtggggccatcggccacatgaggaccaacaagttctgccccctgtactaccagaccaacgtgccccccagcaagcctgtggccatgacagaggagcaggaggaggagctggagaagacagtcatccacaatgacaatgaggagctgatcaaggtggagggcaccaagatcgtgtttgggaagcagctgattgaaaatgtgcatgaggtgcggaggaagagcctggtgctgaagttccccaagcagcagctgccccccaagaagaagagaagagtgggcaccaccgtgcactgtgactacctgaacatcccccacaagagcatccacagaagaagaacagaccccatggtgaccctgagcagcatcctggagagcatcatcaatgacatgagggacctgcccaacacccaccccttccacacccctgtgaatgccaaggtggtgaaggactactacaagatcatcacccggcccatggacctgcagaccctgagagaaaatgtgaggaagtgcctgtaccccagccgggaggagttccgggagcacctggagctgattgtgaagaacagcgccacctacaacggccccaagcacagcctgacccagatcagccagagcatgctggacctgtgtgatgagaagctgaaggagaaggaggacaagctggcccggctggagaaggccatcaaccccctgctggatgatgatgaccaggtggccttctccttcatcctggacaacatcgtgacccagaagatgatggctgtgcctgacagctggcccttccaccaccctgtgaacaagaagtttgtgcctgactactacaagatgattgtgaaccctgtggacctggagaccatcaggaagaacatcagcaagcacaagtaccagagccgggagagcttcctggatgatgtgaacctgatcctggccaacagcgtgaagtacaacggccctgagagccagtacaccaagacagcccaggagatcgtgaacatctgctaccagaccatcacagaatatgatgagcacctgacccagctggagaaggacatctgcacagccaaggaggccgccctggaggaggccgagctggagagcctggaccccatgaccccaggcccctacaccagccagcccccagacatgtatgacaccaacaccagcctgagcaccagcagagatgccagcgtcttccaggatgagagcaacctgtctgtgctggacatcagcacagccaccccagagaagcagatgtgccagggccagggccgcctgggggaggaggacagtgatgtggatgtggagggctatgatgatgaggaggaggatggcaagcccaagcccccagcccctgagggcggagatggagacctggctgatgaggaggagggcaccgtgcagcagcctgaggcctctgtgctgtatgaggacctgctgatcagcgagggggaggatgatgaggaggatgctggcagtgatgaggagggggacaaccccttcagcgccatccagctgtctgagagcggcagtgacagtgatgtgggctacggcggcatccggcccaagcagcccttcatgctgcagcacgccagcggggagcacaaggatggccacggcaagtag

SEQ ID NO: 17139 - DNA, 375 bp, Artificial Sequence
  Description of Artificial Sequence: Synthetic coding sequence
atggctgatgaggaggaggaccccacctttgaggaggagaatgaggagattggaggcggcgctgagggcggccagggcaagaggaagaggctcttcagcaaggagctgcgctgcatgatgtatggctttggagatgaccagaacccctacacagaatctgtggacatcctggaggacctggtgattgagttcatcacagagatgacccacaaggccatgagcatcggccggcagggccgggtgcaggtggaggacatcgtgttcctgatcaggaaggaccccaggaagtttgcccgggtgaaggacctgctgaccatgaatgaggagctgaagagggccaggaaggcctttgatgaggccaactacggcagctag

SEQ ID NO: 17140 - DNA, 375 bp, Artificial Sequence; identical to SEQ ID NO: 17139
  Description of Artificial Sequence: Synthetic coding sequence

SEQ ID NO: 17141 - DNA, 3600 bp, Artificial Sequence
  Description of Artificial Sequence: Synthetic coding sequence
atgcccctgactggagtggagcccgccaggatgaacaggaagaagggggacaagggctttgagagcccccggccctacaagctgacccaccaggtggtgtgcatcaacaacatcaacttccagaggaagtctgtggtgggctttgtggagctgaccatcttccccaccgtggccaacctgaaccgcatcaagctgaacagcaagcagtgccgcatctacagagtgcgcatcaatgacctggaggccgccttcatctacaatgaccccaccctggaggtgtgccacagcgagagcaagcagaggaacctgaactacttcagcaatgcctatgctgctgctgtgtctgctgtggaccctgatgctggaaatggagagctgtgcatcaaggtgcccagcgagctgtggaagcacgtggatgagctgaaggtgctgaagatccacatcaacttcagcctggaccagcccaagggcggcctgcactttgtggtgcccagcgtggagggctccatggccgagcggggggcccacgtgttcagctgtggctaccagaacagcacccgcttctggttcccctgtgtggacagctacagcgagctgtgcacctggaagctggagttcaccgtggatgctgccatggtggccgtgtccaatggagacctggtggagaccgtgtacacccatgacatgaggaagaagaccttccactacatgctgaccatccccacagctgccagcaacatcagcctggccatcggcccctttgagatcctggtggacccctacatgcatgaggtgacccacttctgcctgccccagctgctgcccctgctgaagcacaccaccagctacctgcacgaggtgtttgagttctatgaggagatcctgacctgccgctacccctacagctgcttcaagacagtgttcattgatgaggcctacgtggaggtggccgcctatgcctccatgagcatcttcagcaccaacctgctgcacagcgccatgatcattgatgagacccccctgacccggcgctgcctggcccagagcctggcccagcagttcttcggctgcttcatcagcaggatgtcctggagcgatgagtgggtgctgaagggcatcagcggctacatctacggcctgtggatgaagaagaccttcggcgtgaatgagtaccgccactggatcaaggaggagctggacaagatcgtggcctatgagctgaagacaggaggagtgctgctgcaccccatctttggaggcggcaaggagaaggacaacccagccagccacctgcacttcagcatcaagcacccccacaccctgtcctgggagtactacagcatgttccagtgcaaggcccacctggtgatgaggctgattgaaaatcgcatctccatggagttcatgctgcaggtgttcaacaagctgctgagcctggccagcacagccagcagccagaagttccagagccacatgtggagccagatgctggtgtccaccagcggcttcctgaagagcatcagcaatgtgtctgggaaggacatccagcccctcatcaagcagtgggtggaccagagcggcgtggtgaagttctacggcagctttgccttcaacaggaagagaaatgtgctggagctggagatcaagcaggactacaccagccctggcacccagaagtatgtgggccccctgaaggtgacagtgcaggagctggatggcagcttcaaccacaccctgcagatcgaggagaacagcctgaagcatgacatcccctgccacagcaagagcagaagaaacaagaagaagaagatccccctgatgaatggagaggaggtggacatggacctgagcgccatggatgctgacagccccctgctgtggatcagaattgatcctgacatgtctgtgctgaggaaggtggagtttgagcaggccgacttcatgtggcagtaccagctgcgctatgaaagagatgtggtggcccagcaggagagcatcctggccctggagaagttccccaccccagccagccggctggccctgacagacatcctggagcaggagcagtgcttctacagagtgaggatgtctgcctgcttctgcctggccaagatcgccaacagcatggtgtccacctggacaggccccccagccatgaagagcctcttcaccaggatgttctgctgcaagagctgccccaacatcgtgaagaccaacaacttcatgtccttccagagctacttcctgcagaagaccatgcctgtggccatggccctgctgagagatgtgcacaacctgtgccccaaggaggtgctgaccttcatcctggacctgatcaagtacaatgacaacaggaagaacaagttcagtgacaactactacagagctgagatgattgatgccctggccaacagcgtgaccccagctgtgtctgtgaacaatgaggtgaggaccctggacaacctgaacccagatgtgcggctcatcctggaggagatcacccgcttcctgaacatggagaagctgctgcccagctaccgccacaccatcaccgtgtcctgcctgcgggccatccgggtgctgcagaagaatggccacgtgcccagcgaccctgccctcttcaagagctatgcagaatatggccactttgtggacatcagaattgctgccctggaggccgtggtggactacaccaaggtggacaggagctatgaggagctgcagtggctgctgaacatgatccagaatgaccctgtgccctacgtgcgccacaagatcctgaacatgctgaccaagaacccccccttcaccaagaacatggagagccccctgtgcaatgaggccctggtggaccagctgtggaagctgatgaacagcggcaccagccatgactggaggctgcgctgtggggctgtggacctgtacttcaccctgtttggcctgagccggcccagctgcctgcccctgcctgagctgggcctggtgctgaacctgaaggagaagaaggctgtgctgaaccccaccatcatccctgagagcgtggccggcaaccaggaggccgccaacaaccccagcagccacccccagctggtgggcttccagaaccccttcagcagcagccaggatgaggaggagattgacatggacacagtgcatgacagccaggccttcatcagccaccacctgaacatgctggagcggcccagcaccccaggcctgagcaagtacagacctgccagcagccgcagcgccctgatcccccagcacagcgctggctgtgacagcacccccaccaccaagccccagtggagcctggagctggccaggaagggcaccgggaaggagcaggcccccctggagatgtccatgcaccctgctgccagcgcccccctgagcgtcttcaccaaggagagcacagccagcaagcacagcgaccaccaccaccaccaccaccacgagcacaagaagaagaagaagaagcacaagcacaagcacaagcacaagcacaagcatgacagcaaggagaaggacaaggagcccttcaccttcagcagccctgccagcggccgcagcatccgcagccccagcctgagtgactag

SEQ ID NO: 17142 - DNA, 1770 bp, Artificial Sequence
  Description of Artificial Sequence: Synthetic coding sequence
atgaagagggtgaggacagagcagatccagatggctgtgtcctgctacctgaagaggcggcagtatgtggacagtgatggccccctgaagcagggcctgcggctgagccagacagctgaggagatggccgccaacctgactgtgcagagcgagagcggctgtgccaacatcgtgtctgctgccccctgccaggccgagccccagcagtatgaggtgcagtttggccgcctgaggaacttcctgacagacagcgacagccagcacagccatgaggtgatgcccctgctgtaccccctgtttgtgtacctgcacctgaacctggtgcagaacagccccaagagcacagtggagagcttctacagccgcttccacggcatgttcctgcagaatgccagccagaaggatgtgattgagcagctgcagaccacccagaccatccaggacatcctgagcaacttcaagctgcgggccttcctggacaacaagtatgtggtgcggctgcaggaggacagctacaactacctgatccgctacctgcagagcgacaacaacacagccctgtgcaaggtgctgaccctgcacatccacctggatgtgcagcctgccaagaggacagactaccagctgtatgccagcggcagcagcagccgctcagaaaataatggcctggagcccccagacatgcccagccccatcctgcagaatgaagctgccctggaggtgctgcaggagagcatcaagagggtgaaggatggcccccccagcctgaccaccatctgcttctacgccttctacaacacagagcagctgctgaacacagctgagatcagcccagacagcaagctgctggccgccggctttgacaacagctgcatcaagctgtggagcctgcggagcaagaagctgaagtctgagccccaccaggtggatgtgagccgcatccacctggcctgtgacatcctggaggaggaggatgatgaagatgacaatgccggcacagagatgaagatcctgcggggccactgcggccctgtgtacagcacccgcttcctggccgacagcagcggcctgctgagctgcagcgaggacatgagcatccgctactgggacctgggcagcttcaccaacacagtgctgtaccagggccacgcctaccctgtgtgggacctggacatcagcccctacagcctgtactttgccagcggcagccatgacagaacagcccggctgtggagctttgacaggacctaccccctgcgcatctatgccggccacctggctgatgtggactgtgtgaagttccaccccaacagcaactacctggccaccggcagcacagacaagacagtgcggctgtggagcgcccagcagggcaacagcgtgcggctcttcaccggccaccggggccctgtgctgagcctggccttcagccccaacgggaagtacctggccagcgctggggaggaccagaggctgaagctgtgggacctggccagcggcaccctgtacaaggagctgcggggccacacagacaacatcaccagcctgaccttctccccagacagcggcctgattgccagcgcctccatggacaacagcgtgcgggtgtgggacatccggaacacctactgcagcgccccagcagatggcagcagcagcgagctggtgggcgtgtacacaggccagatgagcaatgtgctgtctgtgcagttcatggcctgcaacctgctgctggtgacaggcatcacccaggagaaccaggagcactag

SEQ ID NO: 17143 - DNA, 255 bp, Artificial Sequence
  Description of Artificial Sequence: Synthetic coding sequence
atgaagagggtgaggacagagcagatccagatggctgtgtcctgctacctgaagaggcggcagtatgtggacagtgatggccccctgaagcagggcctgcggctgagccagacagctgaggagatggccgccaacctgactggaaatggaggcggcagcagcggcggcgtgtccctggagcaggagaacagccggcagtacccctgtggcatcaccagccccctgctgaagacagtgcctgagagagctgactag

SEQ ID NO: 17144 - DNA, 978 bp, Artificial Sequence
  Description of Artificial Sequence: Synthetic coding sequence
atgaagagggtgaggacagagcagatccagatggctgtgtcctgctacctgaagaggcggcagtatgtggacagtgatggccccctgaagcagggcctgcggctgagccagacagctgaggagatggccgccaacctgactgtgcagagcgagagcggctgtgccaacatcgtgtctgctgccccctgccaggccgagccccagcagtatgaggtgcagtttggccgcctgaggaacttcctgacagacagcgacagccagcacagccatgaggtgatgcccctgctgtaccccctgtttgtgtacctgcacctgaacctggtgcagaacagccccaagagcacagtggagagcttctacagccgcttccacggcatgttcctgcagaatgccagccagaaggatgtgattgagcagctgcagaccacccagaccatccaggacatcctgagcaacttcaagctgcgggccttcctggacaacaagtatgtggtgcggctgcaggaggacagctacaactacctgatccgctacctgcagagcgacaacaacacagccctgtgcaaggtgctgaccctgcacatccacctggatgtgcagcctgccaagaggacagactaccagctgtatgccagcggcagcagcagccgctcagaaaataatggcctggagcccccagacatgcccagccccatcctgcagaatgaagctgccctggaggtgctgcaggagagcatcaagagggtgaaggatggcccccccagcctgaccaccatctgcttctacgccttctacaacacagagcagctgctgaacacagctgagatcagcccagacagcaagctgctggccgccggctttgacaacagctgcatcaagctgtggagcctgcggagcaagaagctgaagtctgagccccaccaggtggatgtgagccgcatccacctggcctgtgacatcctggaggaggaggtgtag

SEQ ID NO: 17145 - DNA, 1770 bp, Artificial Sequence; identical to SEQ ID NO: 17142
  Description of Artificial Sequence: Synthetic coding sequence

SEQ ID NO: 17146 - DNA, 1869 bp, Artificial Sequence
  Description of Artificial Sequence: Synthetic coding sequence
atgtctgagcgggaggagaggagatttgtggagatcccccgggagagcgtgcggctgatggccgagagcacaggcctggagctgagtgatgaggtggccgccctgctggccgaggatgtgtgctaccgcctgcgggaggccacccagaacagcagccagttcatgaagcacaccaagaggaggaagctgactgtggaggacttcaacagagccctgcgctggagctctgtggaggccgtgtgtggctacggcagccaggaggccctgcccatgaggcctgcccgggagggggagctgtacttcccagaagatcgggaggtgaacctggtggagctggccctggccaccaacatccccaagggctgtgccgagacagctgtgcgggtgcacgtgtcctacctggatggaaaaggaaacctggccccccagggctctgtgcccagcgctgtgagcagcctgacagatgacctgctgaagtactaccaccaggtgaccagggctgtgctgggagatgacccccagctgatgaaggtggccctgcaggacctgcagaccaacagcaagattggagccctgctgccctactttgtgtatgtggtgtctggagtgaagtctgtgtcccatgacctggagcagctgcaccggctgctgcaggtggcccggagcctcttcaggaacccccacctgtgcctgggcccctacgtgcgctgcctggtgggctctgtgctgtactgtgtgctggagcccctggccgccagcatcaaccccctgaatgaccactggaccctgagagatggagctgccctgctgctgagccacatcttctggacccacggggacctggtgtctggcctgtaccagcacatcctgctgagcctgcagaagatcctggccgaccctgtgcggcccctgtgctgccactacggggctgtggtgggcctgcacgccctgggctggaaggctgtggagcgggtgctgtacccccacctgagcacctactggaccaacctgcaggccgtgctggatgactacagcgtgtccaatgcccaggtgaaggcagatggccacaaggtgtatggagccatcctggtggccgtggagcggctgctgaagatgaaggcccaggccgctgagcccaacagaggaggccctgggggccggggctgccggcggctggatgacctgccctgggacagcctgctcttccaggagagcagcagcggcggcggcgctgagcccagctttggaagtggcctgcccctgcccccaggaggagctggccctgaggaccccagcctgtctgtgaccctggccgacatctaccgggagctgtatgccttcttcggggacagcctggccacccgcttcggcaccggccagcctgcccccacagccccccggcccccaggggacaagaaggagcctgctgctgccccagattctgtgaggaagatgccccagctgacagccagcgccatcgtgagcccccatggagatgagagcccccggggcagcggcggcggcggccctgccagcgccagcggccctgctgccagcgagagccggcccctgccccgggtgcaccgggcccggggggccccccggcagcagggccctggcaccggcaccagagatgtgttccagaagagcagatttgcccccaggggggccccccacttccgcttcatcatcgccggccggcaggccggccgccgctgccggggccgcctcttccagacagccttccctgccccctacggccccagccctgccagccgctacgtgcagaagctgcccatgattggaagaaccagcaggcctgcccggcgctgggccctgagtgactacagcctgtacctgcccctgtag

SEQ ID NO: 17147 - DNA, 153 bp, Artificial Sequence
  Description of Artificial Sequence: Synthetic coding sequence
atgtctgagcgggaggagaggagatttgtggagatcccccgggagagcgtgcggctgatggccgagagcacaggcctggagctgagtgatgaggtggccgccctgctggccgaggatgtgtgctaccgcctgcgggaggccacccagaactag

SEQ ID NO: 17148 - DNA, 438 bp, Artificial Sequence
  Description of Artificial Sequence: Synthetic coding sequence
atgtctgagcgggaggagaggagatttgtggagatcccccgggagagcgtgcggctgatggccgagagcacaggcctggagctgagtgatgaggtggccgccctgctggccgaggatgtgtgctaccgcctgcgggaggccacccagaacagcagccagttcatgaagcacaccaagaggaggaagctgactgtggaggacttcaacagagccctgcgctggagctctgtggaggccgtgtgtggctacggcagccaggaggccctgcccatgaggcctgcccgggagggggagctgtacttcccagaagatcgggaggtgaacctggtggagctggccctggccaccaacatccccaagggctgtgccgagacagctgtgcgggtgcacgtgtcctacctggatggaaaaggaaacctggccccccagggcagctag

SEQ ID NO: 17149 - DNA, 1473 bp, Artificial Sequence
  Description of Artificial Sequence: Synthetic coding sequence
atggccacagagttcatcaagagctgctgcggcggctgcttctatggagaaacagagaagcacaacttctctgtggagcgggacttcaaggctgctgtgcccaacagccagaatgccaccatctctgtgccccccctgacctctgtgtctgtgaagccccagctgggctgcacagaggactacctgctgagcaagctgcccagtgatggcaaggaggtgccctttgtggtgcccaagttcaagctgagctacatccagcccaggacccaggagacccccagccacctggaggagctggagggcagcgcccgggccagctttggagacaggaaggtggagctgagcagcagcagccagcacggccccagctatgatgtgtacaaccccttctacatgtaccagcacatcagcccagacctgagccgccgcttccccccaagaagtgaggtgaagaggctgtatggctctgtgtgtgacctgcggaccaacaagctgcccggcagccctggcctgagcaagtccatgtttgacctgaccaacagcagccagcgcttcatccagagacatgacagcctgagctctgtgcccagcagcagcagcagcaggaagaacagccagggcagcaacagaagcctggacaccatcaccctgtctggagatgagcgggactttggccgcctgaatgtgaagctgttctacaacagctctgtggagcagatctggatcaccgtgctgcagtgccgggacctgtcctggcccagcagctatggagacacccccaccgtgtccatcaagggcatcctgaccctgcccaagcctgtgcacttcaagagcagcgccaaggagggcagcaatgccatcgagttcatggagacctttgtgtttgccatcaagctgcagaacctgcagacagtgcggctggtgttcaagatccagacccagacccccaggaagaagaccatcggagaatgttccatgagcctgcggaccctgagcacccaggagatggactacagcctggacatcaccccacccagcaagatctctgtgtgccacgccgagctggagctgggcacctgcttccaggccgtgaacagccgcatccagctgcagatcctggaggcccgctacctgcccagcagcagcacccccctgaccctgtccttctttgtgaaggtgggcatgttcagcagcggggagctgatctacaagaagaagacccggctgctgaaggccagcaatggccgggtgaagtggggcgagaccatgatcttccccctcatccagagcgagaaggagatcgtgttcctgatcaagctgtacagccgcagctctgtgcggaggaagcactttgtgggccagatctggatcagcgaggacagcaacaacatcgaggccgtgaaccagtggaaggagaccgtcatcaaccctgagaaggtggtgatccgctggcacaagctgaaccccagctag

SEQ ID NO: 17150 - DNA, 1473 bp, Artificial Sequence; identical to SEQ ID NO: 17149
  Description of Artificial Sequence: Synthetic coding sequence

SEQ ID NO: 17151 - DNA, 1473 bp, Artificial Sequence; identical to SEQ ID NO: 17149
  Description of Artificial Sequence: Synthetic coding sequence

SEQ ID NO: 17152 - DNA, 1281 bp, Artificial Sequence
  Description of Artificial Sequence: Synthetic coding sequence
atggccacagagttcatcaagagctgctgcggcggctgcttctatggagaaacagagaagcacaacttctctgtggagcgggacttcaaggctgctgtgcccaacagccagaatgccaccatctctgtgccccccctgacctctgtgtctgtgaagccccagctgggctgcacagaggactacctgctgagcaagctgcccagtgatggcaaggaggtgccctttgtggtgcccaagttcaagctgagctacatccagcccaggacccaggagacccccagccacctggaggagctggagggcagcgcccgggccagctttggagacaggaaggtggagctgagcagcagcagccagcacggccccagctatgatgtgtacaaccccttctacatgtaccagcacatcagcccagacctgagccgccgcttccccccaagaagtgaggtgaagaggctgtatggctctgtgtgtgacctgcggaccaacaagctgcccggcagccctggcctgagcaagtccatgtttgacctgaccaacagcagccagcgcttcatccagagacatgacagcctgagctctgtgcccagcagcagcagcagcaggaagaacagccagggcagcaacagaagcctggacaccatcaccctgtctggagatgagcgggactttggccgcctgaatgtgaagctgttctacaacagctctgtggagcagatctggatcaccgtgctgcagtgccgggacctgtcctggcccagcagctatggagacacccccaccgtgtccatcaagggcatcctgaccctgcccaagcctgtgcacttcaagagcagcgccaaggagggcagcaatgtgtgccacgccgagctggagctgggcacctgcttccaggccgtgaacagccgcatccagctgcagatcctggaggcccgctacctgcccagcagcagcacccccctgaccctgtccttctttgtgaaggtgggcatgttcagcagcggggagctgatctacaagaagaagacccggctgctgaaggccagcaatggccgggtgaagtggggcgagaccatgatcttccccctcatccagagcgagaaggagatcgtgttcctgatcaagctgtacagccgcagctctgtgcggaggaagcactttgtgggccagatctggatcagcgaggacagcaacaacatcgaggccgtgaaccagtggaaggagaccgtcatcaaccctgagaaggtggtgatccgctggcacaagctgaaccccagctag

SEQ ID NO: 17153 - DNA, 1767 bp, Artificial Sequence
  Description of Artificial Sequence: Synthetic coding sequence
atggacctggaggaggccgaggagttcaaggagcgctgcacccagtgtgccgctgtgtcctggggcctgacagatgagggcaagtactactgcaccagctgccacaacgtgacagagcgctaccaggaggtgaccaacacagacctgatccccaacacccagatcaaggccctgaacagaggcctgaagaagaagaacaacacagagaagggctgggactggtacgtgtgtgagggcttccagtacatcctgtaccagcaggccgaggccctgaagaacctgggcgtgggccctgagctgaagaatgatgtgctgcacaacttctggaagcgctacctgcagaagagcaagcaggcctactgcaagaaccctgtgtacaccaccggcaggaagcccaccgtgctggaggacaacctgagccacagcgactgggccagcgagcctgagctgctgagtgatgtgtcctgcccccccttcctggagagcggggctgagagccagagcgacatccacaccaggaagcccttccctgtgtccaaggccagccagagcgagacctctgtgtgcagcggcagcctggatggagtggagtacagccagaggaaggagaagggcatcgtgaagatgaccatgccccagaccctggccttctgctacctgagcctgctgtggcagcgggaggccatcaccctgagtgacctgctgcgctttgtggaggaggaccacatcccctacatcaatgccttccagcacttccctgagcagatgaagctgtatggccgggaccggggcatcttcggcatcgagagctggccagactatgaggacatctacaagaagacagtggaggtgggcaccttcctggacctgccccgcttcccagacatcacagaggactgctacctgcaccccaacatcctgtgcatgaagtacctgatggaggtgaacctgcctgatgagatgcacagcctgacctgccacgtggtgaagatgacaggcatgggagaggtggacttcctgacctttgaccccatcgccaagatggccaagacagtgaagtatgatgtgcaggccgtggccatcatcgtggtggtgctgaagctgctcttcctgctggatgacagctttgagtggagcctgagcaacctggccgagaagcacaatgagaagaacaagaaggacaagccctggtttgacttcaggaagtggtaccagatcatgaagaaggcctttgatgagaagaagcagaagtgggaggaggcccgggccaagtacctgtggaagtctgagaagcccctgtactacagctttgtggacaagcctgtggcctacaagaagcgggagatggtggtgaacctgcagaagcagttcagcaccctggtggagagcacagccacagctgggaagaagagccccagcagcttccagttcaactggacagaggaggacacagacaggacctgcttccacggccacagcctgcagggcgtgctgaaggagaagggccagagcctgctgaccaagaacagcctgtactggctgagcacccagaagttctgccgctgctactgcacccacgtgaccacctatgaggagagcaactacagcctgagctaccagttcatcctgaacctcttctccttcctgctgcgcatcaagaccagcctgctgcacgaggaggtgtccctggtggagaagaagctgtttgagaagaagtacagcgtgaagaggaagaagagccgcagcaagaaggtgcggcggcactag

SEQ ID NO: 17154 - DNA, 1002 bp, Artificial Sequence
  Description of Artificial Sequence: Synthetic coding sequence
atgaagctgtatggccgggaccggggcatctttggaattgaatcctggccagactatgaggacatctacaagaagacagtggaggtgggcaccttcctggacctgccccgcttcccagacatcacagaggactgctacctgcaccccaacatcctgtgcatgaagtacctgatggaggtgaacctgcctgatgagatgcacagcctgacctgccacgtggtgaagatgacaggcatgggagaggtggacttcctgacctttgaccccatcgccaagatggccaagacagtgaagtatgatgtgcaggccgtggccatcatcgtggtggtgctgaagctgctcttcctgctggatgacagctttgagtggagcctgagcaacctggccgagaagcacaatgagaagaacaagaaggacaagccctggtttgacttcaggaagtggtaccagatcatgaagaaggcctttgatgagaagaagcagaagtgggaggaggcccgggccaagtacctgtggaagtctgagaagcccctgtactacagctttgtggacaagcctgtggcctacaagaagcgggagatggtggtgaacctgcagaagcagttcagcaccctggtggagagcacagccacagctgggaagaagagccccagcagcttccagttcaactggacagaggaggacacagacaggacctgcttccacggccacagcctgcagggcgtgctgaaggagaagggccagagcctgctgaccaagaacagcctgtactggctgagcacccagaagttctgccgctgctactgcacccacgtgaccacctatgaggagagcaactacagcctgagctaccagttcatcctgaacctcttctccttcctgctgcgcatcaagaccagcctgctgcacgaggaggtgtccctggtggagaagaagctgtttgagaagaagtacagcgtgaagaggaagaagagccgcagcaagaaggtgagaagacactag

SEQ ID NO: 17155 - DNA, 894 bp, Artificial Sequence
  Description of Artificial Sequence: Synthetic coding sequence
atgagccgcttcaagttcattgatattggcatcaacctgacagaccccatgttccggggcatctaccggggcgtgcagaagcaccaggatgacctgcaggacgtcatcggccgggctgtggagattggagtgaagaagttcatgatcaccggcggcaacctgcaggacagcaaggatgccctgcacctggcccagaccaacggcatgttcttcagcacagtgggctgccaccccacccgctgtggggagtttgagaagaacaacccagacctgtacctgaaggagctgctgaacctggccgagaacaacaagggcaaggtggtggccatcggggagtgtggcctggactttgaccggctgcagttctgccccaaggacacccagctgaagtactttgagaagcagtttgagctgtctgagcagaccaagctgcccatgttcctgcactgcaggaacagccatgctgagttcctggacatcatgaagaggaacagagacagatgtgtgggcggcgtggtgcacagctttgatggcaccaaggaggccgccgccgccctgattgacctggacctgtacatcggcttcaacggctgcagcctgaagacagaggccaacctggaggtgctgaagagcatccccagcgagaagctgatgattgaaacagatgccccctggtgtggggtgaagagcacccatgctggcagcaagtacatcagaacagccttccccaccaagaagaagtgggagagcggccactgcctgaaggacagaaatgagccctgccacatcatccagatcctggagatcatgtctgctgtgagagatgaggaccccctggagctggccaacaccctgtacaacaacaccatcaaggtgttcttccctggcatctag

SEQ ID NO: 17156 - DNA, 753 bp, Artificial Sequence
  Description of Artificial Sequence: Synthetic coding sequence
atgatcactggaggcaacctgcaggacagcaaggatgccctgcacctggcccagaccaacggcatgttcttcagcacagtgggctgccaccccacccgctgtggggagtttgagaagaacaacccagacctgtacctgaaggagctgctgaacctggccgagaacaacaagggcaaggtggtggccatcggagaatgtggcctggactttgaccggctgcagttctgccccaaggacacccagctgaagtactttgagaagcagtttgagctgtctgagcagaccaagctgcccatgttcctgcactgcaggaacagccacgccgagttcctggacatcatgaagaggaacagagacagatgtgtgggcggcgtggtgcacagctttgatggcaccaaggaggccgctgctgccctgattgacctggacctgtacatcggcttcaacggctgcagcctgaagacagaggccaacctggaggtgctgaagagcatccccagcgagaagctgatgattgaaacagatgccccctggtgtggggtgaagagcacccacgccggcagcaagtacatcagaacagccttccccaccaagaagaagtgggagagcggccactgcctgaaggacagaaatgagccctgccacatcatccagatcctggagatcatgtctgctgtgagagatgaggaccccctggagctggccaacaccctgtacaacaacaccatcaaggtgttcttccctggcatctag

SEQ ID NO: 17157 - DNA, 333 bp, Artificial Sequence
  Description of Artificial Sequence: Synthetic coding sequence
atgatcactggaggcaacctgcaggacagcaaggatgccctgcacctggcccagaccaacggcatgttcttcagcacagtgggctgccaccccacccgctgtggggagtttgagaagaacaacccagacctgtacctgaaggagctgctgaacctggccgagaacaacaagggcaaggtggtggccatcggagaatgtggcctggactttgaccggctgcagttctgccccaaggacacccagctgaagtactttgagaagcagtttgagctgtctgagcagaccaagctgcccatgttcctgcactgcaggaacagccacgccgagttctag

SEQ ID NO: 17158 - DNA, 2286 bp, Artificial Sequence
  Description of Artificial Sequence: Synthetic coding sequence
atggccagcgagcggggcaaggtgaagcacaactggagcagcaccagcgagggctgccccaggaagaggagctgcctgcgggagccctgtgatgtggcccccagcagcaggcctgcccagaggtctgccagccgcagcggcggccccagcagccccaagaggctgaaggcccagaaggaggatgatgtggcctgcagccggcggctgtcctggggcagcagcagaagaagaaacaacagcagcagcagcttcagcccccacttcctgggccctggggtgggcggggccgccagcaagggctgcctgatccggaacacccggggcttcctgagcagcggcggcagccccctgcggcctgccaatgccagcctggaggagatggccagcctggaggaggaggcctgcagcctgaaggtggacagcaaggacagcagccacaacagcaccaacagcgagtttgctgctgaggccgagggccagaatgacaccatcgaggagcccaacaaggtgcagaagaggaagagggaccggctgcgggaccagggcagcaccatgatctacctgaaggccatccagggcatcctgggcaagtccatgcccaagaggaaaggagaggccgccacccgggccaagcccagcgctgctgagcaccccagccacggggagggccctgcccggtctgagggccctgccaagacagctgagggcgccgcccggtctgtgacagtgacagctgcccagaaggagaaggatgccaccccagaggtgtccatggaggaggacaagacagtgcctgagaggagcagcttctatgacagaagagtggtgattgacccccaggagaagcccagcgaggagcccctgggggacagaagaacagtgattgacaagtgcagcccccccctggagttcctggatgacagcgacagccacctggagatccagaagcacaaggaccgggaggtggtgatggagcaccccagcagcggcagtgactggagcgatgtggaggagatcagcacagtgcgcttcagccaggaggagcctgtgtccctgaagcccagcgctgtgcctgagcccagcagcttcaccacagattatgtgatgtacccaccccacctgtacagcagcccctggtgtgactatgccagctactggaccagcagccccaagcccagcagctaccccagcacaggcagcagcagcaatgatgctgcccaggtgggcaagagcagccgcagcaggatgtctgactacagccccaacagcacaggctctgtgcagaacaccagccgggacatggaggccagcgaggagggctggagccagaacagccgctccttccgcttcagccgcagcagcgaggagcgggaggtgaaggagaagaggaccttccaggaggagatgccaccccggccctgtggcggccacgccagcagcagcctgcccaagagccacctggagcccagcctggaggagggcttcatcgacacccactgccacctggacatgctgtacagcaagctgtccttccagggcaccttcaccaagttcaggaagatctacagcagcagcttccccaaggagttccagggctgcatcagtgacttctgtgaccccaggaccctgacagactgcctgtgggaggagctgctgaaggaggacctggtgtggggcgccttcggctgccacccccactttgcccgctactacagcgagagccaggagaggaacctgctgcaggccctgcggcaccccaaggctgtggcctttggagagatgggcctggactacagctacaagtgcaccacccctgtgcctgagcagcacaaggtgtttgagcggcagctgcagctggccgtgtccctgaagaagcccctggtgatccactgccgggaggctgatgaggacctgctggagatcatgaagaagtttgtgcccccagactacaagatccaccgccactgcttcaccggcagctaccctgtgattgagcccctgctgaagtacttccccaacatgtctgtgggcttcaccgctgtgctgacctacagcagcgcctgggaggcccgggaggccctgcggcagatccccctggagcgcatcatcgtggagacagatgccccctacttcctgccccggcaggtgcccaagagcctgtgccagtatgcccaccctggcctggccctgcacacagtgcgggagatcgcccgggtgaaggaccagcccctgagcctgaccctggccgccctgcgggagaacaccagccggctgtacagcctgtag

SEQ ID NO: 17159 - DNA, 2286 bp, Artificial Sequence; identical to SEQ ID NO: 17158
  Description of Artificial Sequence: Synthetic coding sequence

SEQ ID NO: 17160 - DNA, 822 bp, Artificial Sequence
  Description of Artificial Sequence: Synthetic coding sequence
atgagagctgctggggtgggcctggtggactgccactgccacctgagcgccccagactttgaccgggacctggatgatgtgctggagaaggccaagaaggccaacgtggtggccctggtggccgtggccgagcacagcggggagtttgagaagatcatgcagctgtctgagcgctacaacggctttgtgctgccctgcctgggcgtgcaccctgtgcagggcctgcccccagaggaccagaggtctgtgaccctgaaggacctggatgtggccctgcccatcatcgagaactacaaggaccggctgctggccatcggggaggtgggcctggacttcagccccaggtttgctggcactggagagcagaaggaggagcagaggcaggtgctgatccggcagatccagctggccaagaggctgaacctgcctgtgaatgtgcacagccgctctgctggccggcccaccatcaacctgctgcaggagcagggcgctgagaaggtgctgctgcacgcctttgatggccggcccagcgtggccatggagggcgtgcgggccggctacttcttcagcatcccccccagcatcatccgcagcggccagcagaagctggtgaagcagctgcccctgaccagcatctgcctggagacagacagccctgccctgggccctgagaagcaggtgagaaatgagccctggaacatcagcatctctgctgagtacatcgcccaggtgaagggcatctctgtggaggaggtgattgaggtgaccacccagaatgccctgaagctgttccccaagctgcggcacctgctgcagaagtag

SEQ ID NO: 17161 - DNA, 825 bp, Artificial Sequence
  Description of Artificial Sequence: Synthetic coding sequence
atgagagctgctggggtgggcctggtggactgccactgccacctgagcgccccagactttgaccgggacctggatgatgtgctggagaaggccaagaaggccaacgtggtggccctggtggccgtggccgagcacagcggggagtttgagaagatcatgcagctgtctgagcgctacaacggctttgtgctgccctgcctgggcgtgcaccctgtgcagggcctgcccccagaggaccagaggtctgtgaccctgaaggacctggatgtggccctgcccatcatcgagaactacaaggaccggctgctggccatcggggaggtgggcctggacttcagccccaggtttgctggcactggagagcagaaggaggagcagaggcaggtgctgatccggcagatccagctggccaagaggctgaacctgcctgtgaatgtgcacagccgctctgctggccggcccaccatcaacctgctgcaggagcagggcgctgagaaggtgctgctgcacgcctttgatggccggcccagcgtggccatggagggcgtgcgggccggctacttcttcagcatcccccccagcatcatccgcagcggccagaagcagaagctggtgaagcagctgcccctgaccagcatctgcctggagacagacagccctgccctgggccctgagaagcaggtgagaaatgagccctggaacatcagcatctctgctgagtacatcgcccaggtgaagggcatctctgtggaggaggtgattgaggtgaccacccagaatgccctgaagctgttccccaagctgcggcacctgctgcagaagtag

SEQ ID NO: 17162 - DNA, 762 bp, Artificial Sequence
  Description of Artificial Sequence: Synthetic coding sequence
atgagagctgctggggtgggcctggtggactgccactgccacctgagcgccccagactttgaccgggacctggatgatgtgctggagaaggccaagaaggccaacgtggtggccctggtggccgtggccgagcacagcggggagtttgagaagatcatgcagctgtctgagcgctacaacggctttgtgctgccctgcctgggcgtgcaccctgtgcagggcctgcccccagaggaccagaggtctgtgaccctgaaggtgggcctggacttcagccccaggtttgctggcaccggggagcagaaggaggagcagaggcaggtgctgatccggcagatccagctggccaagaggctgaacctgcctgtgaatgtgcacagccgctctgctggccggcccaccatcaacctgctgcaggagcagggcgctgagaaggtgctgctgcacgcctttgatggccggcccagcgtggccatggagggcgtgcgggccggctacttcttcagcatccccccatccatcatccgcagcggccagaagcagaagctggtgaagcagctgcccctgaccagcatctgcctggagacagacagccctgccctgggccctgagaagcaggtgagaaatgagccctggaacatcagcatctctgctgagtacatcgcccaggtgaagggcatctctgtggaggaggtgattgaggtgaccacccagaatgccctgaagctgttccccaagctgcggcacctgctgcagaagtag

SEQ ID NO: 17163 - DNA, 723 bp, Artificial Sequence
  Description of Artificial Sequence: Synthetic coding sequence
atgagagctgctggggtgggcctggtggactgccactgccacctgagcgccccagactttgaccgggacctggatgatgtgctggagaaggccaagaaggccaacgtggtggccctggtggccgtggccgagcacagcggggagtttgagaagatcatgcagctgtctgagcgctacaacggctttgtgctgccctgcctgggcgtgcaccctgtgcagggcctgcccccagaggaccagaggtctgtgaccctgaaggacctggatgtggccctgcccatcatcgagaactacaaggaccggctgctggccatcggggaggtgggcctggacttcagccccaggtttgctggcactggagagcagaaggaggagcagaggcaggtgctgatccggcagatccagctggccaagaggctgaacctgcctgtgaatgtgcacagccgctctgctggccggcccaccatcaacctgctgcaggagcagggcgctgagaaggtgctgctgcacgcctttgatggccggcccagcgtggccatggagggcgtgcgggccggctacttcttcagcatcccccccagcatcatccgcagcggccagctgctgagcctcttcagcaagaagcagaagctggtgaagcagctgcccctgaccagcatctgcctggagacagacagccctgccctgggccctgagaagcagcagaacatcctgcccaggtag

SEQ ID NO: 17164 - DNA, 846 bp, Artificial Sequence
  Description of Artificial Sequence: Synthetic coding sequence
atgagagctgctggggtgggcctggtggactgccactgccacctgagcgccccagactttgaccgggacctggatgatgtgctggagaaggccaagaaggccaacgtggtggccctggtggccgtggccgagcacagcggggagtttgagaagatcatgcagctgtctgagcgctacaacggctttgtgctgccctgcctgggcgtgcaccctgtgcagggcctgcccccagaggaccagaggtctgtgaccctgaaggacctggatgtggccctgcccatcatcgagaactacaaggaccggctgctggccatcggggaggtgggcctggacttcagccccaggtttgctggcactggagagcagaaggaggagcagaggcaggtgctgatccggcagatccagctggccaagaggctgaacctgcctgtgaatgtgcacagccgctctgctggccggcccaccatcaacctgctgcaggagcagggcgctgagaaggtgctgctgcacgcctttgatggccggcccagcgtggccatggagggcgtgcgggccggctacttcttcagcatcccccccagcatcatccgcagcggccagctgctgagcctcttcagcaagaagcagaagctggtgaagcagctgcccctgaccagcatctgcctggagacagacagccctgccctgggccctgagaagcaggtgagaaatgagccctggaacatcagcatctctgctgagtacatcgcccaggtgaagggcatctctgtggaggaggtgattgaggtgaccacccagaatgccctgaagctgttccccaagctgcggcacctgctgcagaagtag

SEQ ID NO: 17165 - DNA, 1824 bp, Artificial Sequence
  Description of Artificial Sequence: Synthetic coding sequence
atggccgagaagagaagaggcagcccctgcagcatgctgagcctgaaggcccacgccttctctgtggaggccctgattggagctgagaagcagcagcagctgcagaagaagaggaggaagctgggcgctgaggaggccgccggggctgtggatgatggcggctgcagccggggcggcggggccggggagaagggcagcagtgaaggagatgagggcgccgccctgcccccacctgctggggccaccagcggccctgcccggagcggggctgacctggagagaggagctgctgggggctgtgaagatggcttccagcagggcgccagccccctggccagccctgggggcagccccaagggcagccctgcccggagcctggcccggcccggcacccccctgcccagcccccaggccccccgggtggacctgcagggcgctgagctgtggaagcgcttccatgaaattggaacagagatgatcatcaccaaggccggccgcaggatgtttcctgccatgagggtgaagatcagcggcctggacccccaccagcagtactacatcgccatggacatcgtgcctgtggacaacaagcgctaccgctacgtgtaccacagcagcaagtggatggtggccggaaatgctgacagccctgtgcccccccgggtgtacatccacccagacagccctgccagcggggagacctggatgaggcaggtgatcagctttgacaagctgaagctgaccaacaatgagctggatgaccagggccacatcatcctgcacagcatgcacaagtaccagccccgggtgcacgtgatcaggaaggactgtggagatgacctgagccccatcaagcctgtgcccagcggggagggcgtgaaggccttctccttccctgagaccgtcttcaccaccgtgacagcctaccagaaccagcagatcacccggctgaagattgacaggaacccctttgccaagggcttccgggacagcggcaggaacaggatgggcctggaggccctggtggagagctatgccttctggaggcccagcctgcggaccctgacctttgaggacatccctggcatccccaagcagggcaatgccagcagcagcaccctgctgcagggcactggaaatggagtgcctgccacccacccccacctgctgagcggcagcagctgcagcagccctgccttccacctgggccccaacaccagccagctgtgcagcctggccccagctgactacagcgcctgtgcccggagcggcctgaccctgaaccgctacagcaccagcctggccgagacctacaaccggctgaccaaccaggccggggagacctttgccccacccaggacccccagctatgtgggcgtgagcagcagcacctctgtgaacatgtccatgggcggcacagatggagacaccttcagctgcccccagaccagcctgtccatgcagatcagcggcatgagcccccagctgcagtacatcatgcccagccccagcagcaatgcctttgccaccaaccagacccaccagggcagctacaacaccttccggctgcacagcccctgtgccctgtatggctacaacttcagcaccagccccaagctggccgccagccctgagaagatcgtgagcagccagggcagcttcctgggcagcagccccagcggcaccatgacagaccggcagatgctgccccctgtggagggcgtgcacctgctgagcagcggcggccagcagagcttctttgacagcaggaccctgggcagcctgaccctgagcagcagccaggtgtctgcccacatggtgtag
